United States Patent 9,567,581 (SELECTIVE REACTIVATION OF GENES ON THE INACTIVE X CHROMOSOME) - sequence listing, part 22

SEQ ID NO: 3102 - DNA, 26064 bp, human
gtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcggtgagtcataggggcagtggaatcagccctggggaggttggctaatgtgcttaggagaggagggttgggcagtttcagtggctctgtgtgaggtgtccatggggctgttactgggcagatgtccacagctcactggtatatattctttacacagctgttcaaaaatgtgtatacttctttctgcagaatcctacagacaagacaaattcaattgtcacaaattattctccagtgaaaatttcagctcccaggaatcattctttgtgggtcaaatgcattatttattaaattggaggtttgaaagttacttataaataggaaaatttttaatgctaaaactttttaatttgtaagtcttaggtgtttggcatttaggtggggcagggtttataaagatgttcaaacattgagcactgattgagtcactttcaaaagagacaaaagagactttgttttacttaaaacattggagaatcatcttacaggtattgttctcatctgtcaagtggtgtctgtgctaatgtacagaatcccacaaatacacacttcggtgagcattcagcaggtgcctgttggctgaaaggattctgaaaaatgggtttaggcatttgcacacaggttcttataaataatagtatattggttagtaatatactggttaactctccagccccaagtctgcaaacttgctgatgtcacgtcctttcccaaactgagaccaatcagtgaggaaaccttggagtttatcgggaaggaaactcaaagttcgtaactttcggagagcaaagggagcagcagggtgagggtgaaggcaacagctcactttctgcaactgttgttcaccctgttgagatccttgggggcttgtgacggagacaagccccagcacccagagctgggaaagctggtgttgcagcagccctgctgaattgctgtatttattatttattaatttttttttctttttgagacggagtcttgctctgtggcccaggctggagtgcagtggcgcgatctcgactcactgcaacctccgcctcccgggttcaggcctgtatatataggcggggcacggtggtttacgcctgtaatcccagtactttcggaggccgaggcgggcagatcacgatgtcaggataccatcctggccaacatgatgaaattccgtcgctacctaaaatacaaaaattagctgggtgtgatggcacgtgcctgtaatcccagctactcgggaggctgaggcaggagaatcacttgaacccgggaggcggaggttgcagtgcacctagatctcgccacagcactccagcctggcgacagagtgagactccgtatcaaagaaaaaagaaaaaaatatatacctggtatactgtccacagcacctgttgatcaaaggggcaataaacagggaccctgaagtcagggtgttttgttttgttttgtttttttgagacggagtctcattctgtcgcctgggctggagtgcaatggcgagatctccgctcactgcaacctctgcctcccgggttcaagagattctcctgcctcagcctcccgagtagctgggattataagcgcccgccaccacacccggctaatttttgtatttttagtagagacggggtttcaccacgttggccaggctggtctagaactcctgacctcaggtgatctgcccgcctgggcctcccaaagtgctgggattacaggtgtgagccaccacgcccggccgtcagtcagggtttattaatctactatacaggtaccaaaaaggtaaaaatggaagaaataaaacacaaaacgtcttccctttgactgagtagactagcctgctcattcattcattcatttatccaatttcacttataaaatgagcagagtactcaatggtgagtgggatttagatccacaaaggcagaactggattaatcagcagatgtattgagcatgagtttggagaactaggaaagcaagagtggcatcaaaaatcacttttcacaaagaatttctttttttttttttttttttgttttttttgaagtggagtttcactctgtcacccaggctggaatgcagtggagcaatctcagctcactgcaaactccaccttcccgtgttcaagcgactttcctgcctcagcctcctgagtagctgggattacaggcgtccgccaccacacccagctgatttttgtatttttagtagagacggggtttcaccatgttagccaggatggtctcaatctcctgacctcgtgatccgcccgccttggcctcccaaagtgctgggattacaggcgtgagccaccacgcccggccactttttacaaggaattatatatataattatatatatatatatattttttttttagatggagtctcgctctgttaccaggctggagtgcagtggcaccatctcggctcactgcaacctcggcctcctgggttcaagcaattctgcctcaggagggagaggcagggactaggtgggactacaggcacacgcctggctaattttttggggtgttttttttttgtattttagtagagacggggtttcaccatgttgccccaggctggtctccaactcctgagctcagggaagtctgcccgcctcggcctcccaaagtgctaggattacaggtgtgagccactgtgcccggccgataaatatatttttaaaacagcaaaccaatcattatgggaaagaatcggtaatttggttgacttctgcacggttattttatagctaagtattgtatttatttttgtttccacatgggagagaggcaccagccacttttcactgttagggtttctttttcttttttttttttttttttgagatggagtctcgctctgtcgcccaggctggagtgcagtggcacaatcttggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcaatctcctgacctcgtgatccacccaccttggcctcccaaagtgctgggattacaggcgtgagccaactgttcaggatttctaaagttcctaatacaaccctggtggggtcagggtgggtgagtgggagtgggcaggtgttatacgcaaaggcatggtgcttgtaaagtcaacaagtttttacagctagagtgcaaaatgtgaatgtcttagggagtctagtgagaacaagtttgaagagatggagtggcagataaagcttgaagagctaagtggaggaggtcaggcttcatgaggcaggaaattgagagccattggtggttctagaacagagacctggtaataaggctgtaggtcaattaacatggtagccacagctgggatagattgtgttggaatcgtgggagatggttgcattcatccagtggttctcaaattctcatgtgcctctacatcacctggagagcttattgaaatacagataatgcagcttctggctgggcacggtggctcacgcctgtaatcccagcactttgggaggctgaggtgggcggatcacttgaggtcaggagttccagaccagcctatccaacatggtgaaaccccatctctactaaaaatacaaacatttgactgggtgcagtgcctcacacctgtaatcccagcactttgggaggccgaggcaggcggatcacctgaggttgggagttccagaccagcctgaccaacatggagaaacccagtctttactaaaaatacaaaattagccgggcatggtggtgcatgcctgtaatcccagctacccgggaggctgaggcaggaaagtcgcttgaacccgggaggcagaggttgtggtgagccgagatcacaccactgcactccaacctgggcaacaagagtgaaactctgtctcaaaaaaaaaaaaaaaaattagctgggtgtgttggcacatgcctgtagtcccagctacttaggaggccgaggcaggagaattgcttgaacttgggagggcggaggttgcagtgagctgagatcatgccactgtactccagcctgggcaacagagcgagactctgtctcaaaaaaaaaaaatgcagatgatgcagcttttgatgaagtcgtaggcctggggtgggggcctaggaatctgcattcataacaaactcccaggtgaaatggatggtactggtcagggaccatactttgaaaactactgcactaatccaaccatgaaacttacatttggatcgaactttggaaatgacagagaaagggcgatgatttcaaaggaaagataaatcagcgtatgttgcttgattaaatgttggaactaacagaaggcaggcaaaattataaggttctcaagcccaaagtaatgtcagataagctagataagagggaagttggaaaggaagttgccttggatgcaggatgaggaggggaggatacagagttctgttttggacatgatagtgctaacaatgatgcccagtgcacagtatgatgacatgggactgagacttaggaacgatcacaggttagaagccagatacctcagaatgtcctacagaggggctgtggttgaaacctagggaagggagaaattgtccaatggctaagagctgagagtcaaccaaggatggaaccctgggacaggcctccagttgatgaagtaggaccagtaagttggacagagaagcagaaagagattctggatgttgtaattacacaggtgctaagggaagagaagttttcaaagaagtagaagtcacaagggtaggtgcctggatacttctggtttcttacctcctgttgtgaatctgactggcaaattgctactcaccttctacacccagctgagccattgcccccatgaagccctcctagactttccacctctccctactcaagtggagtcattctccgtctgctttgcatcagtcctgccccttgggtaaaacctcaattgtagttggttgcttttgtttatgcttctgaggtcttaaccttggtgaagtgtggaatggggaacactcagaatgctgttttcaaatagctgtgccaagaaactcagctcaggtgaagcttgtccctttgcacaaggccaagttagaggggaaaatagggcccaggtgtggatcatcttgctgctcccacctccacctgcaggcgtttttctgcccacttccctgggggtagggagggaggaaaggctataaaaatgggcaaccaactctttatagagatttgtttcatgttagactctcctgtccaaggagcagggaaagaatgtcttaattttttcctgaaagtagcttgttacgagttaaattgtgtaccctgaaaatatatatggttaagttcttaacccccgtgcctcagaatgtgaccttattagttaagattagttcaggtgaggtcgtaagtagggtaggatggaccttaatccaacatgaccagagtccctataagaaaaggagaaggagacacatggagaatgctatgtgacaacagaggcagagataggagtgacacatctagaaaccaaggaacaccaaggactgatggccactgccagaagctagaagaggcaaggaaggatttttccctagagcctttggatagagtatggccctgtccacaccttgatttcagacttctagccaactgctagcctctaggactcggcgacaacaaatttctgttgttttaagccacccagtttgtggtgtttcgttatggtatccctaggaggctaatttatacctactcatagaaacttaggaaaatacattgaaggataaactaaccacccataattccaccaagcaggtaatcactgttcccagtgttagtgtctatcttttggggttttgcctgaagactgacaactgtagagatatttctatccttgcaaaattgagcccaccctgtagagagtattcacatttaaacagaagacaagctagaacaggtattgaaagaaaacaattttattgtcttatggtgaatttttagatattggggcacctcaggaggggtgagttttctgggggaaaacctgcctgttgagacagaatgggtgataatgtgagggccctttggagaaggcagctttatattgagagagagagagagagagagaagagagagggagacaggaaagagaagagagagaagagagagaagaaagaggagaggagaggctggatgatggaactggagaaagaactgcagtggacaggcctgacttgcccaagagttgcctcagtgggcctttctgtttgtttctgactgtaagcctcttgtttctttttctcctctttctgtttgtcctgggatcaaaccaaggtccacaataattgtgaatacagcacccagatactttccaggttctggcaggttggttcatgccactgaatccacccttattgtgtcctgaagactgaaggcaaatactcctgtcccctcagagcaacccgacttcttttttgtctccttgactttgcaaaacgtttctcaggatgagtagatttatgctaccgcccagcattcactggggttctcagaacatcagtaatagctattttcagcatgtagcaattagtgcatcttaaatctcttttgaaataatggaaatgaaaaaaatgttccacaaattacaataaaaatgaaatggcagcctccctaatgtgctccaggtttgatgagggtacaatttaaaagaaagataagttcttgctaatacacacacacatacacacaatctatgctctctgaatgttagaaaaatgttaaactaggccaggcgcagtggctcatgcctataatcccagcactttgggaggctgaggcgcatggatcacttgaggtcaggagttggagaccagcctggccaacatggtgaaatcctgtctctactaaagttacaaaaattaactgagtgtgatggtgtgcacctgtagtcccagttacttgagaggctgaggcaggagaaccacttgaacccaggaggtggaggttgcagtgagccaagattgccccactgtactccagcctgggtgacagaatgagactccgtctcaaaaaaccaacagaacattacacacaaagaaaaatgttaaattattaattgtcactactgtaaattttcacataatcactcatttgttctgatacctgctgaggtcaaagtccttgtataaatttgagatggattttagttttacagggactcacgtttttcttctgggcaggagcataggcatactgtgacaggcttaacaaaccctgaactgaaatgactttatgttagaaggggaagcctcatatcctgctgatgggaacatacagtagggcagccactttggaaaacagtctcaaaataaacattgtgttaccatatcatacagcaattcttttaggtgcatattcaggagaattgaaaacatatatctgctcaaaaacttgtatatgaatgtttatagcagcattattcataataggcaagaagtagaaatgacacaaatttttatcagctgatgaatgaatacataaaatgtggcttatccatacaatggaattatttggccaaaaaaaaaaaaaaaaggaatgaagtactgatgcacgctacaacatggatgaaactttgaaacatgctaaataaaagaagccagttgcaaagtaccacatactgtatggtttcatttatatgaaatgtccagaataggcaaatccatagagacagaaagtagatccatggctgccaggggctgagggaagtagaactgtggagtgactgctaatgggcacagagtttctttttggggtgatgaaaatgttctaaaattgattgtggtgttggttgcatagctctgaatatactgaaaactgctgaattgtacacattaaatgggtgtattgtatggtatgtgaattatatctcaatacagctgcttgctagctagctagctagagatattcacattgtcagcccctcactacgtgtaccaggacaacactctgtacttctcaaagacacaagctgtctctgctctgtaaacactacattctgcagaggtgcaaattcagatagccttgttattctcttggagaagtacgtacttctttatttgccccaaatagaaagagtaatggtcccatgatgaatgagcagaaagtaagaccatttgtggctacacttgataaatgcgtcatttttatgaaatctggacagttacaaattaggatgcaatctacctgcctggactgtttagcctgtcgacaataataatcttagggagctctaagagaggttggggaatgtggcagctgtatttcttagcagctgagcacttggaaaaaaaagtggattaatcatcatacatatggtgatccatcaagatacatttgcaaatctattgaaaactgattttcaaaacctttctcaatttgtggctctttgttctcattcaagattttgtgtgaatggtatttggcattatcagcaccaacagggtggaattagttgtccttttaattctaatttggagatcaatctttccatgtctgcagtccgaattttagcttccaagccctagaatcagcagtattattccagaaataattaggagcctcagagaatgccgtgaggacattgagtatctattaagcgtgaggttttgacggtacgaaaagccatttcacttaagatgtaccttgtctcaagcacctttagtgaccccagaaggaaagcattggatgggcggtatgtagatgggctcatttgtcttccttttatgtactaaatgcttaatgaatccatctggaagaatggtaatttgcttactaatacagattttccagggcactgatggcttcaggtggcagacagacgggcctcatgtgttaagtacaaagtgttaagccaacatgtgttaaatacaaaggatacttcatagcctttcagtttgcaaggtatagatagttaagtatcctccttctccaggtcttctcagtttttaggagctattagcttccgtgcaaggcataactggcaccagacctttctaccttgtttgtatgtagtgtgtttggcgaagcaggtggagctggagctgaagcaggttcaggcacgcctccctcacatttctactggaaatcagatgaagcttgagatgagaaaaaaatcagatctatgcctcattcagttatattcaattaagagagaggaaagcatttaatgggttgggattgggttttcaggcttctttcctaagaatttgttttccttctatgtggttgtagaataaatttgctattttattttatttttttgagacagagtctcactgtgtcacccaggctggagtgcagtggcatgatctcggctcactgcaacctccgcctcccgggttcaaccgattctcccgcctcagcctcccgactagctgggattataggcgtgagccaccacacccagctaatttttacatttttactagagatggtgtttcaccatgttgcaaggctggtctcgaactcctgacctcaggtgatctgcccacctcggcctctcaaagtgctgggattgcaggtgtgagccaccacgcctggtgtaaatttgctattttaaatagcaatgatgatgaggtataattaagactctctgtttagtgttagggcaggataataatagtagctagtatgtgttgagccatggtaagtacaggttgagcatcccgtctctgaaatccttgggaccagaagtgtttccagttttttcagatgttggaatatttgcatatacataatgacttatcttgtggatggtactcaagtctaaacacgaaatgcatttatgttttatatacaccttacacacataacctgagataattttatataatattttaaataagtttgtgcatgaaacaacgttttgactgcaacccatcacatgtcagatgtggaattttccacttgtggcatcatgttagcactcaagaagctttggattttggagcattttggatttgggagttttgggttaaggatgctcaacctgtatgttatatattagggctgctcaacttgtaactttacagagaaggaaactgcggcactgggcctttcccgggacccacaggtcagaaaaggtgaagcgggtctgaattaagagctttctttaaccaccttggcatgctgcctttgagggtaaataatgtccctgtttcaaggtgagactgaacactgatttgtgcttaatattaggacaggagataatctataaatagatatggttctgtttagatttgattccaaacctaatggtgtatgtaattacatgattactactattaatacagaacactgtttggtgagatgccaaagtctgtatttcatgcaggaaactagactgacagctacagcttaacacactaatgttggtaattagtgaagctctcgcttaactaaatgggccatttgcctttgaaaccagtgtgtaaatagaaatagagtaatctgtcatcccaatccacctcttttgtccttagtttgaggactggctgtagttctttcccaagctatccagacatttcaaacaaactgtgcacaaaaaatattaataaagaagagaaatgctgaattcctgatgggaattttggttgagtgaatccaatgtctccctccatccagggcctgttaggctcttattgatgggcaaggataagcctctgggtctaagtgcattagcaggatataacccattcccctctttccatacagatgctgtgtctgattggtctcctatgcatgaagctgcaatccacggacatcagctgtctctgaggaacctcatcagccaggtagctttttgaaaatacaatacagaagaaacctatcaaaatattaaaacaaatgtgtgacataataacatagggacttttaaattaattcattaaatagaagacctagtggtgattctagtaactaccataacgtctaaataggatgagtatagattttgagatattttagatgtctacagcaattgtaatacaatagaaaatatctgtaatttctattggagataaccctacataatactattactactgtggtttgttgtctacattctgaactgaaggaaatgctaaatttcagatagagctgagtgagaataaatgtgctttaaaaaatccaatttcatagacctatctagagtaagaagtcctcctataagaaaataatttctaaagaaaaatttcatactatcctaagccactatcttaagccatttttggtagcagcagtctattataaatagattataacactaattctagctaaaagaagttaggctacttctcagataaaattagaaatttaccctattttgatagcatgaaaaatgatcactgcagcttttatatatcacttcttaaattggacagatactcatttacattcagtatttatgtgtttatgaaacatcagccagaaccatatctccaagttctatcacattatttgtgtaagatgtctttttagagccccggtttctgctttcataaaatgagtattctaatacctacctaggtcagtccaccccataactcaataacaaaccatcccaaaactcagtgacatgatacagtaaccattatttcttgctgatgtgtgtttgtgtcagttcatctaggctgggcttggctgggcttggctcccagctgtgggttgggtgtagccctgctgcacatctctttcatcctgcttggaccactggctacctgaggaattattttttcttggcaaaacgctggagcacagcaggacaagccccaccatgcaagaatacttccaatctgttcatgtcacatctgctaacatcccactggtcaagtcacatgaccacatccaaagtcaaggctcaagagaagtacattttgtcaactaagcgtagttgacgactgaaaatagatatattaaagttaagccattcaatctttttttaaaaactaagaactgactgtggactgaacactgtgaagtaatgggttaattaccttatgattttatatgactcagacttgttaataatttagacaaatcacagttaatttaaggtagaactgtagcttgatgatgaactacaaatgagtttctaactttacagaaggaacctctctgcaatgtgaatatgtggtgaaaactttttgtgttacgaatagctgtgttgttgtatttcatttacgtggatttatgtataaacacctaaatgctggttttatttttatcattattattattattattattatttttttgagatggagtttcactcttgttgccatctggagtgcagtggcgcgatctcggctcactgcaacctccgcctcctgggttgaagcaattctgcctcagcctcccgagtagctgggactacaggcatgtgccaccacgccccgctaattttatatttttagtagagacgaggtttcaccatgttggtcaggctggtctcaaactgctgacctcagataatccatcagccttagcctcccaaagtgctgggattataggcatgagccaccgtgcctggtctaaatgccggttttacaatggcagttgtgcctggaggagtatgcacattttcctattggttgtttttatggttgccttttgcccaagttctgtacctcggcctgccttcccccaacttgtgtctgatacacttgcatgatttttgcttcatgtgacaatcatacccctcttgtggcattgacaaagctactttctataagtgtgatgactgtgagaaaataagatattttctcctgccaattggacatttaagtcttaggtatgaatagtaaagtaagaaatgacatattcttttctttgatcacgacaaaagttggcacatttttttctttctttttttttttttttttttgagacggagtcttgctgtcgcccaggctggagtgcagtggcgccatctcggctcactgcaggctccgccccctggggttcacgccattctcctgcctcagcctcccgagtagctgggactacaggtgtcccccacctcgcccggctaattttttgtatttttagtagagatggggtttcaccgtgttagccaggatggtctcgatctcctgacctcgtgatccgcctgcctcggcctcccaaagtgctgggattacaggcgtgagccactgcacccggccaagagttggcaaatttttttcagtaaaggaccagatagtaaatattttaggctgggaggctgaggcaggagagtggcgtgaacccaggaggtggagcttgcagtgacccgagatcgcgccactgcactccagcctcggcgacagagcaagacatcgtctcaaaaaaaaaaaaaaaaaaaaaaaagaatcttaggccttgcgaaccatgcagtctctgttggaagtacctaactctgctgtttagcagaaaagcagttgtagacaatatgtaaatgaatgggcatggctgtgttctgataaaactttgcttatggatgctgaaatttgaatttcataaaattttcacgtgtcacaaaatattcctttgatttcttttaaaccattaaaaatgtagaaaccattcctagctacagaagcaggtgtaggctagatttgactctgtaggctactgtttgttgacccccttgtcaaaactatgatagagctaggaaatctaagaaaaacaattaaatgtcaggaaaaggagggtttttttgagaaaaaaaattgggtgaaactgatatttttattacaaatattattaaatcctgtgtgttactaaatacttatgtttaaagagcaattatattagttaataggtacatttcaatttcctaaaataagaaagtacatttaggcttcctaaaaggtacatgcagcagtctatttcttttccctcgcagtttgaaaatttccttttaattgtctcacaaggtagagccacttgtgaatatgttaaaacttaataattgcttgttaaaacttagcaatttgggccacgctgactttaaaaaaattgagaaatttcataagcatgaaagaacttaaacacgtgtgcagttgaataaaaagtgatgatgatgagaatattgccatgtgactgcctccccaggtcaggaaatggaaaaatagcacaatgctggctcctccaaagactcacccatccctccccttattgtgctttctagaacacaatcctgtccctcttccacaggagtaaccattatcccgatttccttgttttctttatggttttactctatatattatgtcttctgaaacaatatggggtagttttgcctaattttgaactttaaattgatgtaatcattcagtgtgtatgcttttggattttgcttcttttgctcaacattatttttgcaagcatcacccttgtagtgcttgccattatgatttgttgggtgtaatctttctgctgaaagattataccaaagttaattaattcagtccattgttgatggacatttggtttgtttgcagtttttgactattatgaccaatgctgttgtgaatattcttgtatatttatctagatgtatatatacctaagagtcaaattgctgagtcataggcatatgcattgtcagctctaatagatacagtcaaactgttttcctgagtggttataccataccacactcccaccagtagtgtggcatttttttttttttaaagtcaatataaacaccttagtgtaacatctgactttgagccaggtcagctttgtcatagtactggaatggtggctgaaaagcagccccagggcactgttgctttgcaccccttactctgactgtttcccctccttcaggggtgggctgtgaacatcatcacggcagatcatgtttccccactccatgaagcctgtcttggaggtcatctctcttgtgtgaagattttattaaagcatggagctcaggtaagggcagctgaaacaacatcttagaaaccaagaatgaaaaatgactatgtatatcccttctgaataacttccagcacttttgattagactgatttgaaatatgaagacagttgtttttcaagaaaattatgttcatcaggcttgtttgctttagtgatggatggatgaaatactaaatttttagtcacgcttacagtctatatcattttctttatcatacactactaataaatagttattagacttctgtcttcattgttatggccggaaggtaatgaaatattgtggaaagcacacatttgcctgggatggctaggatgtctgaggagacagaaaatctatgtggtcattcatcctttagctggcaacctggacttgttcacatggtagcagggattgcaagagcagcaaaaatggacctgttttgtgttaggcaactgaatggtgggttggggaaaattatgggcttgctatcttctggcaacagcaaatgcaaagtcccagaaatgatagtgagcaatttttatatcttgaagtcattccttacggcaggacagtagagtaggtgagagggttcagaacataagcaaccttgtccatgccaaaaaaagaatgggctttgtcctgagatcagtaaagagccagaggtgagtgcactgccagatttatatttgggttaagaaaacattcaaaacttggaaacagggaacgtgtcaaggtgaagcaagagacacctagggtacaaacttgaaagaagtgctcgctctcagggtcctgcactatttgtgtgactccaaaaatgaatatgtccttaaattttttaccctgggcaacttttatgtctcactctggtcctggccctgcttggaagtagagtttgagaaggaattcgttgtcttcacaatatcattgcttaaaagattcaccagataatcatttaatgatatacaagaatgtgtctgcacttggcttttctattcactatttaattatagcccaaacactgtgaagttagacattaacttcgaaatttctgtctgatttccaacattagaaaagatagcctcaaagattatacttttatggccctataggacattaaccagtttttatgtttttatttttttaatttttgagatggagtctcgctctgtcgcccaggctggagtacagtggcacgaactcagctccctgcaacctccgcctcctgggttcgagtgatactcctgcctcagcctcctgagtagctgggattataggcacgcaccaccacacttggctcatttttgtatttttagtagagatggggtttcatcatgttatcatgttgcccaggttggtctcgaacttccgacctcaggtgacccgcccaccttggtctcccaaagtgctgggattacaggtgtgagccaccgtgcccggcggagttttgtatctattagcaaatatatttcagcagtccattgactatatacgtttttcttttttctttctttttttgagacagagtctcactctgtcgcccaggctggagtgcagtggcgtgatctcggttcactgcaacctctgcctcccgggttcaagtaattctcctgcctcagcctcccgagtagctgggactacaggcgcatgctaccatgctgggctaattttttgtatcttagtagagaccgggtttcaccatgttgcccaggctggtctcgaactcctgagctcaggcaatccgcctgcctcggcctcccaaagtgctgggattataggcgtgagccactgcgcctggccaaatgtttttttgagccagccttaccatcttactggttccctcattaatgagtgagttgaataaaatcttgggtatgtgttaattctatatttgtatgaaagtcaagttttttaaagttttctaaattatactttaagaatatactaaattacacagctaataatttcaacaatttcctcacagcagcaagagtaatcttcttgcacccgttaagaaattgaattggtgtgggatgggtctaggaaagaagtttaaaatagggattagtttgtaagcgattgaaattatcctaactagtttcaaagttcatgttcctggggagggcatggaggagatagaacattgagtaacattttcgatgctttatagccactccctaattccatttttcacaaaaacctgtggaatttcgtagttatttctccattttatagctgaggaatttaaggctcagagatgttaaataacatcttcagagtggtggaccccacatttgaacccaaaacatcccccttcctgtcttcattctggagcttcttttaccaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggtaaatctgttgagaatttttttttctacccactccttcaagggacatcttactgctgaaagaaagaaagaaaaggagatatattttagagcagtagttctcaaaatggagtcccaggactggaagcatcagcatgacctggcctgcaaatgcagattcttcggcctcactccagccccattgaatcagtaactggggatggggctcagccctctgtattttgtttaataagccctccagctgctttctggtacacagtaagtttgagtgcctcccttttagagcattttgaatgtttttcactgctgtattactgaaacagggcttggcacatagtagactatccatcaatatttgtggaatccgttgttatacccgtgaccttatagaaatcaagttatttcataaaacaaattatattcttctatttcagggccttaaagaacattgtctcagtgacacttaagtttgccaaatgaaataagctttcaatttttgaaagtatttgatgttgcatacagtttgggataattcttttcattaaagccataatttttctgatagtcttagctcataaaatcacaagtttttattttctccaatatttagcatcatcgtaatgaccataccttgccagagggctttctgtttctccagtggctttcatagaatggcttcccatttgactggaccaacccactcataatgatctcccaaagcattaatattatttattgagaacatcttaactcatcatattcgctgcatacatagaactaaaatacagcaagagaaacgtagaggagcaatgtcaaaaatatgacatcctggaccaaggaagtgtgattcagctttcacctagtttttcagattgggccctgctcatgttggatttggcagtttcttctaagcattgcctatacccgctgtggcctgttcctcccgggcctgcctttggagaggttgtaagtttccttccctgtcccgtggcccacactgtgccctttattcttcagttccaccttcaggtcctgttcctccatatctctcccaagctctcacttcaatttctgtacttagacaaactacaaagccacagacaattgaaaaaggtggatagttgctggttggttaccgtggctagtaaactcaaatggagtttcacccgtagttgcagattgcatcctatggtcaaaccattaactgatagcagtggttaaaatcactcctgatttggccgggcctggtctcacgcctgtaatcccagcattttgggaggctgaggcgggcggaccacgaggtcaggagattgagaccatcctggctaacacggtgaaaccccatctctactaaaaatacaaaaaagttagcagggtgtggtggcgggcgcctgtagtaccagctactcggaggctgaggcaggagaatggcgtgaacccaggaggcggagcttgcagtaagccgagattgcgccactgcactccagcctgggggacagagcgagactccgtttctaaaataaaataaaatgaaataaaataaaatcactcctgattctaattgaaggaaatagctttttggtcccctggataagctgctgccaaatttaatgcaaaatggggatggcaatgtctttctagctaagggaacttgtattgtaactgtttttcttcctgctttgggctgcaggccacgtggagtgtgtcaactctcttatagcttatgggggcaacattgaccataagatcagccacctgggcactccactctatttggcttgtgaaaaccaacagagagcctgtgtcaagaagcttctggagtcaggtaaagcaaaaagcaaaccaaaacaagaaaagaaaacgaaaagtaaattaaatgtattttaaacatcttactgctgtaggagagaaattagtgtgggcaatggagttggacaaggtcagggttcatattgactgtgttcccttggggaattatttcacactgtttgaactgtagttctctcatttgtaacaaggatgaggaggaggaggaggaggaggaggatgatgatgatgatgatgcctcttctcagggtggtcctcaatgattattagtttctcctccctttcctctgtctccctccatttggccagtcacattattaagccctgcataacttgcaaagctgttggattagtgttgaatcttcctatttgggaccttaaccagttctctttgattagatattgaacttgccccattgcaaatattatattttccttgaaaaggcctatgtacccttatttcttttcacctccctgctgttgtccagcccccttctcaacacctggaacaccatttcatcacctctttaattatctgagtcctatttattctttaaggcttcagtaatctgtttcccaatgaatgttgttgcagtccttattgcctcctactcatctggcaggcattgctatgaattaagagatgcaatctctgtctctcccccactgcccaccccacctctgccactctgggcagattttaagcctctagcctggaaagggccatgtttgatatccctcacaaagtcaggaacaatacaagaccagatcagttaacatttgttgagtggacatagattttcattttaccagagggatggcagctcaggcaaagccacatgttcccacatgtcacagtgaaagctaggctctgggctggggtggggatttgttaagagtgtaagagtggaattgggtggggacagtcctagaaatccaccttactcctgaaagggagaactttgccaccttccctgtgatcttgggattggccagtccaatccaggggatacccccatgagttggttggttgcttttcaaagtccaaatcaccagtcccaagtgtccagttttacaccctgtggcagctgcacaccaggtgagtttggctgcttggtgtaggctggatttcaccatctagtctctccgtcaggctgtactggctaatacttaggttccattaataataatgtggagcttttatgtcactaggatttttcttatatgcatcatgcctatctatgtacagtgctgaaaggcaaatttttaactttctatgctatattcctcatgctgtacattcaataacattatcaggtgggattttccccacattattaaatggaatcacatcatctcccatttttccaggattgctgtgctcaatatggatcccctcttgttaggaaattttggggctcggggctttgaaaagccccgatggttggattctgctccttgctgactcttttttgttctcgtgactgtttaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaaggcaggtatttggcaatttctggctcccattcctataaaaagatcattctctgacatcaccaaatctgggaagttgagataattcaatattcaatgagatacagtactggtcacagtacagtaaataactgtcctgctatttagcatattggatacaggtttttgggatgatctaatattcattatggggtaggccagttttttaaaaattaagatactgttttaaaattttagtattacatttatttaaaacatgctttagaatgaggcagcagagtcctctttggggttgtaagaggccgcaggatatcttgttgaaccacagatgggccagactactggacacttcgtttctgggcttaaaatgcagctgtttaagagtttagggttcacaccaatccaaagatatttactattataaattaaccaatgataagtccacacttctctataagtaagaactgagactcccaactcgaacaatgaaatattgtggttgagcagtgtgtatggaagtagggctttgaggcctgggctgggctggggaacaaagacacctcaagttggggagccacctcttgcaatcttcatgggctcagaggcagttgagaaaccagctcagtacttcttttcttaccggagtatggactctgaagtcttagggattctgggactttgaagcaggccttcctaccagaaggattctgatgttatacaatctagttattttctccccacatgatgagcagtaaggttggctttgggcagaactgtaaagtgggctaaggaatccttcttcctcctactctcactgccccagggtacttgcagtcaagtccctgcctgggggcatgccaaacaaggcctatgctcctgagcagtgctggtcaggcagaaaagattgactccaggcctggacaaggaacagtccagtagaggccccttacagttaagcagtgggataatcatggagcagttctatctgcattttaataattacttgttttgaaaaagttctatgtctacgaggcccataaaaatatcttaatttttaaacaatcagaataaaaaatgaatagaacaacatggattgtaatcatctttataccaacacagttgtgaaatagaatttttaattgttttcactgagaaagggattcataaaggcaaaagtgcctcaggtccccctcagtcataacgtagggcatacgttaatgtaggatgtatatgtcccctcctccatcaaacaacctcatagcattctcaaattgcctcccctggcttttcccttctgctttatttcccaaagccattcctagagacagtaattactttaattttgaatttacgttttgcacggtgacagtgtggcctatggtcccactagtttatgaggtgtcatttgctgctggagagaatcactacttgttttgcctccatgagtcaattttggggttttggtgtagtcacctctcagagggctcggagcccacaagaaatggggtcaggaaagtgcagaaaactagacctgtggattgctcacagcagtttctgtctctgggtgcccctacattcatttgcttcagtccacctgtttctccgtttcctggggaagggaatttattcaattactgtcctctttcaatggtatggcaacaggagaatgttggtaaaacccaaccatgttctgaattgggctttgcgtgggtgttaggaaaggtaagattttcccgttttctgagaaaagggaaaagattttaagaatattgccacctcacccttgataagcatctaaagcagtgtttgctcaattaaaacctagaaatgactgtcagcccaacatgaccgcagcccccatcccccctcacccagtgcactttggctttaaaacatcaatggttgttgctggccgggcacggtggctcacgcctgtaatctccacactttgggaggccaaggtgggtggatcatgagttcaggagatagagaccatcctggctaacacggtgaaaccccgtctcttctaaaaatacaaaaaaaattagccgggcgtggtggcaggcacctgtagtcccaggtactcgggaggctgaggcaggagaatggtgtgaacctgggaagtggagcttgcagtgagctgagatcacaccactgcactccagcctgggcgacagagtgagactcagtctcaaaaaacaaaaaacaaaacatcaatggttgttgctgggggaaaaaagaaatcaaggcccaaaggaatatgccaattcataaatacacaattagctggttttattaccgagcaaagcaaaccccttgaatatttgcaggtgccagcaagtgactgcaaatctgtagtgggttttcagctctgtgtctatggacttgaagctacagttgttttacattgtcttacttgtagtaaacagcagcattcagttggcatcagtagttattaatacactgagtttcctgtgacatcccacttttcttaattctctatcaggcctgctctgagatcttgttatttgtaatgctttatcagtacctcctacggttgcctctgacagcgtttctagcacagatgatcagtcacatgtttcaacattccttagtgaggttagattaggttcagtttccccacagtgtgctttttgctgctcgttaatatgtgccttgagaacactgggaagccgttcatttttaaatgctttgagtatactgggcatcatctcataggtgccttactccaacagggcccttctgttagggcctggtttaaaatactgcaagtatttttttgattgtatatgtgtcgagttccatctctccttgttctgcatcaccttgagagataagttaactcggttgatcctgtagttggtggtattgctataggaaaatagagaccacagtatccttttggatgtattcacaaccctgaccgcacactcagatgacctcgggcacatgcctttagaaaatccagatgcttgggcttcacccaacaataactgaagcaacatccctggttggggggactcagcgtccatgtagttgaatgtacccccaccccaggtgagtctgaagtgctacctggattgagggctacggctttatggagttcttgagggtatatagttttgctttttaaaaaataaccaaaagaagattcccattacaatttgatgcaggaacaggggtaggggggcagggaaaatcattccccatccttttgccctataacagagtttctcaaccttgacgctattgacattttgaatcagttgggggctgtcctgtgtactctgggatttttagaagcatccttggcctctcccattagatgccagtagcacccttcctcaagttttggcaaccaaaaatgtctccagacactgccaaatgtcccctgaggagcaaaatgatctcctcctcctttccttccctgagcctcctcccagttgtgaaccactgtcctaaaatgtaaactgttgggtgttccctaagcaaggtttgtgctagctagttcacttttcacttatgaattgaagcattggaatagctctgaatacaggatgtaaaaacaaacacgacttcacatactcttaggattcactgtgagctcattatttttgagtaccttaatttgctcaagttataaaataaaaatgtttgcatctagaaatatgcccttatttttaaagataaaagaacaccattaaacataaattttatttgtattattggaatttttgtatagctgtgtaattcccaagttagcttatttaagcctccattagtgaggctaagctttaaatttctttcactctgttctaaattaaaaacctaacaagcttatttcaattagctaccggaaaagagagaacatagcctaaaaatgccttctacaaaaaaaccccagaaaatggtcttaaatagttcaatattatttccttataacaatgttctatcttggatgctttttttttttaaaaaaaaggagtcttagatcaatagcaccattgtatgacttgtcttatgatctttctccagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtttgtattattagttagaaggcatgaagacttttttccctgcatggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtcta

SEQ ID NO: 3103 - DNA, 26074 bp, human
ctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcggtgagtcataggggcagtggaatcagccctggggaggttggctaatgtgcttaggagaggagggttgggcagtttcagtggctctgtgtgaggtgtccatggggctgttactgggcagatgtccacagctcactggtatatattctttacacagctgttcaaaaatgtgtatacttctttctgcagaatcctacagacaagacaaattcaattgtcacaaattattctccagtgaaaatttcagctcccaggaatcattctttgtgggtcaaatgcattatttattaaattggaggtttgaaagttacttataaataggaaaatttttaatgctaaaactttttaatttgtaagtcttaggtgtttggcatttaggtggggcagggtttataaagatgttcaaacattgagcactgattgagtcactttcaaaagagacaaaagagactttgttttacttaaaacattggagaatcatcttacaggtattgttctcatctgtcaagtggtgtctgtgctaatgtacagaatcccacaaatacacacttcggtgagcattcagcaggtgcctgttggctgaaaggattctgaaaaatgggtttaggcatttgcacacaggttcttataaataatagtatattggttagtaatatactggttaactctccagccccaagtctgcaaacttgctgatgtcacgtcctttcccaaactgagaccaatcagtgaggaaaccttggagtttatcgggaaggaaactcaaagttcgtaactttcggagagcaaagggagcagcagggtgagggtgaaggcaacagctcactttctgcaactgttgttcaccctgttgagatccttgggggcttgtgacggagacaagccccagcacccagagctgggaaagctggtgttgcagcagccctgctgaattgctgtatttattatttattaatttttttttctttttgagacggagtcttgctctgtggcccaggctggagtgcagtggcgcgatctcgactcactgcaacctccgcctcccgggttcaggcctgtatatataggcggggcacggtggtttacgcctgtaatcccagtactttcggaggccgaggcgggcagatcacgatgtcaggataccatcctggccaacatgatgaaattccgtcgctacctaaaatacaaaaattagctgggtgtgatggcacgtgcctgtaatcccagctactcgggaggctgaggcaggagaatcacttgaacccgggaggcggaggttgcagtgcacctagatctcgccacagcactccagcctggcgacagagtgagactccgtatcaaagaaaaaagaaaaaaatatatacctggtatactgtccacagcacctgttgatcaaaggggcaataaacagggaccctgaagtcagggtgttttgttttgttttgtttttttgagacggagtctcattctgtcgcctgggctggagtgcaatggcgagatctccgctcactgcaacctctgcctcccgggttcaagagattctcctgcctcagcctcccgagtagctgggattataagcgcccgccaccacacccggctaatttttgtatttttagtagagacggggtttcaccacgttggccaggctggtctagaactcctgacctcaggtgatctgcccgcctgggcctcccaaagtgctgggattacaggtgtgagccaccacgcccggccgtcagtcagggtttattaatctactatacaggtaccaaaaaggtaaaaatggaagaaataaaacacaaaacgtcttccctttgactgagtagactagcctgctcattcattcattcatttatccaatttcacttataaaatgagcagagtactcaatggtgagtgggatttagatccacaaaggcagaactggattaatcagcagatgtattgagcatgagtttggagaactaggaaagcaagagtggcatcaaaaatcacttttcacaaagaatttctttttttttttttttttttgttttttttgaagtggagtttcactctgtcacccaggctggaatgcagtggagcaatctcagctcactgcaaactccaccttcccgtgttcaagcgactttcctgcctcagcctcctgagtagctgggattacaggcgtccgccaccacacccagctgatttttgtatttttagtagagacggggtttcaccatgttagccaggatggtctcaatctcctgacctcgtgatccgcccgccttggcctcccaaagtgctgggattacaggcgtgagccaccacgcccggccactttttacaaggaattatatatataattatatatatatatatattttttttttagatggagtctcgctctgttaccaggctggagtgcagtggcaccatctcggctcactgcaacctcggcctcctgggttcaagcaattctgcctcaggagggagaggcagggactaggtgggactacaggcacacgcctggctaattttttggggtgttttttttttgtattttagtagagacggggtttcaccatgttgccccaggctggtctccaactcctgagctcagggaagtctgcccgcctcggcctcccaaagtgctaggattacaggtgtgagccactgtgcccggccgataaatatatttttaaaacagcaaaccaatcattatgggaaagaatcggtaatttggttgacttctgcacggttattttatagctaagtattgtatttatttttgtttccacatgggagagaggcaccagccacttttcactgttagggtttctttttcttttttttttttttttttgagatggagtctcgctctgtcgcccaggctggagtgcagtggcacaatcttggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcaatctcctgacctcgtgatccacccaccttggcctcccaaagtgctgggattacaggcgtgagccaactgttcaggatttctaaagttcctaatacaaccctggtggggtcagggtgggtgagtgggagtgggcaggtgttatacgcaaaggcatggtgcttgtaaagtcaacaagtttttacagctagagtgcaaaatgtgaatgtcttagggagtctagtgagaacaagtttgaagagatggagtggcagataaagcttgaagagctaagtggaggaggtcaggcttcatgaggcaggaaattgagagccattggtggttctagaacagagacctggtaataaggctgtaggtcaattaacatggtagccacagctgggatagattgtgttggaatcgtgggagatggttgcattcatccagtggttctcaaattctcatgtgcctctacatcacctggagagcttattgaaatacagataatgcagcttctggctgggcacggtggctcacgcctgtaatcccagcactttgggaggctgaggtgggcggatcacttgaggtcaggagttccagaccagcctatccaacatggtgaaaccccatctctactaaaaatacaaacatttgactgggtgcagtgcctcacacctgtaatcccagcactttgggaggccgaggcaggcggatcacctgaggttgggagttccagaccagcctgaccaacatggagaaacccagtctttactaaaaatacaaaattagccgggcatggtggtgcatgcctgtaatcccagctacccgggaggctgaggcaggaaagtcgcttgaacccgggaggcagaggttgtggtgagccgagatcacaccactgcactccaacctgggcaacaagagtgaaactctgtctcaaaaaaaaaaaaaaaaattagctgggtgtgttggcacatgcctgtagtcccagctacttaggaggccgaggcaggagaattgcttgaacttgggagggcggaggttgcagtgagctgagatcatgccactgtactccagcctgggcaacagagcgagactctgtctcaaaaaaaaaaaatgcagatgatgcagcttttgatgaagtcgtaggcctggggtgggggcctaggaatctgcattcataacaaactcccaggtgaaatggatggtactggtcagggaccatactttgaaaactactgcactaatccaaccatgaaacttacatttggatcgaactttggaaatgacagagaaagggcgatgatttcaaaggaaagataaatcagcgtatgttgcttgattaaatgttggaactaacagaaggcaggcaaaattataaggttctcaagcccaaagtaatgtcagataagctagataagagggaagttggaaaggaagttgccttggatgcaggatgaggaggggaggatacagagttctgttttggacatgatagtgctaacaatgatgcccagtgcacagtatgatgacatgggactgagacttaggaacgatcacaggttagaagccagatacctcagaatgtcctacagaggggctgtggttgaaacctagggaagggagaaattgtccaatggctaagagctgagagtcaaccaaggatggaaccctgggacaggcctccagttgatgaagtaggaccagtaagttggacagagaagcagaaagagattctggatgttgtaattacacaggtgctaagggaagagaagttttcaaagaagtagaagtcacaagggtaggtgcctggatacttctggtttcttacctcctgttgtgaatctgactggcaaattgctactcaccttctacacccagctgagccattgcccccatgaagccctcctagactttccacctctccctactcaagtggagtcattctccgtctgctttgcatcagtcctgccccttgggtaaaacctcaattgtagttggttgcttttgtttatgcttctgaggtcttaaccttggtgaagtgtggaatggggaacactcagaatgctgttttcaaatagctgtgccaagaaactcagctcaggtgaagcttgtccctttgcacaaggccaagttagaggggaaaatagggcccaggtgtggatcatcttgctgctcccacctccacctgcaggcgtttttctgcccacttccctgggggtagggagggaggaaaggctataaaaatgggcaaccaactctttatagagatttgtttcatgttagactctcctgtccaaggagcagggaaagaatgtcttaattttttcctgaaagtagcttgttacgagttaaattgtgtaccctgaaaatatatatggttaagttcttaacccccgtgcctcagaatgtgaccttattagttaagattagttcaggtgaggtcgtaagtagggtaggatggaccttaatccaacatgaccagagtccctataagaaaaggagaaggagacacatggagaatgctatgtgacaacagaggcagagataggagtgacacatctagaaaccaaggaacaccaaggactgatggccactgccagaagctagaagaggcaaggaaggatttttccctagagcctttggatagagtatggccctgtccacaccttgatttcagacttctagccaactgctagcctctaggactcggcgacaacaaatttctgttgttttaagccacccagtttgtggtgtttcgttatggtatccctaggaggctaatttatacctactcatagaaacttaggaaaatacattgaaggataaactaaccacccataattccaccaagcaggtaatcactgttcccagtgttagtgtctatcttttggggttttgcctgaagactgacaactgtagagatatttctatccttgcaaaattgagcccaccctgtagagagtattcacatttaaacagaagacaagctagaacaggtattgaaagaaaacaattttattgtcttatggtgaatttttagatattggggcacctcaggaggggtgagttttctgggggaaaacctgcctgttgagacagaatgggtgataatgtgagggccctttggagaaggcagctttatattgagagagagagagagagagagaagagagagggagacaggaaagagaagagagagaagagagagaagaaagaggagaggagaggctggatgatggaactggagaaagaactgcagtggacaggcctgacttgcccaagagttgcctcagtgggcctttctgtttgtttctgactgtaagcctcttgtttctttttctcctctttctgtttgtcctgggatcaaaccaaggtccacaataattgtgaatacagcacccagatactttccaggttctggcaggttggttcatgccactgaatccacccttattgtgtcctgaagactgaaggcaaatactcctgtcccctcagagcaacccgacttcttttttgtctccttgactttgcaaaacgtttctcaggatgagtagatttatgctaccgcccagcattcactggggttctcagaacatcagtaatagctattttcagcatgtagcaattagtgcatcttaaatctcttttgaaataatggaaatgaaaaaaatgttccacaaattacaataaaaatgaaatggcagcctccctaatgtgctccaggtttgatgagggtacaatttaaaagaaagataagttcttgctaatacacacacacatacacacaatctatgctctctgaatgttagaaaaatgttaaactaggccaggcgcagtggctcatgcctataatcccagcactttgggaggctgaggcgcatggatcacttgaggtcaggagttggagaccagcctggccaacatggtgaaatcctgtctctactaaagttacaaaaattaactgagtgtgatggtgtgcacctgtagtcccagttacttgagaggctgaggcaggagaaccacttgaacccaggaggtggaggttgcagtgagccaagattgccccactgtactccagcctgggtgacagaatgagactccgtctcaaaaaaccaacagaacattacacacaaagaaaaatgttaaattattaattgtcactactgtaaattttcacataatcactcatttgttctgatacctgctgaggtcaaagtccttgtataaatttgagatggattttagttttacagggactcacgtttttcttctgggcaggagcataggcatactgtgacaggcttaacaaaccctgaactgaaatgactttatgttagaaggggaagcctcatatcctgctgatgggaacatacagtagggcagccactttggaaaacagtctcaaaataaacattgtgttaccatatcatacagcaattcttttaggtgcatattcaggagaattgaaaacatatatctgctcaaaaacttgtatatgaatgtttatagcagcattattcataataggcaagaagtagaaatgacacaaatttttatcagctgatgaatgaatacataaaatgtggcttatccatacaatggaattatttggccaaaaaaaaaaaaaaaaggaatgaagtactgatgcacgctacaacatggatgaaactttgaaacatgctaaataaaagaagccagttgcaaagtaccacatactgtatggtttcatttatatgaaatgtccagaataggcaaatccatagagacagaaagtagatccatggctgccaggggctgagggaagtagaactgtggagtgactgctaatgggcacagagtttctttttggggtgatgaaaatgttctaaaattgattgtggtgttggttgcatagctctgaatatactgaaaactgctgaattgtacacattaaatgggtgtattgtatggtatgtgaattatatctcaatacagctgcttgctagctagctagctagagatattcacattgtcagcccctcactacgtgtaccaggacaacactctgtacttctcaaagacacaagctgtctctgctctgtaaacactacattctgcagaggtgcaaattcagatagccttgttattctcttggagaagtacgtacttctttatttgccccaaatagaaagagtaatggtcccatgatgaatgagcagaaagtaagaccatttgtggctacacttgataaatgcgtcatttttatgaaatctggacagttacaaattaggatgcaatctacctgcctggactgtttagcctgtcgacaataataatcttagggagctctaagagaggttggggaatgtggcagctgtatttcttagcagctgagcacttggaaaaaaaagtggattaatcatcatacatatggtgatccatcaagatacatttgcaaatctattgaaaactgattttcaaaacctttctcaatttgtggctctttgttctcattcaagattttgtgtgaatggtatttggcattatcagcaccaacagggtggaattagttgtccttttaattctaatttggagatcaatctttccatgtctgcagtccgaattttagcttccaagccctagaatcagcagtattattccagaaataattaggagcctcagagaatgccgtgaggacattgagtatctattaagcgtgaggttttgacggtacgaaaagccatttcacttaagatgtaccttgtctcaagcacctttagtgaccccagaaggaaagcattggatgggcggtatgtagatgggctcatttgtcttccttttatgtactaaatgcttaatgaatccatctggaagaatggtaatttgcttactaatacagattttccagggcactgatggcttcaggtggcagacagacgggcctcatgtgttaagtacaaagtgttaagccaacatgtgttaaatacaaaggatacttcatagcctttcagtttgcaaggtatagatagttaagtatcctccttctccaggtcttctcagtttttaggagctattagcttccgtgcaaggcataactggcaccagacctttctaccttgtttgtatgtagtgtgtttggcgaagcaggtggagctggagctgaagcaggttcaggcacgcctccctcacatttctactggaaatcagatgaagcttgagatgagaaaaaaatcagatctatgcctcattcagttatattcaattaagagagaggaaagcatttaatgggttgggattgggttttcaggcttctttcctaagaatttgttttccttctatgtggttgtagaataaatttgctattttattttatttttttgagacagagtctcactgtgtcacccaggctggagtgcagtggcatgatctcggctcactgcaacctccgcctcccgggttcaaccgattctcccgcctcagcctcccgactagctgggattataggcgtgagccaccacacccagctaatttttacatttttactagagatggtgtttcaccatgttgcaaggctggtctcgaactcctgacctcaggtgatctgcccacctcggcctctcaaagtgctgggattgcaggtgtgagccaccacgcctggtgtaaatttgctattttaaatagcaatgatgatgaggtataattaagactctctgtttagtgttagggcaggataataatagtagctagtatgtgttgagccatggtaagtacaggttgagcatcccgtctctgaaatccttgggaccagaagtgtttccagttttttcagatgttggaatatttgcatatacataatgacttatcttgtggatggtactcaagtctaaacacgaaatgcatttatgttttatatacaccttacacacataacctgagataattttatataatattttaaataagtttgtgcatgaaacaacgttttgactgcaacccatcacatgtcagatgtggaattttccacttgtggcatcatgttagcactcaagaagctttggattttggagcattttggatttgggagttttgggttaaggatgctcaacctgtatgttatatattagggctgctcaacttgtaactttacagagaaggaaactgcggcactgggcctttcccgggacccacaggtcagaaaaggtgaagcgggtctgaattaagagctttctttaaccaccttggcatgctgcctttgagggtaaataatgtccctgtttcaaggtgagactgaacactgatttgtgcttaatattaggacaggagataatctataaatagatatggttctgtttagatttgattccaaacctaatggtgtatgtaattacatgattactactattaatacagaacactgtttggtgagatgccaaagtctgtatttcatgcaggaaactagactgacagctacagcttaacacactaatgttggtaattagtgaagctctcgcttaactaaatgggccatttgcctttgaaaccagtgtgtaaatagaaatagagtaatctgtcatcccaatccacctcttttgtccttagtttgaggactggctgtagttctttcccaagctatccagacatttcaaacaaactgtgcacaaaaaatattaataaagaagagaaatgctgaattcctgatgggaattttggttgagtgaatccaatgtctccctccatccagggcctgttaggctcttattgatgggcaaggataagcctctgggtctaagtgcattagcaggatataacccattcccctctttccatacagatgctgtgtctgattggtctcctatgcatgaagctgcaatccacggacatcagctgtctctgaggaacctcatcagccaggtagctttttgaaaatacaatacagaagaaacctatcaaaatattaaaacaaatgtgtgacataataacatagggacttttaaattaattcattaaatagaagacctagtggtgattctagtaactaccataacgtctaaataggatgagtatagattttgagatattttagatgtctacagcaattgtaatacaatagaaaatatctgtaatttctattggagataaccctacataatactattactactgtggtttgttgtctacattctgaactgaaggaaatgctaaatttcagatagagctgagtgagaataaatgtgctttaaaaaatccaatttcatagacctatctagagtaagaagtcctcctataagaaaataatttctaaagaaaaatttcatactatcctaagccactatcttaagccatttttggtagcagcagtctattataaatagattataacactaattctagctaaaagaagttaggctacttctcagataaaattagaaatttaccctattttgatagcatgaaaaatgatcactgcagcttttatatatcacttcttaaattggacagatactcatttacattcagtatttatgtgtttatgaaacatcagccagaaccatatctccaagttctatcacattatttgtgtaagatgtctttttagagccccggtttctgctttcataaaatgagtattctaatacctacctaggtcagtccaccccataactcaataacaaaccatcccaaaactcagtgacatgatacagtaaccattatttcttgctgatgtgtgtttgtgtcagttcatctaggctgggcttggctgggcttggctcccagctgtgggttgggtgtagccctgctgcacatctctttcatcctgcttggaccactggctacctgaggaattattttttcttggcaaaacgctggagcacagcaggacaagccccaccatgcaagaatacttccaatctgttcatgtcacatctgctaacatcccactggtcaagtcacatgaccacatccaaagtcaaggctcaagagaagtacattttgtcaactaagcgtagttgacgactgaaaatagatatattaaagttaagccattcaatctttttttaaaaactaagaactgactgtggactgaacactgtgaagtaatgggttaattaccttatgattttatatgactcagacttgttaataatttagacaaatcacagttaatttaaggtagaactgtagcttgatgatgaactacaaatgagtttctaactttacagaaggaacctctctgcaatgtgaatatgtggtgaaaactttttgtgttacgaatagctgtgttgttgtatttcatttacgtggatttatgtataaacacctaaatgctggttttatttttatcattattattattattattattatttttttgagatggagtttcactcttgttgccatctggagtgcagtggcgcgatctcggctcactgcaacctccgcctcctgggttgaagcaattctgcctcagcctcccgagtagctgggactacaggcatgtgccaccacgccccgctaattttatatttttagtagagacgaggtttcaccatgttggtcaggctggtctcaaactgctgacctcagataatccatcagccttagcctcccaaagtgctgggattataggcatgagccaccgtgcctggtctaaatgccggttttacaatggcagttgtgcctggaggagtatgcacattttcctattggttgtttttatggttgccttttgcccaagttctgtacctcggcctgccttcccccaacttgtgtctgatacacttgcatgatttttgcttcatgtgacaatcatacccctcttgtggcattgacaaagctactttctataagtgtgatgactgtgagaaaataagatattttctcctgccaattggacatttaagtcttaggtatgaatagtaaagtaagaaatgacatattcttttctttgatcacgacaaaagttggcacatttttttctttctttttttttttttttttttgagacggagtcttgctgtcgcccaggctggagtgcagtggcgccatctcggctcactgcaggctccgccccctggggttcacgccattctcctgcctcagcctcccgagtagctgggactacaggtgtcccccacctcgcccggctaattttttgtatttttagtagagatggggtttcaccgtgttagccaggatggtctcgatctcctgacctcgtgatccgcctgcctcggcctcccaaagtgctgggattacaggcgtgagccactgcacccggccaagagttggcaaatttttttcagtaaaggaccagatagtaaatattttaggctgggaggctgaggcaggagagtggcgtgaacccaggaggtggagcttgcagtgacccgagatcgcgccactgcactccagcctcggcgacagagcaagacatcgtctcaaaaaaaaaaaaaaaaaaaaaaaagaatcttaggccttgcgaaccatgcagtctctgttggaagtacctaactctgctgtttagcagaaaagcagttgtagacaatatgtaaatgaatgggcatggctgtgttctgataaaactttgcttatggatgctgaaatttgaatttcataaaattttcacgtgtcacaaaatattcctttgatttcttttaaaccattaaaaatgtagaaaccattcctagctacagaagcaggtgtaggctagatttgactctgtaggctactgtttgttgacccccttgtcaaaactatgatagagctaggaaatctaagaaaaacaattaaatgtcaggaaaaggagggtttttttgagaaaaaaaattgggtgaaactgatatttttattacaaatattattaaatcctgtgtgttactaaatacttatgtttaaagagcaattatattagttaataggtacatttcaatttcctaaaataagaaagtacatttaggcttcctaaaaggtacatgcagcagtctatttcttttccctcgcagtttgaaaatttccttttaattgtctcacaaggtagagccacttgtgaatatgttaaaacttaataattgcttgttaaaacttagcaatttgggccacgctgactttaaaaaaattgagaaatttcataagcatgaaagaacttaaacacgtgtgcagttgaataaaaagtgatgatgatgagaatattgccatgtgactgcctccccaggtcaggaaatggaaaaatagcacaatgctggctcctccaaagactcacccatccctccccttattgtgctttctagaacacaatcctgtccctcttccacaggagtaaccattatcccgatttccttgttttctttatggttttactctatatattatgtcttctgaaacaatatggggtagttttgcctaattttgaactttaaattgatgtaatcattcagtgtgtatgcttttggattttgcttcttttgctcaacattatttttgcaagcatcacccttgtagtgcttgccattatgatttgttgggtgtaatctttctgctgaaagattataccaaagttaattaattcagtccattgttgatggacatttggtttgtttgcagtttttgactattatgaccaatgctgttgtgaatattcttgtatatttatctagatgtatatatacctaagagtcaaattgctgagtcataggcatatgcattgtcagctctaatagatacagtcaaactgttttcctgagtggttataccataccacactcccaccagtagtgtggcatttttttttttttaaagtcaatataaacaccttagtgtaacatctgactttgagccaggtcagctttgtcatagtactggaatggtggctgaaaagcagccccagggcactgttgctttgcaccccttactctgactgtttcccctccttcaggggtgggctgtgaacatcatcacggcagatcatgtttccccactccatgaagcctgtcttggaggtcatctctcttgtgtgaagattttattaaagcatggagctcaggtaagggcagctgaaacaacatcttagaaaccaagaatgaaaaatgactatgtatatcccttctgaataacttccagcacttttgattagactgatttgaaatatgaagacagttgtttttcaagaaaattatgttcatcaggcttgtttgctttagtgatggatggatgaaatactaaatttttagtcacgcttacagtctatatcattttctttatcatacactactaataaatagttattagacttctgtcttcattgttatggccggaaggtaatgaaatattgtggaaagcacacatttgcctgggatggctaggatgtctgaggagacagaaaatctatgtggtcattcatcctttagctggcaacctggacttgttcacatggtagcagggattgcaagagcagcaaaaatggacctgttttgtgttaggcaactgaatggtgggttggggaaaattatgggcttgctatcttctggcaacagcaaatgcaaagtcccagaaatgatagtgagcaatttttatatcttgaagtcattccttacggcaggacagtagagtaggtgagagggttcagaacataagcaaccttgtccatgccaaaaaaagaatgggctttgtcctgagatcagtaaagagccagaggtgagtgcactgccagatttatatttgggttaagaaaacattcaaaacttggaaacagggaacgtgtcaaggtgaagcaagagacacctagggtacaaacttgaaagaagtgctcgctctcagggtcctgcactatttgtgtgactccaaaaatgaatatgtccttaaattttttaccctgggcaacttttatgtctcactctggtcctggccctgcttggaagtagagtttgagaaggaattcgttgtcttcacaatatcattgcttaaaagattcaccagataatcatttaatgatatacaagaatgtgtctgcacttggcttttctattcactatttaattatagcccaaacactgtgaagttagacattaacttcgaaatttctgtctgatttccaacattagaaaagatagcctcaaagattatacttttatggccctataggacattaaccagtttttatgtttttatttttttaatttttgagatggagtctcgctctgtcgcccaggctggagtacagtggcacgaactcagctccctgcaacctccgcctcctgggttcgagtgatactcctgcctcagcctcctgagtagctgggattataggcacgcaccaccacacttggctcatttttgtatttttagtagagatggggtttcatcatgttatcatgttgcccaggttggtctcgaacttccgacctcaggtgacccgcccaccttggtctcccaaagtgctgggattacaggtgtgagccaccgtgcccggcggagttttgtatctattagcaaatatatttcagcagtccattgactatatacgtttttcttttttctttctttttttgagacagagtctcactctgtcgcccaggctggagtgcagtggcgtgatctcggttcactgcaacctctgcctcccgggttcaagtaattctcctgcctcagcctcccgagtagctgggactacaggcgcatgctaccatgctgggctaattttttgtatcttagtagagaccgggtttcaccatgttgcccaggctggtctcgaactcctgagctcaggcaatccgcctgcctcggcctcccaaagtgctgggattataggcgtgagccactgcgcctggccaaatgtttttttgagccagccttaccatcttactggttccctcattaatgagtgagttgaataaaatcttgggtatgtgttaattctatatttgtatgaaagtcaagttttttaaagttttctaaattatactttaagaatatactaaattacacagctaataatttcaacaatttcctcacagcagcaagagtaatcttcttgcacccgttaagaaattgaattggtgtgggatgggtctaggaaagaagtttaaaatagggattagtttgtaagcgattgaaattatcctaactagtttcaaagttcatgttcctggggagggcatggaggagatagaacattgagtaacattttcgatgctttatagccactccctaattccatttttcacaaaaacctgtggaatttcgtagttatttctccattttatagctgaggaatttaaggctcagagatgttaaataacatcttcagagtggtggaccccacatttgaacccaaaacatcccccttcctgtcttcattctggagcttcttttaccaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggtaaatctgttgagaatttttttttctacccactccttcaagggacatcttactgctgaaagaaagaaagaaaaggagatatattttagagcagtagttctcaaaatggagtcccaggactggaagcatcagcatgacctggcctgcaaatgcagattcttcggcctcactccagccccattgaatcagtaactggggatggggctcagccctctgtattttgtttaataagccctccagctgctttctggtacacagtaagtttgagtgcctcccttttagagcattttgaatgtttttcactgctgtattactgaaacagggcttggcacatagtagactatccatcaatatttgtggaatccgttgttatacccgtgaccttatagaaatcaagttatttcataaaacaaattatattcttctatttcagggccttaaagaacattgtctcagtgacacttaagtttgccaaatgaaataagctttcaatttttgaaagtatttgatgttgcatacagtttgggataattcttttcattaaagccataatttttctgatagtcttagctcataaaatcacaagtttttattttctccaatatttagcatcatcgtaatgaccataccttgccagagggctttctgtttctccagtggctttcatagaatggcttcccatttgactggaccaacccactcataatgatctcccaaagcattaatattatttattgagaacatcttaactcatcatattcgctgcatacatagaactaaaatacagcaagagaaacgtagaggagcaatgtcaaaaatatgacatcctggaccaaggaagtgtgattcagctttcacctagtttttcagattgggccctgctcatgttggatttggcagtttcttctaagcattgcctatacccgctgtggcctgttcctcccgggcctgcctttggagaggttgtaagtttccttccctgtcccgtggcccacactgtgccctttattcttcagttccaccttcaggtcctgttcctccatatctctcccaagctctcacttcaatttctgtacttagacaaactacaaagccacagacaattgaaaaaggtggatagttgctggttggttaccgtggctagtaaactcaaatggagtttcacccgtagttgcagattgcatcctatggtcaaaccattaactgatagcagtggttaaaatcactcctgatttggccgggcctggtctcacgcctgtaatcccagcattttgggaggctgaggcgggcggaccacgaggtcaggagattgagaccatcctggctaacacggtgaaaccccatctctactaaaaatacaaaaaagttagcagggtgtggtggcgggcgcctgtagtaccagctactcggaggctgaggcaggagaatggcgtgaacccaggaggcggagcttgcagtaagccgagattgcgccactgcactccagcctgggggacagagcgagactccgtttctaaaataaaataaaatgaaataaaataaaatcactcctgattctaattgaaggaaatagctttttggtcccctggataagctgctgccaaatttaatgcaaaatggggatggcaatgtctttctagctaagggaacttgtattgtaactgtttttcttcctgctttgggctgcaggccacgtggagtgtgtcaactctcttatagcttatgggggcaacattgaccataagatcagccacctgggcactccactctatttggcttgtgaaaaccaacagagagcctgtgtcaagaagcttctggagtcaggtaaagcaaaaagcaaaccaaaacaagaaaagaaaacgaaaagtaaattaaatgtattttaaacatcttactgctgtaggagagaaattagtgtgggcaatggagttggacaaggtcagggttcatattgactgtgttcccttggggaattatttcacactgtttgaactgtagttctctcatttgtaacaaggatgaggaggaggaggaggaggaggaggatgatgatgatgatgatgcctcttctcagggtggtcctcaatgattattagtttctcctccctttcctctgtctccctccatttggccagtcacattattaagccctgcataacttgcaaagctgttggattagtgttgaatcttcctatttgggaccttaaccagttctctttgattagatattgaacttgccccattgcaaatattatattttccttgaaaaggcctatgtacccttatttcttttcacctccctgctgttgtccagcccccttctcaacacctggaacaccatttcatcacctctttaattatctgagtcctatttattctttaaggcttcagtaatctgtttcccaatgaatgttgttgcagtccttattgcctcctactcatctggcaggcattgctatgaattaagagatgcaatctctgtctctcccccactgcccaccccacctctgccactctgggcagattttaagcctctagcctggaaagggccatgtttgatatccctcacaaagtcaggaacaatacaagaccagatcagttaacatttgttgagtggacatagattttcattttaccagagggatggcagctcaggcaaagccacatgttcccacatgtcacagtgaaagctaggctctgggctggggtggggatttgttaagagtgtaagagtggaattgggtggggacagtcctagaaatccaccttactcctgaaagggagaactttgccaccttccctgtgatcttgggattggccagtccaatccaggggatacccccatgagttggttggttgcttttcaaagtccaaatcaccagtcccaagtgtccagttttacaccctgtggcagctgcacaccaggtgagtttggctgcttggtgtaggctggatttcaccatctagtctctccgtcaggctgtactggctaatacttaggttccattaataataatgtggagcttttatgtcactaggatttttcttatatgcatcatgcctatctatgtacagtgctgaaaggcaaatttttaactttctatgctatattcctcatgctgtacattcaataacattatcaggtgggattttccccacattattaaatggaatcacatcatctcccatttttccaggattgctgtgctcaatatggatcccctcttgttaggaaattttggggctcggggctttgaaaagccccgatggttggattctgctccttgctgactcttttttgttctcgtgactgtttaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaaggcaggtatttggcaatttctggctcccattcctataaaaagatcattctctgacatcaccaaatctgggaagttgagataattcaatattcaatgagatacagtactggtcacagtacagtaaataactgtcctgctatttagcatattggatacaggtttttgggatgatctaatattcattatggggtaggccagttttttaaaaattaagatactgttttaaaattttagtattacatttatttaaaacatgctttagaatgaggcagcagagtcctctttggggttgtaagaggccgcaggatatcttgttgaaccacagatgggccagactactggacacttcgtttctgggcttaaaatgcagctgtttaagagtttagggttcacaccaatccaaagatatttactattataaattaaccaatgataagtccacacttctctataagtaagaactgagactcccaactcgaacaatgaaatattgtggttgagcagtgtgtatggaagtagggctttgaggcctgggctgggctggggaacaaagacacctcaagttggggagccacctcttgcaatcttcatgggctcagaggcagttgagaaaccagctcagtacttcttttcttaccggagtatggactctgaagtcttagggattctgggactttgaagcaggccttcctaccagaaggattctgatgttatacaatctagttattttctccccacatgatgagcagtaaggttggctttgggcagaactgtaaagtgggctaaggaatccttcttcctcctactctcactgccccagggtacttgcagtcaagtccctgcctgggggcatgccaaacaaggcctatgctcctgagcagtgctggtcaggcagaaaagattgactccaggcctggacaaggaacagtccagtagaggccccttacagttaagcagtgggataatcatggagcagttctatctgcattttaataattacttgttttgaaaaagttctatgtctacgaggcccataaaaatatcttaatttttaaacaatcagaataaaaaatgaatagaacaacatggattgtaatcatctttataccaacacagttgtgaaatagaatttttaattgttttcactgagaaagggattcataaaggcaaaagtgcctcaggtccccctcagtcataacgtagggcatacgttaatgtaggatgtatatgtcccctcctccatcaaacaacctcatagcattctcaaattgcctcccctggcttttcccttctgctttatttcccaaagccattcctagagacagtaattactttaattttgaatttacgttttgcacggtgacagtgtggcctatggtcccactagtttatgaggtgtcatttgctgctggagagaatcactacttgttttgcctccatgagtcaattttggggttttggtgtagtcacctctcagagggctcggagcccacaagaaatggggtcaggaaagtgcagaaaactagacctgtggattgctcacagcagtttctgtctctgggtgcccctacattcatttgcttcagtccacctgtttctccgtttcctggggaagggaatttattcaattactgtcctctttcaatggtatggcaacaggagaatgttggtaaaacccaaccatgttctgaattgggctttgcgtgggtgttaggaaaggtaagattttcccgttttctgagaaaagggaaaagattttaagaatattgccacctcacccttgataagcatctaaagcagtgtttgctcaattaaaacctagaaatgactgtcagcccaacatgaccgcagcccccatcccccctcacccagtgcactttggctttaaaacatcaatggttgttgctggccgggcacggtggctcacgcctgtaatctccacactttgggaggccaaggtgggtggatcatgagttcaggagatagagaccatcctggctaacacggtgaaaccccgtctcttctaaaaatacaaaaaaaattagccgggcgtggtggcaggcacctgtagtcccaggtactcgggaggctgaggcaggagaatggtgtgaacctgggaagtggagcttgcagtgagctgagatcacaccactgcactccagcctgggcgacagagtgagactcagtctcaaaaaacaaaaaacaaaacatcaatggttgttgctgggggaaaaaagaaatcaaggcccaaaggaatatgccaattcataaatacacaattagctggttttattaccgagcaaagcaaaccccttgaatatttgcaggtgccagcaagtgactgcaaatctgtagtgggttttcagctctgtgtctatggacttgaagctacagttgttttacattgtcttacttgtagtaaacagcagcattcagttggcatcagtagttattaatacactgagtttcctgtgacatcccacttttcttaattctctatcaggcctgctctgagatcttgttatttgtaatgctttatcagtacctcctacggttgcctctgacagcgtttctagcacagatgatcagtcacatgtttcaacattccttagtgaggttagattaggttcagtttccccacagtgtgctttttgctgctcgttaatatgtgccttgagaacactgggaagccgttcatttttaaatgctttgagtatactgggcatcatctcataggtgccttactccaacagggcccttctgttagggcctggtttaaaatactgcaagtatttttttgattgtatatgtgtcgagttccatctctccttgttctgcatcaccttgagagataagttaactcggttgatcctgtagttggtggtattgctataggaaaatagagaccacagtatccttttggatgtattcacaaccctgaccgcacactcagatgacctcgggcacatgcctttagaaaatccagatgcttgggcttcacccaacaataactgaagcaacatccctggttggggggactcagcgtccatgtagttgaatgtacccccaccccaggtgagtctgaagtgctacctggattgagggctacggctttatggagttcttgagggtatatagttttgctttttaaaaaataaccaaaagaagattcccattacaatttgatgcaggaacaggggtaggggggcagggaaaatcattccccatccttttgccctataacagagtttctcaaccttgacgctattgacattttgaatcagttgggggctgtcctgtgtactctgggatttttagaagcatccttggcctctcccattagatgccagtagcacccttcctcaagttttggcaaccaaaaatgtctccagacactgccaaatgtcccctgaggagcaaaatgatctcctcctcctttccttccctgagcctcctcccagttgtgaaccactgtcctaaaatgtaaactgttgggtgttccctaagcaaggtttgtgctagctagttcacttttcacttatgaattgaagcattggaatagctctgaatacaggatgtaaaaacaaacacgacttcacatactcttaggattcactgtgagctcattatttttgagtaccttaatttgctcaagttataaaataaaaatgtttgcatctagaaatatgcccttatttttaaagataaaagaacaccattaaacataaattttatttgtattattggaatttttgtatagctgtgtaattcccaagttagcttatttaagcctccattagtgaggctaagctttaaatttctttcactctgttctaaattaaaaacctaacaagcttatttcaattagctaccggaaaagagagaacatagcctaaaaatgccttctacaaaaaaaccccagaaaatggtcttaaatagttcaatattatttccttataacaatgttctatcttggatgctttttttttttaaaaaaaaggagtcttagatcaatagcaccattgtatgacttgtcttatgatctttctccagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtttgtattattagttagaaggcatgaagacttttttccctgcatggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtcta

SEQ ID NO: 3104 - DNA, 19629 bp, human
ggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcggtgagtcataggggcagtggaatcagccctggggaggttggctaatgtgcttaggagaggagggttgggcagtttcagtggctctgtgtgaggtgtccatggggctgttactgggcagatgtccacagctcactggtatatattctttacacagctgttcaaaaatgtgtatacttctttctgcagaatcctacagacaagacaaattcaattgtcacaaattattctccagtgaaaatttcagctcccaggaatcattctttgtgggtcaaatgcattatttattaaattggaggtttgaaagttacttataaataggaaaatttttaatgctaaaactttttaatttgtaagtcttaggtgtttggcatttaggtggggcagggtttataaagatgttcaaacattgagcactgattgagtcactttcaaaagagacaaaagagactttgttttacttaaaacattggagaatcatcttacaggtattgttctcatctgtcaagtggtgtctgtgctaatgtacagaatcccacaaatacacacttcggtgagcattcagcaggtgcctgttggctgaaaggattctgaaaaatgggtttaggcatttgcacacaggttcttataaataatagtatattggttagtaatatactggttaactctccagccccaagtctgcaaacttgctgatgtcacgtcctttcccaaactgagaccaatcagtgaggaaaccttggagtttatcgggaaggaaactcaaagttcgtaactttcggagagcaaagggagcagcagggtgagggtgaaggcaacagctcactttctgcaactgttgttcaccctgttgagatccttgggggcttgtgacggagacaagccccagcacccagagctgggaaagctggtgttgcagcagccctgctgaattgctgtatttattatttattaatttttttttctttttgagacggagtcttgctctgtggcccaggctggagtgcagtggcgcgatctcgactcactgcaacctccgcctcccgggttcaggcctgtatatataggcggggcacggtggtttacgcctgtaatcccagtactttcggaggccgaggcgggcagatcacgatgtcaggataccatcctggccaacatgatgaaattccgtcgctacctaaaatacaaaaattagctgggtgtgatggcacgtgcctgtaatcccagctactcgggaggctgaggcaggagaatcacttgaacccgggaggcggaggttgcagtgcacctagatctcgccacagcactccagcctggcgacagagtgagactccgtatcaaagaaaaaagaaaaaaatatatacctggtatactgtccacagcacctgttgatcaaaggggcaataaacagggaccctgaagtcagggtgttttgttttgttttgtttttttgagacggagtctcattctgtcgcctgggctggagtgcaatggcgagatctccgctcactgcaacctctgcctcccgggttcaagagattctcctgcctcagcctcccgagtagctgggattataagcgcccgccaccacacccggctaatttttgtatttttagtagagacggggtttcaccacgttggccaggctggtctagaactcctgacctcaggtgatctgcccgcctgggcctcccaaagtgctgggattacaggtgtgagccaccacgcccggccgtcagtcagggtttattaatctactatacaggtaccaaaaaggtaaaaatggaagaaataaaacacaaaacgtcttccctttgactgagtagactagcctgctcattcattcattcatttatccaatttcacttataaaatgagcagagtactcaatggtgagtgggatttagatccacaaaggcagaactggattaatcagcagatgtattgagcatgagtttggagaactaggaaagcaagagtggcatcaaaaatcacttttcacaaagaatttctttttttttttttttttttgttttttttgaagtggagtttcactctgtcacccaggctggaatgcagtggagcaatctcagctcactgcaaactccaccttcccgtgttcaagcgactttcctgcctcagcctcctgagtagctgggattacaggcgtccgccaccacacccagctgatttttgtatttttagtagagacggggtttcaccatgttagccaggatggtctcaatctcctgacctcgtgatccgcccgccttggcctcccaaagtgctgggattacaggcgtgagccaccacgcccggccactttttacaaggaattatatatataattatatatatatatatattttttttttagatggagtctcgctctgttaccaggctggagtgcagtggcaccatctcggctcactgcaacctcggcctcctgggttcaagcaattctgcctcaggagggagaggcagggactaggtgggactacaggcacacgcctggctaattttttggggtgttttttttttgtattttagtagagacggggtttcaccatgttgccccaggctggtctccaactcctgagctcagggaagtctgcccgcctcggcctcccaaagtgctaggattacaggtgtgagccactgtgcccggccgataaatatatttttaaaacagcaaaccaatcattatgggaaagaatcggtaatttggttgacttctgcacggttattttatagctaagtattgtatttatttttgtttccacatgggagagaggcaccagccacttttcactgttagggtttctttttcttttttttttttttttttgagatggagtctcgctctgtcgcccaggctggagtgcagtggcacaatcttggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcaatctcctgacctcgtgatccacccaccttggcctcccaaagtgctgggattacaggcgtgagccaactgttcaggatttctaaagttcctaatacaaccctggtggggtcagggtgggtgagtgggagtgggcaggtgttatacgcaaaggcatggtgcttgtaaagtcaacaagtttttacagctagagtgcaaaatgtgaatgtcttagggagtctagtgagaacaagtttgaagagatggagtggcagataaagcttgaagagctaagtggaggaggtcaggcttcatgaggcaggaaattgagagccattggtggttctagaacagagacctggtaataaggctgtaggtcaattaacatggtagccacagctgggatagattgtgttggaatcgtgggagatggttgcattcatccagtggttctcaaattctcatgtgcctctacatcacctggagagcttattgaaatacagataatgcagcttctggctgggcacggtggctcacgcctgtaatcccagcactttgggaggctgaggtgggcggatcacttgaggtcaggagttccagaccagcctatccaacatggtgaaaccccatctctactaaaaatacaaacatttgactgggtgcagtgcctcacacctgtaatcccagcactttgggaggccgaggcaggcggatcacctgaggttgggagttccagaccagcctgaccaacatggagaaacccagtctttactaaaaatacaaaattagccgggcatggtggtgcatgcctgtaatcccagctacccgggaggctgaggcaggaaagtcgcttgaacccgggaggcagaggttgtggtgagccgagatcacaccactgcactccaacctgggcaacaagagtgaaactctgtctcaaaaaaaaaaaaaaaaattagctgggtgtgttggcacatgcctgtagtcccagctacttaggaggccgaggcaggagaattgcttgaacttgggagggcggaggttgcagtgagctgagatcatgccactgtactccagcctgggcaacagagcgagactctgtctcaaaaaaaaaaaatgcagatgatgcagcttttgatgaagtcgtaggcctggggtgggggcctaggaatctgcattcataacaaactcccaggtgaaatggatggtactggtcagggaccatactttgaaaactactgcactaatccaaccatgaaacttacatttggatcgaactttggaaatgacagagaaagggcgatgatttcaaaggaaagataaatcagcgtatgttgcttgattaaatgttggaactaacagaaggcaggcaaaattataaggttctcaagcccaaagtaatgtcagataagctagataagagggaagttggaaaggaagttgccttggatgcaggatgaggaggggaggatacagagttctgttttggacatgatagtgctaacaatgatgcccagtgcacagtatgatgacatgggactgagacttaggaacgatcacaggttagaagccagatacctcagaatgtcctacagaggggctgtggttgaaacctagggaagggagaaattgtccaatggctaagagctgagagtcaaccaaggatggaaccctgggacaggcctccagttgatgaagtaggaccagtaagttggacagagaagcagaaagagattctggatgttgtaattacacaggtgctaagggaagagaagttttcaaagaagtagaagtcacaagggtaggtgcctggatacttctggtttcttacctcctgttgtgaatctgactggcaaattgctactcaccttctacacccagctgagccattgcccccatgaagccctcctagactttccacctctccctactcaagtggagtcattctccgtctgctttgcatcagtcctgccccttgggtaaaacctcaattgtagttggttgcttttgtttatgcttctgaggtcttaaccttggtgaagtgtggaatggggaacactcagaatgctgttttcaaatagctgtgccaagaaactcagctcaggtgaagcttgtccctttgcacaaggccaagttagaggggaaaatagggcccaggtgtggatcatcttgctgctcccacctccacctgcaggcgtttttctgcccacttccctgggggtagggagggaggaaaggctataaaaatgggcaaccaactctttatagagatttgtttcatgttagactctcctgtccaaggagcagggaaagaatgtcttaattttttcctgaaagtagcttgttacgagttaaattgtgtaccctgaaaatatatatggttaagttcttaacccccgtgcctcagaatgtgaccttattagttaagattagttcaggtgaggtcgtaagtagggtaggatggaccttaatccaacatgaccagagtccctataagaaaaggagaaggagacacatggagaatgctatgtgacaacagaggcagagataggagtgacacatctagaaaccaaggaacaccaaggactgatggccactgccagaagctagaagaggcaaggaaggatttttccctagagcctttggatagagtatggccctgtccacaccttgatttcagacttctagccaactgctagcctctaggactcggcgacaacaaatttctgttgttttaagccacccagtttgtggtgtttcgttatggtatccctaggaggctaatttatacctactcatagaaacttaggaaaatacattgaaggataaactaaccacccataattccaccaagcaggtaatcactgttcccagtgttagtgtctatcttttggggttttgcctgaagactgacaactgtagagatatttctatccttgcaaaattgagcccaccctgtagagagtattcacatttaaacagaagacaagctagaacaggtattgaaagaaaacaattttattgtcttatggtgaatttttagatattggggcacctcaggaggggtgagttttctgggggaaaacctgcctgttgagacagaatgggtgataatgtgagggccctttggagaaggcagctttatattgagagagagagagagagagagaagagagagggagacaggaaagagaagagagagaagagagagaagaaagaggagaggagaggctggatgatggaactggagaaagaactgcagtggacaggcctgacttgcccaagagttgcctcagtgggcctttctgtttgtttctgactgtaagcctcttgtttctttttctcctctttctgtttgtcctgggatcaaaccaaggtccacaataattgtgaatacagcacccagatactttccaggttctggcaggttggttcatgccactgaatccacccttattgtgtcctgaagactgaaggcaaatactcctgtcccctcagagcaacccgacttcttttttgtctccttgactttgcaaaacgtttctcaggatgagtagatttatgctaccgcccagcattcactggggttctcagaacatcagtaatagctattttcagcatgtagcaattagtgcatcttaaatctcttttgaaataatggaaatgaaaaaaatgttccacaaattacaataaaaatgaaatggcagcctccctaatgtgctccaggtttgatgagggtacaatttaaaagaaagataagttcttgctaatacacacacacatacacacaatctatgctctctgaatgttagaaaaatgttaaactaggccaggcgcagtggctcatgcctataatcccagcactttgggaggctgaggcgcatggatcacttgaggtcaggagttggagaccagcctggccaacatggtgaaatcctgtctctactaaagttacaaaaattaactgagtgtgatggtgtgcacctgtagtcccagttacttgagaggctgaggcaggagaaccacttgaacccaggaggtggaggttgcagtgagccaagattgccccactgtactccagcctgggtgacagaatgagactccgtctcaaaaaaccaacagaacattacacacaaagaaaaatgttaaattattaattgtcactactgtaaattttcacataatcactcatttgttctgatacctgctgaggtcaaagtccttgtataaatttgagatggattttagttttacagggactcacgtttttcttctgggcaggagcataggcatactgtgacaggcttaacaaaccctgaactgaaatgactttatgttagaaggggaagcctcatatcctgctgatgggaacatacagtagggcagccactttggaaaacagtctcaaaataaacattgtgttaccatatcatacagcaattcttttaggtgcatattcaggagaattgaaaacatatatctgctcaaaaacttgtatatgaatgtttatagcagcattattcataataggcaagaagtagaaatgacacaaatttttatcagctgatgaatgaatacataaaatgtggcttatccatacaatggaattatttggccaaaaaaaaaaaaaaaaggaatgaagtactgatgcacgctacaacatggatgaaactttgaaacatgctaaataaaagaagccagttgcaaagtaccacatactgtatggtttcatttatatgaaatgtccagaataggcaaatccatagagacagaaagtagatccatggctgccaggggctgagggaagtagaactgtggagtgactgctaatgggcacagagtttctttttggggtgatgaaaatgttctaaaattgattgtggtgttggttgcatagctctgaatatactgaaaactgctgaattgtacacattaaatgggtgtattgtatggtatgtgaattatatctcaatacagctgcttgctagctagctagctagagatattcacattgtcagcccctcactacgtgtaccaggacaacactctgtacttctcaaagacacaagctgtctctgctctgtaaacactacattctgcagaggtgcaaattcagatagccttgttattctcttggagaagtacgtacttctttatttgccccaaatagaaagagtaatggtcccatgatgaatgagcagaaagtaagaccatttgtggctacacttgataaatgcgtcatttttatgaaatctggacagttacaaattaggatgcaatctacctgcctggactgtttagcctgtcgacaataataatcttagggagctctaagagaggttggggaatgtggcagctgtatttcttagcagctgagcacttggaaaaaaaagtggattaatcatcatacatatggtgatccatcaagatacatttgcaaatctattgaaaactgattttcaaaacctttctcaatttgtggctctttgttctcattcaagattttgtgtgaatggtatttggcattatcagcaccaacagggtggaattagttgtccttttaattctaatttggagatcaatctttccatgtctgcagtccgaattttagcttccaagccctagaatcagcagtattattccagaaataattaggagcctcagagaatgccgtgaggacattgagtatctattaagcgtgaggttttgacggtacgaaaagccatttcacttaagatgtaccttgtctcaagcacctttagtgaccccagaaggaaagcattggatgggcggtatgtagatgggctcatttgtcttccttttatgtactaaatgcttaatgaatccatctggaagaatggtaatttgcttactaatacagattttccagggcactgatggcttcaggtggcagacagacgggcctcatgtgttaagtacaaagtgttaagccaacatgtgttaaatacaaaggatacttcatagcctttcagtttgcaaggtatagatagttaagtatcctccttctccaggtcttctcagtttttaggagctattagcttccgtgcaaggcataactggcaccagacctttctaccttgtttgtatgtagtgtgtttggcgaagcaggtggagctggagctgaagcaggttcaggcacgcctccctcacatttctactggaaatcagatgaagcttgagatgagaaaaaaatcagatctatgcctcattcagttatattcaattaagagagaggaaagcatttaatgggttgggattgggttttcaggcttctttcctaagaatttgttttccttctatgtggttgtagaataaatttgctattttattttatttttttgagacagagtctcactgtgtcacccaggctggagtgcagtggcatgatctcggctcactgcaacctccgcctcccgggttcaaccgattctcccgcctcagcctcccgactagctgggattataggcgtgagccaccacacccagctaatttttacatttttactagagatggtgtttcaccatgttgcaaggctggtctcgaactcctgacctcaggtgatctgcccacctcggcctctcaaagtgctgggattgcaggtgtgagccaccacgcctggtgtaaatttgctattttaaatagcaatgatgatgaggtataattaagactctctgtttagtgttagggcaggataataatagtagctagtatgtgttgagccatggtaagtacaggttgagcatcccgtctctgaaatccttgggaccagaagtgtttccagttttttcagatgttggaatatttgcatatacataatgacttatcttgtggatggtactcaagtctaaacacgaaatgcatttatgttttatatacaccttacacacataacctgagataattttatataatattttaaataagtttgtgcatgaaacaacgttttgactgcaacccatcacatgtcagatgtggaattttccacttgtggcatcatgttagcactcaagaagctttggattttggagcattttggatttgggagttttgggttaaggatgctcaacctgtatgttatatattagggctgctcaacttgtaactttacagagaaggaaactgcggcactgggcctttcccgggacccacaggtcagaaaaggtgaagcgggtctgaattaagagctttctttaaccaccttggcatgctgcctttgagggtaaataatgtccctgtttcaaggtgagactgaacactgatttgtgcttaatattaggacaggagataatctataaatagatatggttctgtttagatttgattccaaacctaatggtgtatgtaattacatgattactactattaatacagaacactgtttggtgagatgccaaagtctgtatttcatgcaggaaactagactgacagctacagcttaacacactaatgttggtaattagtgaagctctcgcttaactaaatgggccatttgcctttgaaaccagtgtgtaaatagaaatagagtaatctgtcatcccaatccacctcttttgtccttagtttgaggactggctgtagttctttcccaagctatccagacatttcaaacaaactgtgcacaaaaaatattaataaagaagagaaatgctgaattcctgatgggaattttggttgagtgaatccaatgtctccctccatccagggcctgttaggctcttattgatgggcaaggataagcctctgggtctaagtgcattagcaggatataacccattcccctctttccatacagatgctgtgtctgattggtctcctatgcatgaagctgcaatccacggacatcagctgtctctgaggaacctcatcagccaggtagctttttgaaaatacaatacagaagaaacctatcaaaatattaaaacaaatgtgtgacataataacatagggacttttaaattaattcattaaatagaagacctagtggtgattctagtaactaccataacgtctaaataggatgagtatagattttgagatattttagatgtctacagcaattgtaatacaatagaaaatatctgtaatttctattggagataaccctacataatactattactactgtggtttgttgtctacattctgaactgaaggaaatgctaaatttcagatagagctgagtgagaataaatgtgctttaaaaaatccaatttcatagacctatctagagtaagaagtcctcctataagaaaataatttctaaagaaaaatttcatactatcctaagccactatcttaagccatttttggtagcagcagtctattataaatagattataacactaattctagctaaaagaagttaggctacttctcagataaaattagaaatttaccctattttgatagcatgaaaaatgatcactgcagcttttatatatcacttcttaaattggacagatactcatttacattcagtatttatgtgtttatgaaacatcagccagaaccatatctccaagttctatcacattatttgtgtaagatgtctttttagagccccggtttctgctttcataaaatgagtattctaatacctacctaggtcagtccaccccataactcaataacaaaccatcccaaaactcagtgacatgatacagtaaccattatttcttgctgatgtgtgtttgtgtcagttcatctaggctgggcttggctgggcttggctcccagctgtgggttgggtgtagccctgctgcacatctctttcatcctgcttggaccactggctacctgaggaattattttttcttggcaaaacgctggagcacagcaggacaagccccaccatgcaagaatacttccaatctgttcatgtcacatctgctaacatcccactggtcaagtcacatgaccacatccaaagtcaaggctcaagagaagtacattttgtcaactaagcgtagttgacgactgaaaatagatatattaaagttaagccattcaatctttttttaaaaactaagaactgactgtggactgaacactgtgaagtaatgggttaattaccttatgattttatatgactcagacttgttaataatttagacaaatcacagttaatttaaggtagaactgtagcttgatgatgaactacaaatgagtttctaactttacagaaggaacctctctgcaatgtgaatatgtggtgaaaactttttgtgttacgaatagctgtgttgttgtatttcatttacgtggatttatgtataaacacctaaatgctggttttatttttatcattattattattattattattatttttttgagatggagtttcactcttgttgccatctggagtgcagtggcgcgatctcggctcactgcaacctccgcctcctgggttgaagcaattctgcctcagcctcccgagtagctgggactacaggcatgtgccaccacgccccgctaattttatatttttagtagagacgaggtttcaccatgttggtcaggctggtctcaaactgctgacctcagataatccatcagccttagcctcccaaagtgctgggattataggcatgagccaccgtgcctggtctaaatgccggttttacaatggcagttgtgcctggaggagtatgcacattttcctattggttgtttttatggttgccttttgcccaagttctgtacctcggcctgccttcccccaacttgtgtctgatacacttgcatgatttttgcttcatgtgacaatcatacccctcttgtggcattgacaaagctactttctataagtgtgatgactgtgagaaaataagatattttctcctgccaattggacatttaagtcttaggtatgaatagtaaagtaagaaatgacatattcttttctttgatcacgacaaaagttggcacatttttttctttctttttttttttttttttttgagacggagtcttgctgtcgcccaggctggagtgcagtggcgccatctcggctcactgcaggctccgccccctggggttcacgccattctcctgcctcagcctcccgagtagctgggactacaggtgtcccccacctcgcccggctaattttttgtatttttagtagagatggggtttcaccgtgttagccaggatggtctcgatctcctgacctcgtgatccgcctgcctcggcctcccaaagtgctgggattacaggcgtgagccactgcacccggccaagagttggcaaatttttttcagtaaaggaccagatagtaaatattttaggctgggaggctgaggcaggagagtggcgtgaacccaggaggtggagcttgcagtgacccgagatcgcgccactgcactccagcctcggcgacagagcaagacatcgtctcaaaaaaaaaaaaaaaaaaaaaaaagaatcttaggccttgcgaaccatgcagtctctgttggaagtacctaactctgctgtttagcagaaaagcagttgtagacaatatgtaaatgaatgggcatggctgtgttctgataaaactttgcttatggatgctgaaatttgaatttcataaaattttcacgtgtcacaaaatattcctttgatttcttttaaaccattaaaaatgtagaaaccattcctagctacagaagcaggtgtaggctagatttgactctgtaggctactgtttgttgacccccttgtcaaaactatgatagagctaggaaatctaagaaaaacaattaaatgtcaggaaaaggagggtttttttgagaaaaaaaattgggtgaaactgatatttttattacaaatattattaaatcctgtgtgttactaaatacttatgtttaaagagcaattatattagttaataggtacatttcaatttcctaaaataagaaagtacatttaggcttcctaaaaggtacatgcagcagtctatttcttttccctcgcagtttgaaaatttccttttaattgtctcacaaggtagagccacttgtgaatatgttaaaacttaataattgcttgttaaaacttagcaatttgggccacgctgactttaaaaaaattgagaaatttcataagcatgaaagaacttaaacacgtgtgcagttgaataaaaagtgatgatgatgagaatattgccatgtgactgcctccccaggtcaggaaatggaaaaatagcacaatgctggctcctccaaagactcacccatccctccccttattgtgctttctagaacacaatcctgtccctcttccacaggagtaaccattatcccgatttccttgttttctttatggttttactctatatattatgtcttctgaaacaatatggggtagttttgcctaattttgaactttaaattgatgtaatcattcagtgtgtatgcttttggattttgcttcttttgctcaacattatttttgcaagcatcacccttgtagtgcttgccattatgatttgttgggtgtaatctttctgctgaaagattataccaaagttaattaattcagtccattgttgatggacatttggtttgtttgcagtttttgactattatgaccaatgctgttgtgaatattcttgtatatttatctagatgtatatatacctaagagtcaaattgctgagtcataggcatatgcattgtcagctctaatagatacagtcaaactgttttcctgagtggttataccataccacactcccaccagtagtgtggcatttttttttttttaaagtcaatataaacaccttagtgtaacatctgactttgagccaggtcagctttgtcatagtactggaatggtggctgaaaagcagccccagggcactgttgctttgcaccccttactctgactgtttcccctccttcaggggtgggctgtgaacatcatcacggcagatcatgtttccccactccatgaagcctgtcttggaggtcatctctcttgtgtgaagattttattaaagcatggagctcaggtaagggcagctgaaacaacatcttagaaaccaagaatgaaaaatgactatgtatatcccttctgaataacttccagcacttttgattagactgatttgaaatatgaagacagttgtttttcaagaaaattatgttcatcaggcttgtttgctttagtgatggatggatgaaatactaaatttttagtcacgcttacagtctatatcattttctttatcatacactactaataaatagttattagacttctgtcttcattgttatggccggaaggtaatgaaatattgtggaaagcacacatttgcctgggatggctaggatgtctgaggagacagaaaatctatgtggtcattcatcctttagctggcaacctggacttgttcacatggtagcagggattgcaagagcagcaaaaatggacctgttttgtgttaggcaactgaatggtgggttggggaaaattatgggcttgctatcttctggcaacagcaaatgcaaagtcccagaaatgatagtgagcaatttttatatcttgaagtcattccttacggcaggacagtagagtaggtgagagggttcagaacataagcaaccttgtccatgccaaaaaaagaatgggctttgtcctgagatcagtaaagagccagaggtgagtgcactgccagatttatatttgggttaagaaaacattcaaaacttggaaacagggaacgtgtcaaggtgaagcaagagacacctagggtacaaacttgaaagaagtgctcgctctcagggtcctgcactatttgtgtgactccaaaaatgaatatgtccttaaattttttaccctgggcaacttttatgtctcactctggtcctggccctgcttggaagtagagtttgagaaggaattcgttgtcttcacaatatcattgcttaaaagattcaccagataatcatttaatgatatacaagaatgtgtctgcacttggcttttctattcactatttaattatagcccaaacactgtgaagttagacattaacttcgaaatttctgtctgatttccaacattagaaaagatagcctcaaagattatacttttatggccctataggacattaaccagtttttatgtttttatttttttaatttttgagatggagtctcgctctgtcgcccaggctggagtacagtggcacgaactcagctccctgcaacctccgcctcctgggttcgagtgatactcctgcctcagcctcctgagtagctgggattataggcacgcaccaccacacttggctcatttttgtatttttagtagagatggggtttcatcatgttatcatgttgcccaggttggtctcgaacttccgacctcaggtgacccgcccaccttggtctcccaaagtgctgggattacaggtgtgagccaccgtgcccggcggagttttgtatctattagcaaatatatttcagcagtccattgactatatacgtttttcttttttctttctttttttgagacagagtctcactctgtcgcccaggctggagtgcagtggcgtgatctcggttcactgcaacctctgcctcccgggttcaagtaattctcctgcctcagcctcccgagtagctgggactacaggcgcatgctaccatgctgggctaattttttgtatcttagtagagaccgggtttcaccatgttgcccaggctggtctcgaactcctgagctcaggcaatccgcctgcctcggcctcccaaagtgctgggattataggcgtgagccactgcgcctggccaaatgtttttttgagccagccttaccatcttactggttccctcattaatgagtgagttgaataaaatcttgggtatgtgttaattctatatttgtatgaaagtcaagttttttaaagttttctaaattatactttaagaatatactaaattacacagctaataatttcaacaatttcctcacagcagcaagagtaatcttcttgcacccgttaagaaattgaattggtgtgggatgggtctaggaaagaagtttaaaatagggattagtttgtaagcgattgaaattatcctaactagtttcaaagttcatgttcctggggagggcatggaggagatagaacattgagtaacattttcgatgctttatagccactccctaattccatttttcacaaaaacctgtggaatttcgtagttatttctccattttatagctgaggaatttaaggctcagagatgttaaataacatcttcagagtggtggaccccacatttgaacccaaaacatcccccttcctgtcttcattctggagcttcttttaccaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggtaaatctgttgagaatttttttttctacccactccttcaagggacatcttactgctgaaagaaagaaagaaaaggagatatattttagagcagtagttctcaaaatggagtcccaggactggaagcatcagcatgacctggcctgcaaatgcagattcttcggcctcactccagccccattgaatcagtaactggggatggggctcagccctctgtattttgtttaataagccctccagctgctttctggtacacagtaagtttgagtgcctcccttttagagcattttgaatgtttttcactgctgtattactgaaacagggcttggcacatagtagactatccatcaatatttgtggaatccgttgttatacccgtgaccttatagaaatcaagttatttcataaaacaaattatattcttctatttcagggccttaaagaacattgtctcagtgacacttaagtttgccaaatgaaataagctttcaatttttgaaagtatttgatgttgcatacagtttgggataattcttttcattaaagccataatttttctgatagtcttagctcataaaatcacaagtttttattttctccaatatttagcatcatcgtaatgaccataccttgccagagggctttctgtttctccagtggctttcatagaatggcttcccatttgactggaccaacccactcataatgatctcccaaagcattaatattatttattgagaacatcttaactcatcatattcgctgcatacatagaactaaaatacagcaagagaaacgtagaggagcaatgtcaaaaatatgacatcctggaccaaggaagtgtgattcagctttcacctagtttttcagattgggccctgctcatgttggatttggcagtttcttctaagcattgcctatacccgctgtggcctgttcctcccgggcctgcctttggagaggttgtaagtttccttccctgtcccgtggcccacactgtgccctttattcttcagttccaccttcaggtcctgttcctccatatctctcccaagctctcacttcaatttctgtacttagacaaactacaaagccacagacaattgaaaaaggtggatagttgctggttggttaccgtggctagtaaactcaaatggagtttcacccgtagttgcagattgcatcctatggtcaaaccattaactgatagcagtggttaaaatcactcctgatttggccgggcctggtctcacgcctgtaatcccagcattttgggaggctgaggcgggcggaccacgaggtcaggagattgagaccatcctggctaacacggtgaaaccccatctctactaaaaatacaaaaaagttagcagggtgtggtggcgggcgcctgtagtaccagctactcggaggctgaggcaggagaatggcgtgaacccaggaggcggagcttgcagtaagccgagattgcgccactgcactccagcctgggggacagagcgagactccgtttctaaaataaaataaaatgaaataaaataaaatcactcctgattctaattgaaggaaatagctttttggtcccctggataagctgctgccaaatttaatgcaaaatggggatggcaatgtctttctagctaagggaacttgtattgtaactgtttttcttcctgctttgggctgcaggccacgtggagtgtgtcaactctcttatagctta

SEQ ID NO: 3105 - DNA, 33927 bp, human
atacagagcataagccaaaatggaagatggtcctgttttctatggctttaaaaacatttttattacaatgtttgctacgttttttttctttaagcttttaattaaagtttttttggctctcctaacccatttctatatcgtcaaaggaaatagaaaagaagcggctaggatagcagaagagatctatggtggaatttcaggtaaaagtacatgaatttgttcctaatatttaaagaaaatccctcctagataattcatatgactagtatttctggaaggcagattatatttatactttgattttaagtgggtagtttgaaaaattgtcacttaaagtagcaaatgctgttggctgcatcaatttgtggaggattttcagctttattttttgcaagttcgtagatcttgtagcagttgttatttaagaagtaaataggtagtggcttactaagagtattttgagaaacttcatttctactagccaaagtaattacttgtatataattattttctttaatattttaaagcaaactttaacaatgaagggcattctaaccagactaaattctctcaggaaatagaatgactaataaattataattaaagcagcaaacgtggcaagctatgtgtattttttttgctgtcatttgcaactggaattgattaaccacttgtcactgtcaggaaaagctcttcactaaacccattttatatggtagcatgcaaagcactccaaacaaagtttattctaacatgaaatgccaagatttgggcaaaacattttaaattctcatgctttgtagagaatagtgtccatttctttcaagaaatgatttactttaattgtggtgagatgctacaaaagtaaatgagtcagatatccctgtcactcctgggattgtcacttaatagaggagtatttattcataaacagagttcagaatttccccgtgtatttttagtgtttgcaggggttccaggattacatcattctttatctagtatccatttcaatttgcatccaggattctctttcaaaatagtcttatgtgattccaatacactagacaactcagaagacactagacaacagcagtcttatctaaagaaataagacctccaaggacgaagcatcagaatgcttcaattaactggggaaaatgagaagaattgtgaagtttcagaacgtatcagaaggtccggaccatggaaagagatttcttttggggattatatttgtcacacatttcagggaggtatgttactttgactagttacaaaaaaaaaaaaaaaaagtaatgcttctgataagtttcaagttaagcatgatctgaaaagttatcttctaatttaatttgtcaatttgggcaagggctttctaaaattttcaataatagttttggtgttctcatagataaatcattcttctggtctaaattagatgaagtccaacaaagtcaatattggcaagaacatgttacaaatgttttctcctgttgcacctgcgcattatttctgtctttgtggtctttaattaagtgcactctttttttttttttttttttttgagatggagtctcgctctgtagcctaggctggagtgcagtggcaccatctcggctcactgcaacctccgcctcccaggtcccggttgaagcaattctcctgtcttagcctcctgagtagctgggattacaggcacacgccaccatgcccagctaatttttttgtatttttagtagagacagggtttcaccatgttggccaggctggtcttgaactcctgacctcatgatccgcccgcctcggcctcgcaaagtgctgggattacaggcgtgagccaccgcgcccggcctcaagtgcactcttaaaaaaggtataaaacctccttatagtcaaaacccatgtaagcatggtttgaatttaatctggagctggaatacaaatctcttaaatacagttcgttcattctgtagtgcaaatatctttacttgttcaatctcttaaaataggttaatttgcaagtagcatagtattctaaggtcaaaaacatttttcaattattgttaaagaggcagggaatggtgcatgttaatttcccagttttatttctttcatatatatatgtatatgtgtgtgtgtgtgtgtatacatatacacgaatccccccacccccaaatttaccaagatttggtaaataagactttctgtttttttgtttgttttgagatggattcttgctctgtcacccaggctggagttcagtggcacgatcttagctcagtgcaacctcctcctctggggttcaagcaattctcgtgcctcagcctcctgagtagctgggattataggcgcacgccaccacgcccggctaatttttgtatttttagtagagatggggtttcgctatgttggccaggctggtctcgaactcctgacctcaagtgatctgcccaccttggcctcccaaagtgctgggattataggtgtgagcacctgtgcctggccgctaaataagtctttctataagaatgtaggcagtaacatgcctggaccagtatttttcacatggttctgtgtttttcttttgataccactgttaacagtcagatactatattattacaaatcttcccccgccccacaaaatacttaaaaaataacaactctttattcaaaacccagtcctttaaatattaatgcaactaggccaatacacctaaacaataaatcctcctcaacccctcagtctctctaattcctaaattatcccataacaatatatttaggtgtattaaaaatcaagaacaaaattttgtggaagtgttaaactcaaaccagaaatcaaactcaaaccagaaatcacctttgcttttggtcacttttgcactggtcagacaaatgtttgttgggaaaatatatgacatttaatcagtaaattagctaattgacttacaaaagtcccagcccaaggttaagtttcttgagtctgctagcatatgctattcctgtaaactattgtcagcaatgtcaaaagcaaggaagggcaggaaaaacctagccagcacacaggttagacttttgtaggtccagagcactcttttttttttttttttttggaagctgcatttaacaccacatgcctcattaaatatcattctttgtgctgtaaaaccttttggaaagttgtttttttttttttttttttgtgcagtgggcgggtgggggtggatttcatagtctggaatacattattttatatgtctttgtggcttaaactattacatttgctgatcactcatcatagttgaattaagccatggttgactgttattagttttggtttttaagcttctttgtttattttgtctattatatgtatatttttttttcttttttaaagtttaatacattgtccttggcctttggtgttatgcctagagcaccagatggatcactggatcccaccttcagtccatagatatttctgcaggcactttctcaggagagatgtattgtatgatttttcaagctttgctaatttgtattaagctatgtttagtactgtgacttggtcatcaagaaagaaaatatagtgtagatacagattgatcatctgttattcataacccttcagccagccatgtttcagaattcaatagcttttgaatgttagaaagatcatacaatgtgcatactgtctattgcacagcacttctggtggggcctggagctgcctcccacagtcaaacattttgatctttctatagtgaacatataggtattcacactagatggaaatataaaacaaataataaattgcttaacctaagtcctggccatgctttgctgctaaacaagtttgcatcaaatttggggtaaagcttggttttcagaattggaggaactttacaagtgcagataagacgttgtagaactgtagtgccctctttcaaaaaaaaaaagggctattttaagctgtgtctaaaagatcagtcctattctaagttttatgcttaaaatcacttgttgatggactgaccatgatttgacagctatgcctctgcctaactcagcattctgaatcctttttcctgtcttttccattccaataggatcgccttagtttcattcttgcccaaacctcgacctagccttctgctcttatttagttttgctggttgtctccacaaacattggcctaaccatcctctaagttgcatatcaggtgcctgctggcttttcctaggttgggacaaccagtccttggcagaggctctaccttccaccagtctcctttagctcagctctcccgcccttaagagttcaaaggagccttctttctaatacactgcaacatagttaattgtgtctaacacagctcactgtgtctcatctcctctctaggactggacattctggagaatatttattttaactcagttttattacaatattttagatatctcaggaaatacattctattttcccagttacctttgtttcacataaaataccattaattctgctaggctcttgcctgtattttggttcaaaattaaaattccttatgaattttcttttccttaataaatgctacagaagatttgtttcatatgattttattttttattttttgagttggagtttcgctcttattgcccaagctggagtgcagtgatgtgatctcggctcactgcaacctctgcctcctgggttcaagtgattctcctgcctcagcctgctgagtagctgggagtacaggcgcccgccaccacactggctaatttttgtatttttagtagagacagggtttcaccatgttggccaggctggtctcgaactcctgaccttaggttatccacctgccttggcctcccaaagtgctgggattacaggcataagccaccgcgcccggctgttgggtcatctttttaaataaaaaaacagtaatctgaaatacttgttgaaattagagtaaaaattacaaaaacagtttaatcgttttttatctcaaatggttggaacttagacagctgtactccatctgaaccaatgttattgaaatatatacggttttagaagttgttgtgaagttgtcattcaaacagtctgagatacaaatcacattctgagaaaaattcaaagggggaaatgaaaaagcacttgaacattttccgtacacctcatcaggaataagcaaacatatttgtagagtaaactatcttcataatgtgtttgcagccctgtgacacgggcgatctgccaaaaaactaaaaatagattgccttagaagagaatgattgagtcctacttaagcattcatttatttggagagctcagttgcatacttcctgaagggaatggaaaaactcccaagctgccaagtaacttttatcctcaatttctcacaattagctccagtttgcaaaatgagaatggtaagagtgagagactctgttgggaacaaggatagaaaagcaggagaccccactgtggcagtttctggaaaagggttctgtgtgaaaacccttgaaggtcctttgaagcaagttctgggaaatgatggaactagaaaggctactttcttgagagttacttcgtttccagttgggaaacaaaaaggacttctacttttttttttttttttttttttttgagacggagtcttgctctgtcgcccaggctggagtgcagtggcgcgatctcggctcactgcgagctccgtctctcgggttcacaccattctcctgcctcagcctcccaggtagctgggactacaggcgcccgccaccacgcctggctaatttttttgtacatttagtagagatggggtttcaccatgttagccaggatggtctcgatctcctgacctcgtgatccacccgcctcagtctcccaaagtgctgggattacaggcgtgagccactgcacccagccctggatctctacttttagggtggtacaattggtttatttcacaccatttatagcagtggtccccaaccttcttggcaccagggactggtttcatggaagacaatttctccatggaccagggtgtggggggatggttttgggatgattcttgtgcattacatttattgtgcactttatttgtattattattacattgtaatatataatcaaataattatacaactcaccataatgtagaatctgtgggagccctgagcttgttttcctgcaactagatggtcccatctaggggtgatgggagacagtgacagatcatcaggcattagactcataaggagcgcccatcctagatcccttgtatgttcagttcacactcttctaagaatctagtgccactgatgatctgacaggaggcagagctcaggaggtaatgcaagcaaaggggagtggctgtaaatacagaagaagcatccgggcacagtggctcatgcctgtaatgccagcattttgggaggccgaggcaagtggatcacttgaggtcaggagttcaagaccagcctgggcaacatggcgaaatcccgtctctactaaaaatactaaaattagctgggagtggtgatgtgtgtctgtagtcccagctactcgggaggctgaggccagagaatctcttgaacctgggaggcagaggttgcagtaagctgagattgcaccactgcactccagcctaggggacagagcgagactccatctcaaaaaagaaaaatacagaagaagcttcacttgctcacctgctgctcacttcctgctgtgcagcccggttcctaacaggccacggaatggcccaggggttagggacccctgatttataaagaggaggtggatgtcagagcaacccaagacaagtcaatctaccacgagaataaggagaaattaaaaaccaatagttcttaaaaccagaacaaggtgtgttctaaagtccccataactagggtttcagtcctatttctgatacttcctagccatgagacagcttcatgtggagcagtggttgtcatgcattttggggtgttaccattcagcaaagcaaggcttttccccccttcactggaagctatgggatgggtactctgggagcaatacaagtttagataaggggcattcaaaaggaggggagcctggaatttcactctcaagttggaaatctgcttagagagacaacttgctgaaccccccatgccagatgaatatgaggaagagaattggaaagcagcaatgtggtgagggagaagcccaggacaaccaccattccctctttcttggtggaatgaaagatggcaccacaggcttgttaaccttgatctcagaggcacaggatcagagttggggacatcagaggatgctgcagtgatgacagacactaggagaggtggccaaatgccaatgggtagaaaaggtacatgggtgtaagccccagtgtgaagggcatgccacagacctggagtgaggcctgcagttgagactgatcaagcaggaccagcctcctcttccagttaacacttcccatcccatttccctttcctgtccctcttgtttctccccactcccaaggcactaaagggttggaccctagaagaaggaggtgggaagcatgtgaagaacatgctgcccttctgtctccagctgctgggtgggctggagaaggccataccctgccctgggagtgggaaaaggccaggagctgtgaagaggatcagagattacagctagaaagagggctagtctgtgttactttagaaactcttcatgaaagtatgatgtaaatacagagacatgcacaaatcctaagtgaacaactgcatgaattttcacaaagtgaacacagtcaggaaccagcacctaagagcaagaaattgcatattatcagcatggcccccaccatgccctcttgcaaacagtcctcacccctcctcggggtgcttttgactcctaacacccaaggcaagtttcccttccttgtgtactttatagcaggggtctccaacccccaggccacagaccagtaccagtccatggcctgttaggaactgggccatacagcaggaggtgagcggcaggtgagggacattactgcttgagctccgccttctgtcagatcagtggtggcattagattctcataggagtgtgagccctattgtgaactgcacatgcaagggacctagattacattctctttatgagaatctaatgcctgatgatctgaggtggtacagtgtcatcctgaaaccatcccctgcccaccctcatctgtggaaaaattgtcttccatgaaaccagtccttggtggcaaaaaggttggggactgctgctttatagaaaccaaatcacacggtacatgttcttttgtgtctggcttctttcactcaacattaggtttgtgagatttatccatgttgtgtatatgacttgagtctaatgggactgataagtaacggaaagttactagaaaatgaggatcaccacagcccacttggagacaagttttagaaataatgaaaacattcgtgttgataacctatgttaactcttttaattgcaagttgccacttaaatcctgtctttatttttaaatggaatacttacagtaccttcaagtgactcaggttgactggttattgtcagaacaatgaaatgacaaagccacagttatgggtttgcctcttccattggtcagggtgccgagctggcagccatgggtaaagactgtcctaccaaccccagtgcatgcattcacttccaagagcaactaggcaagagcgtaacatgtctgaagtacatttcatattgaatgagatgcagacatattagaggaaaagcctcactaattggtaattatatgcatacattgtctcattatttccagtttatgcaaattataaatatccaaagagttgttgttgttgttgttgttgttgttgttgtttgagacaaagtgtcactgtgtcacccaagctggagtgcaatggcgtgatcttggctcactgcagcctccacctcccgggttcaagtgattctcctgcctcagcctcccaagtagctgggattacaggcgcctaccaccgtgccaggctaatttttatatttttagtagagatggggtttcatgttggccaggctggtttcaaactcctgacctcaggtgatccacctgcctcagcctcccaaagtgctgggattacagcgtgagccactgcacccggcctcaaagagagtttaaaatattctacttgtcagctttcaaccaactaaagacaagggtaaatacaaatgcaatatatgctcatgttaaaaatttttatctgtttttgaaataccattcgactcagcaatcccattactgggtatatacctaaaggcatatgaattgttctgttataaggacacatacgtgcatatgttcattacagcactaatcacaataacaaagacatggactcaacccaaatgcccatcaatgacagactgggtaaagaaaatgtggtacatatacattatgcaatactatgtagtcataaaaaagaatgagatcatgtcctttgcagagacatggatggagctggaggccattatccttagaaaactaacaggaacagaaaaccaaatgccacatgttctcacttataagtggagctaaatgatgagaacacatggacacgtagaggggaacaacatacactggggcctattggagggtggagggtaggaggagtgagacgatcaggaaaaataactaaaggatactaggcttaatacctgggtgatgaaatactctgtaaaacaaacccccatggcacaagtttacctatggaacaaacctgcacatcctgcacatgtacccctgaacttaagataaaagtcaaaaaacataaaattgatgatgtctattgcatataattattttctttggaaaattttttatctgtttttctttgttattataaaaagcaatacacattcatatcaggagtatgggatcaccagtgattctatctatctatctatctatctatctatctatctatctatctaatctttttttttcttgttaaaatgtttggaaataatttcagccgacagaaaagttacaagaacagtacaaaaaaattcctgcttctcttcacccagagactccattcatgtttagccaacggtcctaataatgtcctttatagcaaaaggatcaggtgtcttgcctttagatagcgcgtttcgtcatccctttcaatctggaactgttcctcagtctctccaattattttgtaaaatgtcccctcagtttgggttggtgcacagtttcctccttatcagattttggttatgcattttgggcagaaatatcacagaagcggtggtgtgttcttctcattatgtttcttcttatggcacatgatgttgctcatcgcattccatcagatgacaatctgttccatcactggtgttaactttgctgatgttaactttgatcacttgggcaaagtgatgtctacaattctgttctataaaattatccctgttccttttctagttagtcattattttgcagggagatgagttgaagctgattctattatttcttcaatttctaagttgggattttattataaggaagcactttctcttctctgtctttatatattcatttatatcagtgaggacttctagattaccattttatttgataagatataatctcttattgtttattttgaaatcaggttttcccatatttggccaatggaagccccatcaagccagcatctgtgtctttttgtcacccaggccagagtacagtggcataatcttagctcactgcaacctctgcctcccgggttcaagcgattcttctgcctcagcctcctgagtagctggcactacaggcgtgcaccaccacaccctaatttttgtatttttatcagagacagggtttcaccatgctggccaggctggtctcgaactcctaacctcgtgatctgcccgcctcagcttcccaaagtgctgggattacaggcgtgagcctggccagcactttcttactttcttggaagatgtttaaggcccatcttgtattttacctggcccagacctgggatcaacatttctctaaggagtccgggttcaggttttctcagtgcaccatgctaaaaaaaaatacgtatatacgcacatctatgttttacatttaaatttacttttatatctagatatattgaaaatcacattttcatgctaattgctccaatatcaatccaacctcgtaaagtgcattcaagtttcccccattttcagaacccaaagggtgagagaagttcatacattgagtttcagtgtaggaggagggcttattgaaatgtttctaaccctgattctcatccactggaaaaattctttctttccttaaggccttcagttatttcaaattcacacaattccatttttgctgggattttcgtttcaccaagtttataggtatggaaacctgagtttttaacaccatcaggatcacccacaagaggttgaggagcctttgtgttaaatccaaattatattacattctattcagtgcatgaaaagcacaaccataatgtgaaaaagtcctacattttgcaaactggagtaggttttcttccaaaacaattgattgccctttggcaggtttaatggggggttacttctcaaatgctcatttaaactagttagtcttgtttgcagataagcaattataagaaaaatatgtctggaaggcggctctaaggctgttccttatggcactgctctactgtgcctacttattaatcatacaatgtccggagcacttaacatcgcggttgtatttgattggcctacttagagaccaatgcacttgacaaatatcagattattatatttccatcttaccagtaaggaaactggggttcaagtaattttggtaacttgctgaatttggcagagaaagtgatcaaggtaggacttgaaccctagcagtctggctccactggcccatgctcagtcatcacactaagctgcccacaacaaagcttttagggaaaaacttttgggagattaaattgtctgaaaaatgacattctgcagtataatagatatgtcttcattatcaaatgaagcagataaaattacctagagaatttggggaaaaaaacattttcactgatccctcagagcaagcttgtccaactcgtggcccaggatggctgtgaatgtggcccaacacaaattcataaattttcgtaaaacttacgagatttttttgtgatttttattttttagctcatcagatattgttagtgttagtatatttcatgtgtggcccaagacaatactccttccaatgcggcccagggaaaccaaaagattggacacccctgccttagagtctccttcataatacacaggctgttgagtctttggggtgtggatgaaggtggaaggcaggggaaggataaaaatgtggaggctcattgactttcttggcccttcattttgccttacatagagctatcggattcaagcactgagcactatatttttgaactaaatctattgcttattaaaattgcctcccaaaagccagagagattgactgttccttctcttggcacgcaccaccaaaccgtaaaggactttaacattcagtagcttgtctccctgaaagtggctgacgagagagcctgatgcgtgatacctgcttccctcctcttccctcctcttcccccaaacctcctctcacagtgggtgggcagcatggacaagttacaggaagaagtctccaggccttgactttgagcttgatttgtgtttcagattgctgggctgatcgatccccacttcatgaagctgcagctcaggggcgcttactggcccttaaaactttaattgcacaagtaagtgaactgaagacttgatccttcatgcttatgctataattacacatcattctttattagctttggctgtagcagaggtgtggctcaccctatccaggtcccaccattgccattcgaggcacgtatgtcctctcatacctcactgcctctcctcctcctgcctctcctttcctggagagctccttcattttcagcccagttccctccttttcctctgggccttcctttacctcataagaagtttccctatgaggaatgatagagaatgctctcaaatgtttgttgcactaactcacctcatgctcttccagcatgcattagcaccagcagtcctgaagctaagttagtcagctattgctgcctaaaaaatgacctcaaagcataatggctgaaaacaacagaaacttggattttcatggtttctgtgggccagggagcagcttagctaggtgattctggctctgggtctctcacaggctgccacgtgtcagccagggctgcagtcatctcatggctcaaggcgggcaggatctgctttcaaactcactcacgtggttgttgggaaacctcaattccttgccacatgagcctctccacagggctgtgtcatgagatggcagctggcttctctcagagagagtgcaagaggtacctaagaaggaagtcacagttgttttataacctcatctccgaagtgacattctgtcacttctgccatattctactcattaggtgtgagtcaacaagtccagcccacactcaaggggcagggattatacaagggaggcaatacctggattccaggattactgggtgctatcttagaggctgcctatcccaatgatacactattttaagaacaagcattaaaataggttgacaatgggtaaatctgactccccagggaacatttattgaagtcttagttatgaaggctactttatttatatttatgactacatccccagcaccttgaaaaatgagtaggggcctggtaagtatttgtgaaatgaatgaatgaaagtgtgcaggctccatttgctttgtatgttttagggtctacatttatacagaggaggtaagccatcatgtctttcttccacaactaggcaatcatctggctttcttgctactttgaatttaaaccactgggtgcactgctctctctctctctttttctttctctctctctctctgtctctctctctctgtctgtgtgtgcatgtgtatgtatttttcatttatttgttttttgatttctcctttatgagttgtgttacttcttaaaaagtagaggtaaatggaaatcagcactgccagcaatgatcaaatgaactttgtacctgattttatcacttgcttatttatttttaagtactttaaattggatgtgatttgattatttttaataggtaatatattcacatagttcaaaaattacaattatttaaaaaggtggactggccggatgtggtggctcacgcctgtaatcctagcactttaggaggccaaggtgggtggatcacctgaggtcaggagttcgagaccagcctgggcaacatggtgaaaccccatctgtactaaaagtacaaaaattagccaggcgtggtggtgggcgcctataatcccagctacttgggaggctgaggcaggaaaatcgtttgaacctggcggggtggaggttgcagtgaaccgagatcgcgtcacttcactccagcctgggtgaaagagtgaaactctgtctcaataaaataaataaataaataaaattaaaaaggtgcacaatgaaacgtcttgcacccacctcttctctctcagtctcccacccacctcttctctctcagtctcccacctcaatactttcattggtatatttttaataggctttttaaatttttgtataattttaaagaagagttgaaaaggatacagacagttcccatatacactgtacccttcacccaacttcctttaatattgacatcttacatagctatggtacattagtcaaaaatacgaagttaacattgatacaataccactgactaaactgcacactattgtgatttcaccagtttttcctctcatgtcctatttctgttccaggatcccacattgcactaactatacttaataagcatattagcttcaataatatggttaaatgtgtaagggggcattctttatacaaaagttcaactttttcttttacacccctacttctttactcttatacactgttaaaaaatgtatttgtctacttttataaactttattttacatttagataatatgatcgatgtgagtaaaacattaaaccgatatgagtaaaacattaagctaatgtgagtaaatgtgagtaaaacattaaaccaagattcaggagctcttggttacactgctggctgtcactgacaaccagtcttaaaaagtatttgaacattctactcctccattttctcatgcacaattgaggtgatccactctagatgatctttcaggcctttccagcatcacatttctacaatttcagggattctgagattttgcaccgtaacagttttttctagcacacttctgccaccttgtggactagtctgttttttcttattttctcaaaaggaaaagaaaaatgaaaagactttttctaactcttattagatgcccagtttgaaatatgtagcacagatctagagtaatgatgtcatattcaggacatgaaaatagacagaattcaggagtcaaaaagaggccttatgatgaagggacaattctgggaaatcacagctgctggccacagcaaggatgcagccagagatctggcaggagatggtggccgtgtaagtaggagttcggggttcagggtcatggcattgggttttggaagctttcagttggtcagttacaaggcataggatcaaaagcaggactcggctgggaaggacagaccagggacctaattccttttataaatcaaaaataaaattctaagcaccccctctccaaccatctgaatgtacccctcctctcagccagggcattccaaaactaacctgaaaaactggttcaggccatgacaggaaaggggggttgaacatgcctcattataccctcctcccttttggaactcaggaaaagatgaccagaatttaacatcaacacagaccttaagtctgataagaaacatttacaatctattctctctgaagcctgctacctggaggcttcatccacatgataaaacttttgtctccacaaccccttattgtaacccagacagacatttctattgataataactctttcaaccaattgccaatcagaaaaattttcaatctgtctataatctggagccccaggcccccactttgagttgtccaaccttcccaggccaaacaaatgtacattttacatgtatttgattgatgtctcatgtttccctaaaatgtataaaactaggctgtgccctgactaccctgggcacatgttctctggatctcctgagagcttgtcacaggccattggtcacttatatttggctcagaataaatctcttcaaatattttatagtttgactgtttttgtcaacacttttgcagatagaacgtgatcatcagagggagggaaatggtaagagccaagttgttaaaatcaggttatgaagtcagagttgtccagcagctaggctgaccttgtcatctgtcacatggagtccaggacaaggaaggggacacatggtagtatggggagggagaatgtgttaggacagggtggaggcactcatacctgggtgaggagatgaaggttaggagaagtccgctggccccggactctaggacttcagagacctctgcacacagtggagtcatggctgaagcagtgctgctactccacagcacatgaatcctaggagcacagtctacttactcttaagcctgggagttattgttttgtttcagatccagctcgacctcctgaacttgtctgcactccatcatctatacctcatacctactgttattcacagccacagcaggcccatgccagcctgttcctagactcatagtgacatctctgtggctctccttgctttggtcttacatccctactcctgcaatcaaccctccatgctgctaccagtaagcttctaaaaaggctaatctattagctccagaccctccgcagcctagcagacttcataggtgctccatttcctctaagacatgccctccttgtttggaaatcaaggcctttcatgacctagctccagcttactgtcctcctttgtctcctcccatctcctgcttctactttctgtgggttctttctgttccagaaatccgactgtggccctgccacaggaagcaacaggaagcaacaggaaataacttcctgttgcttcctgaatttgcagtttctattctctcctaatggcatactctttcttggtcttcacagcttgaaacattttatgcttcaagtcttagctaaatactacctcatttgcaaggtttttcttactccccaagccagattcaaggatatcctatgctcccaaactaattttggacatgcttccagtatagcaatattcttgctcttttgtctttcatttctgcctccccagtaggctctgggagaagagagacccatgtcataagttttgaagacccaggtcctagtacattacctgctccagaatgcagaattaacattcttttggataaatgaatgtgaggctgtcatgctgtctttaggctcccctgatcgtaacttctacttctctctctatggtactaatattacacccacagactgtgaaaatgtcagaaacatgtgaaacaacattgctttcattgctatcactaatgcagtatttcactctcttctgctgggcttggtggcttgcacttgaaatcccagctactcaggatgctgaggcaggaagatcacttgaggccaggagtttgagaccagcctgggcaacacagtgagaccccagtctgtaaaaaataaataaactctcttctttctaaattatagggtgtcaatgtgaaccttgtgacaattaaccgggtgtcttctctccacgaggcatgccttggaggtcacgtggcctgtgccaaagccttattggaaaatggtgcacacgtgagtactgcccctgcccacttgggtctgtctggccagatgcatctgttaatgtttaatgatagtttaccttccagatggcttacccactgtgggtaagggctgggctggttctatccatgtccgtattccatcatttaggctactcctctctcttcaacttacccccctgtgtgtaaatattcagacatggcaactcacaggaaccttttaaaactgtgttgctgaccttaagaaatctttattgtaccatgttttttttttgttttgttttgttttgtttttgagacggagtctcactctgtcgcccaggctggagtgcagtggcacaatctccgctcactgcaagctctgccggggttcacgccattctcctgcctcagcctccccagcagctgggactacaggcacacgccgccacgcccggctaatttttgtatttttagtagagacagagtttcactgtgttagccaggatggtcttgatctcctgaccttgtgatccacctgcctcggcctcccaaagtgctgggattacaggcgtgagccaccgcgcccggccttgtaccatgttttctttatgcattcatctgttggtggacacttgggttgctttcaggtctttgcaattgtgaacagtgctgcatcagacatgggagtgcagatatctcttggatatactgttttcctttcttctgggtatatacccagcagtaagattgttggatcatatggtatctctgtttttagttttctgatgaacctccaaactgttccccataatggttgtactaatttataatcccactaacactgtatgaggcttaataacaagattttaaagaacaatagaaaacactcttaattcaacaccttaaatgaacaactatttttattgagcaaaattatcaaaatgagcgagcttttaataaataatacattgggggaaacctacagaattgaactttatcttattttaaatttatctccaaacttttttcaaagggtgactgaggtgcaatatataatacagatatcagaatagaatcataaaatcacaacttctaaaaatcttctgtgtttagttgccagatgttctttgtttctaattttgttgtttaactcagtccttgcattatttactttatgagctgcaatgtttttaagtgcttaatgacaatttaaaacattttatatggaaatcgggtttctacatgtagaactgaatataaaagtcttccttgtgaaaactaattttcctgatgccattgtggtcgtgcattttctttttttgttttttttttttccatctttttatttttagacagagtctcactaacactgttgcccaagctggagtgcagtggcacaatctcagctcactgcaaactccacttcctagattcgaacgattcccctgcctcagcctcctgagtaactgggattacaggtgcccgccaccacgtccagctaatttttgtatttttagtgcagtaatttttgtatttttagtgaaaccagcgatgctggtttcagactcctgacctcaggtgatccgcccgccttggcctcccaaagtgctgggattacaggcgtgagccaccgtgccctgccaagtggtcatgcattttcattaggtagtgcttctctaagttaccactcagtcagctcatgggtaatgatgaaggaaggctgtgtgagagccgtttcctttcaagctagatgactggagtcacaggcagactgctgacaatatcaggtcagagaggaggttttgttgggcacaaagagaagaataagacatgtttccttgtctttgtcaattttataaagaaacagccaataaatactgtagcacaccatttaacatttaaatcagaatgagaaacgaaataagagaaagttggtccatcagtagaaagtcccccacaattggcagtcccatgaatacctcaaactcagtgcatttgtaactgagcttatcatgttcttccctctgggacctgctcctcatcttgggttcctagtttcagaggcctggtgaaagaaacatcctcttggtttcccaagctgcaaacctgagagtcatcttatttctttcatctccctatctaattaattaaaaactcctgctaattttactttctaagtttttcccaagtctatcctctcctttatcctactcccatagtcatctaaattatttattatattttcaaaatgatttctttttggccaggcacagtggctcacgcctgtaatcccagcactttgggaggctgaggcaggtagatcatgagatcaagagatcaagaccatcctggccaacatggtgaaaccccgtctctactaaaaatacaaaaactagctaggcatggtggcacgcgcctgtagtcccagcttcttgggagcctaaggcagcagaatctcttgaacccaggaggcggaggttgcagtgagccgagatcacaccactgcactccagcctggcaacagagcaagactccatctaaaaaataaaaaaattaaaaaaaattctttttgtatttgtcttccctaatggaattcagcctactcaaggagaggcaattgttcagcccactcaaggagaggcaattgtcttatcattgtttccaaaacattagcacctagtagatgctcaataaatgtttgttgacgtgaactaagagaaatttataggaaatcgcataagaagacaacttcctagactgagggtgaggatgaaacttagtaaaacacaaatcaaactagtcctaccaaatattttttagtaaaaatatagaaacccctagcaatataaatttacacacattttcccctgaccttgtctgtctctgccatcttagcatattatctttaactttccaatttaatgggggttaggctgggtgtggtggctcacacctgtaatccctgccctttggcaggctgaggcaggagggtcatttgaacccaggagtttgagaccagcctgggcaagatagctagacgctgtctacaaataatttttctaaatttgtgggtcatggtggtgcacgcctgtagtcccagctgctcaggaggctgaggcaggaggatcatttgagcctaggaattcgaggctgcagtgagctatgatcatgacactgcactccagcctggatagcagagcaagaccctgtttcacgggttatattgcaactctggaaacaagtctttttttgtgtccaaagcaaggacatttagaatcctgattatcacaagcatgcatccttagttgttgaagcaaaattgtttcacatcacaaacttgactgtcctatatttcaatggcatcagaggctccctaccactcctgcggttcccgatgttctttccaatctattgctgatacacaaagatgtctcccagccctgctggttctcatgtgcttcccacatccctacaaggtaccaaagatggttgcagacaccatgttgatggctattttctttcctttttttaaatttaatcttttaattttatttatttatttttatttttattttttattatactttaagttttagagtacatgtgcacaacgtgcaggtttgttacatatgtatacatgtgccatgttggtgtgctgcacccattaactcgtcatttacatcctaatgctatccctcccccctccccccaccccacaacagtccccggtgtgtgatgttccccttcctgtgaaaccaacccaaatgtccaacaatgatagactggattaagaaaatgttgatggctattttctatgtccctttggcttggtcatgctatctctagaagtaacagctggcatgtgtaatttgcatggattatagtagaccagagaggaagttgtggcaagaaagacagtagatctgtggagaattgccaaggattttgtaagcatggattttgggaccacagcctgccatgtttgttcatgattcagaggggagtcatattaatggaaaatggaaaatggaaataattgttgttgcaaatgcttattgagtgcttactgggtgacatgtaatgttttaagtgtttacatatagtaactcgctcgatccacccaataacttcatgaggtttcataatactgtaaagatgtggagttccctcacttattcaccagcgtggggaattcctctaggcaaatacataggaagacatacttggagatggtgagaatgaaataacaaatcctttgggtctctctttgcccatcattaggtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtaaatgagccaccacaatgcatgtgaaacattgatgggctcactccaatctgtatgaatcaatggtctagtgttagtcattcaagggtgaccctgatcttcctcaccattagaatatgtgtggcctagaaatcccacagcagtaacttcaatttgcctaaatcttcaggaaataccagtgtggcacaaaagagccctacttataacttcggaatgctttcctgactccaatttcccatttcctggggatggtctattggcaggcctttccagatcctctttgctggtgttttggtggcagctggtacagccaaggcagtagttctgacttccctgaattgtactatgcttatgtctctgtccttagtaggcaagaatagcttatcctctaaagcccataaaataccaaccactaacctaaaataaactatgaaagtatctgaaagccaaggctgatactatctctaatggaatagtaaatataaccgttcataataagttacacaatctagatgggctgatgacttcaaggtcatagttattgaaaagaaaaggctgcaactttccaaagtatagcattggtaatcttgaagctgactctagactcctgtgttgtcagttaatttccaagtgaaggaaaatagtaaatttaaggaatttaaagactgtatgtacagactagacctgaaccgagaagatgccactgaaaggagaaggccatttgtcaaaggtcacacccaaagagcaacattttgatgatagcaagtgagggagttgttctcttatactgagatcagaaatacaatggtgaagttaaaacactctagaatagtgatctttgctggtgtaactggagatgaaatattttatttcaaaaagcaaaagtgaaagatttgttccaggttattaaacatgtcacttgccaattttttccagtggattactttaaatgatgcaaaagacccaaatctaaatttatctatgtattttatgttctaaatgtatttaatacatatttattaattaatagctgatgttagtcatttcccaaacatcatgtaagtcctttaagttgtagagtaatgaactactttggaaatgatataaatgtctttctttcttttttttttttttttcgacagagtctcgtgctgttgcccaggctgcagtgcagtggcatgatttctgctcattgcaacctctggctcctgggttcaagcgattctcctgcctcagcctcccaagtagctgggattacaggtgcccgccaccacaattggctaatttttgtatttttagtagagatggggtttcaccatgttggccactctggtctcgaactcgacctcaggtgatccacctgactcggcctcccaaagtgctggtattacaggcatgagccaccgtgctcagccatataagtcttttttttttaatttttttaaattttttttttattttttgagacagagtcttgctctgtctcacaggctggagtgcaatggcacaatctcggctcactgcaacctccacctcctgggttcaagcaattctcctgcctcagcctcccacgtagctgagattacaggcacctgtcacagtgcccagctgatttttgtattttttagtaaagacagggtttcatcatgttggccaggctggtctcagactcctgacctcaggtgatccacccacctcagccttccaaagtgctggtattacaaaaagtctttattaaaaatttaatattgatttgaagtaaatttttgaagtaaaaattaatattatttgtatttccatacaaatgtttaaaaattgataagtactgagaatggtttgaattaattaagtatgtctgcagtgcttgactgattatatttggagcttttggtatctatgtgcctataaaacatatatatgctcataataaacacataatttgtgtgtctctgtatatttttctgtactgtaaaagcatgttaaggataaatatccacagaatgtaagcatgattagcaaattcattattttatacacttgtattagtgctagctatttaacttttctgtattcatttttaaaactttctgagaatatttaaatttaactcaaactaggctgtttcttgttcttcaaaaaaaagacaagaattattcaaaaatatgtattaaataccctgtattttccaagtagttttagggacttactagatattatttctggattcttatagctctaaacctctatgaacaagctgagtcatagtttgagtcaataccttgacatattgatgctgtaattcaggtataatatttaattatgtgaacaaatagtttgaattgacagtcctgatttgtacattttaatgcatatttatacttaatttagaatttgtgataaatcaggtaggtctaaaatgaagcttacttttatgttatctacaaaaaataggttggctaaattaattagtaatgacatgattttttagggagatatttaaatcttcaaagagaactaactctttgcaagctcccatcaatacctcagaagcactctctcctgaacaaagcattcacaggttgcaaatttatcatgtctatctatttattgggcaaactctcaaaagagaatgcttgcttacatagttgttgttagccactgaatatgaaagtgtatttaaatatattctatacttaagacttctttattctttctcataggtatttttcagactaaccaaagtactgttgcaggccatatatccaatctcacatgcatggataaagaagagaatgagagatttgtaatggagaggcgacagggttctcttgggtttgagcactagcttttcagagtaataataggcctagtcgtttgtccctctgggtcttgtcacttccatttgtaaaatggtggcatcattctggagagtgatttcaactgtgctacttggagcccttagttcagttaaagttaacttgggctgtaaagaggagctggagtggggaagcatgggcatgctcctctttttattggtattattttggtggtttctacctaagatttccaaaaacaaacacaaaaatgtttttatgctacaaaaagagatctaggttatttaattaatttatttatttatttattttgagacagagtctcgctttgtcggccaggctggagtgcagtggcgctatctcggctcactgtaacctcctcctccccggttcaagtgattctcctgcctcagcttcccgagtagctgggattatgggtgtgtgccaccatgcccagctaatttttgtatttttagtagagatggggtttcaccatgttggccaggctggtctcgaactcctgacctcagggaatccgccggtctcagcctcccaaaaagctgagattacaggcgtgagccaccacacccggccaacctaggttatttctaaagcccatttcagataagcaatcctataattctgttaatatttaatatgtcccttacttgagtgagggtatcttgtgttccaccaggtcacagagagtgcatggagatcctgctggcaaataatgttaacattgaccatgaggtgcctcagctcggaactcccctatatgtggcctgcacctaccagagggtagactgtgtgaagaaacttctagaattaggtaatttccaaaattattttcatgaagaaacctgttaactttgttgattttctacagcttcaaagatgaagttcttgtcatggttgaaaaatattcggttagcattttatgtttgaatgctaaaaacaaaacttctctagagaaatgagtgtctgtatttctcagtcctgcttcctttgatgttaactccatttacctggtattgttctccctggttgtcacaagatagctgccagcaatacctgggcttacagccctccttatccatacgcagcaagaaagagcattggctctttttaagtcacatgcccatctttgaacccctcatgggggccaagggaatacaatatattgattagtttaggcctagatttcagcctactctgcatttattaggcttcactggaaacacgagaactgaaactaacaagagggtggtttacctttgggaaatctaggtatgcttgccaggaagatgctggacggtaaaaacagacatttgctacaggctagtttatatctatcctgctacagtatctagtcattttaaaagcaattctaaaaggcatatacagaaaccaagagtccgtggaaaaatgaaatatcttttttttttttgagatgaagtttcgctcttattgcccaggttggagtgcaatggcgtgacctcagctcactgcaacctccacctccagggtttaagcgattctcctgccctagccgccggagtagctgggattacagacgcacaccactacacccggctaatttattgtatttttagtagagacaggattttaccatgttggccaggctggtctcgaactcctgacctcaggtgatccaccttcctcagtctcccaaagtgctgggattacaggtgtgagccactgtgcccggccggaaaaatgaaatatcttgaaactattctttggttaaagattcaacaaacttagcccctgacataaaggtggagatttagtaaaaacctttagttgtgaatttttatcttgaggaagtttttgtcttttttatttcccatcatttactattctctatagtaagttcagaaatcattttttgagccccaaataatataaatactaaataaacttagctttatcttttgtcccaaaacataataactatgtaacaggagcctcaaatactttattttgtatgccacacagtttatacgggaaagcaagtatttaaaatgactaaaactatctaaattcacttttctcaccaaagaatttcaagtagtcttagtaggcattgctgaggttctaggcttgagttgcatattttcaaacatttgtcaagtatgtcatggtacttaaaatgtctttatatgcaatgactatatttgaagctcattgtgctttacattacatttagtgttgaattgtggccatctgttttgttaaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggtaaccaagggctgggtatccattcctcttccataagcacattctctccccttcctgtctcatctgtagcattttttcctttttcttttctctttttaattgaaggtggcattgtgggaggtgataggccctgccgtcactgacctgtcttctgggattttatatgctgtgtatattcactaacaaccaaagggcatttacctataaccagagtgttgctttgtattttatataacaagaaaataaccagaaaaccggctgggcgtggtggctcacgcctgtaatcccagcactttgggaggctgaggcgggtggatcacaaggtcaggagtttgagaccagcctggccagcatggtgaaatcctgtctctactaaaaatacagaaattagccagatgtggtggctggcgcctgtagttccagctacttgggaggctgaggcaggagaatcgcttgaacctgggaggcggaggttgcgatgagcagagatcacaccactgcattccagcctgggtgacagagcgagactccgtctcaaaaaaaagaaaaccagaaaaccttgtttataccccgaaaatcttgaatttccatttctgtcctggcataagcgtatgattgagcaaaccaaaactctgctttgtaatattgggagacaatctgatggcaaattcaaaagacttgagtcagagtctgtaggggaggacacagagtatttcagaaatccgactaaatggtgaggttgtttgcctgttctccagatcagggagtaggtgggtctgcattcttcattgcttcattcccgtttccaccatgagcattaagagcaactactgatgccagaagaggtaaggcgagcatctgaaattcagaagagaaccaattcagaagagaacctcttatgtctatacagtaagaaaatattttcggagcctatattgattatttgtgtgcctgaagaatattaaagataattataattattcagctctacgtatgccaggcactgggctaaatttgaaacatagatcaagctcactgaatttttaaaactttagagcagtgggaactttatatggtagtagctggttgctatgccaggtacaaatgggaaaagaaaagcattgacaaggtcacacagctagctacataatagaattaggtaggattctgagccatctgaccccagagtgtgcacttttttttttttttttttttttgagatggagtctcactctgtctccaggctggagtgcagtggtgcgatctcggctcactgcaacctctgcctcccgggttcaagcgatttttctgcctcagcctcctgagtagctgggactacaggcgtgcaccaccacacccagctaatttttgtatttttagtagagacggggtttcaccatgttagccaggatggtctcgatctcttgacattgtgatccgcccgcctcagccttccaaagtgctgggattacaggtgtgagccactgcacctggccatcagaatgtgcactcttaatgtcataaggccccaaccctgaatcttttgaaacattcagtgaggagggtcttatttcactcaccagttccattttgtgaaaccactacatcatatataccttccaagtagaatgcttggttttaaccattttatgaatagtctttctaaatcagtgcttcttaagatttaacatgcatatcagttcacttgaggatttccttaaaatacagattctcattcaggaggtctaggatgggacctgtgactctgcatgtctagcaggctcccacgtgatgttgatggtgctggtctgaggaccacactttgcgtaccactggtctagattattattattgttattattattattattattttagacggagttttgctcttgttgcccaggctggagtgcagtggcgtgatctcggctcactgcaacctccgcctcccgggttcaagcaattctcctgcttcagcctcctgagtagctgcgattacaggcgcgtgccaccacgcccagctaattttttgtatttttagtagagatggggtttcatcatgttggctaggctggtctcgaactcctgacctcaggtgatccacccgcctcagcctcccaaagtgcagggatttcaggcgtgagccaccgcgcctggccaggattattttcaatagtctagatcattaatcattgttcttttatttgaatcttcaccagaagaattatgatcttcctcagcagatccgagcttggaaataccagctactttccaactgttagcagagactatagtttatagaagttttcacatttcctattttcttccatcaaaaatgtttctaggactaggatttgtagacctggatatcctggacagggcctagctcctctgtcctttgtcttcataaatatagccacttgctctagaaagattaatactggctgggcgcggtggctcacacctgtaatcccagcactttgggaggcccaggcgggtagaccatgaggtcaggagttcaagaccagcctggctaagatggtgaaaccccgtctctactaaaaatacaaaaattagctgggtttggtggcacccgcctgtaatcccacctacccgggaggctgaggcagagaactgcctaaacccgggaggcagaggttggagtgagctgagattgaaccactgcatttcagcctgggcgaccgagtgagattctgtcaaaaaaaaaaaaaaaaaaaaagaaagattaaataccaactacatcagagttcactctcctgtcagtgtctctgggcactggacaatttgtctacattaccattttgcagaggaggttaagtaggacaacaggtaaagaagttttctattcttgcttcccaagattttaactaagatcgattgtttggtcctccaggtagctttctatctcatggatgctccttggcaatgtgaagccaaatgttaacctggctattcgcatatgcagtccatcatttttcatggggtgtgagatgctgttacagtggatttttttgaaaaggaaaactttgtgtagaccagtaattaggttttcttgaagagatctttactgataacagtcaggttaggaaataatgactgtgcaactagtattgcagccaaaagctcattcatcctattcaaccatattctggactctcatcagctgattttccttaaggattcagagccattcaaagccatgggcatgatgattctgtgagactccttgagagtccatgagactcagtttcagggaacaatagggtctgacttgagtccttcttgcagatctctattgagctggaatccttgcaagaataaagggcctcttcagatttaagttgagacccagccagcaccacctcatgggcagctagagccggtaggtccaggagtactttgagggctgaatatctggcccctggcacatctcctaacactgcctctgtcaccacgcaggtggaacttcccgctgacaccctttccgtattgtccctctgttctgtggctgtgtcttggagtcctgcgtgttcagtccttccatttgcattttctccttggccagtgtattactttctttctttctttctttttttttttttttttttgaggcggagtctcgctctgtcgcccaggctggagtgcagtggcccgatctcggctcactgcaagctccgcctcccgggttcacgccattctcctgcctcagcctcccgagtagctgggactataggcacccgccaccacacccggctaattttttgtatttttagtggacacggggtttcaccgtgttagccaggatggtctccatctcctgacctcgtgatccgcccaccttggcctcccaaagtgctgggattacaggcgtgagccaccgtgcctggccccgtgtatcactttcattggcacattcaatacatgaatgagatgcattccctttagaccccacacctcattcctaacttgcctctggttagcttcattcttcaacattggtaatccaagtaccattggaagattaacttaaagaaatgcatcccttccagaggggcaaatcaggatctgctgtctgtatttagtgtccgctacctcattctatagttcctatacagatccagcttctcttctgcttttagaaaatttccgcctcttccagttctctgatttcccccttccaccccacctcccaccactatgaagttaacaccatttttatttctctctcaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggtataattttgattttttgtatatatatacgtatatatatatacatacatatacgtatatatatatacgtatatatatacacacacacacatgcactcatatatttaatgttttcaaagtccttaatatatatagttcatatatgttttcaaagtccttaatatatgtataaagcttatatatatatgttttcaaagttctttatatataaagttatatatatttatatagactttatatatatatacatatataaagttaaggacttcagaaacattgtagttaactgaggcttccagttactgcggtcctggttgataagagagactttggaagagatcagtgcacccagaggttggcatctattgcttattgcttctgatattaaatgctgttatttgaagtaagcagttctaggattgagaacactgggtgtccccaacaacctgaacccacaggcattgtctgaggcatgttgcaacccaagcactggcttattttcaaagtcaagatgctcagggtttttgaaataattacatactgatgccagccaccaaagtgggctcaatgctgggtcaatatttttttctgtggataggggcccaaaataagcacaaaggtatataaaaagaggcttctccttttctgtcttctccttcttctcatttctctctccttctgtcacccctcctcttcctctattctttctcttttttgtgaatttagaacatgggaactggatagacttttaattattgtaagtattactgtcatggttcagtattcagttctaaaatgaaaattccctctcagatcatcctaagactcatttcacacatgtttttttttcccccaatttttctagacctttggctctcaactggagacaattttgccccactcccactgagacatttgtcaatgtctgcagacatgtttagttgcaacaactgggggagaattgctactatcatctagacggtggagatcagggatgcagctaatcaccctacagtgcacaggagccagcaacaaagaattatcagatctggccgggcatggtggctcacgcctgtaatcccagcattttgggaggccgaggcaggcagatcgcactgtcaggagttcgagaaccgcctggccactatggtgaaaccctgtctctactaaaaatacaaaagttagccaggcgtggtggcaggtgcctatagtcccagctacttgggaggctgaggcaggagaatcacttgaacccgggaggcggagattgcagtaagccaagatcacgccactgcactccagcctgggtgacagagcgagactccgtctcaaaacaaaaaaaaaaaaa

SEQ ID NO: 3106 - DNA, 34628 bp, human
agacaactcagaagacactagacaacagcagtcttatctaaagaaataagacctccaaggacgaagcatcagaatgcttcaattaactggggaaaatgagaagaattgtgaagtttcagaacgtatcagaaggtccggaccatggaaagagatttcttttggggattatatttgtcacacatttcagggaggtatgttactttgactagttacaaaaaaaaaaaaaaaaagtaatgcttctgataagtttcaagttaagcatgatctgaaaagttatcttctaatttaatttgtcaatttgggcaagggctttctaaaattttcaataatagttttggtgttctcatagataaatcattcttctggtctaaattagatgaagtccaacaaagtcaatattggcaagaacatgttacaaatgttttctcctgttgcacctgcgcattatttctgtctttgtggtctttaattaagtgcactctttttttttttttttttttttgagatggagtctcgctctgtagcctaggctggagtgcagtggcaccatctcggctcactgcaacctccgcctcccaggtcccggttgaagcaattctcctgtcttagcctcctgagtagctgggattacaggcacacgccaccatgcccagctaatttttttgtatttttagtagagacagggtttcaccatgttggccaggctggtcttgaactcctgacctcatgatccgcccgcctcggcctcgcaaagtgctgggattacaggcgtgagccaccgcgcccggcctcaagtgcactcttaaaaaaggtataaaacctccttatagtcaaaacccatgtaagcatggtttgaatttaatctggagctggaatacaaatctcttaaatacagttcgttcattctgtagtgcaaatatctttacttgttcaatctcttaaaataggttaatttgcaagtagcatagtattctaaggtcaaaaacatttttcaattattgttaaagaggcagggaatggtgcatgttaatttcccagttttatttctttcatatatatatgtatatgtgtgtgtgtgtgtgtatacatatacacgaatccccccacccccaaatttaccaagatttggtaaataagactttctgtttttttgtttgttttgagatggattcttgctctgtcacccaggctggagttcagtggcacgatcttagctcagtgcaacctcctcctctggggttcaagcaattctcgtgcctcagcctcctgagtagctgggattataggcgcacgccaccacgcccggctaatttttgtatttttagtagagatggggtttcgctatgttggccaggctggtctcgaactcctgacctcaagtgatctgcccaccttggcctcccaaagtgctgggattataggtgtgagcacctgtgcctggccgctaaataagtctttctataagaatgtaggcagtaacatgcctggaccagtatttttcacatggttctgtgtttttcttttgataccactgttaacagtcagatactatattattacaaatcttcccccgccccacaaaatacttaaaaaataacaactctttattcaaaacccagtcctttaaatattaatgcaactaggccaatacacctaaacaataaatcctcctcaacccctcagtctctctaattcctaaattatcccataacaatatatttaggtgtattaaaaatcaagaacaaaattttgtggaagtgttaaactcaaaccagaaatcaaactcaaaccagaaatcacctttgcttttggtcacttttgcactggtcagacaaatgtttgttgggaaaatatatgacatttaatcagtaaattagctaattgacttacaaaagtcccagcccaaggttaagtttcttgagtctgctagcatatgctattcctgtaaactattgtcagcaatgtcaaaagcaaggaagggcaggaaaaacctagccagcacacaggttagacttttgtaggtccagagcactcttttttttttttttttttggaagctgcatttaacaccacatgcctcattaaatatcattctttgtgctgtaaaaccttttggaaagttgtttttttttttttttttttgtgcagtgggcgggtgggggtggatttcatagtctggaatacattattttatatgtctttgtggcttaaactattacatttgctgatcactcatcatagttgaattaagccatggttgactgttattagttttggtttttaagcttctttgtttattttgtctattatatgtatatttttttttcttttttaaagtttaatacattgtccttggcctttggtgttatgcctagagcaccagatggatcactggatcccaccttcagtccatagatatttctgcaggcactttctcaggagagatgtattgtatgatttttcaagctttgctaatttgtattaagctatgtttagtactgtgacttggtcatcaagaaagaaaatatagtgtagatacagattgatcatctgttattcataacccttcagccagccatgtttcagaattcaatagcttttgaatgttagaaagatcatacaatgtgcatactgtctattgcacagcacttctggtggggcctggagctgcctcccacagtcaaacattttgatctttctatagtgaacatataggtattcacactagatggaaatataaaacaaataataaattgcttaacctaagtcctggccatgctttgctgctaaacaagtttgcatcaaatttggggtaaagcttggttttcagaattggaggaactttacaagtgcagataagacgttgtagaactgtagtgccctctttcaaaaaaaaaaagggctattttaagctgtgtctaaaagatcagtcctattctaagttttatgcttaaaatcacttgttgatggactgaccatgatttgacagctatgcctctgcctaactcagcattctgaatcctttttcctgtcttttccattccaataggatcgccttagtttcattcttgcccaaacctcgacctagccttctgctcttatttagttttgctggttgtctccacaaacattggcctaaccatcctctaagttgcatatcaggtgcctgctggcttttcctaggttgggacaaccagtccttggcagaggctctaccttccaccagtctcctttagctcagctctcccgcccttaagagttcaaaggagccttctttctaatacactgcaacatagttaattgtgtctaacacagctcactgtgtctcatctcctctctaggactggacattctggagaatatttattttaactcagttttattacaatattttagatatctcaggaaatacattctattttcccagttacctttgtttcacataaaataccattaattctgctaggctcttgcctgtattttggttcaaaattaaaattccttatgaattttcttttccttaataaatgctacagaagatttgtttcatatgattttattttttattttttgagttggagtttcgctcttattgcccaagctggagtgcagtgatgtgatctcggctcactgcaacctctgcctcctgggttcaagtgattctcctgcctcagcctgctgagtagctgggagtacaggcgcccgccaccacactggctaatttttgtatttttagtagagacagggtttcaccatgttggccaggctggtctcgaactcctgaccttaggttatccacctgccttggcctcccaaagtgctgggattacaggcataagccaccgcgcccggctgttgggtcatctttttaaataaaaaaacagtaatctgaaatacttgttgaaattagagtaaaaattacaaaaacagtttaatcgttttttatctcaaatggttggaacttagacagctgtactccatctgaaccaatgttattgaaatatatacggttttagaagttgttgtgaagttgtcattcaaacagtctgagatacaaatcacattctgagaaaaattcaaagggggaaatgaaaaagcacttgaacattttccgtacacctcatcaggaataagcaaacatatttgtagagtaaactatcttcataatgtgtttgcagccctgtgacacgggcgatctgccaaaaaactaaaaatagattgccttagaagagaatgattgagtcctacttaagcattcatttatttggagagctcagttgcatacttcctgaagggaatggaaaaactcccaagctgccaagtaacttttatcctcaatttctcacaattagctccagtttgcaaaatgagaatggtaagagtgagagactctgttgggaacaaggatagaaaagcaggagaccccactgtggcagtttctggaaaagggttctgtgtgaaaacccttgaaggtcctttgaagcaagttctgggaaatgatggaactagaaaggctactttcttgagagttacttcgtttccagttgggaaacaaaaaggacttctacttttttttttttttttttttttttgagacggagtcttgctctgtcgcccaggctggagtgcagtggcgcgatctcggctcactgcgagctccgtctctcgggttcacaccattctcctgcctcagcctcccaggtagctgggactacaggcgcccgccaccacgcctggctaatttttttgtacatttagtagagatggggtttcaccatgttagccaggatggtctcgatctcctgacctcgtgatccacccgcctcagtctcccaaagtgctgggattacaggcgtgagccactgcacccagccctggatctctacttttagggtggtacaattggtttatttcacaccatttatagcagtggtccccaaccttcttggcaccagggactggtttcatggaagacaatttctccatggaccagggtgtggggggatggttttgggatgattcttgtgcattacatttattgtgcactttatttgtattattattacattgtaatatataatcaaataattatacaactcaccataatgtagaatctgtgggagccctgagcttgttttcctgcaactagatggtcccatctaggggtgatgggagacagtgacagatcatcaggcattagactcataaggagcgcccatcctagatcccttgtatgttcagttcacactcttctaagaatctagtgccactgatgatctgacaggaggcagagctcaggaggtaatgcaagcaaaggggagtggctgtaaatacagaagaagcatccgggcacagtggctcatgcctgtaatgccagcattttgggaggccgaggcaagtggatcacttgaggtcaggagttcaagaccagcctgggcaacatggcgaaatcccgtctctactaaaaatactaaaattagctgggagtggtgatgtgtgtctgtagtcccagctactcgggaggctgaggccagagaatctcttgaacctgggaggcagaggttgcagtaagctgagattgcaccactgcactccagcctaggggacagagcgagactccatctcaaaaaagaaaaatacagaagaagcttcacttgctcacctgctgctcacttcctgctgtgcagcccggttcctaacaggccacggaatggcccaggggttagggacccctgatttataaagaggaggtggatgtcagagcaacccaagacaagtcaatctaccacgagaataaggagaaattaaaaaccaatagttcttaaaaccagaacaaggtgtgttctaaagtccccataactagggtttcagtcctatttctgatacttcctagccatgagacagcttcatgtggagcagtggttgtcatgcattttggggtgttaccattcagcaaagcaaggcttttccccccttcactggaagctatgggatgggtactctgggagcaatacaagtttagataaggggcattcaaaaggaggggagcctggaatttcactctcaagttggaaatctgcttagagagacaacttgctgaaccccccatgccagatgaatatgaggaagagaattggaaagcagcaatgtggtgagggagaagcccaggacaaccaccattccctctttcttggtggaatgaaagatggcaccacaggcttgttaaccttgatctcagaggcacaggatcagagttggggacatcagaggatgctgcagtgatgacagacactaggagaggtggccaaatgccaatgggtagaaaaggtacatgggtgtaagccccagtgtgaagggcatgccacagacctggagtgaggcctgcagttgagactgatcaagcaggaccagcctcctcttccagttaacacttcccatcccatttccctttcctgtccctcttgtttctccccactcccaaggcactaaagggttggaccctagaagaaggaggtgggaagcatgtgaagaacatgctgcccttctgtctccagctgctgggtgggctggagaaggccataccctgccctgggagtgggaaaaggccaggagctgtgaagaggatcagagattacagctagaaagagggctagtctgtgttactttagaaactcttcatgaaagtatgatgtaaatacagagacatgcacaaatcctaagtgaacaactgcatgaattttcacaaagtgaacacagtcaggaaccagcacctaagagcaagaaattgcatattatcagcatggcccccaccatgccctcttgcaaacagtcctcacccctcctcggggtgcttttgactcctaacacccaaggcaagtttcccttccttgtgtactttatagcaggggtctccaacccccaggccacagaccagtaccagtccatggcctgttaggaactgggccatacagcaggaggtgagcggcaggtgagggacattactgcttgagctccgccttctgtcagatcagtggtggcattagattctcataggagtgtgagccctattgtgaactgcacatgcaagggacctagattacattctctttatgagaatctaatgcctgatgatctgaggtggtacagtgtcatcctgaaaccatcccctgcccaccctcatctgtggaaaaattgtcttccatgaaaccagtccttggtggcaaaaaggttggggactgctgctttatagaaaccaaatcacacggtacatgttcttttgtgtctggcttctttcactcaacattaggtttgtgagatttatccatgttgtgtatatgacttgagtctaatgggactgataagtaacggaaagttactagaaaatgaggatcaccacagcccacttggagacaagttttagaaataatgaaaacattcgtgttgataacctatgttaactcttttaattgcaagttgccacttaaatcctgtctttatttttaaatggaatacttacagtaccttcaagtgactcaggttgactggttattgtcagaacaatgaaatgacaaagccacagttatgggtttgcctcttccattggtcagggtgccgagctggcagccatgggtaaagactgtcctaccaaccccagtgcatgcattcacttccaagagcaactaggcaagagcgtaacatgtctgaagtacatttcatattgaatgagatgcagacatattagaggaaaagcctcactaattggtaattatatgcatacattgtctcattatttccagtttatgcaaattataaatatccaaagagttgttgttgttgttgttgttgttgttgttgtttgagacaaagtgtcactgtgtcacccaagctggagtgcaatggcgtgatcttggctcactgcagcctccacctcccgggttcaagtgattctcctgcctcagcctcccaagtagctgggattacaggcgcctaccaccgtgccaggctaatttttatatttttagtagagatggggtttcatgttggccaggctggtttcaaactcctgacctcaggtgatccacctgcctcagcctcccaaagtgctgggattacagcgtgagccactgcacccggcctcaaagagagtttaaaatattctacttgtcagctttcaaccaactaaagacaagggtaaatacaaatgcaatatatgctcatgttaaaaatttttatctgtttttgaaataccattcgactcagcaatcccattactgggtatatacctaaaggcatatgaattgttctgttataaggacacatacgtgcatatgttcattacagcactaatcacaataacaaagacatggactcaacccaaatgcccatcaatgacagactgggtaaagaaaatgtggtacatatacattatgcaatactatgtagtcataaaaaagaatgagatcatgtcctttgcagagacatggatggagctggaggccattatccttagaaaactaacaggaacagaaaaccaaatgccacatgttctcacttataagtggagctaaatgatgagaacacatggacacgtagaggggaacaacatacactggggcctattggagggtggagggtaggaggagtgagacgatcaggaaaaataactaaaggatactaggcttaatacctgggtgatgaaatactctgtaaaacaaacccccatggcacaagtttacctatggaacaaacctgcacatcctgcacatgtacccctgaacttaagataaaagtcaaaaaacataaaattgatgatgtctattgcatataattattttctttggaaaattttttatctgtttttctttgttattataaaaagcaatacacattcatatcaggagtatgggatcaccagtgattctatctatctatctatctatctatctatctatctatctatctaatctttttttttcttgttaaaatgtttggaaataatttcagccgacagaaaagttacaagaacagtacaaaaaaattcctgcttctcttcacccagagactccattcatgtttagccaacggtcctaataatgtcctttatagcaaaaggatcaggtgtcttgcctttagatagcgcgtttcgtcatccctttcaatctggaactgttcctcagtctctccaattattttgtaaaatgtcccctcagtttgggttggtgcacagtttcctccttatcagattttggttatgcattttgggcagaaatatcacagaagcggtggtgtgttcttctcattatgtttcttcttatggcacatgatgttgctcatcgcattccatcagatgacaatctgttccatcactggtgttaactttgctgatgttaactttgatcacttgggcaaagtgatgtctacaattctgttctataaaattatccctgttccttttctagttagtcattattttgcagggagatgagttgaagctgattctattatttcttcaatttctaagttgggattttattataaggaagcactttctcttctctgtctttatatattcatttatatcagtgaggacttctagattaccattttatttgataagatataatctcttattgtttattttgaaatcaggttttcccatatttggccaatggaagccccatcaagccagcatctgtgtctttttgtcacccaggccagagtacagtggcataatcttagctcactgcaacctctgcctcccgggttcaagcgattcttctgcctcagcctcctgagtagctggcactacaggcgtgcaccaccacaccctaatttttgtatttttatcagagacagggtttcaccatgctggccaggctggtctcgaactcctaacctcgtgatctgcccgcctcagcttcccaaagtgctgggattacaggcgtgagcctggccagcactttcttactttcttggaagatgtttaaggcccatcttgtattttacctggcccagacctgggatcaacatttctctaaggagtccgggttcaggttttctcagtgcaccatgctaaaaaaaaatacgtatatacgcacatctatgttttacatttaaatttacttttatatctagatatattgaaaatcacattttcatgctaattgctccaatatcaatccaacctcgtaaagtgcattcaagtttcccccattttcagaacccaaagggtgagagaagttcatacattgagtttcagtgtaggaggagggcttattgaaatgtttctaaccctgattctcatccactggaaaaattctttctttccttaaggccttcagttatttcaaattcacacaattccatttttgctgggattttcgtttcaccaagtttataggtatggaaacctgagtttttaacaccatcaggatcacccacaagaggttgaggagcctttgtgttaaatccaaattatattacattctattcagtgcatgaaaagcacaaccataatgtgaaaaagtcctacattttgcaaactggagtaggttttcttccaaaacaattgattgccctttggcaggtttaatggggggttacttctcaaatgctcatttaaactagttagtcttgtttgcagataagcaattataagaaaaatatgtctggaaggcggctctaaggctgttccttatggcactgctctactgtgcctacttattaatcatacaatgtccggagcacttaacatcgcggttgtatttgattggcctacttagagaccaatgcacttgacaaatatcagattattatatttccatcttaccagtaaggaaactggggttcaagtaattttggtaacttgctgaatttggcagagaaagtgatcaaggtaggacttgaaccctagcagtctggctccactggcccatgctcagtcatcacactaagctgcccacaacaaagcttttagggaaaaacttttgggagattaaattgtctgaaaaatgacattctgcagtataatagatatgtcttcattatcaaatgaagcagataaaattacctagagaatttggggaaaaaaacattttcactgatccctcagagcaagcttgtccaactcgtggcccaggatggctgtgaatgtggcccaacacaaattcataaattttcgtaaaacttacgagatttttttgtgatttttattttttagctcatcagatattgttagtgttagtatatttcatgtgtggcccaagacaatactccttccaatgcggcccagggaaaccaaaagattggacacccctgccttagagtctccttcataatacacaggctgttgagtctttggggtgtggatgaaggtggaaggcaggggaaggataaaaatgtggaggctcattgactttcttggcccttcattttgccttacatagagctatcggattcaagcactgagcactatatttttgaactaaatctattgcttattaaaattgcctcccaaaagccagagagattgactgttccttctcttggcacgcaccaccaaaccgtaaaggactttaacattcagtagcttgtctccctgaaagtggctgacgagagagcctgatgcgtgatacctgcttccctcctcttccctcctcttcccccaaacctcctctcacagtgggtgggcagcatggacaagttacaggaagaagtctccaggccttgactttgagcttgatttgtgtttcagattgctgggctgatcgatccccacttcatgaagctgcagctcaggggcgcttactggcccttaaaactttaattgcacaagtaagtgaactgaagacttgatccttcatgcttatgctataattacacatcattctttattagctttggctgtagcagaggtgtggctcaccctatccaggtcccaccattgccattcgaggcacgtatgtcctctcatacctcactgcctctcctcctcctgcctctcctttcctggagagctccttcattttcagcccagttccctccttttcctctgggccttcctttacctcataagaagtttccctatgaggaatgatagagaatgctctcaaatgtttgttgcactaactcacctcatgctcttccagcatgcattagcaccagcagtcctgaagctaagttagtcagctattgctgcctaaaaaatgacctcaaagcataatggctgaaaacaacagaaacttggattttcatggtttctgtgggccagggagcagcttagctaggtgattctggctctgggtctctcacaggctgccacgtgtcagccagggctgcagtcatctcatggctcaaggcgggcaggatctgctttcaaactcactcacgtggttgttgggaaacctcaattccttgccacatgagcctctccacagggctgtgtcatgagatggcagctggcttctctcagagagagtgcaagaggtacctaagaaggaagtcacagttgttttataacctcatctccgaagtgacattctgtcacttctgccatattctactcattaggtgtgagtcaacaagtccagcccacactcaaggggcagggattatacaagggaggcaatacctggattccaggattactgggtgctatcttagaggctgcctatcccaatgatacactattttaagaacaagcattaaaataggttgacaatgggtaaatctgactccccagggaacatttattgaagtcttagttatgaaggctactttatttatatttatgactacatccccagcaccttgaaaaatgagtaggggcctggtaagtatttgtgaaatgaatgaatgaaagtgtgcaggctccatttgctttgtatgttttagggtctacatttatacagaggaggtaagccatcatgtctttcttccacaactaggcaatcatctggctttcttgctactttgaatttaaaccactgggtgcactgctctctctctctctttttctttctctctctctctctgtctctctctctctgtctgtgtgtgcatgtgtatgtatttttcatttatttgttttttgatttctcctttatgagttgtgttacttcttaaaaagtagaggtaaatggaaatcagcactgccagcaatgatcaaatgaactttgtacctgattttatcacttgcttatttatttttaagtactttaaattggatgtgatttgattatttttaataggtaatatattcacatagttcaaaaattacaattatttaaaaaggtggactggccggatgtggtggctcacgcctgtaatcctagcactttaggaggccaaggtgggtggatcacctgaggtcaggagttcgagaccagcctgggcaacatggtgaaaccccatctgtactaaaagtacaaaaattagccaggcgtggtggtgggcgcctataatcccagctacttgggaggctgaggcaggaaaatcgtttgaacctggcggggtggaggttgcagtgaaccgagatcgcgtcacttcactccagcctgggtgaaagagtgaaactctgtctcaataaaataaataaataaataaaattaaaaaggtgcacaatgaaacgtcttgcacccacctcttctctctcagtctcccacccacctcttctctctcagtctcccacctcaatactttcattggtatatttttaataggctttttaaatttttgtataattttaaagaagagttgaaaaggatacagacagttcccatatacactgtacccttcacccaacttcctttaatattgacatcttacatagctatggtacattagtcaaaaatacgaagttaacattgatacaataccactgactaaactgcacactattgtgatttcaccagtttttcctctcatgtcctatttctgttccaggatcccacattgcactaactatacttaataagcatattagcttcaataatatggttaaatgtgtaagggggcattctttatacaaaagttcaactttttcttttacacccctacttctttactcttatacactgttaaaaaatgtatttgtctacttttataaactttattttacatttagataatatgatcgatgtgagtaaaacattaaaccgatatgagtaaaacattaagctaatgtgagtaaatgtgagtaaaacattaaaccaagattcaggagctcttggttacactgctggctgtcactgacaaccagtcttaaaaagtatttgaacattctactcctccattttctcatgcacaattgaggtgatccactctagatgatctttcaggcctttccagcatcacatttctacaatttcagggattctgagattttgcaccgtaacagttttttctagcacacttctgccaccttgtggactagtctgttttttcttattttctcaaaaggaaaagaaaaatgaaaagactttttctaactcttattagatgcccagtttgaaatatgtagcacagatctagagtaatgatgtcatattcaggacatgaaaatagacagaattcaggagtcaaaaagaggccttatgatgaagggacaattctgggaaatcacagctgctggccacagcaaggatgcagccagagatctggcaggagatggtggccgtgtaagtaggagttcggggttcagggtcatggcattgggttttggaagctttcagttggtcagttacaaggcataggatcaaaagcaggactcggctgggaaggacagaccagggacctaattccttttataaatcaaaaataaaattctaagcaccccctctccaaccatctgaatgtacccctcctctcagccagggcattccaaaactaacctgaaaaactggttcaggccatgacaggaaaggggggttgaacatgcctcattataccctcctcccttttggaactcaggaaaagatgaccagaatttaacatcaacacagaccttaagtctgataagaaacatttacaatctattctctctgaagcctgctacctggaggcttcatccacatgataaaacttttgtctccacaaccccttattgtaacccagacagacatttctattgataataactctttcaaccaattgccaatcagaaaaattttcaatctgtctataatctggagccccaggcccccactttgagttgtccaaccttcccaggccaaacaaatgtacattttacatgtatttgattgatgtctcatgtttccctaaaatgtataaaactaggctgtgccctgactaccctgggcacatgttctctggatctcctgagagcttgtcacaggccattggtcacttatatttggctcagaataaatctcttcaaatattttatagtttgactgtttttgtcaacacttttgcagatagaacgtgatcatcagagggagggaaatggtaagagccaagttgttaaaatcaggttatgaagtcagagttgtccagcagctaggctgaccttgtcatctgtcacatggagtccaggacaaggaaggggacacatggtagtatggggagggagaatgtgttaggacagggtggaggcactcatacctgggtgaggagatgaaggttaggagaagtccgctggccccggactctaggacttcagagacctctgcacacagtggagtcatggctgaagcagtgctgctactccacagcacatgaatcctaggagcacagtctacttactcttaagcctgggagttattgttttgtttcagatccagctcgacctcctgaacttgtctgcactccatcatctatacctcatacctactgttattcacagccacagcaggcccatgccagcctgttcctagactcatagtgacatctctgtggctctccttgctttggtcttacatccctactcctgcaatcaaccctccatgctgctaccagtaagcttctaaaaaggctaatctattagctccagaccctccgcagcctagcagacttcataggtgctccatttcctctaagacatgccctccttgtttggaaatcaaggcctttcatgacctagctccagcttactgtcctcctttgtctcctcccatctcctgcttctactttctgtgggttctttctgttccagaaatccgactgtggccctgccacaggaagcaacaggaagcaacaggaaataacttcctgttgcttcctgaatttgcagtttctattctctcctaatggcatactctttcttggtcttcacagcttgaaacattttatgcttcaagtcttagctaaatactacctcatttgcaaggtttttcttactccccaagccagattcaaggatatcctatgctcccaaactaattttggacatgcttccagtatagcaatattcttgctcttttgtctttcatttctgcctccccagtaggctctgggagaagagagacccatgtcataagttttgaagacccaggtcctagtacattacctgctccagaatgcagaattaacattcttttggataaatgaatgtgaggctgtcatgctgtctttaggctcccctgatcgtaacttctacttctctctctatggtactaatattacacccacagactgtgaaaatgtcagaaacatgtgaaacaacattgctttcattgctatcactaatgcagtatttcactctcttctgctgggcttggtggcttgcacttgaaatcccagctactcaggatgctgaggcaggaagatcacttgaggccaggagtttgagaccagcctgggcaacacagtgagaccccagtctgtaaaaaataaataaactctcttctttctaaattatagggtgtcaatgtgaaccttgtgacaattaaccgggtgtcttctctccacgaggcatgccttggaggtcacgtggcctgtgccaaagccttattggaaaatggtgcacacgtgagtactgcccctgcccacttgggtctgtctggccagatgcatctgttaatgtttaatgatagtttaccttccagatggcttacccactgtgggtaagggctgggctggttctatccatgtccgtattccatcatttaggctactcctctctcttcaacttacccccctgtgtgtaaatattcagacatggcaactcacaggaaccttttaaaactgtgttgctgaccttaagaaatctttattgtaccatgttttttttttgttttgttttgttttgtttttgagacggagtctcactctgtcgcccaggctggagtgcagtggcacaatctccgctcactgcaagctctgccggggttcacgccattctcctgcctcagcctccccagcagctgggactacaggcacacgccgccacgcccggctaatttttgtatttttagtagagacagagtttcactgtgttagccaggatggtcttgatctcctgaccttgtgatccacctgcctcggcctcccaaagtgctgggattacaggcgtgagccaccgcgcccggccttgtaccatgttttctttatgcattcatctgttggtggacacttgggttgctttcaggtctttgcaattgtgaacagtgctgcatcagacatgggagtgcagatatctcttggatatactgttttcctttcttctgggtatatacccagcagtaagattgttggatcatatggtatctctgtttttagttttctgatgaacctccaaactgttccccataatggttgtactaatttataatcccactaacactgtatgaggcttaataacaagattttaaagaacaatagaaaacactcttaattcaacaccttaaatgaacaactatttttattgagcaaaattatcaaaatgagcgagcttttaataaataatacattgggggaaacctacagaattgaactttatcttattttaaatttatctccaaacttttttcaaagggtgactgaggtgcaatatataatacagatatcagaatagaatcataaaatcacaacttctaaaaatcttctgtgtttagttgccagatgttctttgtttctaattttgttgtttaactcagtccttgcattatttactttatgagctgcaatgtttttaagtgcttaatgacaatttaaaacattttatatggaaatcgggtttctacatgtagaactgaatataaaagtcttccttgtgaaaactaattttcctgatgccattgtggtcgtgcattttctttttttgttttttttttttccatctttttatttttagacagagtctcactaacactgttgcccaagctggagtgcagtggcacaatctcagctcactgcaaactccacttcctagattcgaacgattcccctgcctcagcctcctgagtaactgggattacaggtgcccgccaccacgtccagctaatttttgtatttttagtgcagtaatttttgtatttttagtgaaaccagcgatgctggtttcagactcctgacctcaggtgatccgcccgccttggcctcccaaagtgctgggattacaggcgtgagccaccgtgccctgccaagtggtcatgcattttcattaggtagtgcttctctaagttaccactcagtcagctcatgggtaatgatgaaggaaggctgtgtgagagccgtttcctttcaagctagatgactggagtcacaggcagactgctgacaatatcaggtcagagaggaggttttgttgggcacaaagagaagaataagacatgtttccttgtctttgtcaattttataaagaaacagccaataaatactgtagcacaccatttaacatttaaatcagaatgagaaacgaaataagagaaagttggtccatcagtagaaagtcccccacaattggcagtcccatgaatacctcaaactcagtgcatttgtaactgagcttatcatgttcttccctctgggacctgctcctcatcttgggttcctagtttcagaggcctggtgaaagaaacatcctcttggtttcccaagctgcaaacctgagagtcatcttatttctttcatctccctatctaattaattaaaaactcctgctaattttactttctaagtttttcccaagtctatcctctcctttatcctactcccatagtcatctaaattatttattatattttcaaaatgatttctttttggccaggcacagtggctcacgcctgtaatcccagcactttgggaggctgaggcaggtagatcatgagatcaagagatcaagaccatcctggccaacatggtgaaaccccgtctctactaaaaatacaaaaactagctaggcatggtggcacgcgcctgtagtcccagcttcttgggagcctaaggcagcagaatctcttgaacccaggaggcggaggttgcagtgagccgagatcacaccactgcactccagcctggcaacagagcaagactccatctaaaaaataaaaaaattaaaaaaaattctttttgtatttgtcttccctaatggaattcagcctactcaaggagaggcaattgttcagcccactcaaggagaggcaattgtcttatcattgtttccaaaacattagcacctagtagatgctcaataaatgtttgttgacgtgaactaagagaaatttataggaaatcgcataagaagacaacttcctagactgagggtgaggatgaaacttagtaaaacacaaatcaaactagtcctaccaaatattttttagtaaaaatatagaaacccctagcaatataaatttacacacattttcccctgaccttgtctgtctctgccatcttagcatattatctttaactttccaatttaatgggggttaggctgggtgtggtggctcacacctgtaatccctgccctttggcaggctgaggcaggagggtcatttgaacccaggagtttgagaccagcctgggcaagatagctagacgctgtctacaaataatttttctaaatttgtgggtcatggtggtgcacgcctgtagtcccagctgctcaggaggctgaggcaggaggatcatttgagcctaggaattcgaggctgcagtgagctatgatcatgacactgcactccagcctggatagcagagcaagaccctgtttcacgggttatattgcaactctggaaacaagtctttttttgtgtccaaagcaaggacatttagaatcctgattatcacaagcatgcatccttagttgttgaagcaaaattgtttcacatcacaaacttgactgtcctatatttcaatggcatcagaggctccctaccactcctgcggttcccgatgttctttccaatctattgctgatacacaaagatgtctcccagccctgctggttctcatgtgcttcccacatccctacaaggtaccaaagatggttgcagacaccatgttgatggctattttctttcctttttttaaatttaatcttttaattttatttatttatttttatttttattttttattatactttaagttttagagtacatgtgcacaacgtgcaggtttgttacatatgtatacatgtgccatgttggtgtgctgcacccattaactcgtcatttacatcctaatgctatccctcccccctccccccaccccacaacagtccccggtgtgtgatgttccccttcctgtgaaaccaacccaaatgtccaacaatgatagactggattaagaaaatgttgatggctattttctatgtccctttggcttggtcatgctatctctagaagtaacagctggcatgtgtaatttgcatggattatagtagaccagagaggaagttgtggcaagaaagacagtagatctgtggagaattgccaaggattttgtaagcatggattttgggaccacagcctgccatgtttgttcatgattcagaggggagtcatattaatggaaaatggaaaatggaaataattgttgttgcaaatgcttattgagtgcttactgggtgacatgtaatgttttaagtgtttacatatagtaactcgctcgatccacccaataacttcatgaggtttcataatactgtaaagatgtggagttccctcacttattcaccagcgtggggaattcctctaggcaaatacataggaagacatacttggagatggtgagaatgaaataacaaatcctttgggtctctctttgcccatcattaggtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtaaatgagccaccacaatgcatgtgaaacattgatgggctcactccaatctgtatgaatcaatggtctagtgttagtcattcaagggtgaccctgatcttcctcaccattagaatatgtgtggcctagaaatcccacagcagtaacttcaatttgcctaaatcttcaggaaataccagtgtggcacaaaagagccctacttataacttcggaatgctttcctgactccaatttcccatttcctggggatggtctattggcaggcctttccagatcctctttgctggtgttttggtggcagctggtacagccaaggcagtagttctgacttccctgaattgtactatgcttatgtctctgtccttagtaggcaagaatagcttatcctctaaagcccataaaataccaaccactaacctaaaataaactatgaaagtatctgaaagccaaggctgatactatctctaatggaatagtaaatataaccgttcataataagttacacaatctagatgggctgatgacttcaaggtcatagttattgaaaagaaaaggctgcaactttccaaagtatagcattggtaatcttgaagctgactctagactcctgtgttgtcagttaatttccaagtgaaggaaaatagtaaatttaaggaatttaaagactgtatgtacagactagacctgaaccgagaagatgccactgaaaggagaaggccatttgtcaaaggtcacacccaaagagcaacattttgatgatagcaagtgagggagttgttctcttatactgagatcagaaatacaatggtgaagttaaaacactctagaatagtgatctttgctggtgtaactggagatgaaatattttatttcaaaaagcaaaagtgaaagatttgttccaggttattaaacatgtcacttgccaattttttccagtggattactttaaatgatgcaaaagacccaaatctaaatttatctatgtattttatgttctaaatgtatttaatacatatttattaattaatagctgatgttagtcatttcccaaacatcatgtaagtcctttaagttgtagagtaatgaactactttggaaatgatataaatgtctttctttcttttttttttttttttcgacagagtctcgtgctgttgcccaggctgcagtgcagtggcatgatttctgctcattgcaacctctggctcctgggttcaagcgattctcctgcctcagcctcccaagtagctgggattacaggtgcccgccaccacaattggctaatttttgtatttttagtagagatggggtttcaccatgttggccactctggtctcgaactcgacctcaggtgatccacctgactcggcctcccaaagtgctggtattacaggcatgagccaccgtgctcagccatataagtcttttttttttaatttttttaaattttttttttattttttgagacagagtcttgctctgtctcacaggctggagtgcaatggcacaatctcggctcactgcaacctccacctcctgggttcaagcaattctcctgcctcagcctcccacgtagctgagattacaggcacctgtcacagtgcccagctgatttttgtattttttagtaaagacagggtttcatcatgttggccaggctggtctcagactcctgacctcaggtgatccacccacctcagccttccaaagtgctggtattacaaaaagtctttattaaaaatttaatattgatttgaagtaaatttttgaagtaaaaattaatattatttgtatttccatacaaatgtttaaaaattgataagtactgagaatggtttgaattaattaagtatgtctgcagtgcttgactgattatatttggagcttttggtatctatgtgcctataaaacatatatatgctcataataaacacataatttgtgtgtctctgtatatttttctgtactgtaaaagcatgttaaggataaatatccacagaatgtaagcatgattagcaaattcattattttatacacttgtattagtgctagctatttaacttttctgtattcatttttaaaactttctgagaatatttaaatttaactcaaactaggctgtttcttgttcttcaaaaaaaagacaagaattattcaaaaatatgtattaaataccctgtattttccaagtagttttagggacttactagatattatttctggattcttatagctctaaacctctatgaacaagctgagtcatagtttgagtcaataccttgacatattgatgctgtaattcaggtataatatttaattatgtgaacaaatagtttgaattgacagtcctgatttgtacattttaatgcatatttatacttaatttagaatttgtgataaatcaggtaggtctaaaatgaagcttacttttatgttatctacaaaaaataggttggctaaattaattagtaatgacatgattttttagggagatatttaaatcttcaaagagaactaactctttgcaagctcccatcaatacctcagaagcactctctcctgaacaaagcattcacaggttgcaaatttatcatgtctatctatttattgggcaaactctcaaaagagaatgcttgcttacatagttgttgttagccactgaatatgaaagtgtatttaaatatattctatacttaagacttctttattctttctcataggtatttttcagactaaccaaagtactgttgcaggccatatatccaatctcacatgcatggataaagaagagaatgagagatttgtaatggagaggcgacagggttctcttgggtttgagcactagcttttcagagtaataataggcctagtcgtttgtccctctgggtcttgtcacttccatttgtaaaatggtggcatcattctggagagtgatttcaactgtgctacttggagcccttagttcagttaaagttaacttgggctgtaaagaggagctggagtggggaagcatgggcatgctcctctttttattggtattattttggtggtttctacctaagatttccaaaaacaaacacaaaaatgtttttatgctacaaaaagagatctaggttatttaattaatttatttatttatttattttgagacagagtctcgctttgtcggccaggctggagtgcagtggcgctatctcggctcactgtaacctcctcctccccggttcaagtgattctcctgcctcagcttcccgagtagctgggattatgggtgtgtgccaccatgcccagctaatttttgtatttttagtagagatggggtttcaccatgttggccaggctggtctcgaactcctgacctcagggaatccgccggtctcagcctcccaaaaagctgagattacaggcgtgagccaccacacccggccaacctaggttatttctaaagcccatttcagataagcaatcctataattctgttaatatttaatatgtcccttacttgagtgagggtatcttgtgttccaccaggtcacagagagtgcatggagatcctgctggcaaataatgttaacattgaccatgaggtgcctcagctcggaactcccctatatgtggcctgcacctaccagagggtagactgtgtgaagaaacttctagaattaggtaatttccaaaattattttcatgaagaaacctgttaactttgttgattttctacagcttcaaagatgaagttcttgtcatggttgaaaaatattcggttagcattttatgtttgaatgctaaaaacaaaacttctctagagaaatgagtgtctgtatttctcagtcctgcttcctttgatgttaactccatttacctggtattgttctccctggttgtcacaagatagctgccagcaatacctgggcttacagccctccttatccatacgcagcaagaaagagcattggctctttttaagtcacatgcccatctttgaacccctcatgggggccaagggaatacaatatattgattagtttaggcctagatttcagcctactctgcatttattaggcttcactggaaacacgagaactgaaactaacaagagggtggtttacctttgggaaatctaggtatgcttgccaggaagatgctggacggtaaaaacagacatttgctacaggctagtttatatctatcctgctacagtatctagtcattttaaaagcaattctaaaaggcatatacagaaaccaagagtccgtggaaaaatgaaatatcttttttttttttgagatgaagtttcgctcttattgcccaggttggagtgcaatggcgtgacctcagctcactgcaacctccacctccagggtttaagcgattctcctgccctagccgccggagtagctgggattacagacgcacaccactacacccggctaatttattgtatttttagtagagacaggattttaccatgttggccaggctggtctcgaactcctgacctcaggtgatccaccttcctcagtctcccaaagtgctgggattacaggtgtgagccactgtgcccggccggaaaaatgaaatatcttgaaactattctttggttaaagattcaacaaacttagcccctgacataaaggtggagatttagtaaaaacctttagttgtgaatttttatcttgaggaagtttttgtcttttttatttcccatcatttactattctctatagtaagttcagaaatcattttttgagccccaaataatataaatactaaataaacttagctttatcttttgtcccaaaacataataactatgtaacaggagcctcaaatactttattttgtatgccacacagtttatacgggaaagcaagtatttaaaatgactaaaactatctaaattcacttttctcaccaaagaatttcaagtagtcttagtaggcattgctgaggttctaggcttgagttgcatattttcaaacatttgtcaagtatgtcatggtacttaaaatgtctttatatgcaatgactatatttgaagctcattgtgctttacattacatttagtgttgaattgtggccatctgttttgttaaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggtaaccaagggctgggtatccattcctcttccataagcacattctctccccttcctgtctcatctgtagcattttttcctttttcttttctctttttaattgaaggtggcattgtgggaggtgataggccctgccgtcactgacctgtcttctgggattttatatgctgtgtatattcactaacaaccaaagggcatttacctataaccagagtgttgctttgtattttatataacaagaaaataaccagaaaaccggctgggcgtggtggctcacgcctgtaatcccagcactttgggaggctgaggcgggtggatcacaaggtcaggagtttgagaccagcctggccagcatggtgaaatcctgtctctactaaaaatacagaaattagccagatgtggtggctggcgcctgtagttccagctacttgggaggctgaggcaggagaatcgcttgaacctgggaggcggaggttgcgatgagcagagatcacaccactgcattccagcctgggtgacagagcgagactccgtctcaaaaaaaagaaaaccagaaaaccttgtttataccccgaaaatcttgaatttccatttctgtcctggcataagcgtatgattgagcaaaccaaaactctgctttgtaatattgggagacaatctgatggcaaattcaaaagacttgagtcagagtctgtaggggaggacacagagtatttcagaaatccgactaaatggtgaggttgtttgcctgttctccagatcagggagtaggtgggtctgcattcttcattgcttcattcccgtttccaccatgagcattaagagcaactactgatgccagaagaggtaaggcgagcatctgaaattcagaagagaaccaattcagaagagaacctcttatgtctatacagtaagaaaatattttcggagcctatattgattatttgtgtgcctgaagaatattaaagataattataattattcagctctacgtatgccaggcactgggctaaatttgaaacatagatcaagctcactgaatttttaaaactttagagcagtgggaactttatatggtagtagctggttgctatgccaggtacaaatgggaaaagaaaagcattgacaaggtcacacagctagctacataatagaattaggtaggattctgagccatctgaccccagagtgtgcacttttttttttttttttttttttgagatggagtctcactctgtctccaggctggagtgcagtggtgcgatctcggctcactgcaacctctgcctcccgggttcaagcgatttttctgcctcagcctcctgagtagctgggactacaggcgtgcaccaccacacccagctaatttttgtatttttagtagagacggggtttcaccatgttagccaggatggtctcgatctcttgacattgtgatccgcccgcctcagccttccaaagtgctgggattacaggtgtgagccactgcacctggccatcagaatgtgcactcttaatgtcataaggccccaaccctgaatcttttgaaacattcagtgaggagggtcttatttcactcaccagttccattttgtgaaaccactacatcatatataccttccaagtagaatgcttggttttaaccattttatgaatagtctttctaaatcagtgcttcttaagatttaacatgcatatcagttcacttgaggatttccttaaaatacagattctcattcaggaggtctaggatgggacctgtgactctgcatgtctagcaggctcccacgtgatgttgatggtgctggtctgaggaccacactttgcgtaccactggtctagattattattattgttattattattattattattttagacggagttttgctcttgttgcccaggctggagtgcagtggcgtgatctcggctcactgcaacctccgcctcccgggttcaagcaattctcctgcttcagcctcctgagtagctgcgattacaggcgcgtgccaccacgcccagctaattttttgtatttttagtagagatggggtttcatcatgttggctaggctggtctcgaactcctgacctcaggtgatccacccgcctcagcctcccaaagtgcagggatttcaggcgtgagccaccgcgcctggccaggattattttcaatagtctagatcattaatcattgttcttttatttgaatcttcaccagaagaattatgatcttcctcagcagatccgagcttggaaataccagctactttccaactgttagcagagactatagtttatagaagttttcacatttcctattttcttccatcaaaaatgtttctaggactaggatttgtagacctggatatcctggacagggcctagctcctctgtcctttgtcttcataaatatagccacttgctctagaaagattaatactggctgggcgcggtggctcacacctgtaatcccagcactttgggaggcccaggcgggtagaccatgaggtcaggagttcaagaccagcctggctaagatggtgaaaccccgtctctactaaaaatacaaaaattagctgggtttggtggcacccgcctgtaatcccacctacccgggaggctgaggcagagaactgcctaaacccgggaggcagaggttggagtgagctgagattgaaccactgcatttcagcctgggcgaccgagtgagattctgtcaaaaaaaaaaaaaaaaaaaaagaaagattaaataccaactacatcagagttcactctcctgtcagtgtctctgggcactggacaatttgtctacattaccattttgcagaggaggttaagtaggacaacaggtaaagaagttttctattcttgcttcccaagattttaactaagatcgattgtttggtcctccaggtagctttctatctcatggatgctccttggcaatgtgaagccaaatgttaacctggctattcgcatatgcagtccatcatttttcatggggtgtgagatgctgttacagtggatttttttgaaaaggaaaactttgtgtagaccagtaattaggttttcttgaagagatctttactgataacagtcaggttaggaaataatgactgtgcaactagtattgcagccaaaagctcattcatcctattcaaccatattctggactctcatcagctgattttccttaaggattcagagccattcaaagccatgggcatgatgattctgtgagactccttgagagtccatgagactcagtttcagggaacaatagggtctgacttgagtccttcttgcagatctctattgagctggaatccttgcaagaataaagggcctcttcagatttaagttgagacccagccagcaccacctcatgggcagctagagccggtaggtccaggagtactttgagggctgaatatctggcccctggcacatctcctaacactgcctctgtcaccacgcaggtggaacttcccgctgacaccctttccgtattgtccctctgttctgtggctgtgtcttggagtcctgcgtgttcagtccttccatttgcattttctccttggccagtgtattactttctttctttctttctttttttttttttttttttgaggcggagtctcgctctgtcgcccaggctggagtgcagtggcccgatctcggctcactgcaagctccgcctcccgggttcacgccattctcctgcctcagcctcccgagtagctgggactataggcacccgccaccacacccggctaattttttgtatttttagtggacacggggtttcaccgtgttagccaggatggtctccatctcctgacctcgtgatccgcccaccttggcctcccaaagtgctgggattacaggcgtgagccaccgtgcctggccccgtgtatcactttcattggcacattcaatacatgaatgagatgcattccctttagaccccacacctcattcctaacttgcctctggttagcttcattcttcaacattggtaatccaagtaccattggaagattaacttaaagaaatgcatcccttccagaggggcaaatcaggatctgctgtctgtatttagtgtccgctacctcattctatagttcctatacagatccagcttctcttctgcttttagaaaatttccgcctcttccagttctctgatttcccccttccaccccacctcccaccactatgaagttaacaccatttttatttctctctcaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggtataattttgattttttgtatatatatacgtatatatatatacatacatatacgtatatatatatacgtatatatatacacacacacacatgcactcatatatttaatgttttcaaagtccttaatatatatagttcatatatgttttcaaagtccttaatatatgtataaagcttatatatatatgttttcaaagttctttatatataaagttatatatatttatatagactttatatatatatacatatataaagttaaggacttcagaaacattgtagttaactgaggcttccagttactgcggtcctggttgataagagagactttggaagagatcagtgcacccagaggttggcatctattgcttattgcttctgatattaaatgctgttatttgaagtaagcagttctaggattgagaacactgggtgtccccaacaacctgaacccacaggcattgtctgaggcatgttgcaacccaagcactggcttattttcaaagtcaagatgctcagggtttttgaaataattacatactgatgccagccaccaaagtgggctcaatgctgggtcaatatttttttctgtggataggggcccaaaataagcacaaaggtatataaaaagaggcttctccttttctgtcttctccttcttctcatttctctctccttctgtcacccctcctcttcctctattctttctcttttttgtgaatttagaacatgggaactggatagacttttaattattgtaagtattactgtcatggttcagtattcagttctaaaatgaaaattccctctcagatcatcctaagactcatttcacacatgtttttttttcccccaatttttctagacctttggctctcaactggagacaattttgccccactcccactgagacatttgtcaatgtctgcagacatgtttagttgcaacaactgggggagaattgctactatcatctagacggtggagatcagggatgcagctaatcaccctacagtgcacaggagccagcaacaaagaattatcagatctggccgggcatggtggctcacgcctgtaatcccagcattttgggaggccgaggcaggcagatcgcactgtcaggagttcgagaaccgcctggccactatggtgaaaccctgtctctactaaaaatacaaaagttagccaggcgtggtggcaggtgcctatagtcccagctacttgggaggctgaggcaggagaatcacttgaacccgggaggcggagattgcagtaagccaagatcacgccactgcactccagcctgggtgacagagcgagactccgtctcaaaacaaaaaaaaaaaaaagaaagaaagaaagaaagaaaaacaaacaaaaaaaagaattatcaggtacaaaatgtcaatagtgccaagagtgagaaacccttctctaagcctgtgctattcaatacagtagctgctagctacatatggctaatgagcacaggaattgtggataggctgaattaagatgtgttgtaagtgtaaaatacatattacattttagtgattgagtaaaaaaagaatatgaaacattatgaactttgttttgttttcttttttagacggagtttcacttttgtcatccaggctcgagtgcaatggtatgaccttggctcattgcaacctctaagcctgtgctattcaatacggtagctactagccacatatggctaatgagcacaggaattgtggctaggctgaattaagatgtgttgcacgtgtaaaatacatattacattttaatgactgagtaaaaaaaagaatatgaaatacatgaacttttttcttttcttttcttttttgagacgaagttttgcttttgtcacccaggcttgagtgcaatggcacgatctcggctcactgcaacctctgcctcccaggttcaagcgattctcctgcctcagcctctggagtagctgggattgcaggcatctgccactatgcccggctaattttcggtatttttagtagagatggggttttaccatgttggccaggctggtctcaaactcctgacctcaactggtccacctgcctcttctttttttgttttattttttatttttttgttttgaaatattaatagcttttgatgttgtatttttaattttttgaaaacttccatactgttttccatagtggttgtggtaatttacattcccaccaatagtgtataagaattcccttttctccacatctgcaccagcatttgttattttctattttttggatagccattctaactggggtaagatgatacctcattgtggttttgatttgcattttcctgatgattagtgatgtcgagcattctttcatatacctgttggccatttgtatgtcttttttttggagaaatgtctattcagatcctttgcccattttaaaatcagattatttgttttgttgttgtcaagtatgattcagcaatcccattactggatatttatcagaaagaaaggaaatcaatgtatggaagaggtagttgcacctccatgtttattgtagctctattcagaaaagcaagatatgaaatcaacttaaatgtctgtcaacagatcaatggataaagaaaatgtggtatatatacaaaatgaaatactattcagccttaaaaaagaaggaaattctgtcatttgcagcaacatggatgagcctagaggacattatgttaagtaagtcacgcacagaaagataaacaccatatgttcttgcttacatgtggaagctaaaaaaattgagctcacagaaacagagagtagaattatgcttattagaggctgggaagggtagtgaggaggggacaatagggcaatgttggttaatggatacaaaattataattggatagaagaaataatttctagtgtttcatagcactgtagggtaaatgtggttaacaataatttattatgtattttcgaaaacctagaagagaagattttgaatgttcatagcagaaatgataaatgattgaggtgatggatatgctaatcaccctgatttgattacttctaggtattaaaatatcactctgtaccccataaatatatacagttattacatac

SEQ ID NO: 3107 - DNA, 32240 bp, human
agacaactcagaagacactagacaacagcagtcttatctaaagaaataagacctccaaggacgaagcatcagaatgcttcaattaactggggaaaatgagaagaattgtgaagtttcagaacgtatcagaaggtccggaccatggaaagagatttcttttggggattatatttgtcacacatttcagggaggtatgttactttgactagttacaaaaaaaaaaaaaaaaagtaatgcttctgataagtttcaagttaagcatgatctgaaaagttatcttctaatttaatttgtcaatttgggcaagggctttctaaaattttcaataatagttttggtgttctcatagataaatcattcttctggtctaaattagatgaagtccaacaaagtcaatattggcaagaacatgttacaaatgttttctcctgttgcacctgcgcattatttctgtctttgtggtctttaattaagtgcactctttttttttttttttttttttgagatggagtctcgctctgtagcctaggctggagtgcagtggcaccatctcggctcactgcaacctccgcctcccaggtcccggttgaagcaattctcctgtcttagcctcctgagtagctgggattacaggcacacgccaccatgcccagctaatttttttgtatttttagtagagacagggtttcaccatgttggccaggctggtcttgaactcctgacctcatgatccgcccgcctcggcctcgcaaagtgctgggattacaggcgtgagccaccgcgcccggcctcaagtgcactcttaaaaaaggtataaaacctccttatagtcaaaacccatgtaagcatggtttgaatttaatctggagctggaatacaaatctcttaaatacagttcgttcattctgtagtgcaaatatctttacttgttcaatctcttaaaataggttaatttgcaagtagcatagtattctaaggtcaaaaacatttttcaattattgttaaagaggcagggaatggtgcatgttaatttcccagttttatttctttcatatatatatgtatatgtgtgtgtgtgtgtgtatacatatacacgaatccccccacccccaaatttaccaagatttggtaaataagactttctgtttttttgtttgttttgagatggattcttgctctgtcacccaggctggagttcagtggcacgatcttagctcagtgcaacctcctcctctggggttcaagcaattctcgtgcctcagcctcctgagtagctgggattataggcgcacgccaccacgcccggctaatttttgtatttttagtagagatggggtttcgctatgttggccaggctggtctcgaactcctgacctcaagtgatctgcccaccttggcctcccaaagtgctgggattataggtgtgagcacctgtgcctggccgctaaataagtctttctataagaatgtaggcagtaacatgcctggaccagtatttttcacatggttctgtgtttttcttttgataccactgttaacagtcagatactatattattacaaatcttcccccgccccacaaaatacttaaaaaataacaactctttattcaaaacccagtcctttaaatattaatgcaactaggccaatacacctaaacaataaatcctcctcaacccctcagtctctctaattcctaaattatcccataacaatatatttaggtgtattaaaaatcaagaacaaaattttgtggaagtgttaaactcaaaccagaaatcaaactcaaaccagaaatcacctttgcttttggtcacttttgcactggtcagacaaatgtttgttgggaaaatatatgacatttaatcagtaaattagctaattgacttacaaaagtcccagcccaaggttaagtttcttgagtctgctagcatatgctattcctgtaaactattgtcagcaatgtcaaaagcaaggaagggcaggaaaaacctagccagcacacaggttagacttttgtaggtccagagcactcttttttttttttttttttggaagctgcatttaacaccacatgcctcattaaatatcattctttgtgctgtaaaaccttttggaaagttgtttttttttttttttttttgtgcagtgggcgggtgggggtggatttcatagtctggaatacattattttatatgtctttgtggcttaaactattacatttgctgatcactcatcatagttgaattaagccatggttgactgttattagttttggtttttaagcttctttgtttattttgtctattatatgtatatttttttttcttttttaaagtttaatacattgtccttggcctttggtgttatgcctagagcaccagatggatcactggatcccaccttcagtccatagatatttctgcaggcactttctcaggagagatgtattgtatgatttttcaagctttgctaatttgtattaagctatgtttagtactgtgacttggtcatcaagaaagaaaatatagtgtagatacagattgatcatctgttattcataacccttcagccagccatgtttcagaattcaatagcttttgaatgttagaaagatcatacaatgtgcatactgtctattgcacagcacttctggtggggcctggagctgcctcccacagtcaaacattttgatctttctatagtgaacatataggtattcacactagatggaaatataaaacaaataataaattgcttaacctaagtcctggccatgctttgctgctaaacaagtttgcatcaaatttggggtaaagcttggttttcagaattggaggaactttacaagtgcagataagacgttgtagaactgtagtgccctctttcaaaaaaaaaaagggctattttaagctgtgtctaaaagatcagtcctattctaagttttatgcttaaaatcacttgttgatggactgaccatgatttgacagctatgcctctgcctaactcagcattctgaatcctttttcctgtcttttccattccaataggatcgccttagtttcattcttgcccaaacctcgacctagccttctgctcttatttagttttgctggttgtctccacaaacattggcctaaccatcctctaagttgcatatcaggtgcctgctggcttttcctaggttgggacaaccagtccttggcagaggctctaccttccaccagtctcctttagctcagctctcccgcccttaagagttcaaaggagccttctttctaatacactgcaacatagttaattgtgtctaacacagctcactgtgtctcatctcctctctaggactggacattctggagaatatttattttaactcagttttattacaatattttagatatctcaggaaatacattctattttcccagttacctttgtttcacataaaataccattaattctgctaggctcttgcctgtattttggttcaaaattaaaattccttatgaattttcttttccttaataaatgctacagaagatttgtttcatatgattttattttttattttttgagttggagtttcgctcttattgcccaagctggagtgcagtgatgtgatctcggctcactgcaacctctgcctcctgggttcaagtgattctcctgcctcagcctgctgagtagctgggagtacaggcgcccgccaccacactggctaatttttgtatttttagtagagacagggtttcaccatgttggccaggctggtctcgaactcctgaccttaggttatccacctgccttggcctcccaaagtgctgggattacaggcataagccaccgcgcccggctgttgggtcatctttttaaataaaaaaacagtaatctgaaatacttgttgaaattagagtaaaaattacaaaaacagtttaatcgttttttatctcaaatggttggaacttagacagctgtactccatctgaaccaatgttattgaaatatatacggttttagaagttgttgtgaagttgtcattcaaacagtctgagatacaaatcacattctgagaaaaattcaaagggggaaatgaaaaagcacttgaacattttccgtacacctcatcaggaataagcaaacatatttgtagagtaaactatcttcataatgtgtttgcagccctgtgacacgggcgatctgccaaaaaactaaaaatagattgccttagaagagaatgattgagtcctacttaagcattcatttatttggagagctcagttgcatacttcctgaagggaatggaaaaactcccaagctgccaagtaacttttatcctcaatttctcacaattagctccagtttgcaaaatgagaatggtaagagtgagagactctgttgggaacaaggatagaaaagcaggagaccccactgtggcagtttctggaaaagggttctgtgtgaaaacccttgaaggtcctttgaagcaagttctgggaaatgatggaactagaaaggctactttcttgagagttacttcgtttccagttgggaaacaaaaaggacttctacttttttttttttttttttttttttgagacggagtcttgctctgtcgcccaggctggagtgcagtggcgcgatctcggctcactgcgagctccgtctctcgggttcacaccattctcctgcctcagcctcccaggtagctgggactacaggcgcccgccaccacgcctggctaatttttttgtacatttagtagagatggggtttcaccatgttagccaggatggtctcgatctcctgacctcgtgatccacccgcctcagtctcccaaagtgctgggattacaggcgtgagccactgcacccagccctggatctctacttttagggtggtacaattggtttatttcacaccatttatagcagtggtccccaaccttcttggcaccagggactggtttcatggaagacaatttctccatggaccagggtgtggggggatggttttgggatgattcttgtgcattacatttattgtgcactttatttgtattattattacattgtaatatataatcaaataattatacaactcaccataatgtagaatctgtgggagccctgagcttgttttcctgcaactagatggtcccatctaggggtgatgggagacagtgacagatcatcaggcattagactcataaggagcgcccatcctagatcccttgtatgttcagttcacactcttctaagaatctagtgccactgatgatctgacaggaggcagagctcaggaggtaatgcaagcaaaggggagtggctgtaaatacagaagaagcatccgggcacagtggctcatgcctgtaatgccagcattttgggaggccgaggcaagtggatcacttgaggtcaggagttcaagaccagcctgggcaacatggcgaaatcccgtctctactaaaaatactaaaattagctgggagtggtgatgtgtgtctgtagtcccagctactcgggaggctgaggccagagaatctcttgaacctgggaggcagaggttgcagtaagctgagattgcaccactgcactccagcctaggggacagagcgagactccatctcaaaaaagaaaaatacagaagaagcttcacttgctcacctgctgctcacttcctgctgtgcagcccggttcctaacaggccacggaatggcccaggggttagggacccctgatttataaagaggaggtggatgtcagagcaacccaagacaagtcaatctaccacgagaataaggagaaattaaaaaccaatagttcttaaaaccagaacaaggtgtgttctaaagtccccataactagggtttcagtcctatttctgatacttcctagccatgagacagcttcatgtggagcagtggttgtcatgcattttggggtgttaccattcagcaaagcaaggcttttccccccttcactggaagctatgggatgggtactctgggagcaatacaagtttagataaggggcattcaaaaggaggggagcctggaatttcactctcaagttggaaatctgcttagagagacaacttgctgaaccccccatgccagatgaatatgaggaagagaattggaaagcagcaatgtggtgagggagaagcccaggacaaccaccattccctctttcttggtggaatgaaagatggcaccacaggcttgttaaccttgatctcagaggcacaggatcagagttggggacatcagaggatgctgcagtgatgacagacactaggagaggtggccaaatgccaatgggtagaaaaggtacatgggtgtaagccccagtgtgaagggcatgccacagacctggagtgaggcctgcagttgagactgatcaagcaggaccagcctcctcttccagttaacacttcccatcccatttccctttcctgtccctcttgtttctccccactcccaaggcactaaagggttggaccctagaagaaggaggtgggaagcatgtgaagaacatgctgcccttctgtctccagctgctgggtgggctggagaaggccataccctgccctgggagtgggaaaaggccaggagctgtgaagaggatcagagattacagctagaaagagggctagtctgtgttactttagaaactcttcatgaaagtatgatgtaaatacagagacatgcacaaatcctaagtgaacaactgcatgaattttcacaaagtgaacacagtcaggaaccagcacctaagagcaagaaattgcatattatcagcatggcccccaccatgccctcttgcaaacagtcctcacccctcctcggggtgcttttgactcctaacacccaaggcaagtttcccttccttgtgtactttatagcaggggtctccaacccccaggccacagaccagtaccagtccatggcctgttaggaactgggccatacagcaggaggtgagcggcaggtgagggacattactgcttgagctccgccttctgtcagatcagtggtggcattagattctcataggagtgtgagccctattgtgaactgcacatgcaagggacctagattacattctctttatgagaatctaatgcctgatgatctgaggtggtacagtgtcatcctgaaaccatcccctgcccaccctcatctgtggaaaaattgtcttccatgaaaccagtccttggtggcaaaaaggttggggactgctgctttatagaaaccaaatcacacggtacatgttcttttgtgtctggcttctttcactcaacattaggtttgtgagatttatccatgttgtgtatatgacttgagtctaatgggactgataagtaacggaaagttactagaaaatgaggatcaccacagcccacttggagacaagttttagaaataatgaaaacattcgtgttgataacctatgttaactcttttaattgcaagttgccacttaaatcctgtctttatttttaaatggaatacttacagtaccttcaagtgactcaggttgactggttattgtcagaacaatgaaatgacaaagccacagttatgggtttgcctcttccattggtcagggtgccgagctggcagccatgggtaaagactgtcctaccaaccccagtgcatgcattcacttccaagagcaactaggcaagagcgtaacatgtctgaagtacatttcatattgaatgagatgcagacatattagaggaaaagcctcactaattggtaattatatgcatacattgtctcattatttccagtttatgcaaattataaatatccaaagagttgttgttgttgttgttgttgttgttgttgtttgagacaaagtgtcactgtgtcacccaagctggagtgcaatggcgtgatcttggctcactgcagcctccacctcccgggttcaagtgattctcctgcctcagcctcccaagtagctgggattacaggcgcctaccaccgtgccaggctaatttttatatttttagtagagatggggtttcatgttggccaggctggtttcaaactcctgacctcaggtgatccacctgcctcagcctcccaaagtgctgggattacagcgtgagccactgcacccggcctcaaagagagtttaaaatattctacttgtcagctttcaaccaactaaagacaagggtaaatacaaatgcaatatatgctcatgttaaaaatttttatctgtttttgaaataccattcgactcagcaatcccattactgggtatatacctaaaggcatatgaattgttctgttataaggacacatacgtgcatatgttcattacagcactaatcacaataacaaagacatggactcaacccaaatgcccatcaatgacagactgggtaaagaaaatgtggtacatatacattatgcaatactatgtagtcataaaaaagaatgagatcatgtcctttgcagagacatggatggagctggaggccattatccttagaaaactaacaggaacagaaaaccaaatgccacatgttctcacttataagtggagctaaatgatgagaacacatggacacgtagaggggaacaacatacactggggcctattggagggtggagggtaggaggagtgagacgatcaggaaaaataactaaaggatactaggcttaatacctgggtgatgaaatactctgtaaaacaaacccccatggcacaagtttacctatggaacaaacctgcacatcctgcacatgtacccctgaacttaagataaaagtcaaaaaacataaaattgatgatgtctattgcatataattattttctttggaaaattttttatctgtttttctttgttattataaaaagcaatacacattcatatcaggagtatgggatcaccagtgattctatctatctatctatctatctatctatctatctatctatctaatctttttttttcttgttaaaatgtttggaaataatttcagccgacagaaaagttacaagaacagtacaaaaaaattcctgcttctcttcacccagagactccattcatgtttagccaacggtcctaataatgtcctttatagcaaaaggatcaggtgtcttgcctttagatagcgcgtttcgtcatccctttcaatctggaactgttcctcagtctctccaattattttgtaaaatgtcccctcagtttgggttggtgcacagtttcctccttatcagattttggttatgcattttgggcagaaatatcacagaagcggtggtgtgttcttctcattatgtttcttcttatggcacatgatgttgctcatcgcattccatcagatgacaatctgttccatcactggtgttaactttgctgatgttaactttgatcacttgggcaaagtgatgtctacaattctgttctataaaattatccctgttccttttctagttagtcattattttgcagggagatgagttgaagctgattctattatttcttcaatttctaagttgggattttattataaggaagcactttctcttctctgtctttatatattcatttatatcagtgaggacttctagattaccattttatttgataagatataatctcttattgtttattttgaaatcaggttttcccatatttggccaatggaagccccatcaagccagcatctgtgtctttttgtcacccaggccagagtacagtggcataatcttagctcactgcaacctctgcctcccgggttcaagcgattcttctgcctcagcctcctgagtagctggcactacaggcgtgcaccaccacaccctaatttttgtatttttatcagagacagggtttcaccatgctggccaggctggtctcgaactcctaacctcgtgatctgcccgcctcagcttcccaaagtgctgggattacaggcgtgagcctggccagcactttcttactttcttggaagatgtttaaggcccatcttgtattttacctggcccagacctgggatcaacatttctctaaggagtccgggttcaggttttctcagtgcaccatgctaaaaaaaaatacgtatatacgcacatctatgttttacatttaaatttacttttatatctagatatattgaaaatcacattttcatgctaattgctccaatatcaatccaacctcgtaaagtgcattcaagtttcccccattttcagaacccaaagggtgagagaagttcatacattgagtttcagtgtaggaggagggcttattgaaatgtttctaaccctgattctcatccactggaaaaattctttctttccttaaggccttcagttatttcaaattcacacaattccatttttgctgggattttcgtttcaccaagtttataggtatggaaacctgagtttttaacaccatcaggatcacccacaagaggttgaggagcctttgtgttaaatccaaattatattacattctattcagtgcatgaaaagcacaaccataatgtgaaaaagtcctacattttgcaaactggagtaggttttcttccaaaacaattgattgccctttggcaggtttaatggggggttacttctcaaatgctcatttaaactagttagtcttgtttgcagataagcaattataagaaaaatatgtctggaaggcggctctaaggctgttccttatggcactgctctactgtgcctacttattaatcatacaatgtccggagcacttaacatcgcggttgtatttgattggcctacttagagaccaatgcacttgacaaatatcagattattatatttccatcttaccagtaaggaaactggggttcaagtaattttggtaacttgctgaatttggcagagaaagtgatcaaggtaggacttgaaccctagcagtctggctccactggcccatgctcagtcatcacactaagctgcccacaacaaagcttttagggaaaaacttttgggagattaaattgtctgaaaaatgacattctgcagtataatagatatgtcttcattatcaaatgaagcagataaaattacctagagaatttggggaaaaaaacattttcactgatccctcagagcaagcttgtccaactcgtggcccaggatggctgtgaatgtggcccaacacaaattcataaattttcgtaaaacttacgagatttttttgtgatttttattttttagctcatcagatattgttagtgttagtatatttcatgtgtggcccaagacaatactccttccaatgcggcccagggaaaccaaaagattggacacccctgccttagagtctccttcataatacacaggctgttgagtctttggggtgtggatgaaggtggaaggcaggggaaggataaaaatgtggaggctcattgactttcttggcccttcattttgccttacatagagctatcggattcaagcactgagcactatatttttgaactaaatctattgcttattaaaattgcctcccaaaagccagagagattgactgttccttctcttggcacgcaccaccaaaccgtaaaggactttaacattcagtagcttgtctccctgaaagtggctgacgagagagcctgatgcgtgatacctgcttccctcctcttccctcctcttcccccaaacctcctctcacagtgggtgggcagcatggacaagttacaggaagaagtctccaggccttgactttgagcttgatttgtgtttcagattgctgggctgatcgatccccacttcatgaagctgcagctcaggggcgcttactggcccttaaaactttaattgcacaagtaagtgaactgaagacttgatccttcatgcttatgctataattacacatcattctttattagctttggctgtagcagaggtgtggctcaccctatccaggtcccaccattgccattcgaggcacgtatgtcctctcatacctcactgcctctcctcctcctgcctctcctttcctggagagctccttcattttcagcccagttccctccttttcctctgggccttcctttacctcataagaagtttccctatgaggaatgatagagaatgctctcaaatgtttgttgcactaactcacctcatgctcttccagcatgcattagcaccagcagtcctgaagctaagttagtcagctattgctgcctaaaaaatgacctcaaagcataatggctgaaaacaacagaaacttggattttcatggtttctgtgggccagggagcagcttagctaggtgattctggctctgggtctctcacaggctgccacgtgtcagccagggctgcagtcatctcatggctcaaggcgggcaggatctgctttcaaactcactcacgtggttgttgggaaacctcaattccttgccacatgagcctctccacagggctgtgtcatgagatggcagctggcttctctcagagagagtgcaagaggtacctaagaaggaagtcacagttgttttataacctcatctccgaagtgacattctgtcacttctgccatattctactcattaggtgtgagtcaacaagtccagcccacactcaaggggcagggattatacaagggaggcaatacctggattccaggattactgggtgctatcttagaggctgcctatcccaatgatacactattttaagaacaagcattaaaataggttgacaatgggtaaatctgactccccagggaacatttattgaagtcttagttatgaaggctactttatttatatttatgactacatccccagcaccttgaaaaatgagtaggggcctggtaagtatttgtgaaatgaatgaatgaaagtgtgcaggctccatttgctttgtatgttttagggtctacatttatacagaggaggtaagccatcatgtctttcttccacaactaggcaatcatctggctttcttgctactttgaatttaaaccactgggtgcactgctctctctctctctttttctttctctctctctctctgtctctctctctctgtctgtgtgtgcatgtgtatgtatttttcatttatttgttttttgatttctcctttatgagttgtgttacttcttaaaaagtagaggtaaatggaaatcagcactgccagcaatgatcaaatgaactttgtacctgattttatcacttgcttatttatttttaagtactttaaattggatgtgatttgattatttttaataggtaatatattcacatagttcaaaaattacaattatttaaaaaggtggactggccggatgtggtggctcacgcctgtaatcctagcactttaggaggccaaggtgggtggatcacctgaggtcaggagttcgagaccagcctgggcaacatggtgaaaccccatctgtactaaaagtacaaaaattagccaggcgtggtggtgggcgcctataatcccagctacttgggaggctgaggcaggaaaatcgtttgaacctggcggggtggaggttgcagtgaaccgagatcgcgtcacttcactccagcctgggtgaaagagtgaaactctgtctcaataaaataaataaataaataaaattaaaaaggtgcacaatgaaacgtcttgcacccacctcttctctctcagtctcccacccacctcttctctctcagtctcccacctcaatactttcattggtatatttttaataggctttttaaatttttgtataattttaaagaagagttgaaaaggatacagacagttcccatatacactgtacccttcacccaacttcctttaatattgacatcttacatagctatggtacattagtcaaaaatacgaagttaacattgatacaataccactgactaaactgcacactattgtgatttcaccagtttttcctctcatgtcctatttctgttccaggatcccacattgcactaactatacttaataagcatattagcttcaataatatggttaaatgtgtaagggggcattctttatacaaaagttcaactttttcttttacacccctacttctttactcttatacactgttaaaaaatgtatttgtctacttttataaactttattttacatttagataatatgatcgatgtgagtaaaacattaaaccgatatgagtaaaacattaagctaatgtgagtaaatgtgagtaaaacattaaaccaagattcaggagctcttggttacactgctggctgtcactgacaaccagtcttaaaaagtatttgaacattctactcctccattttctcatgcacaattgaggtgatccactctagatgatctttcaggcctttccagcatcacatttctacaatttcagggattctgagattttgcaccgtaacagttttttctagcacacttctgccaccttgtggactagtctgttttttcttattttctcaaaaggaaaagaaaaatgaaaagactttttctaactcttattagatgcccagtttgaaatatgtagcacagatctagagtaatgatgtcatattcaggacatgaaaatagacagaattcaggagtcaaaaagaggccttatgatgaagggacaattctgggaaatcacagctgctggccacagcaaggatgcagccagagatctggcaggagatggtggccgtgtaagtaggagttcggggttcagggtcatggcattgggttttggaagctttcagttggtcagttacaaggcataggatcaaaagcaggactcggctgggaaggacagaccagggacctaattccttttataaatcaaaaataaaattctaagcaccccctctccaaccatctgaatgtacccctcctctcagccagggcattccaaaactaacctgaaaaactggttcaggccatgacaggaaaggggggttgaacatgcctcattataccctcctcccttttggaactcaggaaaagatgaccagaatttaacatcaacacagaccttaagtctgataagaaacatttacaatctattctctctgaagcctgctacctggaggcttcatccacatgataaaacttttgtctccacaaccccttattgtaacccagacagacatttctattgataataactctttcaaccaattgccaatcagaaaaattttcaatctgtctataatctggagccccaggcccccactttgagttgtccaaccttcccaggccaaacaaatgtacattttacatgtatttgattgatgtctcatgtttccctaaaatgtataaaactaggctgtgccctgactaccctgggcacatgttctctggatctcctgagagcttgtcacaggccattggtcacttatatttggctcagaataaatctcttcaaatattttatagtttgactgtttttgtcaacacttttgcagatagaacgtgatcatcagagggagggaaatggtaagagccaagttgttaaaatcaggttatgaagtcagagttgtccagcagctaggctgaccttgtcatctgtcacatggagtccaggacaaggaaggggacacatggtagtatggggagggagaatgtgttaggacagggtggaggcactcatacctgggtgaggagatgaaggttaggagaagtccgctggccccggactctaggacttcagagacctctgcacacagtggagtcatggctgaagcagtgctgctactccacagcacatgaatcctaggagcacagtctacttactcttaagcctgggagttattgttttgtttcagatccagctcgacctcctgaacttgtctgcactccatcatctatacctcatacctactgttattcacagccacagcaggcccatgccagcctgttcctagactcatagtgacatctctgtggctctccttgctttggtcttacatccctactcctgcaatcaaccctccatgctgctaccagtaagcttctaaaaaggctaatctattagctccagaccctccgcagcctagcagacttcataggtgctccatttcctctaagacatgccctccttgtttggaaatcaaggcctttcatgacctagctccagcttactgtcctcctttgtctcctcccatctcctgcttctactttctgtgggttctttctgttccagaaatccgactgtggccctgccacaggaagcaacaggaagcaacaggaaataacttcctgttgcttcctgaatttgcagtttctattctctcctaatggcatactctttcttggtcttcacagcttgaaacattttatgcttcaagtcttagctaaatactacctcatttgcaaggtttttcttactccccaagccagattcaaggatatcctatgctcccaaactaattttggacatgcttccagtatagcaatattcttgctcttttgtctttcatttctgcctccccagtaggctctgggagaagagagacccatgtcataagttttgaagacccaggtcctagtacattacctgctccagaatgcagaattaacattcttttggataaatgaatgtgaggctgtcatgctgtctttaggctcccctgatcgtaacttctacttctctctctatggtactaatattacacccacagactgtgaaaatgtcagaaacatgtgaaacaacattgctttcattgctatcactaatgcagtatttcactctcttctgctgggcttggtggcttgcacttgaaatcccagctactcaggatgctgaggcaggaagatcacttgaggccaggagtttgagaccagcctgggcaacacagtgagaccccagtctgtaaaaaataaataaactctcttctttctaaattatagggtgtcaatgtgaaccttgtgacaattaaccgggtgtcttctctccacgaggcatgccttggaggtcacgtggcctgtgccaaagccttattggaaaatggtgcacacgtgagtactgcccctgcccacttgggtctgtctggccagatgcatctgttaatgtttaatgatagtttaccttccagatggcttacccactgtgggtaagggctgggctggttctatccatgtccgtattccatcatttaggctactcctctctcttcaacttacccccctgtgtgtaaatattcagacatggcaactcacaggaaccttttaaaactgtgttgctgaccttaagaaatctttattgtaccatgttttttttttgttttgttttgttttgtttttgagacggagtctcactctgtcgcccaggctggagtgcagtggcacaatctccgctcactgcaagctctgccggggttcacgccattctcctgcctcagcctccccagcagctgggactacaggcacacgccgccacgcccggctaatttttgtatttttagtagagacagagtttcactgtgttagccaggatggtcttgatctcctgaccttgtgatccacctgcctcggcctcccaaagtgctgggattacaggcgtgagccaccgcgcccggccttgtaccatgttttctttatgcattcatctgttggtggacacttgggttgctttcaggtctttgcaattgtgaacagtgctgcatcagacatgggagtgcagatatctcttggatatactgttttcctttcttctgggtatatacccagcagtaagattgttggatcatatggtatctctgtttttagttttctgatgaacctccaaactgttccccataatggttgtactaatttataatcccactaacactgtatgaggcttaataacaagattttaaagaacaatagaaaacactcttaattcaacaccttaaatgaacaactatttttattgagcaaaattatcaaaatgagcgagcttttaataaataatacattgggggaaacctacagaattgaactttatcttattttaaatttatctccaaacttttttcaaagggtgactgaggtgcaatatataatacagatatcagaatagaatcataaaatcacaacttctaaaaatcttctgtgtttagttgccagatgttctttgtttctaattttgttgtttaactcagtccttgcattatttactttatgagctgcaatgtttttaagtgcttaatgacaatttaaaacattttatatggaaatcgggtttctacatgtagaactgaatataaaagtcttccttgtgaaaactaattttcctgatgccattgtggtcgtgcattttctttttttgttttttttttttccatctttttatttttagacagagtctcactaacactgttgcccaagctggagtgcagtggcacaatctcagctcactgcaaactccacttcctagattcgaacgattcccctgcctcagcctcctgagtaactgggattacaggtgcccgccaccacgtccagctaatttttgtatttttagtgcagtaatttttgtatttttagtgaaaccagcgatgctggtttcagactcctgacctcaggtgatccgcccgccttggcctcccaaagtgctgggattacaggcgtgagccaccgtgccctgccaagtggtcatgcattttcattaggtagtgcttctctaagttaccactcagtcagctcatgggtaatgatgaaggaaggctgtgtgagagccgtttcctttcaagctagatgactggagtcacaggcagactgctgacaatatcaggtcagagaggaggttttgttgggcacaaagagaagaataagacatgtttccttgtctttgtcaattttataaagaaacagccaataaatactgtagcacaccatttaacatttaaatcagaatgagaaacgaaataagagaaagttggtccatcagtagaaagtcccccacaattggcagtcccatgaatacctcaaactcagtgcatttgtaactgagcttatcatgttcttccctctgggacctgctcctcatcttgggttcctagtttcagaggcctggtgaaagaaacatcctcttggtttcccaagctgcaaacctgagagtcatcttatttctttcatctccctatctaattaattaaaaactcctgctaattttactttctaagtttttcccaagtctatcctctcctttatcctactcccatagtcatctaaattatttattatattttcaaaatgatttctttttggccaggcacagtggctcacgcctgtaatcccagcactttgggaggctgaggcaggtagatcatgagatcaagagatcaagaccatcctggccaacatggtgaaaccccgtctctactaaaaatacaaaaactagctaggcatggtggcacgcgcctgtagtcccagcttcttgggagcctaaggcagcagaatctcttgaacccaggaggcggaggttgcagtgagccgagatcacaccactgcactccagcctggcaacagagcaagactccatctaaaaaataaaaaaattaaaaaaaattctttttgtatttgtcttccctaatggaattcagcctactcaaggagaggcaattgttcagcccactcaaggagaggcaattgtcttatcattgtttccaaaacattagcacctagtagatgctcaataaatgtttgttgacgtgaactaagagaaatttataggaaatcgcataagaagacaacttcctagactgagggtgaggatgaaacttagtaaaacacaaatcaaactagtcctaccaaatattttttagtaaaaatatagaaacccctagcaatataaatttacacacattttcccctgaccttgtctgtctctgccatcttagcatattatctttaactttccaatttaatgggggttaggctgggtgtggtggctcacacctgtaatccctgccctttggcaggctgaggcaggagggtcatttgaacccaggagtttgagaccagcctgggcaagatagctagacgctgtctacaaataatttttctaaatttgtgggtcatggtggtgcacgcctgtagtcccagctgctcaggaggctgaggcaggaggatcatttgagcctaggaattcgaggctgcagtgagctatgatcatgacactgcactccagcctggatagcagagcaagaccctgtttcacgggttatattgcaactctggaaacaagtctttttttgtgtccaaagcaaggacatttagaatcctgattatcacaagcatgcatccttagttgttgaagcaaaattgtttcacatcacaaacttgactgtcctatatttcaatggcatcagaggctccctaccactcctgcggttcccgatgttctttccaatctattgctgatacacaaagatgtctcccagccctgctggttctcatgtgcttcccacatccctacaaggtaccaaagatggttgcagacaccatgttgatggctattttctttcctttttttaaatttaatcttttaattttatttatttatttttatttttattttttattatactttaagttttagagtacatgtgcacaacgtgcaggtttgttacatatgtatacatgtgccatgttggtgtgctgcacccattaactcgtcatttacatcctaatgctatccctcccccctccccccaccccacaacagtccccggtgtgtgatgttccccttcctgtgaaaccaacccaaatgtccaacaatgatagactggattaagaaaatgttgatggctattttctatgtccctttggcttggtcatgctatctctagaagtaacagctggcatgtgtaatttgcatggattatagtagaccagagaggaagttgtggcaagaaagacagtagatctgtggagaattgccaaggattttgtaagcatggattttgggaccacagcctgccatgtttgttcatgattcagaggggagtcatattaatggaaaatggaaaatggaaataattgttgttgcaaatgcttattgagtgcttactgggtgacatgtaatgttttaagtgtttacatatagtaactcgctcgatccacccaataacttcatgaggtttcataatactgtaaagatgtggagttccctcacttattcaccagcgtggggaattcctctaggcaaatacataggaagacatacttggagatggtgagaatgaaataacaaatcctttgggtctctctttgcccatcattaggtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtaaatgagccaccacaatgcatgtgaaacattgatgggctcactccaatctgtatgaatcaatggtctagtgttagtcattcaagggtgaccctgatcttcctcaccattagaatatgtgtggcctagaaatcccacagcagtaacttcaatttgcctaaatcttcaggaaataccagtgtggcacaaaagagccctacttataacttcggaatgctttcctgactccaatttcccatttcctggggatggtctattggcaggcctttccagatcctctttgctggtgttttggtggcagctggtacagccaaggcagtagttctgacttccctgaattgtactatgcttatgtctctgtccttagtaggcaagaatagcttatcctctaaagcccataaaataccaaccactaacctaaaataaactatgaaagtatctgaaagccaaggctgatactatctctaatggaatagtaaatataaccgttcataataagttacacaatctagatgggctgatgacttcaaggtcatagttattgaaaagaaaaggctgcaactttccaaagtatagcattggtaatcttgaagctgactctagactcctgtgttgtcagttaatttccaagtgaaggaaaatagtaaatttaaggaatttaaagactgtatgtacagactagacctgaaccgagaagatgccactgaaaggagaaggccatttgtcaaaggtcacacccaaagagcaacattttgatgatagcaagtgagggagttgttctcttatactgagatcagaaatacaatggtgaagttaaaacactctagaatagtgatctttgctggtgtaactggagatgaaatattttatttcaaaaagcaaaagtgaaagatttgttccaggttattaaacatgtcacttgccaattttttccagtggattactttaaatgatgcaaaagacccaaatctaaatttatctatgtattttatgttctaaatgtatttaatacatatttattaattaatagctgatgttagtcatttcccaaacatcatgtaagtcctttaagttgtagagtaatgaactactttggaaatgatataaatgtctttctttcttttttttttttttttcgacagagtctcgtgctgttgcccaggctgcagtgcagtggcatgatttctgctcattgcaacctctggctcctgggttcaagcgattctcctgcctcagcctcccaagtagctgggattacaggtgcccgccaccacaattggctaatttttgtatttttagtagagatggggtttcaccatgttggccactctggtctcgaactcgacctcaggtgatccacctgactcggcctcccaaagtgctggtattacaggcatgagccaccgtgctcagccatataagtcttttttttttaatttttttaaattttttttttattttttgagacagagtcttgctctgtctcacaggctggagtgcaatggcacaatctcggctcactgcaacctccacctcctgggttcaagcaattctcctgcctcagcctcccacgtagctgagattacaggcacctgtcacagtgcccagctgatttttgtattttttagtaaagacagggtttcatcatgttggccaggctggtctcagactcctgacctcaggtgatccacccacctcagccttccaaagtgctggtattacaaaaagtctttattaaaaatttaatattgatttgaagtaaatttttgaagtaaaaattaatattatttgtatttccatacaaatgtttaaaaattgataagtactgagaatggtttgaattaattaagtatgtctgcagtgcttgactgattatatttggagcttttggtatctatgtgcctataaaacatatatatgctcataataaacacataatttgtgtgtctctgtatatttttctgtactgtaaaagcatgttaaggataaatatccacagaatgtaagcatgattagcaaattcattattttatacacttgtattagtgctagctatttaacttttctgtattcatttttaaaactttctgagaatatttaaatttaactcaaactaggctgtttcttgttcttcaaaaaaaagacaagaattattcaaaaatatgtattaaataccctgtattttccaagtagttttagggacttactagatattatttctggattcttatagctctaaacctctatgaacaagctgagtcatagtttgagtcaataccttgacatattgatgctgtaattcaggtataatatttaattatgtgaacaaatagtttgaattgacagtcctgatttgtacattttaatgcatatttatacttaatttagaatttgtgataaatcaggtaggtctaaaatgaagcttacttttatgttatctacaaaaaataggttggctaaattaattagtaatgacatgattttttagggagatatttaaatcttcaaagagaactaactctttgcaagctcccatcaatacctcagaagcactctctcctgaacaaagcattcacaggttgcaaatttatcatgtctatctatttattgggcaaactctcaaaagagaatgcttgcttacatagttgttgttagccactgaatatgaaagtgtatttaaatatattctatacttaagacttctttattctttctcataggtatttttcagactaaccaaagtactgttgcaggccatatatccaatctcacatgcatggataaagaagagaatgagagatttgtaatggagaggcgacagggttctcttgggtttgagcactagcttttcagagtaataataggcctagtcgtttgtccctctgggtcttgtcacttccatttgtaaaatggtggcatcattctggagagtgatttcaactgtgctacttggagcccttagttcagttaaagttaacttgggctgtaaagaggagctggagtggggaagcatgggcatgctcctctttttattggtattattttggtggtttctacctaagatttccaaaaacaaacacaaaaatgtttttatgctacaaaaagagatctaggttatttaattaatttatttatttatttattttgagacagagtctcgctttgtcggccaggctggagtgcagtggcgctatctcggctcactgtaacctcctcctccccggttcaagtgattctcctgcctcagcttcccgagtagctgggattatgggtgtgtgccaccatgcccagctaatttttgtatttttagtagagatggggtttcaccatgttggccaggctggtctcgaactcctgacctcagggaatccgccggtctcagcctcccaaaaagctgagattacaggcgtgagccaccacacccggccaacctaggttatttctaaagcccatttcagataagcaatcctataattctgttaatatttaatatgtcccttacttgagtgagggtatcttgtgttccaccaggtcacagagagtgcatggagatcctgctggcaaataatgttaacattgaccatgaggtgcctcagctcggaactcccctatatgtggcctgcacctaccagagggtagactgtgtgaagaaacttctagaattaggtaatttccaaaattattttcatgaagaaacctgttaactttgttgattttctacagcttcaaagatgaagttcttgtcatggttgaaaaatattcggttagcattttatgtttgaatgctaaaaacaaaacttctctagagaaatgagtgtctgtatttctcagtcctgcttcctttgatgttaactccatttacctggtattgttctccctggttgtcacaagatagctgccagcaatacctgggcttacagccctccttatccatacgcagcaagaaagagcattggctctttttaagtcacatgcccatctttgaacccctcatgggggccaagggaatacaatatattgattagtttaggcctagatttcagcctactctgcatttattaggcttcactggaaacacgagaactgaaactaacaagagggtggtttacctttgggaaatctaggtatgcttgccaggaagatgctggacggtaaaaacagacatttgctacaggctagtttatatctatcctgctacagtatctagtcattttaaaagcaattctaaaaggcatatacagaaaccaagagtccgtggaaaaatgaaatatcttttttttttttgagatgaagtttcgctcttattgcccaggttggagtgcaatggcgtgacctcagctcactgcaacctccacctccagggtttaagcgattctcctgccctagccgccggagtagctgggattacagacgcacaccactacacccggctaatttattgtatttttagtagagacaggattttaccatgttggccaggctggtctcgaactcctgacctcaggtgatccaccttcctcagtctcccaaagtgctgggattacaggtgtgagccactgtgcccggccggaaaaatgaaatatcttgaaactattctttggttaaagattcaacaaacttagcccctgacataaaggtggagatttagtaaaaacctttagttgtgaatttttatcttgaggaagtttttgtcttttttatttcccatcatttactattctctatagtaagttcagaaatcattttttgagccccaaataatataaatactaaataaacttagctttatcttttgtcccaaaacataataactatgtaacaggagcctcaaatactttattttgtatgccacacagtttatacgggaaagcaagtatttaaaatgactaaaactatctaaattcacttttctcaccaaagaatttcaagtagtcttagtaggcattgctgaggttctaggcttgagttgcatattttcaaacatttgtcaagtatgtcatggtacttaaaatgtctttatatgcaatgactatatttgaagctcattgtgctttacattacatttagtgttgaattgtggccatctgttttgttaaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggtaaccaagggctgggtatccattcctcttccataagcacattctctccccttcctgtctcatctgtagcattttttcctttttcttttctctttttaattgaaggtggcattgtgggaggtgataggccctgccgtcactgacctgtcttctgggattttatatgctgtgtatattcactaacaaccaaagggcatttacctataaccagagtgttgctttgtattttatataacaagaaaataaccagaaaaccggctgggcgtggtggctcacgcctgtaatcccagcactttgggaggctgaggcgggtggatcacaaggtcaggagtttgagaccagcctggccagcatggtgaaatcctgtctctactaaaaatacagaaattagccagatgtggtggctggcgcctgtagttccagctacttgggaggctgaggcaggagaatcgcttgaacctgggaggcggaggttgcgatgagcagagatcacaccactgcattccagcctgggtgacagagcgagactccgtctcaaaaaaaagaaaaccagaaaaccttgtttataccccgaaaatcttgaatttccatttctgtcctggcataagcgtatgattgagcaaaccaaaactctgctttgtaatattgggagacaatctgatggcaaattcaaaagacttgagtcagagtctgtaggggaggacacagagtatttcagaaatccgactaaatggtgaggttgtttgcctgttctccagatcagggagtaggtgggtctgcattcttcattgcttcattcccgtttccaccatgagcattaagagcaactactgatgccagaagaggtaaggcgagcatctgaaattcagaagagaaccaattcagaagagaacctcttatgtctatacagtaagaaaatattttcggagcctatattgattatttgtgtgcctgaagaatattaaagataattataattattcagctctacgtatgccaggcactgggctaaatttgaaacatagatcaagctcactgaatttttaaaactttagagcagtgggaactttatatggtagtagctggttgctatgccaggtacaaatgggaaaagaaaagcattgacaaggtcacacagctagctacataatagaattaggtaggattctgagccatctgaccccagagtgtgcacttttttttttttttttttttttgagatggagtctcactctgtctccaggctggagtgcagtggtgcgatctcggctcactgcaacctctgcctcccgggttcaagcgatttttctgcctcagcctcctgagtagctgggactacaggcgtgcaccaccacacccagctaatttttgtatttttagtagagacggggtttcaccatgttagccaggatggtctcgatctcttgacattgtgatccgcccgcctcagccttccaaagtgctgggattacaggtgtgagccactgcacctggccatcagaatgtgcactcttaatgtcataaggccccaaccctgaatcttttgaaacattcagtgaggagggtcttatttcactcaccagttccattttgtgaaaccactacatcatatataccttccaagtagaatgcttggttttaaccattttatgaatagtctttctaaatcagtgcttcttaagatttaacatgcatatcagttcacttgaggatttccttaaaatacagattctcattcaggaggtctaggatgggacctgtgactctgcatgtctagcaggctcccacgtgatgttgatggtgctggtctgaggaccacactttgcgtaccactggtctagattattattattgttattattattattattattttagacggagttttgctcttgttgcccaggctggagtgcagtggcgtgatctcggctcactgcaacctccgcctcccgggttcaagcaattctcctgcttcagcctcctgagtagctgcgattacaggcgcgtgccaccacgcccagctaattttttgtatttttagtagagatggggtttcatcatgttggctaggctggtctcgaactcctgacctcaggtgatccacccgcctcagcctcccaaagtgcagggatttcaggcgtgagccaccgcgcctggccaggattattttcaatagtctagatcattaatcattgttcttttatttgaatcttcaccagaagaattatgatcttcctcagcagatccgagcttggaaataccagctactttccaactgttagcagagactatagtttatagaagttttcacatttcctattttcttccatcaaaaatgtttctaggactaggatttgtagacctggatatcctggacagggcctagctcctctgtcctttgtcttcataaatatagccacttgctctagaaagattaatactggctgggcgcggtggctcacacctgtaatcccagcactttgggaggcccaggcgggtagaccatgaggtcaggagttcaagaccagcctggctaagatggtgaaaccccgtctctactaaaaatacaaaaattagctgggtttggtggcacccgcctgtaatcccacctacccgggaggctgaggcagagaactgcctaaacccgggaggcagaggttggagtgagctgagattgaaccactgcatttcagcctgggcgaccgagtgagattctgtcaaaaaaaaaaaaaaaaaaaaagaaagattaaataccaactacatcagagttcactctcctgtcagtgtctctgggcactggacaatttgtctacattaccattttgcagaggaggttaagtaggacaacaggtaaagaagttttctattcttgcttcccaagattttaactaagatcgattgtttggtcctccaggtagctttctatctcatggatgctccttggcaatgtgaagccaaatgttaacctggctattcgcatatgcagtccatcatttttcatggggtgtgagatgctgttacagtggatttttttgaaaaggaaaactttgtgtagaccagtaattaggttttcttgaagagatctttactgataacagtcaggttaggaaataatgactgtgcaactagtattgcagccaaaagctcattcatcctattcaaccatattctggactctcatcagctgattttccttaaggattcagagccattcaaagccatgggcatgatgattctgtgagactccttgagagtccatgagactcagtttcagggaacaatagggtctgacttgagtccttcttgcagatctctattgagctggaatccttgcaagaataaagggcctcttcagatttaagttgagacccagccagcaccacctcatgggcagctagagccggtaggtccaggagtactttgagggctgaatatctggcccctggcacatctcctaacactgcctctgtcaccacgcaggtggaacttcccgctgacaccctttccgtattgtccctctgttctgtggctgtgtcttggagtcctgcgtgttcagtccttccatttgcattttctccttggccagtgtattactttctttctttctttctttttttttttttttttttgaggcggagtctcgctctgtcgcccaggctggagtgcagtggcccgatctcggctcactgcaagctccgcctcccgggttcacgccattctcctgcctcagcctcccgagtagctgggactataggcacccgccaccacacccggctaattttttgtatttttagtggacacggggtttcaccgtgttagccaggatggtctccatctcctgacctcgtgatccgcccaccttggcctcccaaagtgctgggattacaggcgtgagccaccgtgcctggccccgtgtatcactttcattggcacattcaatacatgaatgagatgcattccctttagaccccacacctcattcctaacttgcctctggttagcttcattcttcaacattggtaatccaagtaccattggaagattaacttaaagaaatgcatcccttccagaggggcaaatcaggatctgctgtctgtatttagtgtccgctacctcattctatagttcctatacagatccagcttctcttctgcttttagaaaatttccgcctcttccagttctctgatttcccccttccaccccacctcccaccactatgaagttaacaccatttttatttctctctcaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggtataattttgattttttgtatatatatacgtatatatatatacatacatatacgtatatatatatacgtatatatatacacacacacacatgcactcatatatttaatgttttcaaagtccttaatatatatagttcatatatgttttcaaagtccttaatatatgtataaagcttatatatatatgttttcaaagttctttatatataaagttatatatatttatatagactttatatatatatacatatataaagttaaggacttcagaaacattgtagttaactgaggcttccagttactgcggtcctggttgataagagagactttggaagagatcagtgcacccagaggttggcatctattgcttattgcttctgatattaaatgctgttatttgaagtaagcagttctaggattgagaacactgggtgtccccaacaacctgaacccacaggcattgtctgaggcatgttgcaacccaagcactggcttattttcaaagtcaagatgctcagggtttttgaaataattacatactgatgccagccaccaaagtgggctcaatgctgggtcaatatttttttctgtggataggggcccaaaataagcacaaaggtatataaaaagaggcttctccttttctgtcttctccttcttctcatttctctctccttctgtcacccctcctcttcctctattctttctcttttttgtgaatttag

SEQ ID NO: 3108 - DNA, 32099 bp, human
atggaagatggtcctgttttctatggctttaaaaacatttttattacaatgtttgctacgttttttttctttaagcttttaattaaagtttttttggctctcctaacccatttctatatcgtcaaaggaaatagaaaagaagcggctaggatagcagaagagatctatggtggaatttcaggtaaaagtacatgaatttgttcctaatatttaaagaaaatccctcctagataattcatatgactagtatttctggaaggcagattatatttatactttgattttaagtgggtagtttgaaaaattgtcacttaaagtagcaaatgctgttggctgcatcaatttgtggaggattttcagctttattttttgcaagttcgtagatcttgtagcagttgttatttaagaagtaaataggtagtggcttactaagagtattttgagaaacttcatttctactagccaaagtaattacttgtatataattattttctttaatattttaaagcaaactttaacaatgaagggcattctaaccagactaaattctctcaggaaatagaatgactaataaattataattaaagcagcaaacgtggcaagctatgtgtattttttttgctgtcatttgcaactggaattgattaaccacttgtcactgtcaggaaaagctcttcactaaacccattttatatggtagcatgcaaagcactccaaacaaagtttattctaacatgaaatgccaagatttgggcaaaacattttaaattctcatgctttgtagagaatagtgtccatttctttcaagaaatgatttactttaattgtggtgagatgctacaaaagtaaatgagtcagatatccctgtcactcctgggattgtcacttaatagaggagtatttattcataaacagagttcagaatttccccgtgtatttttagtgtttgcaggggttccaggattacatcattctttatctagtatccatttcaatttgcatccaggattctctttcaaaatagtcttatgtgattccaatacactagacaactcagaagacactagacaacagcagtcttatctaaagaaataagacctccaaggacgaagcatcagaatgcttcaattaactggggaaaatgagaagaattgtgaagtttcagaacgtatcagaaggtccggaccatggaaagagatttcttttggggattatatttgtcacacatttcagggaggtatgttactttgactagttacaaaaaaaaaaaaaaaaagtaatgcttctgataagtttcaagttaagcatgatctgaaaagttatcttctaatttaatttgtcaatttgggcaagggctttctaaaattttcaataatagttttggtgttctcatagataaatcattcttctggtctaaattagatgaagtccaacaaagtcaatattggcaagaacatgttacaaatgttttctcctgttgcacctgcgcattatttctgtctttgtggtctttaattaagtgcactctttttttttttttttttttttgagatggagtctcgctctgtagcctaggctggagtgcagtggcaccatctcggctcactgcaacctccgcctcccaggtcccggttgaagcaattctcctgtcttagcctcctgagtagctgggattacaggcacacgccaccatgcccagctaatttttttgtatttttagtagagacagggtttcaccatgttggccaggctggtcttgaactcctgacctcatgatccgcccgcctcggcctcgcaaagtgctgggattacaggcgtgagccaccgcgcccggcctcaagtgcactcttaaaaaaggtataaaacctccttatagtcaaaacccatgtaagcatggtttgaatttaatctggagctggaatacaaatctcttaaatacagttcgttcattctgtagtgcaaatatctttacttgttcaatctcttaaaataggttaatttgcaagtagcatagtattctaaggtcaaaaacatttttcaattattgttaaagaggcagggaatggtgcatgttaatttcccagttttatttctttcatatatatatgtatatgtgtgtgtgtgtgtgtatacatatacacgaatccccccacccccaaatttaccaagatttggtaaataagactttctgtttttttgtttgttttgagatggattcttgctctgtcacccaggctggagttcagtggcacgatcttagctcagtgcaacctcctcctctggggttcaagcaattctcgtgcctcagcctcctgagtagctgggattataggcgcacgccaccacgcccggctaatttttgtatttttagtagagatggggtttcgctatgttggccaggctggtctcgaactcctgacctcaagtgatctgcccaccttggcctcccaaagtgctgggattataggtgtgagcacctgtgcctggccgctaaataagtctttctataagaatgtaggcagtaacatgcctggaccagtatttttcacatggttctgtgtttttcttttgataccactgttaacagtcagatactatattattacaaatcttcccccgccccacaaaatacttaaaaaataacaactctttattcaaaacccagtcctttaaatattaatgcaactaggccaatacacctaaacaataaatcctcctcaacccctcagtctctctaattcctaaattatcccataacaatatatttaggtgtattaaaaatcaagaacaaaattttgtggaagtgttaaactcaaaccagaaatcaaactcaaaccagaaatcacctttgcttttggtcacttttgcactggtcagacaaatgtttgttgggaaaatatatgacatttaatcagtaaattagctaattgacttacaaaagtcccagcccaaggttaagtttcttgagtctgctagcatatgctattcctgtaaactattgtcagcaatgtcaaaagcaaggaagggcaggaaaaacctagccagcacacaggttagacttttgtaggtccagagcactcttttttttttttttttttggaagctgcatttaacaccacatgcctcattaaatatcattctttgtgctgtaaaaccttttggaaagttgtttttttttttttttttttgtgcagtgggcgggtgggggtggatttcatagtctggaatacattattttatatgtctttgtggcttaaactattacatttgctgatcactcatcatagttgaattaagccatggttgactgttattagttttggtttttaagcttctttgtttattttgtctattatatgtatatttttttttcttttttaaagtttaatacattgtccttggcctttggtgttatgcctagagcaccagatggatcactggatcccaccttcagtccatagatatttctgcaggcactttctcaggagagatgtattgtatgatttttcaagctttgctaatttgtattaagctatgtttagtactgtgacttggtcatcaagaaagaaaatatagtgtagatacagattgatcatctgttattcataacccttcagccagccatgtttcagaattcaatagcttttgaatgttagaaagatcatacaatgtgcatactgtctattgcacagcacttctggtggggcctggagctgcctcccacagtcaaacattttgatctttctatagtgaacatataggtattcacactagatggaaatataaaacaaataataaattgcttaacctaagtcctggccatgctttgctgctaaacaagtttgcatcaaatttggggtaaagcttggttttcagaattggaggaactttacaagtgcagataagacgttgtagaactgtagtgccctctttcaaaaaaaaaaagggctattttaagctgtgtctaaaagatcagtcctattctaagttttatgcttaaaatcacttgttgatggactgaccatgatttgacagctatgcctctgcctaactcagcattctgaatcctttttcctgtcttttccattccaataggatcgccttagtttcattcttgcccaaacctcgacctagccttctgctcttatttagttttgctggttgtctccacaaacattggcctaaccatcctctaagttgcatatcaggtgcctgctggcttttcctaggttgggacaaccagtccttggcagaggctctaccttccaccagtctcctttagctcagctctcccgcccttaagagttcaaaggagccttctttctaatacactgcaacatagttaattgtgtctaacacagctcactgtgtctcatctcctctctaggactggacattctggagaatatttattttaactcagttttattacaatattttagatatctcaggaaatacattctattttcccagttacctttgtttcacataaaataccattaattctgctaggctcttgcctgtattttggttcaaaattaaaattccttatgaattttcttttccttaataaatgctacagaagatttgtttcatatgattttattttttattttttgagttggagtttcgctcttattgcccaagctggagtgcagtgatgtgatctcggctcactgcaacctctgcctcctgggttcaagtgattctcctgcctcagcctgctgagtagctgggagtacaggcgcccgccaccacactggctaatttttgtatttttagtagagacagggtttcaccatgttggccaggctggtctcgaactcctgaccttaggttatccacctgccttggcctcccaaagtgctgggattacaggcataagccaccgcgcccggctgttgggtcatctttttaaataaaaaaacagtaatctgaaatacttgttgaaattagagtaaaaattacaaaaacagtttaatcgttttttatctcaaatggttggaacttagacagctgtactccatctgaaccaatgttattgaaatatatacggttttagaagttgttgtgaagttgtcattcaaacagtctgagatacaaatcacattctgagaaaaattcaaagggggaaatgaaaaagcacttgaacattttccgtacacctcatcaggaataagcaaacatatttgtagagtaaactatcttcataatgtgtttgcagccctgtgacacgggcgatctgccaaaaaactaaaaatagattgccttagaagagaatgattgagtcctacttaagcattcatttatttggagagctcagttgcatacttcctgaagggaatggaaaaactcccaagctgccaagtaacttttatcctcaatttctcacaattagctccagtttgcaaaatgagaatggtaagagtgagagactctgttgggaacaaggatagaaaagcaggagaccccactgtggcagtttctggaaaagggttctgtgtgaaaacccttgaaggtcctttgaagcaagttctgggaaatgatggaactagaaaggctactttcttgagagttacttcgtttccagttgggaaacaaaaaggacttctacttttttttttttttttttttttttgagacggagtcttgctctgtcgcccaggctggagtgcagtggcgcgatctcggctcactgcgagctccgtctctcgggttcacaccattctcctgcctcagcctcccaggtagctgggactacaggcgcccgccaccacgcctggctaatttttttgtacatttagtagagatggggtttcaccatgttagccaggatggtctcgatctcctgacctcgtgatccacccgcctcagtctcccaaagtgctgggattacaggcgtgagccactgcacccagccctggatctctacttttagggtggtacaattggtttatttcacaccatttatagcagtggtccccaaccttcttggcaccagggactggtttcatggaagacaatttctccatggaccagggtgtggggggatggttttgggatgattcttgtgcattacatttattgtgcactttatttgtattattattacattgtaatatataatcaaataattatacaactcaccataatgtagaatctgtgggagccctgagcttgttttcctgcaactagatggtcccatctaggggtgatgggagacagtgacagatcatcaggcattagactcataaggagcgcccatcctagatcccttgtatgttcagttcacactcttctaagaatctagtgccactgatgatctgacaggaggcagagctcaggaggtaatgcaagcaaaggggagtggctgtaaatacagaagaagcatccgggcacagtggctcatgcctgtaatgccagcattttgggaggccgaggcaagtggatcacttgaggtcaggagttcaagaccagcctgggcaacatggcgaaatcccgtctctactaaaaatactaaaattagctgggagtggtgatgtgtgtctgtagtcccagctactcgggaggctgaggccagagaatctcttgaacctgggaggcagaggttgcagtaagctgagattgcaccactgcactccagcctaggggacagagcgagactccatctcaaaaaagaaaaatacagaagaagcttcacttgctcacctgctgctcacttcctgctgtgcagcccggttcctaacaggccacggaatggcccaggggttagggacccctgatttataaagaggaggtggatgtcagagcaacccaagacaagtcaatctaccacgagaataaggagaaattaaaaaccaatagttcttaaaaccagaacaaggtgtgttctaaagtccccataactagggtttcagtcctatttctgatacttcctagccatgagacagcttcatgtggagcagtggttgtcatgcattttggggtgttaccattcagcaaagcaaggcttttccccccttcactggaagctatgggatgggtactctgggagcaatacaagtttagataaggggcattcaaaaggaggggagcctggaatttcactctcaagttggaaatctgcttagagagacaacttgctgaaccccccatgccagatgaatatgaggaagagaattggaaagcagcaatgtggtgagggagaagcccaggacaaccaccattccctctttcttggtggaatgaaagatggcaccacaggcttgttaaccttgatctcagaggcacaggatcagagttggggacatcagaggatgctgcagtgatgacagacactaggagaggtggccaaatgccaatgggtagaaaaggtacatgggtgtaagccccagtgtgaagggcatgccacagacctggagtgaggcctgcagttgagactgatcaagcaggaccagcctcctcttccagttaacacttcccatcccatttccctttcctgtccctcttgtttctccccactcccaaggcactaaagggttggaccctagaagaaggaggtgggaagcatgtgaagaacatgctgcccttctgtctccagctgctgggtgggctggagaaggccataccctgccctgggagtgggaaaaggccaggagctgtgaagaggatcagagattacagctagaaagagggctagtctgtgttactttagaaactcttcatgaaagtatgatgtaaatacagagacatgcacaaatcctaagtgaacaactgcatgaattttcacaaagtgaacacagtcaggaaccagcacctaagagcaagaaattgcatattatcagcatggcccccaccatgccctcttgcaaacagtcctcacccctcctcggggtgcttttgactcctaacacccaaggcaagtttcccttccttgtgtactttatagcaggggtctccaacccccaggccacagaccagtaccagtccatggcctgttaggaactgggccatacagcaggaggtgagcggcaggtgagggacattactgcttgagctccgccttctgtcagatcagtggtggcattagattctcataggagtgtgagccctattgtgaactgcacatgcaagggacctagattacattctctttatgagaatctaatgcctgatgatctgaggtggtacagtgtcatcctgaaaccatcccctgcccaccctcatctgtggaaaaattgtcttccatgaaaccagtccttggtggcaaaaaggttggggactgctgctttatagaaaccaaatcacacggtacatgttcttttgtgtctggcttctttcactcaacattaggtttgtgagatttatccatgttgtgtatatgacttgagtctaatgggactgataagtaacggaaagttactagaaaatgaggatcaccacagcccacttggagacaagttttagaaataatgaaaacattcgtgttgataacctatgttaactcttttaattgcaagttgccacttaaatcctgtctttatttttaaatggaatacttacagtaccttcaagtgactcaggttgactggttattgtcagaacaatgaaatgacaaagccacagttatgggtttgcctcttccattggtcagggtgccgagctggcagccatgggtaaagactgtcctaccaaccccagtgcatgcattcacttccaagagcaactaggcaagagcgtaacatgtctgaagtacatttcatattgaatgagatgcagacatattagaggaaaagcctcactaattggtaattatatgcatacattgtctcattatttccagtttatgcaaattataaatatccaaagagttgttgttgttgttgttgttgttgttgttgtttgagacaaagtgtcactgtgtcacccaagctggagtgcaatggcgtgatcttggctcactgcagcctccacctcccgggttcaagtgattctcctgcctcagcctcccaagtagctgggattacaggcgcctaccaccgtgccaggctaatttttatatttttagtagagatggggtttcatgttggccaggctggtttcaaactcctgacctcaggtgatccacctgcctcagcctcccaaagtgctgggattacagcgtgagccactgcacccggcctcaaagagagtttaaaatattctacttgtcagctttcaaccaactaaagacaagggtaaatacaaatgcaatatatgctcatgttaaaaatttttatctgtttttgaaataccattcgactcagcaatcccattactgggtatatacctaaaggcatatgaattgttctgttataaggacacatacgtgcatatgttcattacagcactaatcacaataacaaagacatggactcaacccaaatgcccatcaatgacagactgggtaaagaaaatgtggtacatatacattatgcaatactatgtagtcataaaaaagaatgagatcatgtcctttgcagagacatggatggagctggaggccattatccttagaaaactaacaggaacagaaaaccaaatgccacatgttctcacttataagtggagctaaatgatgagaacacatggacacgtagaggggaacaacatacactggggcctattggagggtggagggtaggaggagtgagacgatcaggaaaaataactaaaggatactaggcttaatacctgggtgatgaaatactctgtaaaacaaacccccatggcacaagtttacctatggaacaaacctgcacatcctgcacatgtacccctgaacttaagataaaagtcaaaaaacataaaattgatgatgtctattgcatataattattttctttggaaaattttttatctgtttttctttgttattataaaaagcaatacacattcatatcaggagtatgggatcaccagtgattctatctatctatctatctatctatctatctatctatctatctaatctttttttttcttgttaaaatgtttggaaataatttcagccgacagaaaagttacaagaacagtacaaaaaaattcctgcttctcttcacccagagactccattcatgtttagccaacggtcctaataatgtcctttatagcaaaaggatcaggtgtcttgcctttagatagcgcgtttcgtcatccctttcaatctggaactgttcctcagtctctccaattattttgtaaaatgtcccctcagtttgggttggtgcacagtttcctccttatcagattttggttatgcattttgggcagaaatatcacagaagcggtggtgtgttcttctcattatgtttcttcttatggcacatgatgttgctcatcgcattccatcagatgacaatctgttccatcactggtgttaactttgctgatgttaactttgatcacttgggcaaagtgatgtctacaattctgttctataaaattatccctgttccttttctagttagtcattattttgcagggagatgagttgaagctgattctattatttcttcaatttctaagttgggattttattataaggaagcactttctcttctctgtctttatatattcatttatatcagtgaggacttctagattaccattttatttgataagatataatctcttattgtttattttgaaatcaggttttcccatatttggccaatggaagccccatcaagccagcatctgtgtctttttgtcacccaggccagagtacagtggcataatcttagctcactgcaacctctgcctcccgggttcaagcgattcttctgcctcagcctcctgagtagctggcactacaggcgtgcaccaccacaccctaatttttgtatttttatcagagacagggtttcaccatgctggccaggctggtctcgaactcctaacctcgtgatctgcccgcctcagcttcccaaagtgctgggattacaggcgtgagcctggccagcactttcttactttcttggaagatgtttaaggcccatcttgtattttacctggcccagacctgggatcaacatttctctaaggagtccgggttcaggttttctcagtgcaccatgctaaaaaaaaatacgtatatacgcacatctatgttttacatttaaatttacttttatatctagatatattgaaaatcacattttcatgctaattgctccaatatcaatccaacctcgtaaagtgcattcaagtttcccccattttcagaacccaaagggtgagagaagttcatacattgagtttcagtgtaggaggagggcttattgaaatgtttctaaccctgattctcatccactggaaaaattctttctttccttaaggccttcagttatttcaaattcacacaattccatttttgctgggattttcgtttcaccaagtttataggtatggaaacctgagtttttaacaccatcaggatcacccacaagaggttgaggagcctttgtgttaaatccaaattatattacattctattcagtgcatgaaaagcacaaccataatgtgaaaaagtcctacattttgcaaactggagtaggttttcttccaaaacaattgattgccctttggcaggtttaatggggggttacttctcaaatgctcatttaaactagttagtcttgtttgcagataagcaattataagaaaaatatgtctggaaggcggctctaaggctgttccttatggcactgctctactgtgcctacttattaatcatacaatgtccggagcacttaacatcgcggttgtatttgattggcctacttagagaccaatgcacttgacaaatatcagattattatatttccatcttaccagtaaggaaactggggttcaagtaattttggtaacttgctgaatttggcagagaaagtgatcaaggtaggacttgaaccctagcagtctggctccactggcccatgctcagtcatcacactaagctgcccacaacaaagcttttagggaaaaacttttgggagattaaattgtctgaaaaatgacattctgcagtataatagatatgtcttcattatcaaatgaagcagataaaattacctagagaatttggggaaaaaaacattttcactgatccctcagagcaagcttgtccaactcgtggcccaggatggctgtgaatgtggcccaacacaaattcataaattttcgtaaaacttacgagatttttttgtgatttttattttttagctcatcagatattgttagtgttagtatatttcatgtgtggcccaagacaatactccttccaatgcggcccagggaaaccaaaagattggacacccctgccttagagtctccttcataatacacaggctgttgagtctttggggtgtggatgaaggtggaaggcaggggaaggataaaaatgtggaggctcattgactttcttggcccttcattttgccttacatagagctatcggattcaagcactgagcactatatttttgaactaaatctattgcttattaaaattgcctcccaaaagccagagagattgactgttccttctcttggcacgcaccaccaaaccgtaaaggactttaacattcagtagcttgtctccctgaaagtggctgacgagagagcctgatgcgtgatacctgcttccctcctcttccctcctcttcccccaaacctcctctcacagtgggtgggcagcatggacaagttacaggaagaagtctccaggccttgactttgagcttgatttgtgtttcagattgctgggctgatcgatccccacttcatgaagctgcagctcaggggcgcttactggcccttaaaactttaattgcacaagtaagtgaactgaagacttgatccttcatgcttatgctataattacacatcattctttattagctttggctgtagcagaggtgtggctcaccctatccaggtcccaccattgccattcgaggcacgtatgtcctctcatacctcactgcctctcctcctcctgcctctcctttcctggagagctccttcattttcagcccagttccctccttttcctctgggccttcctttacctcataagaagtttccctatgaggaatgatagagaatgctctcaaatgtttgttgcactaactcacctcatgctcttccagcatgcattagcaccagcagtcctgaagctaagttagtcagctattgctgcctaaaaaatgacctcaaagcataatggctgaaaacaacagaaacttggattttcatggtttctgtgggccagggagcagcttagctaggtgattctggctctgggtctctcacaggctgccacgtgtcagccagggctgcagtcatctcatggctcaaggcgggcaggatctgctttcaaactcactcacgtggttgttgggaaacctcaattccttgccacatgagcctctccacagggctgtgtcatgagatggcagctggcttctctcagagagagtgcaagaggtacctaagaaggaagtcacagttgttttataacctcatctccgaagtgacattctgtcacttctgccatattctactcattaggtgtgagtcaacaagtccagcccacactcaaggggcagggattatacaagggaggcaatacctggattccaggattactgggtgctatcttagaggctgcctatcccaatgatacactattttaagaacaagcattaaaataggttgacaatgggtaaatctgactccccagggaacatttattgaagtcttagttatgaaggctactttatttatatttatgactacatccccagcaccttgaaaaatgagtaggggcctggtaagtatttgtgaaatgaatgaatgaaagtgtgcaggctccatttgctttgtatgttttagggtctacatttatacagaggaggtaagccatcatgtctttcttccacaactaggcaatcatctggctttcttgctactttgaatttaaaccactgggtgcactgctctctctctctctttttctttctctctctctctctgtctctctctctctgtctgtgtgtgcatgtgtatgtatttttcatttatttgttttttgatttctcctttatgagttgtgttacttcttaaaaagtagaggtaaatggaaatcagcactgccagcaatgatcaaatgaactttgtacctgattttatcacttgcttatttatttttaagtactttaaattggatgtgatttgattatttttaataggtaatatattcacatagttcaaaaattacaattatttaaaaaggtggactggccggatgtggtggctcacgcctgtaatcctagcactttaggaggccaaggtgggtggatcacctgaggtcaggagttcgagaccagcctgggcaacatggtgaaaccccatctgtactaaaagtacaaaaattagccaggcgtggtggtgggcgcctataatcccagctacttgggaggctgaggcaggaaaatcgtttgaacctggcggggtggaggttgcagtgaaccgagatcgcgtcacttcactccagcctgggtgaaagagtgaaactctgtctcaataaaataaataaataaataaaattaaaaaggtgcacaatgaaacgtcttgcacccacctcttctctctcagtctcccacccacctcttctctctcagtctcccacctcaatactttcattggtatatttttaataggctttttaaatttttgtataattttaaagaagagttgaaaaggatacagacagttcccatatacactgtacccttcacccaacttcctttaatattgacatcttacatagctatggtacattagtcaaaaatacgaagttaacattgatacaataccactgactaaactgcacactattgtgatttcaccagtttttcctctcatgtcctatttctgttccaggatcccacattgcactaactatacttaataagcatattagcttcaataatatggttaaatgtgtaagggggcattctttatacaaaagttcaactttttcttttacacccctacttctttactcttatacactgttaaaaaatgtatttgtctacttttataaactttattttacatttagataatatgatcgatgtgagtaaaacattaaaccgatatgagtaaaacattaagctaatgtgagtaaatgtgagtaaaacattaaaccaagattcaggagctcttggttacactgctggctgtcactgacaaccagtcttaaaaagtatttgaacattctactcctccattttctcatgcacaattgaggtgatccactctagatgatctttcaggcctttccagcatcacatttctacaatttcagggattctgagattttgcaccgtaacagttttttctagcacacttctgccaccttgtggactagtctgttttttcttattttctcaaaaggaaaagaaaaatgaaaagactttttctaactcttattagatgcccagtttgaaatatgtagcacagatctagagtaatgatgtcatattcaggacatgaaaatagacagaattcaggagtcaaaaagaggccttatgatgaagggacaattctgggaaatcacagctgctggccacagcaaggatgcagccagagatctggcaggagatggtggccgtgtaagtaggagttcggggttcagggtcatggcattgggttttggaagctttcagttggtcagttacaaggcataggatcaaaagcaggactcggctgggaaggacagaccagggacctaattccttttataaatcaaaaataaaattctaagcaccccctctccaaccatctgaatgtacccctcctctcagccagggcattccaaaactaacctgaaaaactggttcaggccatgacaggaaaggggggttgaacatgcctcattataccctcctcccttttggaactcaggaaaagatgaccagaatttaacatcaacacagaccttaagtctgataagaaacatttacaatctattctctctgaagcctgctacctggaggcttcatccacatgataaaacttttgtctccacaaccccttattgtaacccagacagacatttctattgataataactctttcaaccaattgccaatcagaaaaattttcaatctgtctataatctggagccccaggcccccactttgagttgtccaaccttcccaggccaaacaaatgtacattttacatgtatttgattgatgtctcatgtttccctaaaatgtataaaactaggctgtgccctgactaccctgggcacatgttctctggatctcctgagagcttgtcacaggccattggtcacttatatttggctcagaataaatctcttcaaatattttatagtttgactgtttttgtcaacacttttgcagatagaacgtgatcatcagagggagggaaatggtaagagccaagttgttaaaatcaggttatgaagtcagagttgtccagcagctaggctgaccttgtcatctgtcacatggagtccaggacaaggaaggggacacatggtagtatggggagggagaatgtgttaggacagggtggaggcactcatacctgggtgaggagatgaaggttaggagaagtccgctggccccggactctaggacttcagagacctctgcacacagtggagtcatggctgaagcagtgctgctactccacagcacatgaatcctaggagcacagtctacttactcttaagcctgggagttattgttttgtttcagatccagctcgacctcctgaacttgtctgcactccatcatctatacctcatacctactgttattcacagccacagcaggcccatgccagcctgttcctagactcatagtgacatctctgtggctctccttgctttggtcttacatccctactcctgcaatcaaccctccatgctgctaccagtaagcttctaaaaaggctaatctattagctccagaccctccgcagcctagcagacttcataggtgctccatttcctctaagacatgccctccttgtttggaaatcaaggcctttcatgacctagctccagcttactgtcctcctttgtctcctcccatctcctgcttctactttctgtgggttctttctgttccagaaatccgactgtggccctgccacaggaagcaacaggaagcaacaggaaataacttcctgttgcttcctgaatttgcagtttctattctctcctaatggcatactctttcttggtcttcacagcttgaaacattttatgcttcaagtcttagctaaatactacctcatttgcaaggtttttcttactccccaagccagattcaaggatatcctatgctcccaaactaattttggacatgcttccagtatagcaatattcttgctcttttgtctttcatttctgcctccccagtaggctctgggagaagagagacccatgtcataagttttgaagacccaggtcctagtacattacctgctccagaatgcagaattaacattcttttggataaatgaatgtgaggctgtcatgctgtctttaggctcccctgatcgtaacttctacttctctctctatggtactaatattacacccacagactgtgaaaatgtcagaaacatgtgaaacaacattgctttcattgctatcactaatgcagtatttcactctcttctgctgggcttggtggcttgcacttgaaatcccagctactcaggatgctgaggcaggaagatcacttgaggccaggagtttgagaccagcctgggcaacacagtgagaccccagtctgtaaaaaataaataaactctcttctttctaaattatagggtgtcaatgtgaaccttgtgacaattaaccgggtgtcttctctccacgaggcatgccttggaggtcacgtggcctgtgccaaagccttattggaaaatggtgcacacgtgagtactgcccctgcccacttgggtctgtctggccagatgcatctgttaatgtttaatgatagtttaccttccagatggcttacccactgtgggtaagggctgggctggttctatccatgtccgtattccatcatttaggctactcctctctcttcaacttacccccctgtgtgtaaatattcagacatggcaactcacaggaaccttttaaaactgtgttgctgaccttaagaaatctttattgtaccatgttttttttttgttttgttttgttttgtttttgagacggagtctcactctgtcgcccaggctggagtgcagtggcacaatctccgctcactgcaagctctgccggggttcacgccattctcctgcctcagcctccccagcagctgggactacaggcacacgccgccacgcccggctaatttttgtatttttagtagagacagagtttcactgtgttagccaggatggtcttgatctcctgaccttgtgatccacctgcctcggcctcccaaagtgctgggattacaggcgtgagccaccgcgcccggccttgtaccatgttttctttatgcattcatctgttggtggacacttgggttgctttcaggtctttgcaattgtgaacagtgctgcatcagacatgggagtgcagatatctcttggatatactgttttcctttcttctgggtatatacccagcagtaagattgttggatcatatggtatctctgtttttagttttctgatgaacctccaaactgttccccataatggttgtactaatttataatcccactaacactgtatgaggcttaataacaagattttaaagaacaatagaaaacactcttaattcaacaccttaaatgaacaactatttttattgagcaaaattatcaaaatgagcgagcttttaataaataatacattgggggaaacctacagaattgaactttatcttattttaaatttatctccaaacttttttcaaagggtgactgaggtgcaatatataatacagatatcagaatagaatcataaaatcacaacttctaaaaatcttctgtgtttagttgccagatgttctttgtttctaattttgttgtttaactcagtccttgcattatttactttatgagctgcaatgtttttaagtgcttaatgacaatttaaaacattttatatggaaatcgggtttctacatgtagaactgaatataaaagtcttccttgtgaaaactaattttcctgatgccattgtggtcgtgcattttctttttttgttttttttttttccatctttttatttttagacagagtctcactaacactgttgcccaagctggagtgcagtggcacaatctcagctcactgcaaactccacttcctagattcgaacgattcccctgcctcagcctcctgagtaactgggattacaggtgcccgccaccacgtccagctaatttttgtatttttagtgcagtaatttttgtatttttagtgaaaccagcgatgctggtttcagactcctgacctcaggtgatccgcccgccttggcctcccaaagtgctgggattacaggcgtgagccaccgtgccctgccaagtggtcatgcattttcattaggtagtgcttctctaagttaccactcagtcagctcatgggtaatgatgaaggaaggctgtgtgagagccgtttcctttcaagctagatgactggagtcacaggcagactgctgacaatatcaggtcagagaggaggttttgttgggcacaaagagaagaataagacatgtttccttgtctttgtcaattttataaagaaacagccaataaatactgtagcacaccatttaacatttaaatcagaatgagaaacgaaataagagaaagttggtccatcagtagaaagtcccccacaattggcagtcccatgaatacctcaaactcagtgcatttgtaactgagcttatcatgttcttccctctgggacctgctcctcatcttgggttcctagtttcagaggcctggtgaaagaaacatcctcttggtttcccaagctgcaaacctgagagtcatcttatttctttcatctccctatctaattaattaaaaactcctgctaattttactttctaagtttttcccaagtctatcctctcctttatcctactcccatagtcatctaaattatttattatattttcaaaatgatttctttttggccaggcacagtggctcacgcctgtaatcccagcactttgggaggctgaggcaggtagatcatgagatcaagagatcaagaccatcctggccaacatggtgaaaccccgtctctactaaaaatacaaaaactagctaggcatggtggcacgcgcctgtagtcccagcttcttgggagcctaaggcagcagaatctcttgaacccaggaggcggaggttgcagtgagccgagatcacaccactgcactccagcctggcaacagagcaagactccatctaaaaaataaaaaaattaaaaaaaattctttttgtatttgtcttccctaatggaattcagcctactcaaggagaggcaattgttcagcccactcaaggagaggcaattgtcttatcattgtttccaaaacattagcacctagtagatgctcaataaatgtttgttgacgtgaactaagagaaatttataggaaatcgcataagaagacaacttcctagactgagggtgaggatgaaacttagtaaaacacaaatcaaactagtcctaccaaatattttttagtaaaaatatagaaacccctagcaatataaatttacacacattttcccctgaccttgtctgtctctgccatcttagcatattatctttaactttccaatttaatgggggttaggctgggtgtggtggctcacacctgtaatccctgccctttggcaggctgaggcaggagggtcatttgaacccaggagtttgagaccagcctgggcaagatagctagacgctgtctacaaataatttttctaaatttgtgggtcatggtggtgcacgcctgtagtcccagctgctcaggaggctgaggcaggaggatcatttgagcctaggaattcgaggctgcagtgagctatgatcatgacactgcactccagcctggatagcagagcaagaccctgtttcacgggttatattgcaactctggaaacaagtctttttttgtgtccaaagcaaggacatttagaatcctgattatcacaagcatgcatccttagttgttgaagcaaaattgtttcacatcacaaacttgactgtcctatatttcaatggcatcagaggctccctaccactcctgcggttcccgatgttctttccaatctattgctgatacacaaagatgtctcccagccctgctggttctcatgtgcttcccacatccctacaaggtaccaaagatggttgcagacaccatgttgatggctattttctttcctttttttaaatttaatcttttaattttatttatttatttttatttttattttttattatactttaagttttagagtacatgtgcacaacgtgcaggtttgttacatatgtatacatgtgccatgttggtgtgctgcacccattaactcgtcatttacatcctaatgctatccctcccccctccccccaccccacaacagtccccggtgtgtgatgttccccttcctgtgaaaccaacccaaatgtccaacaatgatagactggattaagaaaatgttgatggctattttctatgtccctttggcttggtcatgctatctctagaagtaacagctggcatgtgtaatttgcatggattatagtagaccagagaggaagttgtggcaagaaagacagtagatctgtggagaattgccaaggattttgtaagcatggattttgggaccacagcctgccatgtttgttcatgattcagaggggagtcatattaatggaaaatggaaaatggaaataattgttgttgcaaatgcttattgagtgcttactgggtgacatgtaatgttttaagtgtttacatatagtaactcgctcgatccacccaataacttcatgaggtttcataatactgtaaagatgtggagttccctcacttattcaccagcgtggggaattcctctaggcaaatacataggaagacatacttggagatggtgagaatgaaataacaaatcctttgggtctctctttgcccatcattaggtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtaaatgagccaccacaatgcatgtgaaacattgatgggctcactccaatctgtatgaatcaatggtctagtgttagtcattcaagggtgaccctgatcttcctcaccattagaatatgtgtggcctagaaatcccacagcagtaacttcaatttgcctaaatcttcaggaaataccagtgtggcacaaaagagccctacttataacttcggaatgctttcctgactccaatttcccatttcctggggatggtctattggcaggcctttccagatcctctttgctggtgttttggtggcagctggtacagccaaggcagtagttctgacttccctgaattgtactatgcttatgtctctgtccttagtaggcaagaatagcttatcctctaaagcccataaaataccaaccactaacctaaaataaactatgaaagtatctgaaagccaaggctgatactatctctaatggaatagtaaatataaccgttcataataagttacacaatctagatgggctgatgacttcaaggtcatagttattgaaaagaaaaggctgcaactttccaaagtatagcattggtaatcttgaagctgactctagactcctgtgttgtcagttaatttccaagtgaaggaaaatagtaaatttaaggaatttaaagactgtatgtacagactagacctgaaccgagaagatgccactgaaaggagaaggccatttgtcaaaggtcacacccaaagagcaacattttgatgatagcaagtgagggagttgttctcttatactgagatcagaaatacaatggtgaagttaaaacactctagaatagtgatctttgctggtgtaactggagatgaaatattttatttcaaaaagcaaaagtgaaagatttgttccaggttattaaacatgtcacttgccaattttttccagtggattactttaaatgatgcaaaagacccaaatctaaatttatctatgtattttatgttctaaatgtatttaatacatatttattaattaatagctgatgttagtcatttcccaaacatcatgtaagtcctttaagttgtagagtaatgaactactttggaaatgatataaatgtctttctttcttttttttttttttttcgacagagtctcgtgctgttgcccaggctgcagtgcagtggcatgatttctgctcattgcaacctctggctcctgggttcaagcgattctcctgcctcagcctcccaagtagctgggattacaggtgcccgccaccacaattggctaatttttgtatttttagtagagatggggtttcaccatgttggccactctggtctcgaactcgacctcaggtgatccacctgactcggcctcccaaagtgctggtattacaggcatgagccaccgtgctcagccatataagtcttttttttttaatttttttaaattttttttttattttttgagacagagtcttgctctgtctcacaggctggagtgcaatggcacaatctcggctcactgcaacctccacctcctgggttcaagcaattctcctgcctcagcctcccacgtagctgagattacaggcacctgtcacagtgcccagctgatttttgtattttttagtaaagacagggtttcatcatgttggccaggctggtctcagactcctgacctcaggtgatccacccacctcagccttccaaagtgctggtattacaaaaagtctttattaaaaatttaatattgatttgaagtaaatttttgaagtaaaaattaatattatttgtatttccatacaaatgtttaaaaattgataagtactgagaatggtttgaattaattaagtatgtctgcagtgcttgactgattatatttggagcttttggtatctatgtgcctataaaacatatatatgctcataataaacacataatttgtgtgtctctgtatatttttctgtactgtaaaagcatgttaaggataaatatccacagaatgtaagcatgattagcaaattcattattttatacacttgtattagtgctagctatttaacttttctgtattcatttttaaaactttctgagaatatttaaatttaactcaaactaggctgtttcttgttcttcaaaaaaaagacaagaattattcaaaaatatgtattaaataccctgtattttccaagtagttttagggacttactagatattatttctggattcttatagctctaaacctctatgaacaagctgagtcatagtttgagtcaataccttgacatattgatgctgtaattcaggtataatatttaattatgtgaacaaatagtttgaattgacagtcctgatttgtacattttaatgcatatttatacttaatttagaatttgtgataaatcaggtaggtctaaaatgaagcttacttttatgttatctacaaaaaataggttggctaaattaattagtaatgacatgattttttagggagatatttaaatcttcaaagagaactaactctttgcaagctcccatcaatacctcagaagcactctctcctgaacaaagcattcacaggttgcaaatttatcatgtctatctatttattgggcaaactctcaaaagagaatgcttgcttacatagttgttgttagccactgaatatgaaagtgtatttaaatatattctatacttaagacttctttattctttctcataggtatttttcagactaaccaaagtactgttgcaggccatatatccaatctcacatgcatggataaagaagagaatgagagatttgtaatggagaggcgacagggttctcttgggtttgagcactagcttttcagagtaataataggcctagtcgtttgtccctctgggtcttgtcacttccatttgtaaaatggtggcatcattctggagagtgatttcaactgtgctacttggagcccttagttcagttaaagttaacttgggctgtaaagaggagctggagtggggaagcatgggcatgctcctctttttattggtattattttggtggtttctacctaagatttccaaaaacaaacacaaaaatgtttttatgctacaaaaagagatctaggttatttaattaatttatttatttatttattttgagacagagtctcgctttgtcggccaggctggagtgcagtggcgctatctcggctcactgtaacctcctcctccccggttcaagtgattctcctgcctcagcttcccgagtagctgggattatgggtgtgtgccaccatgcccagctaatttttgtatttttagtagagatggggtttcaccatgttggccaggctggtctcgaactcctgacctcagggaatccgccggtctcagcctcccaaaaagctgagattacaggcgtgagccaccacacccggccaacctaggttatttctaaagcccatttcagataagcaatcctataattctgttaatatttaatatgtcccttacttgagtgagggtatcttgtgttccaccaggtcacagagagtgcatggagatcctgctggcaaataatgttaacattgaccatgaggtgcctcagctcggaactcccctatatgtggcctgcacctaccagagggtagactgtgtgaagaaacttctagaattaggtaatttccaaaattattttcatgaagaaacctgttaactttgttgattttctacagcttcaaagatgaagttcttgtcatggttgaaaaatattcggttagcattttatgtttgaatgctaaaaacaaaacttctctagagaaatgagtgtctgtatttctcagtcctgcttcctttgatgttaactccatttacctggtattgttctccctggttgtcacaagatagctgccagcaatacctgggcttacagccctccttatccatacgcagcaagaaagagcattggctctttttaagtcacatgcccatctttgaacccctcatgggggccaagggaatacaatatattgattagtttaggcctagatttcagcctactctgcatttattaggcttcactggaaacacgagaactgaaactaacaagagggtggtttacctttgggaaatctaggtatgcttgccaggaagatgctggacggtaaaaacagacatttgctacaggctagtttatatctatcctgctacagtatctagtcattttaaaagcaattctaaaaggcatatacagaaaccaagagtccgtggaaaaatgaaatatcttttttttttttgagatgaagtttcgctcttattgcccaggttggagtgcaatggcgtgacctcagctcactgcaacctccacctccagggtttaagcgattctcctgccctagccgccggagtagctgggattacagacgcacaccactacacccggctaatttattgtatttttagtagagacaggattttaccatgttggccaggctggtctcgaactcctgacctcaggtgatccaccttcctcagtctcccaaagtgctgggattacaggtgtgagccactgtgcccggccggaaaaatgaaatatcttgaaactattctttggttaaagattcaacaaacttagcccctgacataaaggtggagatttagtaaaaacctttagttgtgaatttttatcttgaggaagtttttgtcttttttatttcccatcatttactattctctatagtaagttcagaaatcattttttgagccccaaataatataaatactaaataaacttagctttatcttttgtcccaaaacataataactatgtaacaggagcctcaaatactttattttgtatgccacacagtttatacgggaaagcaagtatttaaaatgactaaaactatctaaattcacttttctcaccaaagaatttcaagtagtcttagtaggcattgctgaggttctaggcttgagttgcatattttcaaacatttgtcaagtatgtcatggtacttaaaatgtctttatatgcaatgactatatttgaagctcattgtgctttacattacatttagtgttgaattgtggccatctgttttgttaaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggtaaccaagggctgggtatccattcctcttccataagcacattctctccccttcctgtctcatctgtagcattttttcctttttcttttctctttttaattgaaggtggcattgtgggaggtgataggccctgccgtcactgacctgtcttctgggattttatatgctgtgtatattcactaacaaccaaagggcatttacctataaccagagtgttgctttgtattttatataacaagaaaataaccagaaaaccggctgggcgtggtggctcacgcctgtaatcccagcactttgggaggctgaggcgggtggatcacaaggtcaggagtttgagaccagcctggccagcatggtgaaatcctgtctctactaaaaatacagaaattagccagatgtggtggctggcgcctgtagttccagctacttgggaggctgaggcaggagaatcgcttgaacctgggaggcggaggttgcgatgagcagagatcacaccactgcattccagcctgggtgacagagcgagactccgtctcaaaaaaaagaaaaccagaaaaccttgtttataccccgaaaatcttgaatttccatttctgtcctggcataagcgtatgattgagcaaaccaaaactctgctttgtaatattgggagacaatctgatggcaaattcaaaagacttgagtcagagtctgtaggggaggacacagagtatttcagaaatccgactaaatggtgaggttgtttgcctgttctccagatcagggagtaggtgggtctgcattcttcattgcttcattcccgtttccaccatgagcattaagagcaactactgatgccagaagaggtaaggcgagcatctgaaattcagaagagaaccaattcagaagagaacctcttatgtctatacagtaagaaaatattttcggagcctatattgattatttgtgtgcctgaagaatattaaagataattataattattcagctctacgtatgccaggcactgggctaaatttgaaacatagatcaagctcactgaatttttaaaactttagagcagtgggaactttatatggtagtagctggttgctatgccaggtacaaatgggaaaagaaaagcattgacaaggtcacacagctagctacataatagaattaggtaggattctgagccatctgaccccagagtgtgcacttttttttttttttttttttttgagatggagtctcactctgtctccaggctggagtgcagtggtgcgatctcggctcactgcaacctctgcctcccgggttcaagcgatttttctgcctcagcctcctgagtagctgggactacaggcgtgcaccaccacacccagctaatttttgtatttttagtagagacggggtttcaccatgttagccaggatggtctcgatctcttgacattgtgatccgcccgcctcagccttccaaagtgctgggattacaggtgtgagccactgcacctggccatcagaatgtgcactcttaatgtcataaggccccaaccctgaatcttttgaaacattcagtgaggagggtcttatttcactcaccagttccattttgtgaaaccactacatcatatataccttccaagtagaatgcttggttttaaccattttatgaatagtctttctaaatcagtgcttcttaagatttaacatgcatatcagttcacttgaggatttccttaaaatacagattctcattcaggaggtctaggatgggacctgtgactctgcatgtctagcaggctcccacgtgatgttgatggtgctggtctgaggaccacactttgcgtaccactggtctagattattattattgttattattattattattattttagacggagttttgctcttgttgcccaggctggagtgcagtggcgtgatctcggctcactgcaacctccgcctcccgggttcaagcaattctcctgcttcagcctcctgagtagctgcgattacaggcgcgtgccaccacgcccagctaattttttgtatttttagtagagatggggtttcatcatgttggctaggctggtctcgaactcctgacctcaggtgatccacccgcctcagcctcccaaagtgcagggatttcaggcgtgagccaccgcgcctggccaggattattttcaatagtctagatcattaatcattgttcttttatttgaatcttcaccagaagaattatgatcttcctcagcagatccgagcttggaaataccagctactttccaactgttagcagagactatagtttatagaagttttcacatttcctattttcttccatcaaaaatgtttctaggactaggatttgtagacctggatatcctggacagggcctagctcctctgtcctttgtcttcataaatatagccacttgctctagaaagattaatactggctgggcgcggtggctcacacctgtaatcccagcactttgggaggcccaggcgggtagaccatgaggtcaggagttcaagaccagcctggctaagatggtgaaaccccgtctctactaaaaatacaaaaattagctgggtttggtggcacccgcctgtaatcccacctacccgggaggctgaggcagagaactgcctaaacccgggaggcagaggttggagtgagctgagattgaaccactgcatttcagcctgggcgaccgagtgagattctgtcaaaaaaaaaaaaaaaaaaaaagaaagattaaataccaactacatcagagttcactctcctgtcagtgtctctgggcactggacaatttgtctacattaccattttgcagaggaggttaagtaggacaacaggtaaagaagttttctattcttgcttcccaagattttaactaagatcgattgtttggtcctccaggtagctttctatctcatggatgctccttggcaatgtgaagccaaatgttaacctggctattcgcatatgcagtccatcatttttcatggggtgtgagatgctgttacagtggatttttttgaaaaggaaaactttgtgtagaccagtaattaggttttcttgaagagatctttactgataacagtcaggttaggaaataatgactgtgcaactagtattgcagccaaaagctcattcatcctattcaaccatattctggactctcatcagctgattttccttaaggattcagagccattcaaagccatgggcatgatgattctgtgagactccttgagagtccatgagactcagtttcagggaacaatagggtctgacttgagtccttcttgcagatctctattgagctggaatccttgcaagaataaagggcctcttcagatttaagttgagacccagccagcaccacctcatgggcagctagagccggtaggtccaggagtactttgagggctgaatatctggcccctggcacatctcctaacactgcctctgtcaccacgcaggtggaacttcccgctgacaccctttccgtattgtccctctgttctgtggctgtgtcttggagtcctgcgtgttcagtccttccatttgcattttctccttggccagtgtattactttctttctttctttctttttttttttttttttttgaggcggagtctcgctctgtcgcccaggctggagtgcagtggcccgatctcggctcactgcaagctccgcctcccgggttcacgccattctcctgcctcagcctcccgagtagctgggactataggcacccgccaccacacccggctaattttttgtatttttagtggacacggggtttcaccgtgttagccaggatggtctccatctcctgacctcgtgatccgcccaccttggcctcccaaagtgctgggattacaggcgtgagccaccgtgcctggccccgtgtatcactttcattggcacattcaatacatgaatgagatgcattccctttagaccccacacctcattcctaacttgcctctggttagcttcattcttcaacattggtaatccaagtaccattggaagattaacttaaagaaatgcatcccttccagaggggcaaatcaggatctgctgtctgtatttagtgtccgctacctcattctatagttcctatacagatccagcttctcttctgcttttagaaaatttccgcctcttccagttctctgatttcccccttccaccccacctcccaccactatgaagttaacaccatttttatttctctctcaggcccacctgctctttcccagctctgccgcctgtgtgtccggaagtgtctcggtcgagcatgtcatcaagccatccacaagctacatctgccagagccactcgaacgattcctcctataccaat

SEQ ID NO: 3109 - DNA, 32612 bp, human
aactcagtgaaattttacagtcctaggaccctatacagagcataagccaaaatggaagatggtcctgttttctatggctttaaaaacatttttattacaatgtttgctacgttttttttctttaagcttttaattaaagtttttttggctctcctaacccatttctatatcgtcaaaggaaatagaaaagaagcggctaggatagcagaagagatctatggtggaatttcaggtaaaagtacatgaatttgttcctaatatttaaagaaaatccctcctagataattcatatgactagtatttctggaaggcagattatatttatactttgattttaagtgggtagtttgaaaaattgtcacttaaagtagcaaatgctgttggctgcatcaatttgtggaggattttcagctttattttttgcaagttcgtagatcttgtagcagttgttatttaagaagtaaataggtagtggcttactaagagtattttgagaaacttcatttctactagccaaagtaattacttgtatataattattttctttaatattttaaagcaaactttaacaatgaagggcattctaaccagactaaattctctcaggaaatagaatgactaataaattataattaaagcagcaaacgtggcaagctatgtgtattttttttgctgtcatttgcaactggaattgattaaccacttgtcactgtcaggaaaagctcttcactaaacccattttatatggtagcatgcaaagcactccaaacaaagtttattctaacatgaaatgccaagatttgggcaaaacattttaaattctcatgctttgtagagaatagtgtccatttctttcaagaaatgatttactttaattgtggtgagatgctacaaaagtaaatgagtcagatatccctgtcactcctgggattgtcacttaatagaggagtatttattcataaacagagttcagaatttccccgtgtatttttagtgtttgcaggggttccaggattacatcattctttatctagtatccatttcaatttgcatccaggattctctttcaaaatagtcttatgtgattccaatacactagacaactcagaagacactagacaacagcagtcttatctaaagaaataagacctccaaggacgaagcatcagaatgcttcaattaactggggaaaatgagaagaattgtgaagtttcagaacgtatcagaaggtccggaccatggaaagagatttcttttggggattatatttgtcacacatttcagggaggtatgttactttgactagttacaaaaaaaaaaaaaaaaagtaatgcttctgataagtttcaagttaagcatgatctgaaaagttatcttctaatttaatttgtcaatttgggcaagggctttctaaaattttcaataatagttttggtgttctcatagataaatcattcttctggtctaaattagatgaagtccaacaaagtcaatattggcaagaacatgttacaaatgttttctcctgttgcacctgcgcattatttctgtctttgtggtctttaattaagtgcactctttttttttttttttttttttgagatggagtctcgctctgtagcctaggctggagtgcagtggcaccatctcggctcactgcaacctccgcctcccaggtcccggttgaagcaattctcctgtcttagcctcctgagtagctgggattacaggcacacgccaccatgcccagctaatttttttgtatttttagtagagacagggtttcaccatgttggccaggctggtcttgaactcctgacctcatgatccgcccgcctcggcctcgcaaagtgctgggattacaggcgtgagccaccgcgcccggcctcaagtgcactcttaaaaaaggtataaaacctccttatagtcaaaacccatgtaagcatggtttgaatttaatctggagctggaatacaaatctcttaaatacagttcgttcattctgtagtgcaaatatctttacttgttcaatctcttaaaataggttaatttgcaagtagcatagtattctaaggtcaaaaacatttttcaattattgttaaagaggcagggaatggtgcatgttaatttcccagttttatttctttcatatatatatgtatatgtgtgtgtgtgtgtgtatacatatacacgaatccccccacccccaaatttaccaagatttggtaaataagactttctgtttttttgtttgttttgagatggattcttgctctgtcacccaggctggagttcagtggcacgatcttagctcagtgcaacctcctcctctggggttcaagcaattctcgtgcctcagcctcctgagtagctgggattataggcgcacgccaccacgcccggctaatttttgtatttttagtagagatggggtttcgctatgttggccaggctggtctcgaactcctgacctcaagtgatctgcccaccttggcctcccaaagtgctgggattataggtgtgagcacctgtgcctggccgctaaataagtctttctataagaatgtaggcagtaacatgcctggaccagtatttttcacatggttctgtgtttttcttttgataccactgttaacagtcagatactatattattacaaatcttcccccgccccacaaaatacttaaaaaataacaactctttattcaaaacccagtcctttaaatattaatgcaactaggccaatacacctaaacaataaatcctcctcaacccctcagtctctctaattcctaaattatcccataacaatatatttaggtgtattaaaaatcaagaacaaaattttgtggaagtgttaaactcaaaccagaaatcaaactcaaaccagaaatcacctttgcttttggtcacttttgcactggtcagacaaatgtttgttgggaaaatatatgacatttaatcagtaaattagctaattgacttacaaaagtcccagcccaaggttaagtttcttgagtctgctagcatatgctattcctgtaaactattgtcagcaatgtcaaaagcaaggaagggcaggaaaaacctagccagcacacaggttagacttttgtaggtccagagcactcttttttttttttttttttggaagctgcatttaacaccacatgcctcattaaatatcattctttgtgctgtaaaaccttttggaaagttgtttttttttttttttttttgtgcagtgggcgggtgggggtggatttcatagtctggaatacattattttatatgtctttgtggcttaaactattacatttgctgatcactcatcatagttgaattaagccatggttgactgttattagttttggtttttaagcttctttgtttattttgtctattatatgtatatttttttttcttttttaaagtttaatacattgtccttggcctttggtgttatgcctagagcaccagatggatcactggatcccaccttcagtccatagatatttctgcaggcactttctcaggagagatgtattgtatgatttttcaagctttgctaatttgtattaagctatgtttagtactgtgacttggtcatcaagaaagaaaatatagtgtagatacagattgatcatctgttattcataacccttcagccagccatgtttcagaattcaatagcttttgaatgttagaaagatcatacaatgtgcatactgtctattgcacagcacttctggtggggcctggagctgcctcccacagtcaaacattttgatctttctatagtgaacatataggtattcacactagatggaaatataaaacaaataataaattgcttaacctaagtcctggccatgctttgctgctaaacaagtttgcatcaaatttggggtaaagcttggttttcagaattggaggaactttacaagtgcagataagacgttgtagaactgtagtgccctctttcaaaaaaaaaaagggctattttaagctgtgtctaaaagatcagtcctattctaagttttatgcttaaaatcacttgttgatggactgaccatgatttgacagctatgcctctgcctaactcagcattctgaatcctttttcctgtcttttccattccaataggatcgccttagtttcattcttgcccaaacctcgacctagccttctgctcttatttagttttgctggttgtctccacaaacattggcctaaccatcctctaagttgcatatcaggtgcctgctggcttttcctaggttgggacaaccagtccttggcagaggctctaccttccaccagtctcctttagctcagctctcccgcccttaagagttcaaaggagccttctttctaatacactgcaacatagttaattgtgtctaacacagctcactgtgtctcatctcctctctaggactggacattctggagaatatttattttaactcagttttattacaatattttagatatctcaggaaatacattctattttcccagttacctttgtttcacataaaataccattaattctgctaggctcttgcctgtattttggttcaaaattaaaattccttatgaattttcttttccttaataaatgctacagaagatttgtttcatatgattttattttttattttttgagttggagtttcgctcttattgcccaagctggagtgcagtgatgtgatctcggctcactgcaacctctgcctcctgggttcaagtgattctcctgcctcagcctgctgagtagctgggagtacaggcgcccgccaccacactggctaatttttgtatttttagtagagacagggtttcaccatgttggccaggctggtctcgaactcctgaccttaggttatccacctgccttggcctcccaaagtgctgggattacaggcataagccaccgcgcccggctgttgggtcatctttttaaataaaaaaacagtaatctgaaatacttgttgaaattagagtaaaaattacaaaaacagtttaatcgttttttatctcaaatggttggaacttagacagctgtactccatctgaaccaatgttattgaaatatatacggttttagaagttgttgtgaagttgtcattcaaacagtctgagatacaaatcacattctgagaaaaattcaaagggggaaatgaaaaagcacttgaacattttccgtacacctcatcaggaataagcaaacatatttgtagagtaaactatcttcataatgtgtttgcagccctgtgacacgggcgatctgccaaaaaactaaaaatagattgccttagaagagaatgattgagtcctacttaagcattcatttatttggagagctcagttgcatacttcctgaagggaatggaaaaactcccaagctgccaagtaacttttatcctcaatttctcacaattagctccagtttgcaaaatgagaatggtaagagtgagagactctgttgggaacaaggatagaaaagcaggagaccccactgtggcagtttctggaaaagggttctgtgtgaaaacccttgaaggtcctttgaagcaagttctgggaaatgatggaactagaaaggctactttcttgagagttacttcgtttccagttgggaaacaaaaaggacttctacttttttttttttttttttttttttgagacggagtcttgctctgtcgcccaggctggagtgcagtggcgcgatctcggctcactgcgagctccgtctctcgggttcacaccattctcctgcctcagcctcccaggtagctgggactacaggcgcccgccaccacgcctggctaatttttttgtacatttagtagagatggggtttcaccatgttagccaggatggtctcgatctcctgacctcgtgatccacccgcctcagtctcccaaagtgctgggattacaggcgtgagccactgcacccagccctggatctctacttttagggtggtacaattggtttatttcacaccatttatagcagtggtccccaaccttcttggcaccagggactggtttcatggaagacaatttctccatggaccagggtgtggggggatggttttgggatgattcttgtgcattacatttattgtgcactttatttgtattattattacattgtaatatataatcaaataattatacaactcaccataatgtagaatctgtgggagccctgagcttgttttcctgcaactagatggtcccatctaggggtgatgggagacagtgacagatcatcaggcattagactcataaggagcgcccatcctagatcccttgtatgttcagttcacactcttctaagaatctagtgccactgatgatctgacaggaggcagagctcaggaggtaatgcaagcaaaggggagtggctgtaaatacagaagaagcatccgggcacagtggctcatgcctgtaatgccagcattttgggaggccgaggcaagtggatcacttgaggtcaggagttcaagaccagcctgggcaacatggcgaaatcccgtctctactaaaaatactaaaattagctgggagtggtgatgtgtgtctgtagtcccagctactcgggaggctgaggccagagaatctcttgaacctgggaggcagaggttgcagtaagctgagattgcaccactgcactccagcctaggggacagagcgagactccatctcaaaaaagaaaaatacagaagaagcttcacttgctcacctgctgctcacttcctgctgtgcagcccggttcctaacaggccacggaatggcccaggggttagggacccctgatttataaagaggaggtggatgtcagagcaacccaagacaagtcaatctaccacgagaataaggagaaattaaaaaccaatagttcttaaaaccagaacaaggtgtgttctaaagtccccataactagggtttcagtcctatttctgatacttcctagccatgagacagcttcatgtggagcagtggttgtcatgcattttggggtgttaccattcagcaaagcaaggcttttccccccttcactggaagctatgggatgggtactctgggagcaatacaagtttagataaggggcattcaaaaggaggggagcctggaatttcactctcaagttggaaatctgcttagagagacaacttgctgaaccccccatgccagatgaatatgaggaagagaattggaaagcagcaatgtggtgagggagaagcccaggacaaccaccattccctctttcttggtggaatgaaagatggcaccacaggcttgttaaccttgatctcagaggcacaggatcagagttggggacatcagaggatgctgcagtgatgacagacactaggagaggtggccaaatgccaatgggtagaaaaggtacatgggtgtaagccccagtgtgaagggcatgccacagacctggagtgaggcctgcagttgagactgatcaagcaggaccagcctcctcttccagttaacacttcccatcccatttccctttcctgtccctcttgtttctccccactcccaaggcactaaagggttggaccctagaagaaggaggtgggaagcatgtgaagaacatgctgcccttctgtctccagctgctgggtgggctggagaaggccataccctgccctgggagtgggaaaaggccaggagctgtgaagaggatcagagattacagctagaaagagggctagtctgtgttactttagaaactcttcatgaaagtatgatgtaaatacagagacatgcacaaatcctaagtgaacaactgcatgaattttcacaaagtgaacacagtcaggaaccagcacctaagagcaagaaattgcatattatcagcatggcccccaccatgccctcttgcaaacagtcctcacccctcctcggggtgcttttgactcctaacacccaaggcaagtttcccttccttgtgtactttatagcaggggtctccaacccccaggccacagaccagtaccagtccatggcctgttaggaactgggccatacagcaggaggtgagcggcaggtgagggacattactgcttgagctccgccttctgtcagatcagtggtggcattagattctcataggagtgtgagccctattgtgaactgcacatgcaagggacctagattacattctctttatgagaatctaatgcctgatgatctgaggtggtacagtgtcatcctgaaaccatcccctgcccaccctcatctgtggaaaaattgtcttccatgaaaccagtccttggtggcaaaaaggttggggactgctgctttatagaaaccaaatcacacggtacatgttcttttgtgtctggcttctttcactcaacattaggtttgtgagatttatccatgttgtgtatatgacttgagtctaatgggactgataagtaacggaaagttactagaaaatgaggatcaccacagcccacttggagacaagttttagaaataatgaaaacattcgtgttgataacctatgttaactcttttaattgcaagttgccacttaaatcctgtctttatttttaaatggaatacttacagtaccttcaagtgactcaggttgactggttattgtcagaacaatgaaatgacaaagccacagttatgggtttgcctcttccattggtcagggtgccgagctggcagccatgggtaaagactgtcctaccaaccccagtgcatgcattcacttccaagagcaactaggcaagagcgtaacatgtctgaagtacatttcatattgaatgagatgcagacatattagaggaaaagcctcactaattggtaattatatgcatacattgtctcattatttccagtttatgcaaattataaatatccaaagagttgttgttgttgttgttgttgttgttgttgtttgagacaaagtgtcactgtgtcacccaagctggagtgcaatggcgtgatcttggctcactgcagcctccacctcccgggttcaagtgattctcctgcctcagcctcccaagtagctgggattacaggcgcctaccaccgtgccaggctaatttttatatttttagtagagatggggtttcatgttggccaggctggtttcaaactcctgacctcaggtgatccacctgcctcagcctcccaaagtgctgggattacagcgtgagccactgcacccggcctcaaagagagtttaaaatattctacttgtcagctttcaaccaactaaagacaagggtaaatacaaatgcaatatatgctcatgttaaaaatttttatctgtttttgaaataccattcgactcagcaatcccattactgggtatatacctaaaggcatatgaattgttctgttataaggacacatacgtgcatatgttcattacagcactaatcacaataacaaagacatggactcaacccaaatgcccatcaatgacagactgggtaaagaaaatgtggtacatatacattatgcaatactatgtagtcataaaaaagaatgagatcatgtcctttgcagagacatggatggagctggaggccattatccttagaaaactaacaggaacagaaaaccaaatgccacatgttctcacttataagtggagctaaatgatgagaacacatggacacgtagaggggaacaacatacactggggcctattggagggtggagggtaggaggagtgagacgatcaggaaaaataactaaaggatactaggcttaatacctgggtgatgaaatactctgtaaaacaaacccccatggcacaagtttacctatggaacaaacctgcacatcctgcacatgtacccctgaacttaagataaaagtcaaaaaacataaaattgatgatgtctattgcatataattattttctttggaaaattttttatctgtttttctttgttattataaaaagcaatacacattcatatcaggagtatgggatcaccagtgattctatctatctatctatctatctatctatctatctatctatctaatctttttttttcttgttaaaatgtttggaaataatttcagccgacagaaaagttacaagaacagtacaaaaaaattcctgcttctcttcacccagagactccattcatgtttagccaacggtcctaataatgtcctttatagcaaaaggatcaggtgtcttgcctttagatagcgcgtttcgtcatccctttcaatctggaactgttcctcagtctctccaattattttgtaaaatgtcccctcagtttgggttggtgcacagtttcctccttatcagattttggttatgcattttgggcagaaatatcacagaagcggtggtgtgttcttctcattatgtttcttcttatggcacatgatgttgctcatcgcattccatcagatgacaatctgttccatcactggtgttaactttgctgatgttaactttgatcacttgggcaaagtgatgtctacaattctgttctataaaattatccctgttccttttctagttagtcattattttgcagggagatgagttgaagctgattctattatttcttcaatttctaagttgggattttattataaggaagcactttctcttctctgtctttatatattcatttatatcagtgaggacttctagattaccattttatttgataagatataatctcttattgtttattttgaaatcaggttttcccatatttggccaatggaagccccatcaagccagcatctgtgtctttttgtcacccaggccagagtacagtggcataatcttagctcactgcaacctctgcctcccgggttcaagcgattcttctgcctcagcctcctgagtagctggcactacaggcgtgcaccaccacaccctaatttttgtatttttatcagagacagggtttcaccatgctggccaggctggtctcgaactcctaacctcgtgatctgcccgcctcagcttcccaaagtgctgggattacaggcgtgagcctggccagcactttcttactttcttggaagatgtttaaggcccatcttgtattttacctggcccagacctgggatcaacatttctctaaggagtccgggttcaggttttctcagtgcaccatgctaaaaaaaaatacgtatatacgcacatctatgttttacatttaaatttacttttatatctagatatattgaaaatcacattttcatgctaattgctccaatatcaatccaacctcgtaaagtgcattcaagtttcccccattttcagaacccaaagggtgagagaagttcatacattgagtttcagtgtaggaggagggcttattgaaatgtttctaaccctgattctcatccactggaaaaattctttctttccttaaggccttcagttatttcaaattcacacaattccatttttgctgggattttcgtttcaccaagtttataggtatggaaacctgagtttttaacaccatcaggatcacccacaagaggttgaggagcctttgtgttaaatccaaattatattacattctattcagtgcatgaaaagcacaaccataatgtgaaaaagtcctacattttgcaaactggagtaggttttcttccaaaacaattgattgccctttggcaggtttaatggggggttacttctcaaatgctcatttaaactagttagtcttgtttgcagataagcaattataagaaaaatatgtctggaaggcggctctaaggctgttccttatggcactgctctactgtgcctacttattaatcatacaatgtccggagcacttaacatcgcggttgtatttgattggcctacttagagaccaatgcacttgacaaatatcagattattatatttccatcttaccagtaaggaaactggggttcaagtaattttggtaacttgctgaatttggcagagaaagtgatcaaggtaggacttgaaccctagcagtctggctccactggcccatgctcagtcatcacactaagctgcccacaacaaagcttttagggaaaaacttttgggagattaaattgtctgaaaaatgacattctgcagtataatagatatgtcttcattatcaaatgaagcagataaaattacctagagaatttggggaaaaaaacattttcactgatccctcagagcaagcttgtccaactcgtggcccaggatggctgtgaatgtggcccaacacaaattcataaattttcgtaaaacttacgagatttttttgtgatttttattttttagctcatcagatattgttagtgttagtatatttcatgtgtggcccaagacaatactccttccaatgcggcccagggaaaccaaaagattggacacccctgccttagagtctccttcataatacacaggctgttgagtctttggggtgtggatgaaggtggaaggcaggggaaggataaaaatgtggaggctcattgactttcttggcccttcattttgccttacatagagctatcggattcaagcactgagcactatatttttgaactaaatctattgcttattaaaattgcctcccaaaagccagagagattgactgttccttctcttggcacgcaccaccaaaccgtaaaggactttaacattcagtagcttgtctccctgaaagtggctgacgagagagcctgatgcgtgatacctgcttccctcctcttccctcctcttcccccaaacctcctctcacagtgggtgggcagcatggacaagttacaggaagaagtctccaggccttgactttgagcttgatttgtgtttcagattgctgggctgatcgatccccacttcatgaagctgcagctcaggggcgcttactggcccttaaaactttaattgcacaagtaagtgaactgaagacttgatccttcatgcttatgctataattacacatcattctttattagctttggctgtagcagaggtgtggctcaccctatccaggtcccaccattgccattcgaggcacgtatgtcctctcatacctcactgcctctcctcctcctgcctctcctttcctggagagctccttcattttcagcccagttccctccttttcctctgggccttcctttacctcataagaagtttccctatgaggaatgatagagaatgctctcaaatgtttgttgcactaactcacctcatgctcttccagcatgcattagcaccagcagtcctgaagctaagttagtcagctattgctgcctaaaaaatgacctcaaagcataatggctgaaaacaacagaaacttggattttcatggtttctgtgggccagggagcagcttagctaggtgattctggctctgggtctctcacaggctgccacgtgtcagccagggctgcagtcatctcatggctcaaggcgggcaggatctgctttcaaactcactcacgtggttgttgggaaacctcaattccttgccacatgagcctctccacagggctgtgtcatgagatggcagctggcttctctcagagagagtgcaagaggtacctaagaaggaagtcacagttgttttataacctcatctccgaagtgacattctgtcacttctgccatattctactcattaggtgtgagtcaacaagtccagcccacactcaaggggcagggattatacaagggaggcaatacctggattccaggattactgggtgctatcttagaggctgcctatcccaatgatacactattttaagaacaagcattaaaataggttgacaatgggtaaatctgactccccagggaacatttattgaagtcttagttatgaaggctactttatttatatttatgactacatccccagcaccttgaaaaatgagtaggggcctggtaagtatttgtgaaatgaatgaatgaaagtgtgcaggctccatttgctttgtatgttttagggtctacatttatacagaggaggtaagccatcatgtctttcttccacaactaggcaatcatctggctttcttgctactttgaatttaaaccactgggtgcactgctctctctctctctttttctttctctctctctctctgtctctctctctctgtctgtgtgtgcatgtgtatgtatttttcatttatttgttttttgatttctcctttatgagttgtgttacttcttaaaaagtagaggtaaatggaaatcagcactgccagcaatgatcaaatgaactttgtacctgattttatcacttgcttatttatttttaagtactttaaattggatgtgatttgattatttttaataggtaatatattcacatagttcaaaaattacaattatttaaaaaggtggactggccggatgtggtggctcacgcctgtaatcctagcactttaggaggccaaggtgggtggatcacctgaggtcaggagttcgagaccagcctgggcaacatggtgaaaccccatctgtactaaaagtacaaaaattagccaggcgtggtggtgggcgcctataatcccagctacttgggaggctgaggcaggaaaatcgtttgaacctggcggggtggaggttgcagtgaaccgagatcgcgtcacttcactccagcctgggtgaaagagtgaaactctgtctcaataaaataaataaataaataaaattaaaaaggtgcacaatgaaacgtcttgcacccacctcttctctctcagtctcccacccacctcttctctctcagtctcccacctcaatactttcattggtatatttttaataggctttttaaatttttgtataattttaaagaagagttgaaaaggatacagacagttcccatatacactgtacccttcacccaacttcctttaatattgacatcttacatagctatggtacattagtcaaaaatacgaagttaacattgatacaataccactgactaaactgcacactattgtgatttcaccagtttttcctctcatgtcctatttctgttccaggatcccacattgcactaactatacttaataagcatattagcttcaataatatggttaaatgtgtaagggggcattctttatacaaaagttcaactttttcttttacacccctacttctttactcttatacactgttaaaaaatgtatttgtctacttttataaactttattttacatttagataatatgatcgatgtgagtaaaacattaaaccgatatgagtaaaacattaagctaatgtgagtaaatgtgagtaaaacattaaaccaagattcaggagctcttggttacactgctggctgtcactgacaaccagtcttaaaaagtatttgaacattctactcctccattttctcatgcacaattgaggtgatccactctagatgatctttcaggcctttccagcatcacatttctacaatttcagggattctgagattttgcaccgtaacagttttttctagcacacttctgccaccttgtggactagtctgttttttcttattttctcaaaaggaaaagaaaaatgaaaagactttttctaactcttattagatgcccagtttgaaatatgtagcacagatctagagtaatgatgtcatattcaggacatgaaaatagacagaattcaggagtcaaaaagaggccttatgatgaagggacaattctgggaaatcacagctgctggccacagcaaggatgcagccagagatctggcaggagatggtggccgtgtaagtaggagttcggggttcagggtcatggcattgggttttggaagctttcagttggtcagttacaaggcataggatcaaaagcaggactcggctgggaaggacagaccagggacctaattccttttataaatcaaaaataaaattctaagcaccccctctccaaccatctgaatgtacccctcctctcagccagggcattccaaaactaacctgaaaaactggttcaggccatgacaggaaaggggggttgaacatgcctcattataccctcctcccttttggaactcaggaaaagatgaccagaatttaacatcaacacagaccttaagtctgataagaaacatttacaatctattctctctgaagcctgctacctggaggcttcatccacatgataaaacttttgtctccacaaccccttattgtaacccagacagacatttctattgataataactctttcaaccaattgccaatcagaaaaattttcaatctgtctataatctggagccccaggcccccactttgagttgtccaaccttcccaggccaaacaaatgtacattttacatgtatttgattgatgtctcatgtttccctaaaatgtataaaactaggctgtgccctgactaccctgggcacatgttctctggatctcctgagagcttgtcacaggccattggtcacttatatttggctcagaataaatctcttcaaatattttatagtttgactgtttttgtcaacacttttgcagatagaacgtgatcatcagagggagggaaatggtaagagccaagttgttaaaatcaggttatgaagtcagagttgtccagcagctaggctgaccttgtcatctgtcacatggagtccaggacaaggaaggggacacatggtagtatggggagggagaatgtgttaggacagggtggaggcactcatacctgggtgaggagatgaaggttaggagaagtccgctggccccggactctaggacttcagagacctctgcacacagtggagtcatggctgaagcagtgctgctactccacagcacatgaatcctaggagcacagtctacttactcttaagcctgggagttattgttttgtttcagatccagctcgacctcctgaacttgtctgcactccatcatctatacctcatacctactgttattcacagccacagcaggcccatgccagcctgttcctagactcatagtgacatctctgtggctctccttgctttggtcttacatccctactcctgcaatcaaccctccatgctgctaccagtaagcttctaaaaaggctaatctattagctccagaccctccgcagcctagcagacttcataggtgctccatttcctctaagacatgccctccttgtttggaaatcaaggcctttcatgacctagctccagcttactgtcctcctttgtctcctcccatctcctgcttctactttctgtgggttctttctgttccagaaatccgactgtggccctgccacaggaagcaacaggaagcaacaggaaataacttcctgttgcttcctgaatttgcagtttctattctctcctaatggcatactctttcttggtcttcacagcttgaaacattttatgcttcaagtcttagctaaatactacctcatttgcaaggtttttcttactccccaagccagattcaaggatatcctatgctcccaaactaattttggacatgcttccagtatagcaatattcttgctcttttgtctttcatttctgcctccccagtaggctctgggagaagagagacccatgtcataagttttgaagacccaggtcctagtacattacctgctccagaatgcagaattaacattcttttggataaatgaatgtgaggctgtcatgctgtctttaggctcccctgatcgtaacttctacttctctctctatggtactaatattacacccacagactgtgaaaatgtcagaaacatgtgaaacaacattgctttcattgctatcactaatgcagtatttcactctcttctgctgggcttggtggcttgcacttgaaatcccagctactcaggatgctgaggcaggaagatcacttgaggccaggagtttgagaccagcctgggcaacacagtgagaccccagtctgtaaaaaataaataaactctcttctttctaaattatagggtgtcaatgtgaaccttgtgacaattaaccgggtgtcttctctccacgaggcatgccttggaggtcacgtggcctgtgccaaagccttattggaaaatggtgcacacgtgagtactgcccctgcccacttgggtctgtctggccagatgcatctgttaatgtttaatgatagtttaccttccagatggcttacccactgtgggtaagggctgggctggttctatccatgtccgtattccatcatttaggctactcctctctcttcaacttacccccctgtgtgtaaatattcagacatggcaactcacaggaaccttttaaaactgtgttgctgaccttaagaaatctttattgtaccatgttttttttttgttttgttttgttttgtttttgagacggagtctcactctgtcgcccaggctggagtgcagtggcacaatctccgctcactgcaagctctgccggggttcacgccattctcctgcctcagcctccccagcagctgggactacaggcacacgccgccacgcccggctaatttttgtatttttagtagagacagagtttcactgtgttagccaggatggtcttgatctcctgaccttgtgatccacctgcctcggcctcccaaagtgctgggattacaggcgtgagccaccgcgcccggccttgtaccatgttttctttatgcattcatctgttggtggacacttgggttgctttcaggtctttgcaattgtgaacagtgctgcatcagacatgggagtgcagatatctcttggatatactgttttcctttcttctgggtatatacccagcagtaagattgttggatcatatggtatctctgtttttagttttctgatgaacctccaaactgttccccataatggttgtactaatttataatcccactaacactgtatgaggcttaataacaagattttaaagaacaatagaaaacactcttaattcaacaccttaaatgaacaactatttttattgagcaaaattatcaaaatgagcgagcttttaataaataatacattgggggaaacctacagaattgaactttatcttattttaaatttatctccaaacttttttcaaagggtgactgaggtgcaatatataatacagatatcagaatagaatcataaaatcacaacttctaaaaatcttctgtgtttagttgccagatgttctttgtttctaattttgttgtttaactcagtccttgcattatttactttatgagctgcaatgtttttaagtgcttaatgacaatttaaaacattttatatggaaatcgggtttctacatgtagaactgaatataaaagtcttccttgtgaaaactaattttcctgatgccattgtggtcgtgcattttctttttttgttttttttttttccatctttttatttttagacagagtctcactaacactgttgcccaagctggagtgcagtggcacaatctcagctcactgcaaactccacttcctagattcgaacgattcccctgcctcagcctcctgagtaactgggattacaggtgcccgccaccacgtccagctaatttttgtatttttagtgcagtaatttttgtatttttagtgaaaccagcgatgctggtttcagactcctgacctcaggtgatccgcccgccttggcctcccaaagtgctgggattacaggcgtgagccaccgtgccctgccaagtggtcatgcattttcattaggtagtgcttctctaagttaccactcagtcagctcatgggtaatgatgaaggaaggctgtgtgagagccgtttcctttcaagctagatgactggagtcacaggcagactgctgacaatatcaggtcagagaggaggttttgttgggcacaaagagaagaataagacatgtttccttgtctttgtcaattttataaagaaacagccaataaatactgtagcacaccatttaacatttaaatcagaatgagaaacgaaataagagaaagttggtccatcagtagaaagtcccccacaattggcagtcccatgaatacctcaaactcagtgcatttgtaactgagcttatcatgttcttccctctgggacctgctcctcatcttgggttcctagtttcagaggcctggtgaaagaaacatcctcttggtttcccaagctgcaaacctgagagtcatcttatttctttcatctccctatctaattaattaaaaactcctgctaattttactttctaagtttttcccaagtctatcctctcctttatcctactcccatagtcatctaaattatttattatattttcaaaatgatttctttttggccaggcacagtggctcacgcctgtaatcccagcactttgggaggctgaggcaggtagatcatgagatcaagagatcaagaccatcctggccaacatggtgaaaccccgtctctactaaaaatacaaaaactagctaggcatggtggcacgcgcctgtagtcccagcttcttgggagcctaaggcagcagaatctcttgaacccaggaggcggaggttgcagtgagccgagatcacaccactgcactccagcctggcaacagagcaagactccatctaaaaaataaaaaaattaaaaaaaattctttttgtatttgtcttccctaatggaattcagcctactcaaggagaggcaattgttcagcccactcaaggagaggcaattgtcttatcattgtttccaaaacattagcacctagtagatgctcaataaatgtttgttgacgtgaactaagagaaatttataggaaatcgcataagaagacaacttcctagactgagggtgaggatgaaacttagtaaaacacaaatcaaactagtcctaccaaatattttttagtaaaaatatagaaacccctagcaatataaatttacacacattttcccctgaccttgtctgtctctgccatcttagcatattatctttaactttccaatttaatgggggttaggctgggtgtggtggctcacacctgtaatccctgccctttggcaggctgaggcaggagggtcatttgaacccaggagtttgagaccagcctgggcaagatagctagacgctgtctacaaataatttttctaaatttgtgggtcatggtggtgcacgcctgtagtcccagctgctcaggaggctgaggcaggaggatcatttgagcctaggaattcgaggctgcagtgagctatgatcatgacactgcactccagcctggatagcagagcaagaccctgtttcacgggttatattgcaactctggaaacaagtctttttttgtgtccaaagcaaggacatttagaatcctgattatcacaagcatgcatccttagttgttgaagcaaaattgtttcacatcacaaacttgactgtcctatatttcaatggcatcagaggctccctaccactcctgcggttcccgatgttctttccaatctattgctgatacacaaagatgtctcccagccctgctggttctcatgtgcttcccacatccctacaaggtaccaaagatggttgcagacaccatgttgatggctattttctttcctttttttaaatttaatcttttaattttatttatttatttttatttttattttttattatactttaagttttagagtacatgtgcacaacgtgcaggtttgttacatatgtatacatgtgccatgttggtgtgctgcacccattaactcgtcatttacatcctaatgctatccctcccccctccccccaccccacaacagtccccggtgtgtgatgttccccttcctgtgaaaccaacccaaatgtccaacaatgatagactggattaagaaaatgttgatggctattttctatgtccctttggcttggtcatgctatctctagaagtaacagctggcatgtgtaatttgcatggattatagtagaccagagaggaagttgtggcaagaaagacagtagatctgtggagaattgccaaggattttgtaagcatggattttgggaccacagcctgccatgtttgttcatgattcagaggggagtcatattaatggaaaatggaaaatggaaataattgttgttgcaaatgcttattgagtgcttactgggtgacatgtaatgttttaagtgtttacatatagtaactcgctcgatccacccaataacttcatgaggtttcataatactgtaaagatgtggagttccctcacttattcaccagcgtggggaattcctctaggcaaatacataggaagacatacttggagatggtgagaatgaaataacaaatcctttgggtctctctttgcccatcattaggtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtaaatgagccaccacaatgcatgtgaaacattgatgggctcactccaatctgtatgaatcaatggtctagtgttagtcattcaagggtgaccctgatcttcctcaccattagaatatgtgtggcctagaaatcccacagcagtaacttcaatttgcctaaatcttcaggaaataccagtgtggcacaaaagagccctacttataacttcggaatgctttcctgactccaatttcccatttcctggggatggtctattggcaggcctttccagatcctctttgctggtgttttggtggcagctggtacagccaaggcagtagttctgacttccctgaattgtactatgcttatgtctctgtccttagtaggcaagaatagcttatcctctaaagcccataaaataccaaccactaacctaaaataaactatgaaagtatctgaaagccaaggctgatactatctctaatggaatagtaaatataaccgttcataataagttacacaatctagatgggctgatgacttcaaggtcatagttattgaaaagaaaaggctgcaactttccaaagtatagcattggtaatcttgaagctgactctagactcctgtgttgtcagttaatttccaagtgaaggaaaatagtaaatttaaggaatttaaagactgtatgtacagactagacctgaaccgagaagatgccactgaaaggagaaggccatttgtcaaaggtcacacccaaagagcaacattttgatgatagcaagtgagggagttgttctcttatactgagatcagaaatacaatggtgaagttaaaacactctagaatagtgatctttgctggtgtaactggagatgaaatattttatttcaaaaagcaaaagtgaaagatttgttccaggttattaaacatgtcacttgccaattttttccagtggattactttaaatgatgcaaaagacccaaatctaaatttatctatgtattttatgttctaaatgtatttaatacatatttattaattaatagctgatgttagtcatttcccaaacatcatgtaagtcctttaagttgtagagtaatgaactactttggaaatgatataaatgtctttctttcttttttttttttttttcgacagagtctcgtgctgttgcccaggctgcagtgcagtggcatgatttctgctcattgcaacctctggctcctgggttcaagcgattctcctgcctcagcctcccaagtagctgggattacaggtgcccgccaccacaattggctaatttttgtatttttagtagagatggggtttcaccatgttggccactctggtctcgaactcgacctcaggtgatccacctgactcggcctcccaaagtgctggtattacaggcatgagccaccgtgctcagccatataagtcttttttttttaatttttttaaattttttttttattttttgagacagagtcttgctctgtctcacaggctggagtgcaatggcacaatctcggctcactgcaacctccacctcctgggttcaagcaattctcctgcctcagcctcccacgtagctgagattacaggcacctgtcacagtgcccagctgatttttgtattttttagtaaagacagggtttcatcatgttggccaggctggtctcagactcctgacctcaggtgatccacccacctcagccttccaaagtgctggtattacaaaaagtctttattaaaaatttaatattgatttgaagtaaatttttgaagtaaaaattaatattatttgtatttccatacaaatgtttaaaaattgataagtactgagaatggtttgaattaattaagtatgtctgcagtgcttgactgattatatttggagcttttggtatctatgtgcctataaaacatatatatgctcataataaacacataatttgtgtgtctctgtatatttttctgtactgtaaaagcatgttaaggataaatatccacagaatgtaagcatgattagcaaattcattattttatacacttgtattagtgctagctatttaacttttctgtattcatttttaaaactttctgagaatatttaaatttaactcaaactaggctgtttcttgttcttcaaaaaaaagacaagaattattcaaaaatatgtattaaataccctgtattttccaagtagttttagggacttactagatattatttctggattcttatagctctaaacctctatgaacaagctgagtcatagtttgagtcaataccttgacatattgatgctgtaattcaggtataatatttaattatgtgaacaaatagtttgaattgacagtcctgatttgtacattttaatgcatatttatacttaatttagaatttgtgataaatcaggtaggtctaaaatgaagcttacttttatgttatctacaaaaaataggttggctaaattaattagtaatgacatgattttttagggagatatttaaatcttcaaagagaactaactctttgcaagctcccatcaatacctcagaagcactctctcctgaacaaagcattcacaggttgcaaatttatcatgtctatctatttattgggcaaactctcaaaagagaatgcttgcttacatagttgttgttagccactgaatatgaaagtgtatttaaatatattctatacttaagacttctttattctttctcataggtatttttcagactaaccaaagtactgttgcaggccatatatccaatctcacatgcatggataaagaagagaatgagagatttgtaatggagaggcgacagggttctcttgggtttgagcactagcttttcagagtaataataggcctagtcgtttgtccctctgggtcttgtcacttccatttgtaaaatggtggcatcattctggagagtgatttcaactgtgctacttggagcccttagttcagttaaagttaacttgggctgtaaagaggagctggagtggggaagcatgggcatgctcctctttttattggtattattttggtggtttctacctaagatttccaaaaacaaacacaaaaatgtttttatgctacaaaaagagatctaggttatttaattaatttatttatttatttattttgagacagagtctcgctttgtcggccaggctggagtgcagtggcgctatctcggctcactgtaacctcctcctccccggttcaagtgattctcctgcctcagcttcccgagtagctgggattatgggtgtgtgccaccatgcccagctaatttttgtatttttagtagagatggggtttcaccatgttggccaggctggtctcgaactcctgacctcagggaatccgccggtctcagcctcccaaaaagctgagattacaggcgtgagccaccacacccggccaacctaggttatttctaaagcccatttcagataagcaatcctataattctgttaatatttaatatgtcccttacttgagtgagggtatcttgtgttccaccaggtcacagagagtgcatggagatcctgctggcaaataatgttaacattgaccatgaggtgcctcagctcggaactcccctatatgtggcctgcacctaccagagggtagactgtgtgaagaaacttctagaattaggtaatttccaaaattattttcatgaagaaacctgttaactttgttgattttctacagcttcaaagatgaagttcttgtcatggttgaaaaatattcggttagcattttatgtttgaatgctaaaaacaaaacttctctagagaaatgagtgtctgtatttctcagtcctgcttcctttgatgttaactccatttacctggtattgttctccctggttgtcacaagatagctgccagcaatacctgggcttacagccctccttatccatacgcagcaagaaagagcattggctctttttaagtcacatgcccatctttgaacccctcatgggggccaagggaatacaatatattgattagtttaggcctagatttcagcctactctgcatttattaggcttcactggaaacacgagaactgaaactaacaagagggtggtttacctttgggaaatctaggtatgcttgccaggaagatgctggacggtaaaaacagacatttgctacaggctagtttatatctatcctgctacagtatctagtcattttaaaagcaattctaaaaggcatatacagaaaccaagagtccgtggaaaaatgaaatatcttttttttttttgagatgaagtttcgctcttattgcccaggttggagtgcaatggcgtgacctcagctcactgcaacctccacctccagggtttaagcgattctcctgccctagccgccggagtagctgggattacagacgcacaccactacacccggctaatttattgtatttttagtagagacaggattttaccatgttggccaggctggtctcgaactcctgacctcaggtgatccaccttcctcagtctcccaaagtgctgggattacaggtgtgagccactgtgcccggccggaaaaatgaaatatcttgaaactattctttggttaaagattcaacaaacttagcccctgacataaaggtggagatttagtaaaaacctttagttgtgaatttttatcttgaggaagtttttgtcttttttatttcccatcatttactattctctatagtaagttcagaaatcattttttgagccccaaataatataaatactaaataaacttagctttatcttttgtcccaaaacataataactatgtaacaggagcctcaaatactttattttgtatgccacacagtttatacgggaaagcaagtatttaaaatgactaaaactatctaaattcacttttctcaccaaagaatttcaagtagtcttagtaggcattgctgaggttctaggcttgagttgcatattttcaaacatttgtcaagtatgtcatggtacttaaaatgtctttatatgcaatgactatatttgaagctcattgtgctttacattacatttagtgttgaattgtggccatctgttttgttaaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggtaaccaagggctgggtatccattcctcttccataagcacattctctccccttcctgtctcatctgtagcattttttcctttttcttttctctttttaattgaaggtggcattgtgggaggtgataggccctgccgtcactgacctgtcttctgggattttatatgctgtgtatattcactaacaaccaaagggcatttacctataaccagagtgttgctttgtattttatataacaagaaaataaccagaaaaccggctgggcgtggtggctcacgcctgtaatcccagcactttgggaggctgaggcgggtggatcacaaggtcaggagtttgagaccagcctggccagcatggtgaaatcctgtctctactaaaaatacagaaattagccagatgtggtggctggcgcctgtagttccagctacttgggaggctgaggcaggagaatcgcttgaacctgggaggcggaggttgcgatgagcagagatcacaccactgcattccagcctgggtgacagagcgagactccgtctcaaaaaaaagaaaaccagaaaaccttgtttataccccgaaaatcttgaatttccatttctgtcctggcataagcgtatgattgagcaaaccaaaactctgctttgtaatattgggagacaatctgatggcaaattcaaaagacttgagtcagagtctgtaggggaggacacagagtatttcagaaatccgactaaatggtgaggttgtttgcctgttctccagatcagggagtaggtgggtctgcattcttcattgcttcattcccgtttccaccatgagcattaagagcaactactgatgccagaagaggtaaggcgagcatctgaaattcagaagagaaccaattcagaagagaacctcttatgtctatacagtaagaaaatattttcggagcctatattgattatttgtgtgcctgaagaatattaaagataattataattattcagctctacgtatgccaggcactgggctaaatttgaaacatagatcaagctcactgaatttttaaaactttagagcagtgggaactttatatggtagtagctggttgctatgccaggtacaaatgggaaaagaaaagcattgacaaggtcacacagctagctacataatagaattaggtaggattctgagccatctgaccccagagtgtgcacttttttttttttttttttttttgagatggagtctcactctgtctccaggctggagtgcagtggtgcgatctcggctcactgcaacctctgcctcccgggttcaagcgatttttctgcctcagcctcctgagtagctgggactacaggcgtgcaccaccacacccagctaatttttgtatttttagtagagacggggtttcaccatgttagccaggatggtctcgatctcttgacattgtgatccgcccgcctcagccttccaaagtgctgggattacaggtgtgagccactgcacctggccatcagaatgtgcactcttaatgtcataaggccccaaccctgaatcttttgaaacattcagtgaggagggtcttatttcactcaccagttccattttgtgaaaccactacatcatatataccttccaagtagaatgcttggttttaaccattttatgaatagtctttctaaatcagtgcttcttaagatttaacatgcatatcagttcacttgaggatttccttaaaatacagattctcattcaggaggtctaggatgggacctgtgactctgcatgtctagcaggctcccacgtgatgttgatggtgctggtctgaggaccacactttgcgtaccactggtctagattattattattgttattattattattattattttagacggagttttgctcttgttgcccaggctggagtgcagtggcgtgatctcggctcactgcaacctccgcctcccgggttcaagcaattctcctgcttcagcctcctgagtagctgcgattacaggcgcgtgccaccacgcccagctaattttttgtatttttagtagagatggggtttcatcatgttggctaggctggtctcgaactcctgacctcaggtgatccacccgcctcagcctcccaaagtgcagggatttcaggcgtgagccaccgcgcctggccaggattattttcaatagtctagatcattaatcattgttcttttatttgaatcttcaccagaagaattatgatcttcctcagcagatccgagcttggaaataccagctactttccaactgttagcagagactatagtttatagaagttttcacatttcctattttcttccatcaaaaatgtttctaggactaggatttgtagacctggatatcctggacagggcctagctcctctgtcctttgtcttcataaatatagccacttgctctagaaagattaatactggctgggcgcggtggctcacacctgtaatcccagcactttgggaggcccaggcgggtagaccatgaggtcaggagttcaagaccagcctggctaagatggtgaaaccccgtctctactaaaaatacaaaaattagctgggtttggtggcacccgcctgtaatcccacctacccgggaggctgaggcagagaactgcctaaacccgggaggcagaggttggagtgagctgagattgaaccactgcatttcagcctgggcgaccgagtgagattctgtcaaaaaaaaaaaaaaaaaaaaagaaagattaaataccaactacatcagagttcactctcctgtcagtgtctctgggcactggacaatttgtctacattaccattttgcagaggaggttaagtaggacaacaggtaaagaagttttctattcttgcttcccaagattttaactaagatcgattgtttggtcctccaggtagctttctatctcatggatgctccttggcaatgtgaagccaaatgttaacctggctattcgcatatgcagtccatcatttttcatggggtgtgagatgctgttacagtggatttttttgaaaaggaaaactttgtgtagaccagtaattaggttttcttgaagagatctttactgataacagtcaggttaggaaataatgactgtgcaactagtattgcagccaaaagctcattcatcctattcaaccatattctggactctcatcagctgattttccttaaggattcagagccattcaaagccatgggcatgatgattctgtgagactccttgagagtccatgagactcagtttcagggaacaatagggtctgacttgagtccttcttgcagatctctattgagctggaatccttgcaagaataaagggcctcttcagatttaagttgagacccagccagcaccacctcatgggcagctagagccggtaggtccaggagtactttgagggctgaatatctggcccctggcacatctcctaacactgcctctgtcaccacgcaggtggaacttcccgctgacaccctttccgtattgtccctctgttctgtggctgtgtcttggagtcctgcgtgttcagtccttccatttgcattttctccttggccagtgtattactttctttctttctttctttttttttttttttttttgaggcggagtctcgctctgtcgcccaggctggagtgcagtggcccgatctcggctcactgcaagctccgcctcccgggttcacgccattctcctgcctcagcctcccgagtagctgggactataggcacccgccaccacacccggctaattttttgtatttttagtggacacggggtttcaccgtgttagccaggatggtctccatctcctgacctcgtgatccgcccaccttggcctcccaaagtgctgggattacaggcgtgagccaccgtgcctggccccgtgtatcactttcattggcacattcaatacatgaatgagatgcattccctttagaccccacacctcattcctaacttgcctctggttagcttcattcttcaacattggtaatccaagtaccattggaagattaacttaaagaaatgcatcccttccagaggggcaaatcaggatctgctgtctgtatttagtgtccgctacctcattctatagttcctatacagatccagcttctcttctgcttttagaaaatttccgcctcttccagttctctgatttcccccttccaccccacctcccaccactatgaagttaacaccatttttatttctctctcaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctgg

SEQ ID NO: 3110 - DNA, 33927 bp, human; identical to SEQ ID NO: 3105

SEQ ID NO: 3111 - DNA, 34628 bp, human; identical to SEQ ID NO: 3106

SEQ ID NO: 3112 - DNA, 32240 bp, human; identical to SEQ ID NO: 3107

SEQ ID NO: 3113 - DNA, 32099 bp, human; identical to SEQ ID NO: 3108

SEQ ID NO: 3114 - DNA, 32612 bp, human; identical to SEQ ID NO: 3109

SEQ ID NO: 3115 - DNA, 38785 bp, human
caaaaaagtttcaatccagagttgggttccagctttctgtagctgtaagcattggtggccacaccacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaaggtaggtgagctcaatttttaatgtgatgaagttctttttattggctcatacagaggactttctttgccctcactatttttgaaacaatataaaaatgcagaaccatcctagtagtggactggacaggatatatcctgcatttcttggtgactgttctgtttcttagtcttattaaacttctggccatgagtatttgaaaatgctggggtgggggttggttgttttttgaagttatggtagaacatgagcagtctggaatctttttggatggagaagtttctcctcggttgcatatgcagatggcacagtggttttttaatgaaacattgatttgtttttatgactgataactttgtgggccatttattttcaggtctttgtgagcagcagaggttagtttattcgtttggtaaattgaaaattgcagtgctttctatgaacattttctatctgcttttgcaaattaccaattgctgccatccagaaaaatgttttctcagagagtgtttggttttttcgcttcttgaaaggtgtaaaattcaacactaatcaaatctttggttctgtgagcaagcatcaaatagagcttaacgaacagagagtaatgcaaaaaattaaccagaatgttgctgactgctggaacaatacttagcccaattttatgcatttcatggattatatatattttaagcttctattttgaaaatgattcggatgtaattgttttgactgaagtggtgctaaatcattattgatttaggaacttctggccttgaaaagacaattaaatgtgagtttgagtttttgtagctgttgtttaggacgtgcattttcaacaggggtgatatcgcccccagcaggggaaaattggttcgtggagggatgaaaaagttttacccttttgatacatcacgcacagacgtacatacagtacatatggtatgtagtttaaaatacgttatacattcaaattgcatagggggaaagtgtcttcaaaggctcctggctggtgttggtggcctggcgagggtgggggctgatatttaaaaatgttgaacactgagctggaggtgagtgggaagtcaccttgtctggcagccagcacttttctaacttctcaaattccaaatttacatgggagaaatcacagtgtttggctccattttactgccaccagccttgatattggatctcaaggccagattgtaggtaaatgggaatctgactgtaagcataggtaacaggagaaaacggtctgacttgtttgaagcaagtaagacttttccgactgtccagctttttcgtaagttcatgaaacagaaatcctttagatgtgctgggctcctcgagttttaaaatatttccattttccttgtaaaacatcactttatctgatggtataataaaggagactgaattgttggacataagtcatattctttaggttgctcagctctttcaaagagcacaagcaccaagaatgtctcaggtgtcctgggcactgtgaagttttatttatttatttatttatttatttgagacggagtctcactctgtcacccaggctggagtgtagtgatgcaatctcagctcgctgcaacctctgcctcccgggttcaagtgattcccctgcctcagcctctcgagtagctggaattataggcacgtgccaccatgccgggctaattttttgtatttttagtagagacagggtttcactgtgttagccaggatggtctcgatctcctgacctgatgatctgcccgccttggcctcccatagtgctgggattacaggcgtgagccaccgcgcccggctggcactgtgaagttttaaatgctttgaatgtactgttaatatataaatttgttgaatggagtaacgaaggaaagcagctgaatttgcatgtgacagaaaacaagttgttacacgtggaggatgcagcattatatacttactaatacgattagcaattttttttcagaatatatcagaatttcctttaaaaagtgaagctacatatactgaacttatatccaccctacccctcgctcaattaaattatttctgatatgaaggaaaggattgcctatagctaaacagaagttttggcatagatatgactgagtggtaagggataatgagatatataatattggttatagttttcttttttccccaacttttaagaaaagaaaatctaagaggaaataatgtttctaaatgttaaagttcttcttgttaaaattaaaatgtagtgtgaaaacatattcatggtggtaatggtttagggtggtggtatttgaattttttgtttttttttttttactttttgaaataaaatgttttatttattataagaaattcatggtcttcctcggtacttggtccatatgtatttctttctcctcaccctcccctcttctaaccacctcttttccagaatggatggtgatgccaattttgctcctaggttgtcctccagccacccccagcccagttttcactttctagctttgaagattgtccagttttccagcttagactagcattgcctctacgatagttctaggtatctgtgaagatttttttttttcctgtagcaatcatgaaatagctactagtgctctggacgattgtgcttaatgccatttgggtgtaaggcctcctaatttcattagtcttaccacttgtgtttgcaaggatagctgtttggagtcagcagtgcatggaacatgtgaactgagacaaatctgtttgaaaatctcaacttaagatttcaaatccactgtgtatactatttagctgttaagtttctcagtctaagaagaacacgttttcctctagaaataagcttaacccagtacctatgcatcgttcattaatataatcagattacggcctagatgtggaatttatttctgtttctattttctccagctttttaatacagctcagacagtcatatacagttgtacacgatgtgcactgcacaactctagggtgctccatgcatatagacatatctgtatgtgacagccctaagtacaatgtggtagacactctggacatttggtaaataagtatctacatcctcactcttctctcattcacattggccttctggccagcactatttctggtttatttaataaacaattcttgtcccccagaaattctgtgagtcttctgaagatgctggggaaagccagccttcataaatcttttcaatgtcactaatgaagacatgtcactattgcaacaaaggaataccaggccatagtaggctttcacaacttttttctgacagaatttgtttctttctgctttatcttccctgtgtactgtctttttttatccaccctctttcttaattacactggtagaagaatattggtgggtgatggagtcattcacattctgtgtaagactagaatcagtccaagatccacaggaatgtgggatacttctttcatgagaagccacatggctcacaagacttctttacatttgtgttacttgccttctcctgaaattgtctctacagtgaatcaaataacaaggactgaggtgtattttccatatttaattccaggaagcagtcccactccttctccctgcccgatttccagttccaaagtcatgtacagggaagtccattgactttgatgttggtcaaatggcccagcaagcttttgtccacttttctgtcagacacagtccttggcacaaaagacatctgaaatacttcccattaatttcttctttatttatgaccttgtagttaagtgtgttgaattatatgcttctatacacatctgttttaatccagttactcacttataactggtgactgaaacttttatatcactatagcgtattattggtacccaggatacaatagaatcctcaatatcttacatcttcaatatagtacttccttgtatgacttatttcttaacataaaaatcctgttttagacctgtggataaacctttactataaatcccagagacaatttctggaatgagaatatagtatttgtccacacacatgattccatgtagaacttgaggtaataagatctgggactcccagatacatttattattaccacaattggatagaggtgctacagaaataggcacacaaatgacagtaaaattgtttctgagaacatttctaggctcaacttttttctacaacttaggatgaacagagagagtggaaactgtatataattgggaatgtgactgagatgagacaaagatgacatggaagcatttcttcttcccttgcttttctggtggtaagttcactcttctgtcttccttgccactagttcttgcagtccctaccaagacactagggcattatacagcaaacacaccctgaggccccctgctactgcatcatgaaagccttagctggttgtgatgtcctagttcataaagaatctgcctagtctctcattagagctttccaatatttgacaattcattcatttatttttttcaacaggtatttattgggcaccaatatatctaggcattgatctaggggctgggaatgaagcaggaaataagtctaggggctgggaatgcagcaggaaataagacaatgtttcaattctcttggaatttgcattccaagtgtgatgggtagaggcagacaatatgcaaatgtgtaacatgtcaggtgtgataaatgctatgaagaaaatcaagtagggggagcggatacagtactgaataaatcagaggagacctttctgattcagttatgtctctacagagtcctgaaggtaataagagagacagaggcaaccatcagtgcagtggccatggtgggcgcagcaagttggcttcgatgtctgggtattagccagggagccggtgcagctggaggtggggtgagtggaggccagaagtgcagttgttgaggttggagaagtagccagagaagatcatgtaaggtgtgactgtgctcccataaaactttatggacactaaaaattgaattttatgtaattttcctgcatcatgaaattaaaaaaaaaattgtttcaaccattggaaaatgtaaaaaattgttcttagctaacaggccatacaaaaacaggctgcaggttagatttggcccatgggtcatagtttggcaattgtgttatatataaattattacactgttttatcttcatcatggtacacatccatacctgacatgttttatttgcctgtgtatacatttattgctttgtcaccgtctactagaatacaagttttttgagaaaaggagctcttaattgtcttgtttactgcagcatcccaatcaccagtgaaaagcctgtatgtaatagagtagatactaaaaacagtatttgttgactgattgatggactagacctcaggatttttagatacccaggatcaggatatgaactactgcattaaatcatctccaacatctactctcatgatggcttgtctgacttcatgatttaaaaaaaattctaaagcatttttaaggcagtatattcaccctgtgctattttcctgtgggcataggatagggtttgtgtggatgtatcaaagacttctccactgtccttccaggcacaagccatcctataaggcgttcccttttaggagccagaggtatagaaggaagtcatctgagcccattattccagcctgttggtaacagaaagagagatgagcaaagtagcatttggctgcacaggggtctggacaaaacttcaacatcttgatgttttccttcatccctgagagccttagaaatgctacctatgctttcattttatgttaggttgtttgtaaaatcatggtaaattatggcaaaatactctggtcagatactttatcaggttaggccaggatatgctgtgaaaacaaacacccccgaaatcttggtggttcataaacaacagagacttatttattgcttataccacatgaccagcctggttcatctggggtcaaatccacatggggatgaagctggctgagtatccgatcttgaatgttaggaatcactatgacagagggagggagagcctgagagcgcctcaccctggcacttaaattctctggcccagaagtgacacatattacttctagttgcagccccttgacccactgccccatctagccacaaagggccaggaagtgcaatcccaccatgcgctcagaaggcagagagatggaaatatttgacaaaccgtattaatgactgtgacacatggtgagttcttcacattggtgacttctaagtgcttctgaacacacctttgactgtagaatgtcaaaaacattctcaattttacagcagtgctggaaaatgaattgtattgagacaacttgggaggagtagaaggagatggaataaaaaaaattcactgatttctgtcatgtgtcatgcctcctttaatgcacggaagaacgtatactttgcttaggaaatcacattaccacattcagaacaactttagtgaagatgggaaacaaccatggctggtcaatggggtaacgtgtgctgaaggaagacaggtttatttctcaggaggcatcttctccctgggaaaaggaaagacacatattcatctcagtaaatatttgtggaatgtctaccatgtgccaggcatatgagtggaaatgatgtttttataaaataaagatgtcttaagtatttgcatgtcttactaacagtcagggagttcaacttggccagtgggaaggataattttatgcctgaaactttagtaatgtaaatttttatgctgattctctttttgtcattcactgagtattcctaagtaactataacactcacatattggagataagtattggtttcctgaaatctaggtttggctaacattgcttctggaaagagaaaataacatgtgttgaatgtccctatggcaaattcttgctgttacttactgttccattatggagagtgttagaaagagtgtaattttgattgaatgaatatgctaaaaaaaacaccctaaataagaaactcacaaaaagaacagagtggaatgaaaaagtgaaaacaactttgcaatggtgtgcttcgtttataagtacattgtcacagcaagactagggatgattgggcatcttagagagtgcagaggatgttgataaggaagaggaagaggagataagtggattttgatatgggacactagatccttagggaagaaatgtgaaagagggtattctgggctgactgccgctggcatagcaaggctgctttgtagaagggacaataaagttttgcataaggatcctttttcccatccaatggattatgctatactttagctggaatagggctgtagcagttagctattgccacaataatgctgtgtaacaaagcagtccaaatttcagtggcttaaaacatcactaccttattctcacttatgtctccaagtcagctgggagtcagaggattaaggctcaaggcttaggtttggtgcaggtcagccccaggtgtctctcatcctcctttgatcagtgggctagcaggagcatgtgcttgcaatgatggtggaaatagaaaaacgtgcaatcatatgtgagtttcaagcctctccttgcatcatgtcttgtaatgtcctattggtcagtagggctgggaaatatatccctccctcagagagtcaggagtggaaatgaaaatgtttttaacaatagcctaatcaccataaaggctttgggtggcacactgggcccttgatcttggagatcagtgatagactgtaacagacctcagaaaccccttggggttattcagagcatacttctagagggtctggggttgtcttgccattcaagcccatcccacacccatctgcccccacatatcctaagcacagttatgtcaagtgagaacagaggcatttgagtggagcacagatttcaaacacataaaggcagggcatggccatctcccgcagtgctagatgatctggctgggagaaaaccacaagcagtcttcatcaaattggaggatgtggaggtcccaggcatttagtcccctagtatgtccttaaaaaacccagacagccatgcacacacactcacacaaatgcacacgcacacacacatacattcacacacacactcttttcctgcatttgtagttcctttcctcagtctaagtttaattaaacaacttggatttcatatatattcatttaaatatagaattgcataaagaaaagagccaccagaaccaccaatggtagcatgaggcctctgaaatgaaagatgagcccaccccaaccttaaatggccaggtttctggatttcagagaagcaagatcagacccttggcaggttccatctgagcagccacagcagccatagctacagcaataattattagcaagtgtgcgttctccctgccctagttagtacaccctataccatcaggtgtcatctgttctagttaaagtcagaccgtaataacaaaacatcaaaatgtaaaatgtgggttgtttttttctttacacacttctaaagacatttaaagcctgagcagataccttaaaattcatcttctatctgaaaatacctcctagaaccattttaaaaaggagatggaggcaaggtggagagaaaaagtttgtctttggttgacactgggaaagttgtcttttaaaaaattttttaatgtttatttactatggagttgccgtgtcttgctcttttcaagctcacctgtccggcttctaaggaatatcaggggccctaaaacacagacttctaaaccccaacacataggacacacctaagtgtggaaagaaaggaaagaggcaggaaagaaaggaaagaggaaggaaagaaaggaatgcaacatttattgtgtgcctaccatatacctgaccctttcctacatatgaccacatatgatctcttcatgagctttatgaggtgacctattattaacaatgctgctttataaatgaggaaaccaagccttaaggaagtcaaataccatatcctcagtcaaatagctaaaaaaaaaaaaagaaaagaaaaagaaaaggtagtgcctggattcaaagacagcttatttttttaacttatagagtaaaatggattttttcccttttggtgtgtagttctatgaattctaacacatgtatagatttatataaccacaaccataattaggatacggaactattccatcaccccccaaaaattcacttacgttatccttttacagtcagaccttcctcccagcctcccaacctctggcaatcactgatctgttctccttcactgtcgttttgtatttttggttcgctgtcattttggttttttgggaatgtcatataaatggaatcatacagtatgtagcagtttgagattggcttctttcactcatactgcctttgagattctaccagtgtcccagtagttcattcctttttattgctgagtagtattacatcgattgctgaaccgttcacccattgaatgacacataagttgtttctagttttttggctattgtgaataaagctactacaaacattcatgtacatgtatttatgtgaacataaggcttcatttatcaagggtaaaatccccagaagtaggactgttgggtcatatggtgagcatatgtttataagaaactgcaaacacattttccagagtgttataccattcaaagccagttttgaacaattcaaatctatgctttttctttccagtaagctgtttctccagacgacagagtggtttactatattaggcaaagcttcatcttggggaatgttatttccaactgagagctatgggaggcaaagtcacaaaccttcagctcagactcaccaatctaacttgatctgggaagatacctcgacaggtgggggagggagaacatctgctgaggaaggccgggagtggagtgagacattgctacttggaccccaaaaccaggaaaaatttggtggttttggttgagcttgaaccatcaggttaaacaggaaatgcaaaatgctcttccagtgaaacagaagaagctgctaagaggtagagggaacatggaactatttgtattgcaaccgaatccacctccccaaacccactgcaaagggaaattgctgactgcaatgtccctgaactccagggtgagtaagaagagaaccacgccccccagggaacacttgtaaatttttaagcaaatctagggaaagttgtgtaaaatgtgtcccttccataactcaccctaaagcttctgggtattctaaatatacaaattctattcatcacaccgttttatcaccaagcttcctgaaggcatattgccaacacaatttgacaaagaaaatagcaccaacagctttttaaagccttggaaggatagtctcagacccatggctctctagaggtccagggatgaatctagcaaagctggcctccttttccatatatatagaacaagaggattgttaatagcatgggattggaatggctcaagaaaagctttttgaagctctttgagaaaagtagccagggtccccccttaaaccttctttgctgatggccttacagctcaaaaccagcattggaaccggctaggtactcccaaaccaaagcctcttccacttggcatgtatatttatattctcatatcttctttcaaatacctttcagtgttgccttttgaaaagattataatttgtacttttttgttgaattcagtaggttaaagcagtacctattatctttaattttattttgaaaaattggttggtttggcttttggggaatttgagaggcaatttagtctgtcatttaggatggcatcatataaggcagccaacttcatcatgctatttagcctgaaaagcgatattgttgatcttcaaccttgaaaaagtcgtacaggttgggagctgacctgcaaatggtcaggtatcttgagataggaaaaggatttacaaatccaggtcagcaagatactcatacaaatattttgaacccaaggtatacatcaaatagatttaaagactaagactatttctgagcatgcatcgactgtttgaagactagtggacttgtatgaagttcaggagttaacctgggtcttgtaacttaaaaacagcatttctcatgccctaaattagtagtagagagacaatatagagagttcctatatagccctcacctatcttcctctaaggctaacacctgggaagtttttttttaaaaaatcctgatggcaaagctgcagcccagacccaaaaaatgagaatctgtgagatttaagattcgagcatcagtatttctttgaagcttattcccaggtagattcaagaagaagccaagattttgaatgcctgctttattatttttttttttgtgagagctttaatggcacaaaatgtttatagctacaagttatacatgtattgtaaattgtatataacgatacaaagtgctaactaaatagatggagaacgcataaccactttggctcagttaatccaataatttccacaatgggttcatgaaaaacctcatctgactggctaagtcttcaattctcatttttttagaatagtaaatatttttactgcaatcacaggaacttgttgcgctttccaatgtgcaagtttctgcagttttgctcttgattctatttacaaatatcttaagccagttttcatcaaacatatgaaaaatgaagcctgcctttttgtccccaaattgtaaataggtgtaaatctttttaagcatcaatctcacaatttcaacagttaattgttgaattctcctttccaatacacgatgttttcgttcaacacaaatctgggtagtagtaaaatgttcatcccgtgtgttagggctacagatacatactacgtgctctcataataaattttactgttatgatgtattcattttttaagtaattttccataatttcactgatgctttaagaaaaagagcaacactatgtttctttttaacgttgaaagaaatcataaatatacccaggttcaatggcgctactgatagaactgctgctgaatttggaatgagcacaatgcactagctgtaagaagtcagttttgggtaatgaataattttacttttccctcctgtaataccaatttcatactgtagcagtttatctagtcagttctcctaactttctgtcctttccaattttattcaggcttttcaaaaatcagtgagccatcagatttactttcttcccaaagaaattcaaatatgaatgcttgaaataaataggttatagaaggcaaatcaagtgttatcaggtttaagattaagacagaaacatggtctaataaaaagatgtccaaaattatctagacatcaaatgctagaaagaaaaaagaaaattacttgcaaaactatttaggatatatcatctttcttaaagattgccagctatattcttgaaaaaaagataaaaattttcttgtttaacctgcatgttattttccactataacattaattttacaaatgttgatgtgagagagaagagttagatagtttctgcaaactggcaaacctggctgtgatagtgtttttattcaagttaacctggtgcactttatagattgctagctttaaaattaacagtgtgaacccctgctttaaacccttctcaaagtgcagtcagccaatcaacagtattgccatcacctgggaacttgttagaccccactttgtcaaactcatttcctggtatgacaatgaatctggctacagcaacagggtggtggacctcatggtccacatggcctccaaggagtaacaccccaggaccatcagccccagtgagagcacgagagaaagagagaggccctcagctgcttgggaatccctgccacgctcagtccccaccacactgaggatctcctctcctcacaatttccatgcagaccccctgaagagggaagggcctagggagccccactttgtcatgtaccaccaataaagttccctgtactcagccaaaaaaaaaagaaagaaagaaaaaagaaaaagaaatgcagcatcctgtcttgccccaaacccactgcgtcagaatctgcattttaacaagatccccaggtatgcacattaagttttgagaggcagtactacatataaaatatgcaacagaccacacaaacctgggcccaattgctatttgtcagatacatgtatgtatttattacttataaattccttcatcagatatgtattacgtgcttattactttaaaaagatgaatctgacacatatcctaccctcaaagagatctcagtctaggaagggaaatacaatgtgttcataaataatatagtctaagttagggacttcataaaatgcttgatggaagaagtggcatttattttggacctggaatgagaactgaaagaagatattcaaaagacaagtgatgtagtgatgtagttttgaatacacgaataatctcagggttactttttctatagcttttggtgaatcaagttgtttattcatacatttaataaatatttattcagctcttactattgctataagacagataccattactgctcaggtggtttttacaacctagtggggaagacaagcagataacaagaaatgacacaattcattagtgttactggtagcgttgtgaaggacaaggatggggtgctagaaatccatgtgacggaccagacctaggcaggggtgggagttatggaggaggtttccctgagtaggtaacatctaagctgagaaagatttagttagacaaagagtgaatggcattccaggcaaaggaaacagcatggactaaggtcaaaacaagaagaaatgaacgaaagagcaagttgataaaatggatgtccaataatattccattgttcaactatgcaacatttttcattgcctcccaaattggatcaaagtagcctggtcttcatgcctccagtccttcctctttttaaaaattttatacaactatattaatatagaatttacatactataaaatttcattcaagtatattaggaaatttactgagttgtatagctatcatccatataaggtccgttatgtccctttgcaatgaaccctccattctcactcccagcctcaggcagccaataatctattttctgtctctaggggctggaaacttaggattggaattagttggttgtataataaatttagcttattagagaactgctgaactcttttccaaagcaacaatacaattttacagtttcatcagccttgtgtgagggttcctgttgctccatatccattacaacacttggtattgtcagtccttttgtttatagccattctactgggtgtgaagtggtatctcatttcaccagcccctcttcctaacttatttgccagattccccacttctaaacttgctctatgcccaaccaaagtgaaccccttgctgttttttttttcccctgaggctcgttgatatccccaaattatgcctttcttcattctttgaatgtgttacttgactggatatgtatttttggtgaaggagaggggctggaaattgagagatgaaattggtaggagtacagaaggccgttgacttcctcacaacgtgggacacttccaagtttctcctacaaaccccaccactatacctttccaaatatcttgcctgccatcttggtcacccgtgacctaaattaatacttaggaagctatggagatgctcatgcttcctcaggggagaatgctgtgtgaacttagaaattagcaaaaggggaaatgactacccttgaaattgtaccacagaaaggagcatacattcaaatgatggtgaagtcttattaaaaagactttaagcctcccaatttagaagctggcttgtggtagccaagaaattagagaatgatttgttatttaagagtgaaattgctagtagtcttgaattaattaccataaaaaagctgccgctgtaataaaaagcagagatctggtaaccctgcttcattcactttcttcctcttgatgaaaaccttttaattattttgattttgattagcacttccatcagaaaataggaagaaattaggagcaatttacttggcaaaggtttagtaattaaaaccactgaaatcaatggtttaagtatgtatttgggataaacacatttttaattgttatttttgtcttacccaagtggataacataaagttcattatacaaaaatcaaccagtgcagaaagccgattgggaacaaacaaccattcttgaaccctttgaaaatgtatgcccttgatgaattacttgtcaggtttctacttaagtttaattgttagtacttccacttaaaatagcaaaatgactgtctgcaatttctgttatttcaaactaggttttaaattctggggttgaaagtaagcttaaataactctgagtacttgagtaaacactgcattttttatgatgaggcaagttgtatgagccatttaattactttaattcaatccagagatttgatattttctcctgagttctcacagttggatagtttaaaaatatttctaagattgaattgaatcctgtaagaactataataaaaccatacatctgcctgttttctttctttctctttctctcctttcttttctttctttctttctctttctctcctttctttctttctctttctctcctttctttctttccttcttttctttctttctttcttttctttctttctttctttctttcctttctttcttctttctttctttcttctttcctttctttctttctttctttctttctttctttctttctttctttttctttttctttctttctttctttctttctttttcaagatcgtgctccattgcccaggctggagtgcaagtggcgagatcatggctcactgcaaccttgacctccccaggctcaggtgattctcccacctcagtctcctgagtagctgggagtacaggcatgcaccagcatgtctggctaatttttgtatttttagtagagacagggtctcaccatgtttccagtctgatcttgaactcttgggctcaggcaatcctcccacctcggcttcccaaagtgctgggattacaagtgtaagccaccatgcctggccttgtatttttggataatattgagtgaaatttgcctcaatacataaaaatcctttcaatatgcttcaactctaaaatctttaaaaagctgcttggtttcattattttcacgtggaagcagcattgtcacaaagttttattttgaagactgaattgtatatggagtactgtccaactagaagagaatgaataatcaggaaaagagagactattgacaaataagacttaatggagaagcattgaatttcaaagctgccagagacattagcaattgttcagtttcatctccagatttcttagatgaagaagctgtggcaagccaatttcacaaacccgatctatgatcctcatgctccccactcctctcactcccacaattttgccttgattcaaactttatcgaaaagtgagaaatcacaggtatgagctcactgagcttcccaggcagtcttgccatctacaaacccatgtcattctgtattttcctcttgtttctgacagtgatcctctcatctagtcacactacatccacttatctctggcacttatgtcaaaacaacccctctaggtcctgccttagctctcctgcatatgctttttctttcttcctgtctgttgcctctttcccccagcttataattctcccgcttttattaaaaacatgcacccacagacacacactcacatctggattcccaagtgcgataaccttgtagattcatattttcagatcgttcttagtccacagaatataaaattgattgaatgatggcaaacatctgcagatgacaatcatttacagaaatggcactaaagccatgaagctgaagctgcaggacttatggatctgggctagaagacaggggccatcaaaaatttagcttcagttggaaatcggctcttttagtgcactacatcagatccatgaaagaggaaggaagagttactgctcattgctgcctggagctgtgacttctatgaaattacttaacggggcaaaggaggaagcagatacttccttgcaactaggacgtgagctgagctgatccctgaatcataaatactcaacaagattcggattcaggacccagggtattatggggtacaaccataaaacttctaaatgttggagaaagaataatgagaaagaaaaatgaatctctgaatgaaaatggaactactaaccaaaattccaaatcacgttaatataattattactaagaatgacagcaacaaaatgaataatcagtatatgtcatacctataaagttaaaatctaaaataatttgaagaaatacttaaaaatatttgcaaccctcaaagagataaagaaataatattcataaaattgaaatgacaaactaggggcagggcgcagtggctcacgcctgtaatcccagcactgtgggaggccgaggtgggtggatcacaaagtcaggagatcgagaccatcctggctaacacggtgaaaccctgtctctaataaaaatacaaaaacaaaattagccgggcgtggtggtgggcgcctgtagtcccagctactcaggaggctgaggagggagaatggcgtgaacccgggaggtggagcttgcagtgagccgagatcgcgccactgcactctagcctgggcaacagaatgagactgggtctcaaaacaaacaaacaaacaaacaaacaaactaggaagaatatacagaaatgtaacagaaagtagataggaagaagaatgaagtagaaatgcttgaaattagaaatacggtgattgaaattaaaaccttaacaaagtaaactctagactcacaacaattggagagttggtgattggaaagatgaaccaattaatttacccataacacattagagagaggtgaagaggaaaaaatagctaaatataaaagcacatttaagagacatgtaagatgattaaaagcctccaacatttttcaaaaaagagagtagaggcaatattataggtggaataatgaaaatgataatggctgagaatattaaagaattgagaataaaaaagacaagtggcctcagattgaaactgccatgaaggtctctgtctcaaattctcaactctgcttttgtagtatgaaagcagccgtagacaataagtaaatgaatggacatggctgtgtgtcaatacaacttgatttacaaaaacaggcaggcagcaggctaaattaggctgggaggtcatagtttgacagctcttgatctaaagaataaccattgttggccaggcgcagcggctcatgtctgtaatcacaacactttgggcggccaaggcgagcagatcacttgagcccaggagttcaagaccagcctgcgcaacatggcgaaaccccatctctactaaaagtacaaaaattagccgggcatggtggcaggctcctgtagtcccagctacttaggaggctgaggcaggagaatcgcttgaacctgggaggctgaggttgcagtgagcggagatggtgccactgcactccagcctggatgacagagccagactcggtctcgaaaataaataaagaataacctttgtttacattttcatgtatatgtctccagatgttcctcatatatccatataagtatgtatatatgatgtacataagtgcataagtaaaaatacataagtaattttaaaagaggttatatcatagctgaatcacacatgacttagaccacacttgctcttctgagtacccatttttggacaactctcagtgtccactagcatgtctaaaaaaaatttctcctcctaaaatgctaatgcatgatgtagattttaactacagcttttgaggctcagtggaggagagtgtacatcacactacccaatgcaaagccttttaacagccccttttgctcatctttgttttccttcactgttcctcgccctgcagcaggcagctgacattcacctttcccttccaccctcctctctcagcactggtcctttgcctcctccctcatcccagctctacaaatggcctcagcctgcatattccaaccacccagcaaaacaaacatctagtaactaccgggtcagcaagagaaaatcggaggccctagccatagatagatcaccttatcatttctccagcacattccaggaaggatctcaattcgttctgtcccaatatacctctacatcctttgttttgatgatcacatagaattcattgtatgcatatatcattatttatataactaagcccccaattttgaacaagaggctacatactgaaaatcttttatctaccaagtcttttttttcttacaaacccatccaatacagttgcactgtatccgccaatacagttcatgcaactgtatggaaagcaaactctagaagagtatttgatagctccataagaatattaaactcttatacttctagagcgtaaaaccccagaaaagtattttgtcagaaaaaaatcatgtttttgaaatagtaggttttaaaagaaaacaaagagagttagaagtaagaaaattcaggttatcaggggcttgatatcttttttttgtgactgtagtcaggttacccaggcctttgtggatcaatttctcaaacaaataacagagatgaaaacaactgtcagtagctactgtcacaaaaataatatgataaacatcttttcgtttcctatggctgccataactaattatcacaaacttggtggcttaaaataacagaaatgtattttctcacagctccagagtccagaattccaaaatggaagggtcagcaaggctgcacgccctcaaaacactcttggagagaatcttttcttgcttcatccagcttctgatggctctaggcaatcccccgcttgtcactgcatcactccggtctctgcccccatcttcaaatgaccttcctctgtgtccctgtcttctcttctgtctcttataaggacacttgtcattgtacagtatttagggtccacatagataatccaggaggatctcattttaagatccttaacttcattacatctgtacagatcctttgtccaaattaaggtaatgttcacaggttctgtgggttaggatgtggacatatcattttgaggcccaccattcaatgcactacaattttctttgtaagtgttctgagaacccaggaagaataagtaaatcctctgattcaatcaaaaatgagcagaatgtaaaccaaaaatactagaagatatcctttttcctaggcactggcatacgtttcaatagtatctctaattacagatgtatttacacttctaagtgtcagaaatgaagattattatgacaaatttaaaatttagtaacttgtttttaaactggtatttttgtttttttaagcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaaggtaggtgtgtggatgtggagacaaattctttctctttattagatagtgacaaacacacttactttctccaaaagtctgcgtagggcagacacgtgtcagagggagaatgaaagtcggtctttgatttccagtattagtgcagaatcttgattttttaatgtttacttcacagagaaatatattcaatatgattttgagataaaaaacacaaaagaacatctcaaaatatagaaataaatttaactcaaggatgtgggggcaaagaaaacccaggaagactattgttctcaatagaaaaacaatcatcaggtttacttagaaaataaaacctggggattcatccacaaggagtattctactgccatacatacatagacaaaaaccaaagatggccaggcatggtggctcatgcctgtaatcccagcactttgggaggccaagaacggcagatcgcttgagcccaggagtttgaaaccagcctgggcaacatgacgagaccccatctctacaaaaaaatagaaaaaaatagctgaacattgtggtacgtgcctgtattcccagctacttgggaggctgaggtgggaggatcggctgagcccaggaggtcgaggctgcagtgagccatgatcatgctactgcactccagcctgggcaacagagcaagatcctgtctcaaaaaaaccaccccctccccgaaccaatagattaggtatagcttttttttttatttctgcaaagttgtgtgattttttagtaaaagtgaaaagtaaaagttagacactgagttgtaatattgggtactggtattgctaggagaataatgaagggagaaaattctcaagacaaaatgatcaaaactccagactagaaaataacataatttgaaataaggataatgatcgttccctagtaacgtatgaagattctttaaaagaaaatcaggccaggtgtggtggatgacacctgtaatcccagcactttgggaggttgaggcaggtggatcacctgaggtcaggagttcgagaccagcctgaccaacatggtgaaaacccatctctactaaaaatacaaaattagccaggcatggcggtgcatgcctgtaatcccaactacttgggaggctgaggcaggagaatcacttgaacccaggaggcggaggttgcagtgagccaagattgcaccattgcactccaacctgggcaacaagagtgaaactccatcttaaaaaacaaaaaaacaaaacaaaacaaaacaaaaaaacaaagaaagaaagaaagaaaaccagtgtgagtaggtactgtcataatgaataaaatgcttgtcaagtaaagttctgtggtttctgattaggcacttaattttttgatgtcatgtcaaaacaacacaagaagctgctacagcattgctgatctagcattctagatttgattaacatgattacctggtaactgactatatatatagcataattcaaattaaccactaggccaaaactatttttttctttctacctaaaattgtatttgttttttcccatttgtaaaaagatgttggggttgcacagacctctgttgttggctgtggggagagctgtgcatagatggggacatattctttggtagcaccttgggcatgagtgtgaagaggattcttagtgttcatgtgtatgactgtgtgtctaagtgagttgatgtggtaggaaccatagcctcgagctcacttcagacagaaatttgaagctctagatgtttctatgtggtgaattaatatagccttcatgagaacaaagggttggcacctcatctagaggtcaaaggccttaaccagattacctgactgaaggcctgaggtgaacctggagctatttcatgaacatgaacgttaccataaaaccaagactaggtgatctaaaaaaagtcaatgacattgacattttctaaggagaaaaccattaaaatatcacggaatttgcaaaccctatgaatttatctcgtaatttctaggggatcatctgaagttatttactaagttagaagcagtcaataatgaaatcagcatgttacaccaattagaatttgttatcaactctcccttgtggatttcaaggtaatttcctgaggcagagcagtcctgctgggaagcagtaaagaatagtagagttatgaagcctttaatcagtgatgttggtcataattgcatatgattttgattaaaagcttaccactccaatttcaaaacttagttttataaaaagagaaaaagcaaatggaaagcaacctttaagtagaattttaaattgggaatattttcataggttggtttcttgttttttcaaggattcatgattaattatagtgaattaaataataaccataataatacttaattgagtaatttatctctcatgtgttcagccttcaggctttttatataaatattaataatcagaaatttttaaaaaggtttcttgggggctgggcacagtggctcacgcctttaatcccagcactttgggaggctgaggtgggcggatcacaaggttaagagatcaagaccagcctggccaacatggtgaaactccgtctctactaaaaatacaaaaattagctgggcatggtggcgcatacctgtaatcccagctacttgggaggctgaggcaggagaatcgcttgaacccaggaggtggaggttgcagtgagccgagatcgcgccgctgcactccagcctggcaacagagtgagaccccgtctcaaaaaaaaaaaaaaaagtttctcaggatagaatgttttattatgaggaaaaaaataaaaaaaaacaaagtttaggtagactgtgtagtataatgcagtgctccagacaactcatattatgttttcagtgattgaagaagcaacatatgaaaaaaattggtattaagggatgaaaaaggagaaaggaatggagaagatgttataagggaataatttagggactagggtcacatctcaaatggtaatattgtatcagtatacttcaagcagacgttttctctattccttctattcccctatatgggaattcaggataatctcaggagagttcttgaaaatgcagtaaaaataaaggagagtttgcctattgttgcataacacattaccacaaaacttagctacttaaaacaatatttatctcagtttctgtgggccagaaatgctgacatggcctagatcagtttttctgcttcagatgtctctggaggctgcagttaagatgttggcttgggctgcaggcatcttagggcacagctgaagcagagtgtgctttcaagttcagtcagctgttgtttgcaggactcaattcctcacaggctgttggactgagggtcttagttcctcgctggctattggccagaggctgcctcaagttccttgtcgtgtggacctttctaacatggcggcaaactaacacaagaactgaaaaccaaacaccgcatgttctcactcataagtgggagttgaacaatgagaacacatatacacaaggaggggaacatcacaaaccagggcctgttggtgggtggggggcaaagggagggagagcattaggacaaatacctaatgcatgcggggcttgaaacctagatgacgggttgacgggtgcagcaaaccaccgtggcacatgcatacctgtgtaacaaacctgcacgttctgcacatgtatcccagaacttaaagtaaaataagctaaaaaaaaaaaaaaaaaaaaaagcctgcaagtggagaaggaggagagagagagagagagtgtgtgtgagaaagtgagacagagtaagaaagaagggagcttgcaataagtagaaacaagactgcaatcttttttaacttcatcatggaagtggtatcccatcacttttgctgtattctcttcataagaagcaagttactaggttcagctcacacacgaggggaaggcatttacacaagggcatgactatcaggagatggggaccactgggggttagtttcaaagctgcctaccacaagagattttcaccagcaccacaaccccacacataataaataaactctacagttccatggcaagctacaaggaagtctttgtgttgtctttatcataaaattgaatctttcccccaaaacacctgtagaaaggctatgcagcattaagtatcaaagggtcaaaatctaatttaaaaaataaattatgagagaaaagcaagtactgttttacaagaaagtatataatttttttattcccataggcttctttttttgttaccttcaaattaactatggtcaaaggattgctcattccagtaataagaacaggcttatttcatcatttacataaatatcagtatcgggcacttgcaaatgagaaaactctgatttgagtaaggattagtttcacttcaatttccatttatgcgtttgccaagtttaaatcctactgtagttacttaagcaaccaacagaaacatatttcttgatgatgctaaaacctacctacacctggctttaaagcagaagaaatgctatccagctgtatcctataaattgcttgataaataatatttacatgttatttctttacacgcttctatttacttccctattaaccagcttctccagatgtattcagtgtaattatgtacaggacatggtgttctacctcaaagggaaataaaatacttatattctacaaggtatggtataaatgggaaagagcacagagattggttgtaacttctctgcaaacaatctttggttaaaggactgacaaaaaatatccatctagtaaaagaaacaagcagtagaaatgtgaaaatgactgtgttcagcataaccctggcacatgttggcacaccaggaccattccacctgctagccccagtgagctttctttctctctgcagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacaggtataaggacatcggcaagcctgccgtctctaaagccctgatgataatagtgttgatagctacaacaaccttgttgctaaacactgtactaaatgctttatgtgcataatcgcatttaatctttgaaacaaatcaagagggtattttatgctcctttatagatgaggaaactgaggctcagagaggtaacttacttatccaagtttacacggctgataaatagcagagctgggattcaaacccaggtctgtgggaggccagagcctgaactcttatcagttattgtctctctgatgctatgatgtcaagactcagaaaaccatatggaagttactaggacaggatgttaaaaggaatgaagatagctgatggcaggttctgtgttgctcaaatggagtgattgagaaaaatttaatgaaggttgtgggcagaattggggaaagagggatgggacagtgaagcacctgaagctagcaaaaagggtgagatttccccacccttcgactgaggagacaaggggagggagcagttatgggaacccagagggaaagcggagaagagggtttctggactggccactgtcaactcttagcctggcagggagtaggggcaggggctgggagaggcaagagggtttatagatgtagcccatggagggcagcgtcctggggcacagagcctgatggggaaggaaggggagaggatggtgtctctggaggggcaaagagagaatatctagcacaaaagacatttggaaataattctgcagtccccatgaaagaaataattcagccctcttcatcttataaatttccctttgcttagtaggtaagttttcctttctctggttaccatgtttttaataaatgtcgcatatgagagcagtagtaacaaacttgggaaagcaatactaaaaaactgtacatcaaactacattatttttggtatctgttgcaaattctttgaatgttgatatacttatttaattgtcagtttgcctatatggtttattctccttttaactgcaaaaagaggtagtacaagaaaattacatgcactgaatatatccatgttaggtaattttcttaatgctgatttgttttgttaatagatttacttatccttaattttgttcctccaccctctaaaatatcctttaaactgcagagtttctttttctaaattcttttagagaatcttggagcttgtgtgtattttaacctctactatttgacaattaggaaaaaaaaatgacccaagtagggctaagcatcaattctgagtagaaaaaaagcttgcataacgtaagagggtttagttcatgatcatgtgattccctagagcatagccaaaaaattgtgcaagaagatgaagtttatgcaaagtaaacactacaaaaacactctcactgagactcatggaagttccattacatattgagatgtcagaataaacacaaccttaatggattgcttccacttaatagatagttgagtactttattttgactgctgtactcaacaaatgattaatttcatacaatgtacttaagtgtaagtgtacagcagtttttcttccaaatatgcatttttgaacattttaatagtagttttttaaaaactatctctcgccccaaagttatggactatttggcaaaccacctcttagaaacaaagtgaacaaatgaatactctatgtagtaaggactacatggaatggtgattgaatagacaatgcattaaaatcaacttcaaactcatccacacatcatagaaccactcaagaaagttgtgtaatctctctgtacatctgtttcttcacctgtaagatggggataataaaaacccaccccataatgttgttataaggggtaaatgagttaacatgaaagcacttacaacagggcctggcctacggaaagcgtagaaagaatgatatacatgttagctataattatttgtttgggcatgatgatcttgtatcagtcagctattaatacacagtgctacgtaacaaacacactaaaactcagtggttccaaacaacaatgatttactctcacttatgtatctgaggttcagttagtttagggtggattcagctgggcttgactctaagctgcagtgtgagtccaagtcaacttctatgtttcccatcgcttggaccagcaagcctgccggattatgttcttttcatggctatagcataagtttgagaaaacaagccccataaaacatgcacagttcaaatttgtacttctgtcatgtctgctaacatcccactagccaaagaaagtgacatggccaaataaaaagtcaagagacaggaaactatatttcttcaatagagatggtgtgagaagggatgaataaatagtttgaataataatctattctaataaaatcctaaagaaactgcatagctttaatctcatttaacccttacgatttacactcaaatttaaagcaggagcagggattaacagtaccattttacaagagtatcaatgatcaaaaagttaaaagatttgaccaaacttaaacacttcataaagttagatgagcctgtttagttccattcttaatggacaacttggctaaagtcattgccgtaaatgacaaaggcaaaaattcagactagaacaactttaaaaatgatatataaaattaaaaaaatatattgtggttatctttctctgctgtagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcggtaagcacttttgtttttttttttatactggattatgcttatttttgccttgccaaaactgtgtgtagaggatttttcattaatgtagagttatcaatttatcttcaaattattcatattttagcttctaacctgaacctactggtaataactggcaaatacatatttttattagatgttagatatatattgtggtaggaccaaaacgctcagtggtatgagcttgtcatgtctacttgtagacacgtttgttcttaatatgcatagtctactgcaggtgtaaaaccgctgtaacctcaaatttagcacatgttccagaacaagcattaaataaaacttatttcaggctgtttgtatatttacatcctgaaatgagagaaaacaaagaagattcctggggtcattggggagtgacaaaactagcagcacgtgagttttgcaactttctaatctttcccccttaagattaccaaatggaaaacccttattttaaattaaaatgacttaaaattaatttggctttgaaattctcttgagattaattttgtgattatttataagacaaacgacaaaaccaaaggtaaggatcacttatttgaagaaaaaaaaggatttaatataaagaaacaagtaaagggtaactgaatgaaaagatcattagttagatacttagactttgcaaaagtaaagcaataaatatattgtgtgagtggcaagtaaaagagtaagctggtgattagttaacattgaaccaagaagacacctcccgcctctctccagcagaaaagaaaacttgtagaaaagcaacatttattctcaagatgttcctgctgttctggccaatgcttttatctttattttaaagaaaataatcttaggggccgggcacggtggctcacacctgtaatcccagcagtatgggaggctgaggcgggcagatcacgaggtcaggagattgagaccatcctggctaacacggtgcaactccgtctctactaaaaatataaaaaaaaattagccgggtgtggtggtgggtgcctgtagtcccagttacttgggaggctgaggcaggagaatggcatgaacctgggaggtggagcttgcagtgagccgagatcgcgccactgcactccagcctgggcaacagagggagactccgtcaaaaaaaaaagaaaagaaaataatcttaggaggtatgttagaacatatttaattttcgtaaataaactgttgacagctataatttgcatagttttaacatataccttcttaagaagattacaatttccaaaattacagtttagtttctaaacatttccacgtagaatatttataattacagaatcactatctagtaagatgcagttcataaatacaaattaagctcctttaaaatcttttttttttttgagacggagtttcgctcttgttgccccggctggagtgcaatggcgagatctcggctcactgcaacctccgcctcccaggttcaagtgattctcctgcctcagccttccaagtagctgggattacaggcatgtgccgccacgcccggctaattttgtatttttcagtagagatggggtttctccatattagtcaggctggtctcgaactcccgacctcaggtgatctgcccgcctcggactcccaaagtgctgggattacaggcgtgagccaccgcacctggcccgctcctttaaaatcttaactcttctcacatccttatcattttgtggtgagaacatttgaaatttactctcttagcaatttggaaatataaaatacattattattattgactatagttaccatgctgtgcaatagatctcaaaaccttatttctccaaactgagtataaaaagcaaaaaataaatttaaaaaatcttaactattatctactcaggaatttatttaatgttccaaagttttgattatccttgaaagcttttaaatctggttcattgttttcttttcctagctgttcccattccaagaaactctgtcctattgacatgctatgggatagcaacaaatgtaaatgtgttttgcaggaggaaaatccacttgctggaacagaaggtaatgatagtagtagtaaaataataacagtaataataaaagtagcaacaatagcagcaaccgttattgagtacttagtatgaccagacaatgttgtaaatcttgtatatgttttaactcatttaattctcacaacaaccctgtaatgtactattgttatttctttttttacaattacaaaatgggcacaccaagatatcgagtaatttcctcaaggtcacacagctgagagtgatagaagtggtcagattccagaaccctctgtaccataatcatatagtaagtccatcaatgcatcactctgctttttaatctcaaagaaaagcccagagtggttggagcatcctgaaacactgaaattgaaaggggatgttaaacttgaatgaaagctgcttcagaactaaatactagtcaactgcagtttactaatttatttgtataaaagtctcacaggaacataaagtaattttggacttggtttctgtcagctgcatcatatgaaaacacgccagtaatttgaaaaaagaaatggagaataagagaaaatttttctggaattagggcaaagcaaaagcaaaatatggctattggtctaaggggagctgggagcaaaatgagatatagtcaaattgtcattgctcataatccgtaattctgtgactttgggtgatgaacatttgcttgaaaatgaatgcattttaatgtattttccagagagctttacatggttccaccaaaaaaaaaaaagaaagaaaaaaaaagtcacaagtagtcatgcagttttaaccttgcttgttttaaactataatctataagcaagaacagtaagggctaaactctaagaaatctgtcctataaactgtaaatagcaacctactctccattcttctgcctctcagcttccttctaaatgttttcacgaaagctcagcccagagcatgtggggaaatttaatatttatgtggtttaaatgcccatgccgatcttgaatgttctttacacccttcccaccaagtgttcagccatcctctaccagaacatacatcagttatttggagactcgccatccagtgaggcagcaccaaggggtgggcacactcctgttgttatactgaaatgaaatctctctccagaacagaccagactgcccaatggaatacaataagagtcatatatgtaactcacattttacattaaaaagataaaaagaaacaagtgaaatttatcttaatatattttatttaatccaatctatccaatgtactatcatttcaacatgcaatcaatataaaaaatttatgagctagcctacattctttgtgctaagtctttgaaatccagtgtgtgttgtacacttacagcacatctcaatttagactctctatttcatgcccaatagtcacatatggcccatagctaccttgttggacagcccagctcaagagcatcaactcattagttcaggttttaccctatagaaccatgtaaaacaaatctaattctttctccatgtgactcatgttctaaaagtgttagaaaatttttgtggggttggccgggaatggtggctcatgcctgtaatcctagcactttgggaggccgagatgggaggatcacttgaggttgggagtttgaaaaccagccgggccggccgggcgcggtggctcacgcctgtagtcccagcactttgggaggccgaggcgggcggatcacgaggtcaggagattgagaccatcctggctaaaacggtgaaaccccgtctctactaaaaatacaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaagaaaaaaaaaaaaaagaaaaccagccgggccaacatggcgaaatcccatctctactactactaaaaaaaaaaaaaaaaaaaaaaaaaaaaaaaaaaaaatagctgggcatggtgatgtgcgcctgtagtcccagctactcaggaggctgaggcatgagaatctcttgaacctgggaggcagaggttgcagtgagccgaggtcatgccaccgcactcgggcctggatgacagagtgagactctgcctccaaaaaaagaaagaaagaaagaaagagagaaagagaaaaagaaaagaaaagaaagagagagagagagaaagaaagaaagaaaagaaaagaaagagagagaaagaaagaaagaaaagaaagaaaaagaaaggaaggaaggaaggatagaaagaaagaaagagaaagaaagtaagttactgtgggaagggcaatatacttagagcttaaaggctctagctgaggatttcctggcacaaagcctctgagacagttttgtacggaggaggtttgtaggcaggcacaaggcattaaagggtaaagagagaggcagcagaccacagcgcagttgctaagaggcatcagcctaagccaatgggaagttgaagctgggaacccctgcgggggtaagtcttaaatctaggtgaagaggctgagccctgtagaccgttcattggctgccttggagaggggatgtagccttaggagaggcagcttatttctgctggagataattcttgggaaggcactcagccagtacacgtgtgtagagggtggtaagaagaatagggaagaagagaagtgctgttctaagcagcgggtatatgagcactcagggctggaggtgagagaacatactggaagaagttcagcatggtggggatataatgggtggggacataatggggaaggggctggttagatgtgagagaagaagctggacaggctcacaggggcaaagcagaaggaccttgtaattcttgcatgggagcttggatgtgatactaaggacaaagggaaaccacacaactggctaaagcaggagagtgacagtacccattagaattttaacaaaatcatatcagcaacagtgtagaagaggatgtgttgactcggggcagggaaggaggcaggaaaccttttgggaagttgtagcaatgatgtaagtgagaggcgcagggtggactggatcacaattgtttctcattctcatctcctataagtccccaatgtggatcaagttcacattcatttctccagtggccccatcaaattgatgggatttactgagcttactgctcactatactttttttccgcacatgtgactgttaagccaactgccttttctacagtgacttctcttgcccagatgagcacatttaggttagtgaatccaagtctaatttaattgagtcttgttagagtcaggtcattgctctaaattgttaaaacaaacgatatacacaaacacacacacacacaaaagaataaattgaggaggtcccaattctgtattttaaaatacttaatatatcccttccttcttgaagagagctacaatttcaagaatttattttgaaaaaattctatcagtttattgataaaaatggtaaaaggaacaaagctgagaacagaacatatcatcagactctctagggacggaaatcaatacataatacttcaagatatcaccctcagctacttgctgttccaccaccagttctcttgcatccagtttttgtttcttttaacttggctataaggatgtgagcacagactctgccaaacagcctgctgaagttctgcaaacaccttgtggattgtgtttccctgaacaaccctgtccaacaatggccttgggcctgtctgaagtattcttagtgaacttctgctgccacctagtgatcattgcgaatttttaaaaagcctctttatcctttaacaagttactcttgtcttaccccaaagcggcatctgcctcactggcatatgacttacagagctcacattttccctctccacaaagttcaaaatggagacttctcagatttagccttccagcacccattctcaaacgtcgtgcattacagaaaagtttaaactataaagttgaaccgcacgagattctcattttgatatgtcattaaagtcagatattggcaagaacatatggtttaacccaatggcttggaatgctggatgggattcccagaagctccatacatcggcctgcttcaggacccttttattacaccaaataaacccaacaaacatccatcgagtgcctattttatatcagaacaatgagacctgctccttctccttcaggacattttacttaatgggggaaacatacaagtaaacagacaaatgtaatcagtgcaagaaagaatcggacagcaatatgcacaggataaggacacttagctaaacctgcagacattgggaaagatgtcagggaaaagggatggcagaaggaaagacaaggccaaaggcatgggactgggaggcactggaatatcagggcaacagaaagtgctgtcatttggtataaatggaacacacaggatatatgaaagcaagaaacagaagatgagtctgtgaggttactatgatccagttcatggagggccttgtatgtcctggtgggaaaattggtttttattgtgggaagggaaccttttaatgcattcaaagcagtggaatgaagtgatttggtttgcatttgttaatcatgtgaagaagaataggttggagggataaaacttgtggtggtgagatgagtgacagagcgacagccatctacaaaagaaacacaaggtacagactgaattgtgggagtggtagtggggatggaaaataaagaacaaatttagagaggcagaactgagtggacatgatgctcagacttaccagagcaggtgagtcaagaatgatgtcaccattccctaaatgaggcaaactgggagagaagcagatttggggagaaaactactaaacatgtacgtccctccaaaaccttcaagaatgctaaagggacagagtcaagttcttccaaagtttctgtctcttccatttattttgcaatgaatttcaacttgttaatcagaaatggatttggagtagtagctattcaattgttttatacaccttctagaagaaatatttgtcagatgagtatgtcaaaaacttctcagaccctcccctttacttgaatgtatcttccagcagatgttggtggaatcaaagttcattattactcctatatcttttatactagtgttatgatctgcagtgaggacatgcattgctattgctacgcctggcctggaatgtctgaggtgtatttctacaacaccaattattttgtgtgtctctccttttaatctccaccaaaaaatggagacagctagattcataacccttagacatcctatattttattactaatacttggttgtggaagtttgcattctaaacaagtcatcaacataaaaatctctaaaaatattttatgaaaaatattcagcttatgatattttaaaaatcacaaacctaagaaaacacacaaacctgtgtttgtattgtgaaatcagaggttaatcttcctcaccctgtgaaaaaattaggggcataaatctataggaaggagattgggtgaatccaagttacttacggatgacataaaagatacaatcaactttggtgatccaattgccacactacaactatctgaccaacacgtttctgtttctctttagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcaggtaaatgccttgagttgtcttgcctttactcatgacatttaacgtagatgccattttaatttggtgggattccttagtaagctaatttttccccttggtgcctgagtcccttttggataatagaacagaggtttagcagctaaggaataagcaagagtataccgagtcatgattaatcatgaaaataagaaaatcaatcctgcctgttattatgtgtgtagagctttttttttttagacggagtctcgctctgtctccaggctggagtgcagtggcgtgatctgggctcactgcaacctccgtctctctggttcaagggagtctcctgcctcagcctcccaagtagctgggattacaggcacgtgccaccacacccagctaatttttgtatttcagtagagacggggtttcaccatgttggccaggatagtcttgatctcctgacctcatgatccacccgtctcggcctcccaaagtgctgggattacaggcatgagccaccgcgcccacccggggtttagagctcttaaacaacaatgaaattggtaaaatttaagcagttattaggatattgcttaataataatattttaggaaggggaggtttcagatcatcaacctgtttagttcaatctctcattgtttatgtctatatatgtttgtttttttctttaatggagggaatatcattggatttatatagcaagtaatttattcatgaatagaacacttggaggttactgattcacttcagtagattttgaatccatgtgggataaccatgcaggattttatactgacattttaaatacatgtctggaaaacttaatcaaatcagagcagagttattcttttgaatccagtcattgattctgaattctcatctttattttcttttgcaacagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatata

SEQ ID NO: 3116 - DNA, 38785 bp, human; identical to SEQ ID NO: 3115

SEQ ID NO: 3117 - DNA, 37713 bp, human
cttttgaggtagagtcagagtagggaaaacaactaatctgttttccaaacaggttttcataaataactgacaggagatgggctgtttttatggaagtattaacccaaatgatgggtgttaatcattaaacctttttggtggtggctcgcttgtttctctgatattctaatccgggtcacagaatggctaaggcagatttaagtgcagcgtggattttttttttctcactttgccttgtgttttccaccctgaaagaatgttgtggctgctcttttttctggtgactgccattcatgctgaactctgtcaaccaggtatgtagccttgaaatttaaaaatagatgaacagttttctacatgtttgacaagtcatcgactgaaagaactctttatttttctaaatctgcagacatgttgtggcttgaaagttggggcagtgagtgtttaatgagtttgaaagaaaatattaaaccatctaagatgatttaggttaaacttccaggagtatttggggctgtttaattgtagttctttgttccattagtttgagttgcattacatattaggatttttcagactctgttttggcagatcctaatcatcatatactgctctttcttttttcttttctggcaggtgcagaaaatgcttttaaagtgagacttagtatcagaacagctctgggagataaagcagtaagtggagcacctgagtgttctttttaaattttgtttgctaataacactgtgctttctctaataatgggcctgtctgcatagttaccttaatcttgaataaattatttctaaagacctcaaatctgatttcttaaagatagattatagaataatatgaatttttaataaagtaggtttgcctaaagtatttaatcagtagtgtatgctaggcaacatgtgaagttttgtgccacacaaaacaacttaaaaaaccagcatctcaactcgggatagtgaagccaagtggcctgagtcagtcgttcaggtctggactgggtctactcctcaccgttgtggtcatttgaattttgttagcctcgattttctaccattgaaaataagggatagttctacccacataaagtctttcatagcacaaaaaatttccaatttgaacctgaagtttcttcaattattctcaattatcaaagtaacatatgaaatatatgcttatgaaatagaagtttaaaaaatagtcatagggcccatgtggctataggaatggtaaagatcattgaattaaaaagacagtattgtctaattctagtttcagtttcctagtgtggtctgcaaaattttttccccaatagaaggtgacgttaagatgccttaggcatagaaacagaaaaaagagtgctaaagaaacttagaggtattctgtttgcaggccagttcatcaatttggtattttattattgactcaatgagtaatgattgttataacagccagcatttattgagaacttatcttactttctagctggggctcttctaagcaccttactcctatcaaatcatttagccctcacaacaatgctttgaggaagatagtagtacaggtattagtattcccactgaatggatgagaaaactgaggttcaaagaaattaagtaacatgctcaatatttcaagtcagcaagtggcagaagtaagatttgagcccaggcagtctgagtgcagaatacactgtctctactagtgtgcagggttggccatcccagtatcctctaatagcaggtacgatgctgaatgctgggatgtaatggtgattaaggcttgtccttacccttgtggagcttatagtagtagtagaattggtcatctattaaatattcagtaaaccaaatgcaaatgtgcaatcttgacaagtattacgggaagaagtacaagggcacttcggctttgtcaaggcccacaatacctggcacttactgtgatgtctgaagcatgagttgaagtgttacaggaaatgaaagaaggaaaggcagagggaacagcatgtgcaaaggcttatcacaggaaggatcttggtgagagtaaagattagaaagagggcagaaatatctggaattggggcagtgaggaggaacatggcaggtgatgagcttaaagagagaggagcaggcaggccaaggaatatgtgggctgtgttagggagtttcattttgagatgtagggagggttcaagagcatcaaatgccgttgagaggccaagccagaaggcgactgaaaaatgttcattgtgttggacaatatggaggtcaatggtgattttagaaagagctcttttcgtggggtggaggagctggaagacagatagtggggagttaaaaaataaatgagtggtgaacatgttgaaacagatgtgtggacaactcctgggagaattttggctgtgaagggcaggaaagagatagcagtaggtagaagaaaggaagactgagtaaaatgatttgtttttgctgttgcaaaacaacagctctttgctatggctttaatgagaaagtcttgagcttggttaaaagacaatgaacagactccggtcagagctaaatacacagaatggaggggaactgatattgtttagatctgagaagggcagaggagaagcattcctaatataagtgacggaaatggcctctgataggcatagttctgtctggcacttcaggagaggaggcggctaagacgtgtctatggaggaagtgttgtatcttgatgtcaggaggttgggagagttgaaattgatgagatgtatctataaattatgaagcaaaaccatttagtgagagtgaggtttgagggaaaccattgggaaaaatggttaaaaaaaaaaagcattgaccatcagttctctctctagagagaggtttgaaatagttatgtgacccatgagaaagagaactgatggtgaaaccttagggattcccaggcaatttgggggtaggtcatcatgaatttagagttaaaccaactaaccctgttctgtaattgtctctagttataccagttacttacctaaaatgtggggttagccatggtttgagtgttcttagatgtgtgcaaaaagcaaggtgagctggggcatttaaggtcctggcacatgttattgaaatgaggaaccaaggaatctaaactgatagataaatatatgcaattaatttgtaccatttggtctgtgaagccacacgtggcatataaagatgtgttcaatttcacattgagcacctattatgtgtcaagtatacgcacaacaggtagttaagctgctatggacattcttatatgtgtatttttcatatgccttcttttttgggggtatttaccctggagtagattaatggatcataaagtatacaaatgtttagctttagtaactcttaccttatcctctcttaagttgtacattttctcattaatatatgtgctcaattccttttataagcggaggctctctctttgaagtgtttgaatgccctgggagaaatacactacgtccaatgcacaagctttcaatccttttcacacttgcccaagataagttggttccactggcaggatacccaacccaatctagaactgcatcagttctgttctgatctaagtagcttggacctttgttctgtgaccaaaattggactcctacccagccagcttatgctcttgtttttgagatgaacaaatggaaggacaggagatcaggtcaagttgtccccaagatctgaaaagcaactgaaattcatgtcccagggagagctggctaacatctttattttcattttctgcactgagcttattattctcatttgttcttgagcaggcttattccttgtgtctgcattctgttaataagccttccctgtcttaatagtgtttctgcaccatttttaatcagacccatttcttcttcatgttttattcatttattattaggttagatcatagctactcttattctgaataaaattaattttggaaaaaaatgcattatcaaaaacaaagagctatgccaccaatcagttacttttaaactttcatagtataatatcaaatgaaaagttcacatcaaaacattgaaggagcacttcaaataagatctaaagttgacattaaaatgcagtatttaacatttgcatatgagaaaagtgatttttccatttccattcttttgttgttgttgttgttgttgttgttgttgttgttgttggagacagggtctcactctgtcatccaggctggagtgcagtggcatgatcttggctcacggcaacctccacttcccaggttcaagcaatcttcctgccttagcctcctgggtagctgggactacaggtgcatgccaccacgcctggctgattttttttttttttttggtagagatggggtttcactatgttgcccaggctagtcttgagctcctgggctcaagtgatccacccatcttggcctcccaaagtgttacaggcttgagccaccactcctgtcccccttttctgttctttatggtaacatcttacagcagagttacataaggtaggactgaaggagaaaatggtgaagtggaagaagcaactgaagaaagtttaaggttctatgttacagaggccaaggcaggaggatcacttaaggccacacatttgagaccagcctggacagcacagcaagaccccatccctcctcccttccaaaaaaagaatatgctatgaaaatatttaggagaaaggaaaaagtacagcacagtcataaaccttacccagagaaggtaactgagtaatacattttttgttgttgttatttaggagtcatttatttttacttactatcctccctgccaccaaagaggagaaaggcagtaacggtaaaatatgtttccccatcccagagtgaaaccccaatcctgacaatgtccttgtgatataccaaccccccaccctcaccaacttcttccgctcagcttttgctactttctcccttcctgcttctctttagttgctaccctccttggtggtccttaaacagctcagtttctttttgcctcaggctttttgcatttactgcattaaggagcagagtgagtcaaatatactatattaatttgctagggttgccataacagagtaacacagactgggtgccttacacaacggaaatttattttctctcagttctggaagtcaagatgtcatagggttggttccttctgagggctgtgaaggaaggatctgttccaggcctctctctttggcctgtatgtagatggctgtcttctccctgtgtcttcatatcatcttccctctgtgtccagatttcctcttctaaggacaccaatcatagtggattagggcccactccaacaacttcattttgacttaatcatcactgcaaagaccctgtctccaaatagagttaaattctgaggtattgcaagttaggacttcaacatgaaatttttctggtgaggacaaaaattcagcccataatatgcacgcacacacactaaagtttctggctaagaaaattttttaaaaattgtactgatgttaataaaggcaactgggagggagtttatgagggaaaagagaaagggaggaaggaaatgaaaatggactatatatggccaggatgaaatgtccaaatgccctatttgttggctgggtactgatgctgcaggttcttaggaagatagtgcaacaggagacacaccaaacttagaatgtccaagaaaccctaccccaaacatggggatataatttatcgtggtctccagtatctaatatatgagaaacgtgtgtgtgtgtgcgtgtgtgtgtgtgtgtgtgtggagagagagagagagggagagccactgtgggtacaagtagaaccaatggaccatattttcccccatacactttgttttccttctttttcagtatgcctgggataccaatgaagaatacctcttcaaagcgatggtagctttctccatgagaaaagttcccaacagagaagcaacagagtaagcaaataatgagaaatcttaactgattatttacagtattatttgagatagtgcattatttcaaaccttgattttgaaaataatttattaagctaatttttcaaagggattcacacttttattaaacttaaaaataacttttataatctaactcatcttacagtttatatcatgttccaacaatgctctttgtttaatagataatatgaagataaatatccctcaaaattgcagctatatatcctaagctttctacatttctattgtgtgtgtgtgtgtatatatatatatatatatatataattttcttgcagatagataccaaagaattttactcttattttgaaaataacctaagtgtgtataagttctttccactcttggtatttatcatagtaccttgtttattttcttaaaagcacttaatatgacttttaatagttttatattttttgtctgttcttctggaggaatcttctctatgatgtttctttctttctctatttgtgatgagggtaacattcctggtctttctctattcccttcttcactcctcccttgagaggtaaaatgacttatgtgattggtgagctggaaggagaacctgggcatgggttcctttctccttgtgaggtagccatccccaaatgatagcagacgtctctcatgcaactctctagctaagtacagaaccaggccctgcatgcacaggtgcatacaccctaaggttgtacttgctgtttgcagctgaggagcatttagtaggtgccattttatatgaagggttaaatatcttgtgtattactccagtacaggacaatacctgcctcacttatgctctacttgagacaatggaggtgaatatatttcatttcaggattttttttaaattagggagaaattctgcctgctgattaaagtcatatcctccaacctaaccttttattttggtctcccatctgtacaatctttttgtcttaattctataataattcaaggcccagtatagatgattactattaattggtctccctcacatccacaatatctgatgcatgggatatgaatataaagaatgaaacagaagagtggaatttgagggagcaaaatgaacacatatacatttgtgtatacacacatgtatattttaaatatatgttttaaaataatatattaacgtgattcaaaaaatgaaaagaaggtatataataaaacaaaactttgccctaagttctactcctgttttatagatcttaaaattatatatattgtatttcatgccattaaactgcagcattctttcacaactatttataataacttttttcaataaaaataaggtgattacattacaaaaagttgaacaggaaaaaaaaaataagaagaaaagccactggttatctcacaatggtaacctcttaaatattctctttgtattttcttctagcccttcttgtaagcaagttttatacattgctgtgttcatggcactattagttcctttaaatgatcacatttcacctagtacatgactaagttaaattaagtgtttccattcttaggaaattttaatttaagtatataacatttcagattgatttttgggagtttacctttaaaatatcttccttcagaatctggagcattgtaggagtctatgaatatctgatccggtttatttgaaaggttgtttgacttacagttgggcactggggctgggtgcagtggctcacgcctccaatcccaaaactttgggaggccgaggcaggcagatcacttgagcccaggagttcgagaccagcctgggcaacatggacaacatggcaaaacctcgtttctacaaaaaatgcaaaaattagctgggcatggtggcacacaccaatagtcccagctactcaggaggctgagatcacttgagcctgggagtttgaggctgtagtgaactatgatggtgccactgcactccagcctgggtgacagagtgagactctgtctcaaaaaaaaaaaaaaattgggtacacaggatatatgtcgggttggtgaaatagtaattgtggtttttgccattgcaagtaatggcaccttcaagaaaagtagaagcttttgttgccagtgtcagttgtaaaaatcaaaactgcaaaactggactgagggtcagtacacatttttctgtaaagagtcaggcagtatgagtcctggtaatactgctatcaaggggatgaattggcgagcgagatgtgtttaagatgcaattcagctgctggcctggattccacatgcactgccatattggaagctgcacccctacatgaagagctatgggaaagggcaccacataatgcaagattggattgaaaatagctttgcggagaggctgcttctctccagtgtggcaggtggatggaagataccagtagccgccttccagaaatcttttggtgccaatgtgggcagactgaaggagtgtggcaaatattcctttccaggatagcttcaggatccaagttttgggactggctgtttattgtctcccccccgcccaccattgtttatctactaatattgcagaaaactgtaaagcacaaaaataaaccaaatcacgtgaattaaaaataaagatattcaagtaattaacagaataatgaatagtctcactttcatcccaccttttacccagggtgatatctacaacatctcttatatcaagtttggtcaccaccaatgatacagagctcattgtctcctgagcatgcctcttcctatttggaaacgtacaattggcatatacttacagtagaagcttgcatggctatgaaaaaggaagtgatgtcttgttggagagctgatctagtccagttaccatcaccgcaggcaggcagtggaagagaaaccagggattccctaaggggatcagagaggctgagggtgtgggcttgcagagagggctgtggcatttccactcccctaggacttgaacagggctgggaatgggttcctgtgcagattccccagtgcggccagctagggtgttgacaactgagttcatgctgatgagttggtccccattccttacgagtgatgatgtgttggagtgatattcttgtttgcatccctacctacctgaagtcaggtagagaagtgctcatagaggatacagttgtctttaagaaaggagactggcataatattttctggagggatgctccccaacttgcagacattctcaggactccgtcaagttgccactagagtaacagtagctggagctctagagaatatgatggtgtccctagccactgagagtgtatctggaacagaaactggtggctacttcttagccagagaagtctcatggtggaaggctggcttgagtacctgtgactggggagagagagagcagttttttgagcagtctgcacttgaatatattcctggggccaagcagaggctttggaagggaacaggatagagttactgcctattgggcccatgtccctaagtgagacagagcaaggcaaggcagcagagtgaggctggaggtgtacaccccggaggcagagccgaggcgaggtggaggaaatcagtcagcgtgtcacccatgtcaggggaagatgcagtgcagaggtccctggaggggcccttgaaggccccacaggagcattctgagtggagagcatctggacgtccactaccacagaagacctctcaaagcgggggaaccacaaggacccaggtccaggaagaataatttggcctttccttatctatctcacgcccccatcatcttgctttcctgtccctaagcgaggagaatgaagcatggtggaggggagcacaggcagggagggagtagggagtggagcccggaggaaatggctggagcccaccactcaggtccctgctctggccagaactgctggaaggagagcagctgtaggtgagaggcaggaaggcagttttggttagactggcctggatgccttagcagccggaagtgacaggaaagccacaccatctgccccagatgctgtcaagaggcgaggaagaaggagctgacagagtgcccaaagggaacagtgtgagcaacatcaacctcttccttcactgctgtccatgaggccagcccgtggaactacactgctgtggctggagccacaggattaagtgacctctactgaaagcctgctacgtgctgagcactgagattcgaatgaggactaagaccaggtcccacactgcaccaggtccacacccaggaacctagccctggtagacattgtagaaagatagatcaaatgtgacagcaacaagacaactctttcaaaatcatcattcacaatttctgatattaaatgctttttttgctattgctgtatttttttaggagcagaatgggagatagatggaaaaatgaagttaagggaaagctctggtttcattagttgaggttacttgaggttttcctggaacttggattgaagatggcaaccaagtgttttcaactgtttaaaatatgatttaggccagatttactaaaacagtttcacaggaattttaaaatgttgaaaggaatttctaaggaagctataatctaatccaaagtttagtctaattcccaggtcaactggaaacttaatatgcctagtttactcaaacatcaacttttagataatttatcatttttagcaagaaagataaagtctaactcaggcaaggctttctctttctgagttaaatggtgtagaatatataatggatttctgcctctgcctaattattcaaggataagtcttgtgatctaaaaaggaacaacgtgctgttgtatccacggtaaggggattaacggtcttgtgcttgtaaaacagcagcccagcgcctatttagtccttttgatttccagaaacaagagccagattcttaccactctttggaggcagttggccctgtctggcgccattgatgaaaaatggcagtggatccaattcttagagaaaccttcagaccagggctttccacacttgaggaaaaggagtaaacatttttacctctctttcatgatttgctgaaagaagttacttatgtatgaattaatataatttcttggtaaaaacaattggtcaaaatgattattaaagtgaattcaaataattccaccagcccactggctgctctgaaaagccatatttgcattgtttttgggtttggcttccagcttgctgcagctacacctgcccttctcggactctgcattattgccagtccccaaactctcggtttctttttagtccactgcattggtcactggtgtgccccaccatgtcagatgcaactgtggacaccagctccaagatcatcaccaaagtcttaaaggagaagaaagaagttgtggaggaggcagagaagggaagagatggtcctggtaatgggaacgctaatgaggaaaatgggaaacaggaggctgacaatgaggtagaagaagaataggaagaatatggggaggaaaaagaggaggaagaaggtgatggtgaggaagaggatgaagatgaagatgtggcagctgaggatgctatgggcaaatgggcagttgaagatgctgaggatgacaacgttgataccaagaagcagaagactgatgaggttgactagacagcaaaaaaggaaaagttaaattaaaaaaaagaaaaaaagagaaaaggccaccgtgatccattcactcttcaccctgtttcagaatctaagtgtagtcatcttgaagtagagaggcctgccgggcaagcactcttcaacacccaacccaaaccacaagaatttgcaacaggggaggaaaaaaaaccccaaacttccaaagctcagcttttttccttaaaagtacttcaagaaaaaaatttgttcatattttttatttacattgtttatttatttgtttttttttgagatggagtctcgctctgtcacccagggtggagtgcagtggcgccatcttggctcactgcaacttccatctcctcggttaacgcaattctcctgcctcagtttcccgagtagcaaggattacaggtgcctgccacaacgcctggctaatttttgtatttttagtagagacggggtttcaccatgttggccaggctgtctcgaactcctgacctcaggtgatctgcccgcctcagcctcgagagtcctgggattacaggcgtgagccactgtacctggcaatattttttattttcattgtatatttttgtacatattgttaggggtcagccatttttaatgatttcaaatgatcaaaccagccttcagagctttctctgtcttacttctgactttacttgtggtgtgaccatgttcatgatacagttcaaagaaaaaacaaaccttgaagaaaagcaaaaacaacaacaacaacaacaaaatcttattccgagtgttccagtgtcttttttgtatatgaacttagcggtactataagtttgtatgagatggttaaaaaggccaaagataaaaggtttctcactcccctccctgccttttttttttttttgtctgtaaagttgctgtttatttttttggcctctttgacatatgtgtgaaacaatatgatgaacaataaattagaattttgtttcgctgagttgctctaacaacaacaaaaaataattccattggactcattcatatttaaaatcttgaaaatgtaggatttttatttagttgtgctaatggcatttcagtttctttatgacatcaaaacgtgctttaaaaagacatgtttagctcaagaaatgcttgttgatcaatttttcattctgtacaaatcttggaggacattcaatgtagtcacatttggaagaaaggccatggagaagtcacattagttgcacataatctataactggaagaaatttgtatcctttggttccttaatacataaattacagaactatgtgcagtcattcttcatgttacttcctttttagcaccaactttctgccttcacatttacagttcttcttggctactttcatctacagtatattcaggattcttcttttgccagagagttctgtgttttgttttgttgtctgagtatttgtaggtgagtagataaagtttcgggaaagtaatctccttccctccctgcctctcttttctgttattacagccctggaccaatttacttcctcagtttgtctctctgggaataatgtcagaagcactgagatgttaaccttctttcatccatccatttttccccccaatcacttgctgaatccacgtgggccaagcttcaggaatatgggggcttacagcacaggacagacttgggactcatgtcctcatgtcccagggcacaagagaaatctgctgcaaatggacaaaatatttgataatctccctagtgaccctgcaactgatcaaattaaaacaggtgctctttgcttggagatcatgaagttcaaatcagggcagggattagagaccctcctgacaaagaatgcagacaagccatgtgaaatctagaagatctttgtcctccccatgtcctgggtctattctcacatagggcatggaactatgtgcaaattctgccaccgtgggggttactggcttccactttggtatttaatgctctggtggactcaagactctggtcttggttttcaagagtcttagcatcactaaattcctgcatgggatggggcacggaatctgaaggccgctgtagtaggaactcttttcctaaccatatccctaaccatactggctaatcaaggttagctcttagtaaatagttgtgagtgaatgaagcatgtttaacatcctggctcttaaaccagaggcctgtctattgaggtgcagtggacacaagaaaaccatgtccccccatccccccaatttctttctctttttcacctcagtcccacaggaggatgctcccatggtggatttggcacacaatggccagagtagaagcagttccctgttgcctgggtattagctcttgttggacctcggtttcttactcttggggaggccaagacatcagttagtttctgaaagcatcatccaagcaagtaggaagtatcagcccagagtgtgtctccatcttcatatacagcctttgctgccttcagagcagggctaggctttcccctggcccccttcccacaacattgctactgtgggaagtgggcttattaattcttagttcaactgcctgtatgtgaacaaaatataaacacgtctgtagagttatatatctgttggtgacatttgttgaacattaggttacctttttgtttgcttagaatcttgagacgagttacatatttgggcagaaacatcatgtaggaaggacacaacattgtcctgttgaagaagaccacaaacagccaaaactatttacctcttctctttatatcaatcttagagaaatgatgcttaagaaactagtacgatggaagtcatcataataaataattttacatctgaatgtataacaaagaatttttaaaaaattcaggtaactattaataccatccttatgctggtgggtaccagtatcttgcatttgaatacagctttcttaatttcaaacaaattttttaaatctgttatctccttatcaatgaagctagtcaaaagcattaaaacgttgcctagtttttatttttcgtgtagatacttttactgtgcccaggcaactttttaaataactgctttgctcttatatgtatgtatatgtctgtgtatttaattaaaaagatttacaaaagagttacaaagttaatatagagagtccctacgtaccagtggttctcaacacttggtgggggggttccctgcaattgctcccaaggatatctggcaatttctggagacattttggttttcacaattggatgtgctactggcatctagtatgtagaggctagggatgctgctatatatcatacaaaacatagacagtccccgacaacctagaattatccaggctaaaatgttaatggtgctattgagaaaccctgctctaaccccaattcccttatgatatcatgttaaataaccacggtagacttatccaaacaaagaaattcacgttggttcactttttctactaatgtcctttttctgtttaagaatctatttctccttagtctgatccactctatgacactttctctgtcttcctttgttttcatgaccttgaaacttttgaagggatttagaagtgtttcttacttggtactgaccgccccctgcccatggagtataaggaaatgggatctgtatgggggttatatctatgactgtagagtgctgtggcatttaaagggtggggaagagagataatcagtgtggtgaatggctcaagacagttacccataacattcccacccaaaatgccaacagcacacccccattgacacactaagagctcaagcccttcctagtaactcatagacagcgaaatgacttgtctcaagaccaccatttggcaggtagtaaatttcaaaataaaaactttgtttttagagtttcagtccaggaactttttctatctaacaataactgtctctattgaaaatgtaaggtttactattttcagcaaaaattttaatcttttggaaatctttatttctaagtagataaaatattttcattttatttgctgaggtaatgtgttaaagtatgagttgccacccattggaaacttgaataaatttaaagaacttgaattcatggtatagttccatagtgatggggacagaggaaagtatttggggccatagttgtgttgatggagttgtatgcccttccttttatttttttttctttatagtacttacttcacacctccacagtgtatgcatttatttacttgtttatcttttgtctccacctccttagcaagctccatgagataaaggattttgctttgtttacagctgtattctatggctctgtaatggggaataccatgaaattcatgtttgaacagtatttaaagaggctttatatggaaaaaataatacaggcaaagtaactaaatgactctttacatgatttctggccttttatgcctgaaattctatttggtatttgtttaatttatataaatgttatgtactacgcataatattttacctcttatctttttcacttgatggtgtatttttgagatttattctttttttttttgagacggagtcttgtttgttgcccaggctgcagtgcagtggcgcgatctcagctcactgcaacctccacctcccgggttcaagcgattctcctgcctcagcctcctgagtagctgggattacacgtgtgcgtcaccatgcctagctaatttttgtatttttcgtagagatggggtttcaccatgctggccagactggtctcaaactcctgacctcgtgatctgcccccctcagcctcccaaagtgctgggattacaggcgtgagctaccgtgccaggccaagatttattcttttatttaaaaaattatatagctctagctcaatggttgccaccaggggggtgattttgtccttcaggggatatttgggaacacctgtagccatttttgattgtcacaactggaggtagtcctgatacctggtagatagagctcagatttgctgctaaacaacctggaaagcacatggtatcctcacaacataaaattatctggcctgatcgtactgatgttgagaaaccctgggctatttctttcctttaatctgtggaacagtattccctcgacagcatatactatatttactttagtcccgtactgattgacatttgggttgttccaattctctgctatggtgacgagtgccgcaaagaacatcctcaccagtgtctgtgtatgtgtgccacagggtttctggtagctgcgttttctgttctgggaatcacttccaaatgccattccagagtggctggactccttgcttccacagcgtcacctgggattccaattccatgcgtctttaccagcccttggtattatttaacttttaaattgttgccaatttgaaacgtttaaaatagtagctcatttgtaacaattttgcatttcctgattgctagtaagaccagaccacaggaatcattcacaccccaagcattctagaaaactggtgaaaatgttttctgtccagcatgcgccacttcatttggtttgtccctacgtctttgatatgtattagaaaaccgcacattttgggggactaggcttgcctgtttctgccagtagaggtcactgttcctcagtggttctccaccagtatgacttttgacctctctaccctcccagggagtatttggcaacgcctggagccatttttgataggactgtgagtgtgctgctggcacctagaagtgagaggccagggatgttgctaaggccctgcaatgcacaagacagcttcccgctcctccctcccccttcccctcccccctcccccccccaccaagaaagaaccatctggcccaagtagtagtgccaagctggagaaaccatggtgtcgtctttgaaagaaagaatatgacaatctctatgataataaagacacctattattattaacaacaaatattttattgcggaaactggggagaagcatgcctcctgtccccagggagaaggcaggagcgaatgggcaagggcaagggaagggctttaagggagaggagaggtgggcctggggctcgctgagtggtcggctggagcagtgggaagtgccccggtggggccggtggctggtgtgggggtagaaccgcggtcagtagggtgaaggtgctgagggctggaggctcaggaggtggtggcaggggcctgactcttggagccgggcagcaggctgggtgtgctcagaggctcatggcccacctggcgaagctccttccaggtgcaggcaagcctgaggcgtcagggcagtgctacccgcaggcctagcgctcctgcggcgaccgggcgcctggcggccacatatcctcagcagggcaggcggccgccaggaaggattgagacaacgctgcccgggagtaggggctctgctcagcggcctagacccgggcagaaaggaatgggccactccgtttctcatcacagacccgaaggcagatggcctgggcatcgggctccctctgcgctcgggcggggcgattttcatggttaccaggctgcggacaggctggtgggggggtggcggcggtccaaagccaccgcttcatgtaggccaggcgagcctcagagaaatcaggcctgatgttgctcagcagcggcagcctgttgggaaagcacctccaggcctcgggaaccatctctctcaggacgcggatgcgggcgggcaccatctctctccggatgcggatgcgggcgtagtcccagctgggaggagcggtggggaggggctggatgcagacccagcgcttcccgtggaagtaggtgaccttgcagttctcctggacctgggagctgaggaagggcctggacagtagggcccagtgcttctggcgcgggggtcgggcgggggggtgggtgcgcggttttctggcccagagccagcccaggaagccgctcaggtagctgcccatgagagcagggcagtgggttgggccttccagtagacactgggctgccagaagtttccgaaatctgcggtcagggccagagatagtgtccgggctcagtgaccagcgacctttggtatcaaaatgtcagaaagtgcacgaggcgccatgtgccgggtacggtctggccaccaagtgttgcatggggcaggaggccacggccaggccagagctttgcggcgcgcagctgcagaaggggcaagtggcgccccatgctgtctggcggaccaaggaggctcaagcctcagtccttcccactcatggtcccagacactcagctctgggcagaggggcctggcagctgcctctacttttgtacctgacctttaaaaacagaacatagaagaatttctgccaggtcctgaaaactgcagatacctgttgacagaagggtgctctctttgatcagtgtgaaaatgatcacaatacacttggatgctctaaacaaatcctttactcatatcagattcttctaggatggatgttaatgttgctttttgcaattttgctcttaagtaaactgggaaagccatcaggttttgttttagcattggcaatgttgattttatgtggactttcctataatttccatcctgagtacatccatgtatagattgtctctctctgaacactattttcatttctcccctttcacttgtaatacagaggagagtgagtcacatttccaatttgcagttgaaaagtctgtaactgcaaaacaaagagttcaaagactgctggtgaattgattatagtgtttaagttggaggtttgttcaaggcgatgtaaaagaaacttgtttttgagaactttttcttcaaaagtacacacagaaggtgccttttgtcttggccctgatgctggggtggaagagagacagtagatgcagacagagcaagtattgaatcatgagggggcagcagatcctctctggatctgagaggtggaagactgaatgggcagggcactaaaaagagttgaatgagaaaataccaaaggtttctgtggttcagagagggccaagcattggggaaacgggggctgtcaccaaccggtgatggagaatgagatccctaatgctctccactgactattattattttttggcagattccctgttattccctataaggaatgatccccaagtatatgattttgaaacaatgggaatttcctatataattttcttcttactgagctcattcttcataatggtagaaatgactttttaaacatagctaagatgtctcttaagatagtagtagcatcagagtgaacggtttaatgccatttggtatgatattcttctcatgtattttttctttccactgtctgcagaatttcccatgtcctactttgcaatgtaacccagagggtatcattctggtttgtggttacagacccttcaaaaaatcacacccttcctgctgttgaggtgcaatcagccataaggtaatcacccttaaatatgccttctattagtcaatcaacttgctgattaattcaactgtttttaaaaatagatattgaagagttttatctgtttcatacatgaattatttattaaaatgacaaagatttcattttgttagtttctgttagagatgagtatagatcagtagttctcatccaggggcaattttaccttcaaggagacatttggcaatatctggagacatttcgcaatgtctggagacatttttattgtcacagctggagggggtggtggtaccaccagcattgagtaagcagaagttagggacccaatagcttacctttttcagtcaatatatagtctttactttaaaaagataattttttttaaaaaaaggtaaaatcatgactctcatgcaaactaatcattattactatcaaaaattttatctcattagttaatgagggcactagtaagatgttaaattctttttcaaggagacttcaaggaaccacccatatatagaaagtgaggaatggcaaaatgcatttacagaaggatgcatcagtctatttttcgggcagtaaccaattatgttccactagacacagttcatttgattttctatggacaagaatcatttacattatgttagttttcaagaacttagggatttgcaaagtagctcaaagaccgtaagagatggaaattgcctagaaaggtgctctcagcaggacaatcaggaaaaagtccagtactctgttttgcccatttcaagtattttacaatttttcccgacttcccgacagttgtactcctcccctccttatgatcgtaagaaactcaaaagtgaaacgaattcgagactttcaagaattaggaggatgcaacttgtatttctttcaattactgtgcctttggtatgtgtcaaaacttcaaataccacatgtgattgatgttgggcaaagatatactcaaaaaatgagctcaggaaataaactagaacaaagcaaagtagctctccccacacaagatttacaagttactgaaatacatattattctttttaccaaggataaatacctactggaataactcattagctctctgtaaaatgttaacacttaagataatgagtatataatcaaatgtcaaaggtttttgtgaacatcatctatttcttttgctgaagcaaaggcactgaggatttatactgattggaaatggttgaatctgccctaacaagaaagtttgaactaaattgcttcttcactgtggccactaagaatactgttaagactctcaccacttagggagtaagaattataaatatcatatttcatgtgaaaaaagattttattcatgtcttgtgatctgtgagggctacagggaaaatgaaggcactgggttaaaccagtccttcagttgataggaggaggaagagtgagtgcttagggtgaaggtctgggaagtattaatacatgaatatgttcacaacaaaatgtctttttcaagggtcctagcaggagaatctatttaggaagtggggatagccaatagaatgagaatttatgtcagggaattagtagggcacatcaggattggatgaaaataaaggaaactatacaacaaaggaaggatagagtgaaaaaaaggagatggtgtttagagagcaaataataggaatttcaaggctgaagaatctaagtgattgggcaaaataatactagttccacctaatatttgcataccactttttggttcacaaggaatgttcttatgcatctgtggcatttaataatgacaccaacagtttttttttgttttctttttaagaggcagagtctggctttgttgcccaggctatagtacagtagcatgataatagctcattgcagccttgaactcctggggttcaagtgatcctcttgtctcagcctcctgagtagctgggactacagggatgtgccactatgcctggctaatttaaatttttttttttttttgtagagacagggtcttactatgttgcccaggctgcccttgaactggcctcaggcgatcctcctgcctcagactcccaaagtgctgggattacaggcatgagccattgcacccagccaacaccaataatttttcagtaattactattatctctcctttataaatgaagaaactgaggctcagggagattaattgatttgttaaggccaccatgctagaaagagaaagtgaggacttgaacctaggcatcctgccaccatatccagtgatttttcctgtttaccagagtacacaaagaactgaaacagacatcttagaattggttggtcattcctttacacaaagtgcttagggtgaaggtccaggaagcacgtgaatttgttcacaaaatgtctatttcaaaggtcctagcaggataaactatttaggaagtggggatagccaacagaatgagaattacaaaattctcatttcaagtaaaataattgaaatgggcaaaaaagagtactggactttttaccaatacagagtatacatagtatgaggtaaaggagtgaccaactaattccaagatgtctgttttagttcttttgtgagggcgtggcctaattcaataccactcttggctgaaagacatacatgatgcttgatgccaattggtgattccagtggtggagcagatttaatatgtacctgagctagaacttccagtcagtctgtgagatgatagaatacattccaagcctagagtgagcaagtaacaaagggttaaccaactaggaagatagaatgagaatgcagagcaacttctcatttttctctgagttatatcttagcagtgggtttcattattttgtggaaaagtttgtgctctcagatgttcaatattaggttatgacaaaataaaatattccattgttggataaaaatcccttgttgtagattatctggctagagttcactttcacatccatgaataatcatgccacagcatagttatttatttactaaagggggtctttcctgatagcctggtgctggcctgcagagattctcaagccatactatcaggctgtagacttggactgtccggtaccgtagccaccagccaaatgtggttattaagcacctgaaatgtggctagttcaaagtcaggtgtgctcacagtgtaaaacataagccaaatttcaaagacattgtacaaaataaaatgtggagccccagcctgggcaatatagcaagaccctgtttacacacacacacacacacacacacacacacacacacacacagccaggtgtggtggcacacacctgtggtcctagctacttgggaggttgatgcaggaggattgcttgagcccaggagtttgaggctgcaatgaaccatgatcgttcctgtctcaaaaaacaaacaaacaaacaaacatgcaaagtcaacttgatactgtttacatgttgaaattacattttcttggatatattggacaaaaaatacattattaaaattagtttcatctgtttattttagtgcagctactagaaaattttaagtcacacgaagctcacattatatttctgttttccagggctgctctagaggtagacaaaggcagcttgcataatatgaattcagtaaaggtcataaaatatctccaaggactctccagtttacagttagaaattcacttatttggtttcaattaaataagtctttgctaccaacctctccttaactgccaccaccactaaaaatgcagatatttcctaggaaaagtaacatttttctaagcttttgaactcctaaatcattaatgtctttagtcctatggaactacttgcaatttgctgaacaagtcttactttaccttgtttccattcctgtgctcaccacatactttggtctaaaaactcctacttgtccctcaaaacagagctcaaaaatggcctccacagcaaagcagctctgacttctcacaatggtgtacttggcccttccctctgctcacactgtgcccatatttgcctctttcacagaacattttgtaccacactgtggttgtggatctactgatctgtcacccttctagaccgtaagctccttggtactttaatttcacgttgtatctccagcatctagcacagtatttgatatttaataagtttttggcaaatgtttgttgaattaatgaaaaaaatatcaagatcaagttggtgaatttgaagccactcctggttcatgttttcatttttgcttctggttttctttacttctcctattcatcacccatattttacatgtaattttacttttgggggctgtgatatttatgtaagccaccttaaatagagctttgtcattctaatctagatgctactcacacaggacaggtgaaacccaaattgaggcttagcccatgaggattctgggctttgcccaggaaaaaaattcaagagagagccagaagtagaagaaaacaactttactgaagaggcagtattatagctcctgtgatgttactgctctgtgactgctcctgcagagcaggactaccctgtaggcagagactagcagctcagggcagttttgcagtcatatttatacccacttttaattacatgtagattaaggagcagtttatgcagaaatttctagggaagggtaataactttggggtcatcacatcattgctatggaaaggggtggtaactcccaggtgttgccatggcaatggtaaactgacatggcacactggtgggcatgtctgatggaaagctgcttccccgccaccccctagctctgttttagttagtcctcagtttggtccagggttagagccctgcctccagagacgagtccctccgtctaccttactacctctcaggaaataaaacatggtggacagagctcaaagctcaggacttctggacattcacaacaatgggggcagcagtggatacatgggtatccctctggcagctagtgttgtaacttaagagaaactatggcatgattgccctcagcaaactttttagtcaacttgaagtctcctgccaggaggatgctttgtttatagagatatttataatcatggagaaacaggtttgtactttgtcttaatagttttttttctgtcttattttgtttatttttaattatcattgcattttagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaaggtaagatatttaaaaggagtgattgaaagagcattttcttatttcctcatgacttggacaaatcaggagaggattttcctctggctgaagataatgccttaaatttgaaactttgaaaaaattggtgattttcaaaaatatcacttatgctcttttctttagatatattttagagtccagcgtcccttacttaactaggctccttccacgactacctttccctctattctgtaccacataaatgtttcatatccaggcttgattttaatatctgtgttgtgattttgtaagctagatgtaaggagctaaacagactttttgggtaggcagagttaatctttggtagtcatccacatccaaatgccagcaggttcatagttgcatgcctccctactttggcttacctcttcttagtccagtgcatgcaggctaccatcttgtcccagatgcctttgtactgttttatacttccttccctttgatggacactcatcccttgtgtgcctatgatattgaatagagctgtgttgcttgtggcctttaaatcaactctcagcatcagacatcacctggaacacttgtttaacatgtaggttctttggccctattgcagacccactaaattagaatctctgaagggatgcattttaatgaatactcaggtcatccttattcattgagtttgagagctttcaatttaacaatttataggtagagtttcacttcttgagttcgtttacctagattctggaggcatttgcaaacttcgatgtctaagttattgatactgcttcaagagggaatttaagacctgtggggaagttactgaggtagtggagaagaagaggagacaggatttctcagcatgattttgttaaccagtacctctaatgcaggggggaagatggaaaaatcctcagcttttcactagactttaatgcttgtaaaccttcctttctgatactaaggaagaataattctggtaagtggtaattacagtgacatgcatttgaaaataacagggacatggtttttaaaagtgttggttcttacatgggacatgtgggatgtgtttggctaagtaagtatgtgttgactaaatgctcctcttgaagtttactactttccatatgtttcaccctagtaactaacagaaggtaataattttaaatcttgggctttgtaattttattcacaaatgataagtaaaatgctatgaaataaatatggtttatgtctagtcctcaaattaaattcaaagatttaggatcaagttacacttacctgatttttttgatgatcttggcatggcatgtaatgcaaagagacttggtacaagatgtgcattttggtttttcttttgaaaatattgagaaatattctcatgcaatgcttgaatacctgtgtttaatacttttgttttgtattaatcttgagatgctttgattctgtgttctaacaactgtaacattagtgaattcactccatctacttggtttctaatttcctcactagtacagtatagtgtaggagttagaagaatggactctggagatagattgcttagactcaacatatttatctcttagattctgcccttgtatataatccattaactgtatggatatcaggaagcacagtgagtcagggaaactgagcttaggagaatataatttgtggtgctagactcaagctggttaagtttatctttactgtttgtgaatagataacttttctagagtgacagtgaggtgtactggaaataattaacttggtgggataaaaagagttaatacatagagtgcttagagtggtatctggcacacagtgagtgctcaataagtgttagctgttactattattttatgatcttgccatttgctggcctttcagctagtttgtattgggatcagctatctctttccttctgagcagattctgcagtaatataataattgggtgtgtagcatcataatttgttgcctgggagaagtgaagctgttgtcaccaccttgcctttacaaatttatttcatgttcaaactgggaaagcagatggacacatctcttgtgtaaaccgggagagcatcaataattagcaaatatagtcaggaaaattatgacaaccttctgaagataaattgtttgttgtgttttaagtttgacacaatttgtgatgggtttctcctggacaaaatgttgcgtcaaatgtgaggagagggtgcagtttgaagtggggagagccctgaaaattgcaatgaaagccctttctaatcatggaaaagataggagttgcccccaaaacctttagtttcgaggaagacagtcaaaggaatgttcaacaatctaatccatacattagataataatgaacatagtttttgtggtacagaatcttaaacttagaagacctggagggaccatgggattatctaagtcaccattctgcttctatggagaagagtgccagagtcatctaacacacatatatatatttaaacttactattgaggaaatttctcagcaaagctttaacaattctgttatctttgccaataacaccattatattaattattcagggacagtgagtggcaagtatgcaaccaatggagcccaaactaggtaaactcaaataccagctgtgccctttacctgtataatcttagttgagtcacctgatttccagggatctcagtttctccatctgcaacagggagatgatgtttcacagggctttcatgaggattgactgacataaatgtgtataaagtacctaggatatagtgtgcactaaataaacagtaattatgattatccaagatcggcttaagccattgctatgattaagaggtgctgggaaaggatctcttttccaccaagatattgtggaaaatatcttggtattttccatcatactgtagaaacttctccaattcaccaactcattgcttgggattttattaaatgcttgttttattttattaaggtgttgttaacaaataaaagttgtatatatttatggcatataaggtgatgttttgatatatgtatatattatgaaatggctaaatcaaataattaacatataaattcaacttatttatgtggcatttgtctttctgtgcctggcttatttcatttagcatactgttcttcaggttgatccttattgtcacaaatgtcaggatttccttctttttaaaggctgaatagtatttcattgtaccacattttctttatccattcattcattgatggacacttaggttgattccataccttggctgttgtgagtagtgctgggttgaacataaaagtgcagaaatctctttgacataatggtttcaattcttttgggtatatacccagagtgggattgctggatcatatggaagtttattttttattttttgaggaacttccatactgttttccataatggctgtactaatttacatttcctgcagtagtgtaccagggttcccttttctccacatcctcaccaacacttgctatgtttcgtctttttgataataggtattctaataggcgtgaggtggtatctcattgtggttttgatttgcatttccctgatgattagtgaagttgagcattctttcatgtacccgttgggcatttgtatgtcttcttttgaaaattttctattgacatcctttccccattttaaaattgggttatttgttttcttgttattgagttgtttgagtttcttatatatttttggatattaactcctttgctgtgcagaaacgtttcattttgatgtaaatcccatttgtctatttttgaatttgtttttgtgcttttggggtcattgcccagaccaatgtcatggagcttttctcctatgttttcttctagtagttttatagtttcaggtcttaggtttaagtctttaatctattttgagttgatttttgtatttggtgtgagacaacaatccagtttcattcttttgcatcgagatatccagttttcctaacaccttttattgaagagattgttctttcctcattgtgtgttcttgccatctttgttgaagatctgttgaccataagtgcatggatttatttctgtccttgctattctgttccatttgtctatgtgtctgttttgatgccactaccatgctgaataaacactttttaaaaatgcaaataattctatgaggtctactggtcaccacaatagtggtgaattggttaaccagctctctaaaaaataccctgatttgtagcatttgccagtttcccatcaaggctgaaaaattctgaataaataccctgatttgtagcatttgccagtttcccatcaaggctgaaaaattctgaataaataccctaatttgtagcatttgccaatttcccatcaaggctgaaaaattctgaatatttagcaatcagcccttgaaaacctgtaccagccagatctagcacaccattacagctgccacctctttgtgaaatacctagaagaggttgcttctctattgccctctagatgagaatagcagtttgtgaaaatgagagatttgttgaaggaaagaagttggaaaagcgattttttttcttttatttatttatttatttatttattttttattattattataatttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcagttcccacctatgagtgagaatatgcggtgtttgattttttgttcttgcgatagtttactgagaatgattttgaaaatttggggcaacaattagggagcagaacaagtgggaaggcaaccaggatgaactgcatatacttcacaataatgtctctactagatttagtgtctagccacaggctagaagtaggtgtgttagttgtatggtcaattttatgatggtagtgataatgatgatggtgatagtgatggtgatggtgatgatggtgatggtgatggtgatgaagttgataatgtgatgtgtgttttaatagaaagagccctaaactaagactctttgttttgggttccagtctcaggctctggcatttgttagctgtgtccttgagcaggtcacataaggaaaatgatgataatattttcttaaatagtgtaatgatgagaagacaaaatcagagaatatatctagtggtttacatgctagaaagtgctatatcaatttaagttactagcatgaccataaaaagcagttataaagtgctaattttatataacctggaactttgtagtttacaaggacagtcatggacacagcacaatttcagatttacatgtatatactagaattgatgttgaatccagtatataaatagactgttataatgttagaccttagttgtatctaagatcacaactgggtcttaggaagggaccttaacaatgatccaaatccaaccctccagaaaccaaagcccagataagtaagaatattttattgttttattgaccatccattctgtgataggagctatagtatgtattgtggatgagacaaacataaataacatggatggtccttgcctaaaaggagattgtaatcttatagtaacaaagccaggtcaaagacttaggacatagaaccctagctaatgctcccagctgagtagagtcattagtaaatttgcttggtttgtttctagttatacttatattcccataaggtcaatagtaaataaaaatgcatttggatttccacagatcttgtttttcacacaagcggatgtggctcagtcaacacttttatatcctgaaaccacattcttataaagtcttaattaaatgaatagtcttaaaaatagaggtgtaaataaaatgagtaatgtcatagcgaatataacaaatgtttttctttgctgttcttaaatatacatacctgataaaaatctaatgtaagtgtgttgagtaaagcctggggagagtaaatagagttctaggtcaactcctttcaccagtcttgtttcattctgaaagacaagttactctacgtatttgagtgtcaattccttcatctgaaaaacagagatgaggcacgtagtcgtggctgagtggttaaaacgatggatttgaaaaacagtgataataaaatatgcataatattgcagtaagaattaagtgagatgatgcatacaaaacatctagtctgatttctaccatgtaataaatacttaatattatcattagcattatcattgctattatatggcacatgtaaagcaacttgcctacagtcacatggttagaaagtaatagtaacaggatttaaaaccaggtaggtttgatttcaaagtccatcaatctcactgtgctacagtgcccactcaaatcattccagtaaccctatttacccccagaatcatccagagcaattctgaggatggtctcaattccccgataattgattctgtactgtttgaaaatcatatttgtctgtcttttattgtctttctggctattcttgggtcttggctctttagctctatttttttttttttttttttttttgagacagagtcttgctctgtcacccaggctggagtgcagtggcaagatcttggctcactgcaagctccgcctcccgggttcacaccattctcctgcctcggcctcccgagtagctgggactacaggcgcccgccaccacacccggctaatttttttgtatttttaatagtttcatcatgtcagccagggtggtcttgatctcctgaccttgtgatctgcccacctcagcctcccaaagtgctgggattacaggcgcgagccaccacacccagcctctttagctctatttatttatttatttattttgagacggagtctcactccgttgccaaggctggagtgcattggtgcgaactctgctcactgcaacctccacctcccgggttcaagcaattctgttgcctcagcctcccgagtagctgggactacaggcatgcgccaccacgcccggctaatttttatatttttagtagagatggggtttcaccatattggccagcctggcctcgaactcctgacctcaggtgatccgcccgtctcagccttccaaagtgctgggattacaggcgtgagccaccacgcccggcagtcagctctattttgtttgaagggggacagaaatgctcttcctgcttttggcaccattactttatcttagaacagagcaaaccccgttcctcaacatcccctagctctgagggccacacctgatacttctttcctcccctcttttgcccctcttctctctatatttatgaggtatatgagagatattcactctcaaggcttctaggagctcgttccaggaattttaatcagttttttcatcctcttcctgaaccccctgacattgcaggaatagcagaagtaattaacacttgattttagttttcaggaaaaagaactcatgtttttagcagaacatcaaatcagaatgatccagaaagatagttaagttttattattcttagtaaaagcaatgcacaggtagtgaatcaatttattacagcaaacactatgaaatgtgacaaagtgatatattactgttagatagcctttgagctgcttatcatgtccaccaagcagcaagttcctgacactgcaattggtgaagcccagcaatgccaggactctgcaactggatctatggttgtaaaagaacaatatgcacctaatttgccactgacacagctcagtttgataaatttctacagcaattccccttggaatctttttggttgagatattattcttattctaaagaagaaaaacttgtcctcatttgtttacatcttcctttttagtttttccccattctttcgtgatgcctgatgaatcatttttccttgttgctgggaagggggaagcgagattccttgtaatgatcatcacatacgtctagctctttgttatttttcttctaactccataaatactttttttattaactgaagaaactggaaaataggccctggcaattattatttctaagactgctattgcattgccacctacttcagaatgcttcctttactaaaatgtttgtaatacaggtttcatacttaacatatacaaatatcagggtaaaatttggctgtccacaatctatttattgttgtggaaaattatcattcactccaagcccagtgaggagtgattttgggggaatttacatgagatagccattttaaatgatgatttataaatagacatttgctacttacagcttcatctttagaagaaacattcctctctcttataaagcattaaaatggggagagggaggatgagtatatatggcatttttccctttcattgagttcattttaggacaaggactgtatctcttccatacacatagtagacgctcaaaatgtagctgttagtgaatgttggatactatgaatggaagtgatgtgattgatggttatagaatgttgatttcctttgctttctggaggacgtggaaagtgaacaatacacctatctataggaagaggaaccaaagtgttctaatcctctggtgggtaatttcacctggaaggatcctctcatcacattaaaatctatgtccaccccaacccatgctgattgctgattgctgatgcttgccatgaccagtgtggtgtcttcactccaaggatggaaaaatatagcagcctatctttccctaggtctctaggaccacaactcctgactttcaacccagcattgggccagaagttttattaataaatgtttaaaatgtggcatctgcaattcagtgattgcctattgtgtttaattgtgatatttgatggtggcatatgcaatggtaaaatactttcaaatgatgacattgggatctacagaattggaatgctactttacctttgttttaaatgaacaactatttgaaattatttaataaaccatcagcaaagcctaaaatacaagagatacaagaaatttcttgtgtgtaaaattcccttccttccttccttccttccttccttccttccttccttccttccttccttctttcttgtggtaaagcccgttcaaggtctacctagggctactgcctgagtaactttacctacaacattagtccatacatacatacatctaattgttcaatctaccatctatcttctgtccatctatccatccatccatccatccattcagccagccagccattaatatatcatctagccaaccagcaattgaactacattcattgattattttatccatctgtccatccacctttcatcatttgttcagccacccacccatcttctgtccatccatgtatttattatccagccagtcagccattaatctacattcattgattcatctacccatacagttgaatgcctactctgtgctgagtccaggtcagctgttttgcaaaacatttttaaatttggatttttctgattaggctccttattatgagattcaggtcaaaacaaattggagggggcggggctggaacacaggaaaaacatatatgtgatctactcagtgtatcacatcaggagagacttgtcagtttctttcattgttggaaattttcactagatttctcttttagcaaaatacaagtgtccttttataattaatattttgcttatgggggtgatatcttgaaaccatgtgaatatcctgttctccaaccgtctctcacataatggtttagtatccattgataatcctcatcagaatcaattattattatatggtgattttctgttcctattactctttctatattcgttggcattcttctataaaaaaagagctttctcttttcttcactttcttccaccatattctttttttgaaatatatacaatttttatttgtcaattatacctcaataaaactgataggggaaaatgatacagaggacaggaatggagtcaggaaaatcatgtgggtgggaaagatgatttaaaaaaaatttttttttattatactttaagttctagggtacatgtgcaccatatcctttaaagcacattctcacgcaggactaataggaattccatctcggtcatcattggggcaccttcaccatctcctcacctgtcagagactcaccaaggttctaagggactctcatagtggtgggactctacctggtcaccactgcagtgcccaacatctcagccagatgatctattcttttctgctatttggcatttccacaaattcgtgggacaagagaatcctttgcaagtccaggagcctcatgcctaacatcatgcctccgtggtgtcaccatggagtggtgctccaacatccaacctgtgataagccttagggaaacccctccttcttctggttgcctagaggcacccacctctcttttttcttttactgcatgatatcaagcataattgtctcattgttttagtctttcacaaaagacaggaaaaacctttgaatttgagtctactgttttccacactccaaagaaatattacagatctgcatattacttcggttggggtcagcaaggtctacaaagggtgaaactatgagaaactcaagaatttatcctgtcatatggaatttttggagtgacctggaattataactacaagttgtaaagtaattagggaaaatgtattctgagttccaaaatcgtgacttgcaaattaacacaattattttgtaatgagtagagccaagcagcaatatttgaagtttatagcacttactttctacaaagtaatgttaattttctttctgatagctcatttctatttgattttcactcaacattttcagaccattaatttgtcaaatcccatgagaggaatttattacttttagcaattcaattgttattaagttctcctagagatggattttaaacttgcgaatttactatgcattttcttcacattacttcatgcaatttgtgtgtgtgagtgtctatgtgtatatatgtgcatatacactcatattcatatacatattcatctatattgattttagtattctgaataagaccacttgtgttgatcactatgtatatgtcatctatacagacttctcatcttgatagtatcttttcacctcaccaactctttatggtctttgaaattcgtttgaaaattacacaatatcattaaattatttcattgttctaaggttcctattccccttcctgttctccatgttcgttcagaagaccatatgcaaccatggttatggtccttctagatgccaatcactcttttttatgtgcttttagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgt

SEQ ID NO: 3118 - DNA, 29465 bp, human
cagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacaggtaagtacaggctgaaagttacatgctctccaagggtgatagacgcctgggtaaatgaactaccatgtcgggacagggagctgattgcacaagggaagttttactcaaacacggattcccttccaggcaggtttttattctgggtatgacttcttgagtgtaacatattggtttaagaaagaaaagtgaatgatggggacagaaggagacagatgagaaaaaaaaaatctctaagcagaaaactgaggtgcctttttctggagacatatctatttagcattgccttttcctaacttctccctccttgcaaaattaattgaccagtgagaaagacaatcacacccaatagagtttaaacctcaggcaaatgttttttaggagcaattgaaacccctcagagaacaggaaagttccactggatttcttcaaaacgttctttcagaaataaccaagaggagaaaataagcctcatttctctgaaattcattttcctcagacagtttaacttttctcacagctgattttgaatttgactctctgtgatagaacaattgtatgccggttttcctaagtctctcttaaatgaaatcaaacattatttgagtttttaaaattttctggagaaagctctattcaaggttgatttctaattttaatatctttattgacaatacttcatataccatgcttttggggcttattgtggggaggaagagggagttcactacagttttttattctgggaaatatacatatttgcaaactgcatttcttgtgtgagcacattgcataaaagtttacgtttattcagtcttaaaactatatattcattctttgaacatttatcaagtgtctagcatgtaagaaacacttacctgaattagcaagtcaagaaatagctgcaggttgttcacataaattactgaacatactttatgtacttctgtgttctggaaattggacatagtaatgaatagactttcagacacagcatagaccatatggtcaaacccagaaaaactgctgcaatgaacctagactataaatttttcacttataatcaactgtatgttatgtgttaaagatacagaaggatttgagagtgttctggaaaagacatagatgctgctcttgaaagtttatactccgaagaaaatgtcccacattttaatacatgtggtgctggattctcattttgtagaggaacaaacagtcctcaggtgatctggctttgttgagtaatggacaaataaagatagtgttatcagtatttatagacatgtgtttatgcttagctacctgaagcacactgcccagcacacgacattttcaaagtctgaaaagtaatagcacagaagtaaggtttgcacattgtaccgactggacagagtttctccattccctccattccccttcggcttgcacatcctcccctgcacatctgcccacagataccaatgaccacagacagtttcatgtattgattcagggctggcaaactctggagctggcagaagggctgtggcttgttaccaatggccgagggctcttcaggatgagggtaattttcttaatgggaaggagagattttggtttccgggttggtgagtgcagtggtacagatggtgtttactctcttcttagggagaaaaacagaaaggaaagtgagggcatgaactgtaaagatgcagctgcagggaactcttctctggagtttcaaagcagaccaagttcaccatcaacagaaagggaaagctctttcaaaagccaggttgcactccttcgcggctccagtgtgttcccagtaagtttatagttactgcctgtccttgccaagttcagaaattactagaagctcccatatagctaactttttgtgttttgctaagtctttaaaaagctgatggatcacctgaatcacaggtagtgcatctaaccaattccaatagaaagaataggtattgagctaaatgattaagactgtactttttttctattcatctcatttttgaaaacaatgggattcttctatcttatatctctgaggttggcagggcaaatatatattctatattattttttcttctcaacaaggtgtaatccatatacacagtaaactgaacaagtaacagctcaatatatttttacatatgtctatagaactgcataaccagatggagatatagaacagttccagcatcccccagagtttctcttatgccctttcctagttaatacccccatacagaggcaatcactattctgattccaatcaccataggttatttttgccagttctttaatctcatataaatggaatcatatagcaagtactcctttgtatctatcttcttatgcttatcattatctctgtgatattcacctgtattaatacgtgtaacagtgtggtttgttctttttaattgtgtgtggtgttccattgtatgaatacactttggtttatttattccttctaataccgatggacactgggttgtttttagtttggggatgatgataacctgctctggacattcttattcatgtctttggggaaacataagtgtttatttttcttggatatatgtctgcgagtgaaattgctgggttataggggcctatatttactaaatattgtcagttttcaaggtggtagtctgtattaggtagattggtgaaaaagtgaatgaactagaagaccctccaaaccagatgatcaccagagtcacaggggagctttaaaaacatacagattcctaggccctgtcctaaatctactgaattcagggttctgaggcatgagtggggcacatagtgataaccatccatccctgccccctatacattgcccagcattgccagtcctcattccagcttcccttctgcagttccccccttcaccgggtgaattcgagtctttgtcaatatgaaaagaatatcaagtttctagaaaagtttacactggcatcaccgggtaaaagggagacttcaaggcagtcccagaaaccagaattctggggatttgcacagctgagcagttgtaggtttgcattcaaccaccttcaatattgatccccatcctccctctcctcccatgctttctgtccttacacacacactgatatcctcatacacagtggttgcactgatgtgttcctggctctgtttcctggcttatgctgtgtcccacccgctctccagaatgctttctcctttcctaaatacagactgtattcctcatcccatgtggcatttgggcttggaatgggtatcaacaaacctgcattttagacattttcctgccattactacccgtatgagaaagtgggactaagtcacttaactctctgaccttagtttaatcatctataaaatgatggagtcgagctaggcaatgtctatggtcccttcaagttctaaaatcttgtgattgttttttctatcttcttgtctatcattcagaatctgattcaaatctcctccttaaagccctaagttgagccattctagctcaaatttcctgaccctcttgaaatatcagacttattatctgagacatgaattatcttgtgacaccttttatattgctgtttggaagtgttttgtttgtctgtttattttagcctctcatatattcattgctttacattttttaggtagattattaagaatgttgaaggcagagattttcaatatattcttaaatcttccatagtgcccctcaagttttcttgtgccaaatgggtgatcaataaatattgactaattaaaattacgtttagttaatgcatacaattttcctcattcttattcttcattctattttgaggattaatctgaaagcatactcttaaaaataatgtattggccgggcgcagtggctcgcgcctgtaatcccagcactttgggtggccaaggtgggtggatcacttgaggtcaggagtttgagaccagcctggacaacatggtgaaacctcgtctctactaaaaatacaaaaattagccgggtgtggtggcaggagcctgtcatcccagttacttgggaggctgaggcaggagaattgcttgaacccaggaggcggaggttgcagtgagccgacattgtgccactgtactccagcctgaatgacagagcaagactccatcccaaaataataataataataataataacaataacgtatcacatagtcacctgctcatctgttctctattaagctctcattatctgggtaaatgaaagaaaaactattttttgtgggtcagtaagtagattcaggggataaatagatgggtggatggatggatagatggctggctagctgattgggtgggttacatgtatgagtggacagatggatggatagatggctggctggctgattgggtgggttacatgtatgagtggacagatgggtggatagatggatgaatggttggatagatggagatattttttacatactggtccttcctattagatgtccacctttgtgctaggtgcctcattattatgtaaatgaaatttgagacctgaattggaccctcaacagaaaaagggtgagcgtggtttgtgttttcttttccagtaagtgtaaggtttaaagctgaatttaatgttgacaatatatgtaatgcccaagttatatcaagcctgcttcagtgccattattcagtgttatttttactagaatggggctggcagaatggattctaaggacagatggatatggcggttccactgtaacatgattcttctttgattctatggaaagactggttataagtttctttgttatttggaatgtggaaagaaacaggaaggtgttatatttctgcaaacttcttgaagtacagattctttgaattttctgcaaggaatgtatgtgataacatggtttgtagctttcccgacatctagagttgtatggtctaacttggtagccactaaccacatgtggctatttaaatttgcatttaatttaaatgaaatggaaaatttcatttcctcatcacaccagccacacatcaagtgctcagtagccacatgtggctagtggctactctattgggcagtggagacagagaacacttcagtcattgcagagggctctattggacagtttagaaaagagtttgctatatgctttggggtccaaatttcttccccaggatacacgtttgctcctctctctcacagagggtatcaggaattcctcagataggcaaatatcaaatgcctcccagctgcacaggctctttctgtctgtgaaatatcttctgttggaagacacacacaagtgaagagggaagaaatgaagcagccccatatcatctgtagtcacaggcttggggaatttaggcatcccattgatgaggttttgaggctttccaaagacatgaggggtcagctttccaggtctccactgtgaacttgtgtctgatcctttcattctttcttgtaggtcctcttccagctgccagtctctcttttatatccccctgtcccaagacttgccagaacaaacactgctctagccaaactcttctcactgcctcccacatgtgccaccagacttctccccctctaacttcatttccccttctctgatggctgggccctattctttccatctacccaaatcctatcaatccttcaagggatagttcaagtcctttctcttctatgaagcattccctgatctttggctttcattgattttttttcccttcctaagatgtttctgcctgtattgttcattaaatgccaaatctatcctgtactactaggtctttgttagagatgtgttttatacttccttaatcgtatggggtggttcatagggatctgtgtcttctacagtagccaggcccactctgcattcagtaagagtacaataactacaccttggttgatgtttgagcagtgacaaaaggataaagtccagcagctagaagtaaaagtcatcttgaagttcacacccttgtttgacacagagaccaaaagaggtgatgggatttaactttgtcacaacaaattcagaatggactcagattagaaagaaccctttcatcctcattccaagtcttaattccttcaggggaactggaaacttttcttcagaagccatcaaacacagagtctgattccatttcccttttctggacagtgggagctactgatgccaaaactacccttctgaaggaaaataccctgagtgactccagggtaatccccttctaatggggtcaccccagtaattccaaaggctcctttaccattctggaggcccagcttcattgattgcaaggagattggcccctttctcacaagagaagacttacttaatatcattccttgtaaagcatccttctagaaatgctttacaagaaagtccctctgctggaaccagtttacataagctgccagttcataacttctgtatagtttgatttttctgaaacacatgctgcccctctctggaaggaaactcaactcatgtctctccacggcagtggaactaccacagctgccagcagcctctgggaatgatgagaggacaggtgctgttgaagtgaggtttcccagcaaggctctttcaagcggatcaggagaggagaagggcagcaaagaactttgaccttgtctctcacttgttatcttttaaagtgttaggcttttatgtgactaattaagtatcatttctggcaacttaatatgcatagaggcaaaaaagaaagcacaagcttgatcatgaaacatagagtatagcctgaaagggctccctgctgaggatttttgaactgtgcctgtcaataacatcctttgaaaataggctaaatttacatttttgagcttgtaagtcctcctatgtgtggggtttgcgtaaattctctcttaattaaaacacatgtttttcagaataaaagaaaaaaaaattctccatttcttctttttatctcctagtaataatagaacaagggattttgaagaagttcgtttcacatattacacatcatttcctgtaggaggtcttccttggccactgaatctgaagaaataaccaatactaccccataatccaatttctttttttcaggtctactgaggcgtagtttatatacaataaattttttacatttgtatgaattttgacaaacatacagtcacatcactaccaccaccagcacagtcaagatagaggacattttcgtcatcccccaattctatcatgcccctttgtaatctatctccttcctccacctacagatcctggcaaccactgatcatttccagaatgtcatgtgaatgatatcacatagtatgtagctattttaggtctggcttcttttaactcactttttgcacgtatcagtaatccatttctttttattgctgagaaggattccattgtatggatattccacattttgtttatccattctccggttaatgagcattagggttgtttttggtttgggtgattatgaataaatctgccataaacattcttgtacagtttttgtatggatatatgtcttcatttcttttgggtaaatatcatccagtattattttcttgagaattattttgttcatttgtttgtttactgtctgtctgccaccactagaatataagctccaaaaaagtgggaggccatctcattctttggtgtattctctgacactggaacagtccctaacctgtagtaggtgcttgataaacatttgttgaattgatgaatggatggatgcatgaagagaggaataaaggaattaatgaattctagtaggtcctactgggtaaacccagaatactggattatggtctgtaaatcatgttgctcattacttttcatgattaacagagtgattgcaggagaacaatggttccaaccctagatgacaagagtttatccagattttatggggactcttggagtgggggcatttttaaagaaaaaccaaataaaattatgactacaaaattagggagagaagtggatattttaaaacctttagaaatcacacattagatttagaaatcataataaatctctcatttaaataagctgctaaatttcaccaacatcataaaatccagaaaaagaatataatatctattaaataactgtctgacacacctctgtcatacttgttttcttaaatattttggcttcatcctcatttgtctccctttaaaatgacattatttggtaaaatccatttctatagagaaaatagaaggaggaggtcagtcttctagcatggttgattaaaattgtctttttattaatgagagattagaaaaactttctttcaacttcatatctcattattggtagtgtcatatatatgtttaggattaacatcaaacttggaaaagccattatcaaatttctttcttatctggactgtaaaaacccaaagcatttcaagttttcttctgcgttgagtaatcttaaatacttattcaattgatgactcctagtaacctatttttcatggatatcttcacattatgagttttgtgctatctccatcaatgtcagtattttgtgagtttgcacaacatctgtgactttacacaaatatattcgctatttgtaatttggctacatgtttctgccctataaacacagacactcataaattcaattctactcatatatttggatttaaatctaccatcttattgtttgatttccattgatctcacctgtttcataatattttttccttcccttcttgctttcttttaaattagatattttaattattctatttcccctgtctctgagtttgttaattatacaaactcttcttaatttcttttaggggcttccctagagtttacaacagcgtgtatccctgatagaatctactacaaattggaactttcctacttcctggacaatgtaaaaataataggacacttttaacttcatttaaaattccctcttgcctttttgttggttattgtgattctatagtttaattctctctagatttaaaaacctacattatttttactgtttgtacatactttacatatactcacatatttacctttagatttagatttagattccgtttatttacctttcctgttgttctccattctttcctgtatctctgtggcttcatctgagatcactttacttctccccaaagatcttccttcagtatttcatttagtgtacctattttctcagtctttgtttgtctgaaagtgtctttgtttcatgtacttttggaggatattttcagtgggcatagaattctaggttggcagttcttatctttcagcacattgaagttgccattcattgtcctcttactgtatctgacagtcatatgtcagttttattgttgctcctttaatagtattgattttttctcttggactgattttaagatttttctctttctttctgattttcagcagtattactatgatgcacttaggcatgatttcctttgtatttctgctgcttggagttcatagcatttcttaaatctgtggcctgaagattttaattagttttggaaaattctcaaccattacaacttcaactattgcttctatctcattatctctttcctctccttctttgtcttggctacagataaatagaataactacaggttaactttaagcttttaaagtgttttcccctttggttatctttgcttttactaaggcaggcaatttcatactagagtcagacctctgttactgagaagtattttaagcacaatttcatttcaccattttgccatgtcccataaatttcctactctcttttctgtatttgccatctttttttcctcactgtacttcagtctggccattttcagttctctaatcctttcttcagttgtgtctaggctgcttctgaagcttccatttaattcttcatttcagttattatatattgcaattctagaattttcattttgttccatcttgtagtttaatttctcaaattagtccgaatatattttaaaatacctttctggtaagcctaatatgtagaacctctataaatctgtttctatttatgtatcaagaattatagataatttgaggctctagatggtattatcttccagaagagattagcttttgcttcttgaaggtaattaggaagtggcattacatctgatgcagtcagggattgaacagattgaaggatggactttggtttttgtgagagttggtctatttaatctagttttcccctgtcactgaggcttaccctttcaggcatctcaactaaaagcctgaggtgttaacctgggcttctctccttggtgggccctggactctacttattgttctccttcatcctaaaactcctggaagctcggatcagctctcactttctctgctgctgcttgacatttggttaatgccttaagggggaaatgatgctgaataacaacttcacgtttttgcacatcatttctctccaggactttggactctcaaatccctattaccttggtatttctctgatgttttcaaatagatttttaaaacttttccttccaggagagtttgccatcaaaaagagtacatcctatactactacctcccttaaagacctgatctgctgccctcaaaactacacacatcccagtttctttaaagaggcattcagagctacctattcaggcctatgggatcaacattcacagcctcaaattatctcagcaattttgagtgagagaagtgagttctggctaacctcaaagtgaataagtcaggaatctcaactgatgcctgccgcaggggacactgccaagcatgtaggtacatcaaagcctctgggatctttaaactaagccaggacttttagccccaataagcaggagctacaaatgacattttgctattcagtgattgataacagctaaaatttcatgggaaggaaagagccagaatgttcctaaggtacatttctttaaacttcacatctttattactttttctgtctttctttgtcttctttctcttttttaatattgtttttgtattgtactcaggctagctggccagtggtgatagctaaagattacatgggaaagaagtaggggaaaaatgcaaaatttgtcacataaagaatttattttccaatgtaaggagaatttactgtgacaatattgtgtgtatgtgactcacttctttcttcatgctgtctacatataaatagaataactacagatcaactttaagcttttcaaggtttcttttttccgtttggtggtggtgattttttaattgagtcaggctgtttcatattagccacaggcctctgttatgagaaatactttaaatacaatcttaaaacaatagaaaattatgtacaaaacaaaatcacagtagttaccccatgagtacatatgggaaatgcttatttctttttaaatgaatggtgatcagaacagatttctaagaatttcattattatcttttcttctccctttacactttaaatgtttggaaacatcatagaaaaacagaaaaatcagaatttggcatcgtttctttcctagattgtgaacagaagtgaaattgaaggttaaaatgatgatttaaggaatacatgtactgcgggatgaagacaagtacagtcaatatttagttttaagtattctttacttgtgctttaaaaagacccgagcatctaaagtgctataggtaaacataaaaatctctgctgacttggggatcaagagacccaggtctagtcttggttctcagctaactggctgtgggacttctctgggcctcagtctctggtctcagtctcctcttctatgacctctaagttttatattccatagttacatatgaaacagatttgtgattagacgttgactcatttgtctgtaccaggatagcagcactttatatgctgacctagcagcatctattctaagagctcttcataaaggcatatgtcagtattcttatatggctcattaagggcttttcctagatgtatcttgcttccccaattagattttaaaccctcaatggccgggaactattatatccatggtgccaagcagagcctgagatgccaaattagtacttaaatatgctgttagactaagcatcctgagcgatgagtgcttagtactggaagaccaacgacaggggtcagtggcctattgtcttcattatcacaaattaataagtctaacagacggtgctgtgtgagatggaaaatgagcttacctctgtttaaagaaggaaccaacagctttggtgtggacaggcagagaacaacagaaacggtaaaacttttggcaaacattttctgcagcatattaggctttgtggaccatacagtctctattgcaactgctcaattctacccttgtagggtggaatctgccacaatgtgtaaacaaatatacacggtgataatacaataaagcattatttatgtaccttgaaatttgaattttatgaaatttttacatctcaaaatgttcttttgatttttttctcaaccatttaaaatgtaaaaaccattcttagctcacgggccatataaaaacaggcagtggaccagacttggttggtgggtcttagtttactgtccctgatatagagtgtgcatgctttctggggtggttatttagcagtgagaatttcctatttgaatggagtgggacctaggggaatccacgacccctttccagttagccaggacagacttcctaaggaatattataaagaaaaggcatacatctgtgtgatgcttcagggttttgaggcactgtcatatcatgaacattaactttttagatcatttggaatccttatcattatccctgtttttagatggtgaaatgagggttctacatcacacgattagcaaacagtgaaattgagaatcaagctgaagtctttaagccaagtgtcctttccagcatgacctgggtcccgtgtgatgctaactgttgtttaaatgaaacaagtaagagggttttaaatggaggtttagctggattccaatttccatgggtggcagacatgagggcagggcctggtaaattgtttactagggaagtaaaggtgtaaacagatgcttctcaccacctccttttaatgtttctccatcatgcaaagtgctgctttctctaaggtcttttcattataggctcatgtgagcaagttgccttaaaattgtcaaaaagaggaactgagtttgggagaatcacttctttggttacccccagtgatttttctagtcttgaaatgattagagaaataggaagtgttttggctctaggagatctcttgggaaaaggctaataagctggtatccagagtgattttgggtaaaagggcttgagagtagtgtgtgtgactgggagcatggcaggggaggaatgggttgtcttgagcatcttgaacccatttccttatctgaaaggaagacatcacaggccagacaaattggatgaatagttctagacttttagttttagtcatttatttatttcataaataaagtaggcagaaaatgaacaagacctagactctacccttaagaaactgatactcctgttactcagggtacatcaaccttcttaatttccaaaatggaatgaacataaatgtcactgagtgtccagagcttatgctttgtttaaactcttgtgtacctagcataggaccatgcaaaagtagctgcttaaggtatgctttggatttggatttgtatatgctagaggtattactttttgggaagtagggggtgctttgtgtcattttagcatgatgtgttgcactgaagctaattgtaggaagaacctgtgaaagcagggacattgccctctagcgagcaccaaggttctttgaaaagtcatggtgcccagaagcatgagcagagcactgcctgtttgctagaagggtcttggacatctgtgtgaaactgggagatgtttatgctatagatcattaagaaaagatacagaattgtatgctctcaattctgtacaaaagacaaaaggaaaaattggaaggaaatatatcaaaacatgacatgcaaaacttacagatgatttttgtttgtttttagaattctctactaagattttacaataagctctttgtagtttgataataacttttttgaatgaaaaacgtccttcaaaatagctaaatgcctcctaaccaccttccttgttgatgcttttgctgactcaaagcgactatttcagttagttcttacgataaccctgaagttgcatgataacaagcttgaaaactatttcatctttcttccctttcttcttttcttgctgttttgttttttttctttttaaaattgtactggggtaaaatatacacaacaaaatttgcccttttaaccatctttaagtgtatagttcagtggcagtaaggacattcacagtgctgtgcaactatcactgtcattcttctccagaactttcttcatcttcccaaactgaagctgtatgcccattaagcaacaagtccccttatttttgtcattttcttttgtttgctttcttttgttttatttatgaattttgggggatcacatttagtacatcactattattcatagtggggataaattcaaaagcattaaatttgaagaaatgtctgagattgagccctggttcttccagttgtcagctatgtgactttgggcaaaccactttgtaagcttcagtttcctgatctttaaaatggggagaggatcatctacttttcatatatcataggactgttgtaatttttgtaatgatgtaattaaataatatatgttgacttctttatgacatgttacgattcctagtcaaaagagtgagtgcaccgttagcatgactgctatttaggttcataggggagccaagaggttgtcgtagaagttgactttctagtggactcgctttccttttcaggaaatacaataataaccttttatttaaatccaacttttccaacccgcagcctgcggaccacctgcggcccgggatggctttgaatacggcccaacacaaatccataaactttcttaaaacatgagatttttttgagattttttttttttttacttgtcagctatcgttagtgtattttatgtgtagcccaagacaattcttcttcttccagtgtggcccagggaagctaaaagattgggcacccctgatttaaataatgctgtttttcaaagtgcgtttgaaaaatttagctcatttaaatcctcatcatactaagtaagattggtatctttagctctgtttcacagatgaagaaaatggaggcatcaaaatcttgcagtttaaagtatggactcagacgctagatggtctctgtttaaaccccagctcttccacttgctagctgtatgaccgtgaacaagttacttaacctctcagtgccttcgtttcttcatgtgttaagaaaaagatgacaatagtaatacctatcttctagtattgttatgtaggggcagagggaaagcttcctctaattcttgaaaagtgtcgagaactttgtgctaggcacacagtgagtactatgtaagtttttgttaaataacaaaaaataaaaagaaacggagacaacatgctttcacaaaaacagttaatcatagaagtgggactagagtgcagggttcccagtcttcatccagtccctctctccccgtcttggacctctgcaccatatggtgatgcctcaccagcactgccaggatcaacctcctgggccagtggtcccagtaagctacaaagttgggtcaccatttcaccatttataaaacctttcccaaacatttatttaaatctagtgctgttaaatttttataattagacacagtgactcatatgccatgatggtatttttgagctgtaatgattcttattttggaaaaaaatgataatgtattttattatgataatttagaagttccatttttatccttaatgatttgaaatatatttaaaaactgaaaattatctgtgatatttcattttctatatatgtgtttgataaactgaccggatcaggagaaaaaatgtacatagtgagggtgtccatatcccctggcacaactcagaggtcacttagagggctgggcttcctgtgtttctctgaccaagggtgatctctggccaaggaaaggtttggggtaggctgaagtgccccagaattaccaccaacagacaattgtcaaccagagatgagagttggtgggtaaacaccccacccacctcatcctttggtggcacagttctggaacgtgttaactgtggtttctcaggggattcccagcaagaatgtgccccagttgcccaccgtggtgccctttactggctttttctacctccctgtgcttcctggcatcttcttccaaataaattacttgcacctaaatccttgcctcggggtctgtttggaggtgaacgacaatttacaaaggcaatttatgaccctgaatctattatcccttccacctagagcacggttaatttttctttgtcttcgtgatttgtttttttcccccgttctctgtgtatcttctttgctacgcagtaaagtaattgcaggctgtgtctaactacaatttgcaaatgggattttgaaatgtttttcaaacattttggctcataaaattttaacaagttataaatacatgttcttcctccataacatttttgaggaatgaacaatgtgtgccaggatgtttgaacacctactgaaattaaatggattactactttcctttgtcatttcaaacatatccactggtaactgtaatatttcatcctgcatatacctttctgatgggctcccttacaggattagcattgagctttgaaattggatcactctgctgaaactcatttttggcccaagggtcaatagttgcccaactccttatgagaaagtgccataagatgtccaacaactaattgcatctctctttccattttatccctaagcttctacatccctcatatcccaggatcagtaccttctcaatgtcagtagctctttctctagccttgttccagcctctggtttctagtccttcactggtgccatttttcaccttggctctaaggtcaaagtctcactcagatgaccactgctggccctgaggcctctgaatattttaaggagcccagacactgctctaggcctcaggccatagggaactgcaaggcgtgtatatgggggtgaagagaacctttgaaaccttagccaagttttctggaaagtgtcttctgggacaatgaaccccaaagtgaacttcacatgctcccggagaggtgtggcctgatctgagagataagggaggaaagtaccaaagcctctatttatattgatttttattttaatagaaggatgaattaaacatgagtaatatgtagtatccaaactgaggctcacccacatcagaggattccttatcacatgtggctcaggcagcaggagtgagtggcccactatctagaaggctcaaataggacacccttactcttctttgcacttttagcttaagggaaggcatcgccaagtgatgcttgttgtgcataatctagttttaattaaagtaacctcttcaaatgggcaagtggcttaaaaatattcctgctgaaacaaaatagacaaaaccaaaccccacagattgtagatgatattaaaattgcaagcccaagagagtaatatgaatataacagagaagacacttctctcattcccggtataggctctaatcagatatgacacattcaatcacatcacagttataataagcttttctggtggcaaaaggttcactgacaataaactaggataaaatatttaacaaaaaatatttaaagtaggctttaaaattttattttactgttagctcatcttttaaaaattctacattttagcatatgttttctccctgacttgtttatgaactcttgtataatacccacccacattcagcaattaccatttcctagattttttttctctctttctttctgtgtgtatgttgttgtgttttgttttgctgagctttggaaagtaaggtgcaaacatcctcacctttcacccctaagtatttcagtgtatattttctgagaacaaagatagtcttctacacaacccaatgccaccatcacattgaatgaaattaacaataattcctggtaacatagaatgaaattgtacctaatatattagtacagtagtacatatatataatttatacattaacatacatacaatgtaggtgtatgttcaatttgttattactttcttaaagctctgttcttcaaggatttttaaagaatgggggttggtatacttccctaagtgcccccactccccctccaacttcccaccacccttattccagcttcttcttgggcatccgagtagactgacaaggtccagatgaatgtgtctgcagggaactggcccaacttgtgttgctagctggaatataacttttgttcctttcttctcttctccatcttttctgtcttctcccctttcatctcctctcctcctctcccttgcctccttctctcctatcctcaagtttcctttctttttctcttgttccttttttttctcttcccctccttccatccccttatttccccagtgattctgctcttttccttttagtccctcaggcattcctgctcatgtctgacagcagaaaagttggggaattatttatttaattgcccttttgctggagctcttcacccctccatgccctgttgatcacacactcagacctgtgagctataaagctgaaagcttgttccctccatgcagggacagaaattctctcctgccccatattactgctcttttttacccatcctggtgggaaaaactaaagtttcacccctctccaacactttacctctccctgttgagccaaaagcaaatcccaagacatttcttttccccagcttagcttctgcagtctctctgaatcattgaggttttccaagaagttggtgctcacgcacaaattaaagcaatgaagaaaaggagccaaaagatggaggactgctggagtaaacaacctgaagattcccaaatattaatattccccaaatgcaacaagccacccaaagttctagaacctccctgctctccttcctttgttcgttcctattggaggaataccttttgactcttccttagcttctctaacaggatgtggctttattccacttctccccagtcttccctcatcgatgttgtcaatattacttgaaattaccacaaagactccttactcctttctttagaggttcctcaaaagcttgaggctaagaattgcaagtcccttctggagggtagaatagcgaagtgggatgtgagttctgtttgttcattcagtgtagcacctcagttcttaaagtaatggggaatgtaatacctaatatctagagggttctttctagttattttgttaacatatccccacgagctccttgtcggtaaagaattgtctcctgttcaaggatgagaatactgaagtgcagagtccacgattcatccaagaccatacaactagttgggagaatcaccattaggaactacatctcttgatcccaggtctgcattggagcccagaggaaactagagtatattaagaagaggtgaaaaggagcattggagatatttatcctggagaaaacagaaaagcataactgcaatctgttacatacttaaagataacagttggattggcaccaaagaccagtaagttctccatttgtggagtaatagctcagagagataagattccattgctctgggttataatcatcatataagccagctaataattgccttacttgttcagaaaaattcttggtgctattctcaggagaaaataaagctgatgtttagtagttttgtcaaatctcatcaggtagaattctaattttaaggcaggcaatgtgtcagttaccctagagaccatttagtttgtttaattatcgtcttcacctcagtattctccacatagtatacattaggattgcagtggagttttaaaaatattgtagtgcaacaattcctacagacttccgtaggtaattatggacaaataagggctgaaatgctggatccttaaaaataaacaaactgcccatatttgaataaaagacatacctttctgtgggcaaaggtttccaacccagagtgtggcagccagctacttctagttgccaagaatctctttgacaaattaatcttcccacagagaacgttttgtgacctttccaatgtttgtataagaaaaatgaagcacagatgttttcagaagtgggaaacaattgtttgagccccatattgtcagaggaccaaatttgtcagtctattgaagaatgatttttactgacttaatgtgtaaaagggaaacttctctctctcatttgtgagaagttggaaataagagacacaacggcaagtcacatactaatcatcaattaattagcaagtatttgccgagtccctactttgaaataagtgatttgcagagcaaggaacctggaacatttttagtgagacaggaaaaagagaagaggaaagcatgtaagcttctgacctcaggaaaattaagaaaaagtcaggtagaaaagacatacccatagaatgtaaattagtataaccaccatgaagaacagtttggaggttcctcaaaaagctaaaaatagagctaccatatgatccagcaatcctgctgggtatatacccaaaagaaaggaaatcagtatatctaagagatatctgcactcccatgtttgttgcagcactgttcacaatagccaagattaggaagcacactaaacgtccatcaacagatgattggataaagaaaatgtggtacatatacacagtggagtactattcagccctaaaaaagaatgagatcctgtcatttgcaacaacatggatggaactgaagatcattttgttagtgaaataagtcagacacagaaagacaaacattgcatgctctatttgggagatttaaaaatcaaaacaattgaattcatggacatggagagtagaaggatggttaccagaggctgagaagggtagtgggataggcgggaggcagtggtggttaatgggtacaaaaactaattagaaagaatgaataataaaacctactatttgtcagcacaacagggtgactatagtcaataataatttaattgtacattttaaaataactaaaagagtataattggattgctttttacactaaggataaatgcttgaggggatggataccccattctacatgatgtgattattatgcattgcatgcctgtaccaaaacatctcatgtgccccataaatatatatacctgccatgtacctacaaaacttaaaaatggaagaagaaagaaaagacatacccatagaaaactagcaaacaattcaagatagtgcataataagcagaaaatgagaggagctgataatcttgtcataaaagtcagacaggttgggagaaagaatgggaactattaaggcctagactggtcagcaaaacttcatcaagatgatacttaaactgaaatttggaaggattggatttaaatgaatcaagaatctggaattgggcatgatggaaggagggaaacaggaaagcaatggaaaatttaggaatgaggcatagactagtctatctcttgagtacaatgaaaagtggacagctctttctttcagagggtagcaagtggggaatgatctatgtaaaatgatcttggaactaaatctggtgataactttaaagggttatcacatctaattgttttagataaggctcttttgttggcaaagaacagaagccactcaaactaactcaaggaaaaaggggatggtagtattgtaaaattataacaggacatctcttgtacattcaaaactagtacataagccagaaaccataccctctgtatgacttagggccacattatctcagcttctcctcttatgtctgcttcatttttttttctctcagtccatttactcagcttattcatcttctgcatgtttaaatatggctgccctgatcttttccttgacatcaaaatcttatatttccagcatctattactaactatattctctctatttttccgtttaaatgcttaagagaaagagaatctctttagtagctagccaggcagttcattggctggtttagatcgggtatctactctaatccaaccagccattgctcctaaacaggaactaccctgtggtgtctccctgcattgggagctctgggcagagcaatctaggccagaagaggaaatagactgatatgctccatgctatacaaaaccattagacttgcaggaaacattttgtatgttctacatacatttgagaaacatctggtctatctctctccctctaggaagaatttacccaaagctctcttctgaaagaactgtggtgttctaaaaaacattggttctaaattgaatgttgactctaccacctcttaaactgagcttcaatttcccatctgcagagtggagataataatgtctacctattggagttgtctggaatataaatgagataatatagattctattctctgcttggaaaaaggcaagagcttagtaaatgggatttctttcgtttatttgctatgttctgaacataccacaacagaaaattgtttgcaatgcattttaacttatttttaattgcacaagtgatatattaatatgtcaatactttaaagcaaatactagatattatattatttcactggtaaatactttagcttgtgtcttttataaacaaggtcttttaagaaacacatagccgcaatacccttatcacactcaatacattaaaaataattccttgatatcaccaatagtacatttatatttgattttcttcaatatttatttcacaaatatctttttattgttgtttggtttgactcaaaatccaaaaggagcctacacgttgcatttggttgatatgtctttcagtcagtctataaccattctctcattttctatgccatatatttgttgaaaaaaaatggggtaattattcgtgtaggattttccaattcagaatttggctgattgtatccttatagcatcatttagcaggttcttctatcaccatatttcctgaagactggcacataaatctagaggcttaattagatttagattcaaattaattttctagtaaaactataaatgctttatactatattttatattttaaaagttgtgaatttaaaagaaagagcatagttcccatggtattttgcacctaggaagacaagattcctaaaagagaaggacgtaagccatttactctggtttctgactgagtgaatcacctttactcagagagttagtgtaattatgactgctatctgccagaaaatgcagatagaagtcttagttatcattttatctctaacaaatttattagcgatatctttagccatatgcatctttggctgaagatgttctcatgcctttaattaaagataccaatttcttgcctacattctaagctaggaaaatgtttaaaatggctaatgaataaagaagatccaaaagaaaatagaactttattttaaatttttatttttatttgtatttgtttaaaaataaagcaaatacaggtacattgaagcaggactgtagtattgttctggaattttggggtttggggatgtttaataaataatagccctctcttccctacctaatttgagaacaaaaagccagataaggaaatcagagagactatgataaaaatagttgcatctatgtctgataaagctgtttggggaatgtaactcaggtctatagcaataatgaacttgcagacactctcttatcttctatattacacttgccattcctctagacagggccagttaaacaaccataatcctccctgagcccaatgcacaagccaggttctttttcccaaacttgccactgaataattcccccttccctggtaggaggaggaaagtgagtgaggagtcagggtgcagccaagagtggtaaaccaatggaggtctaatcaacatgaaaacaagtggaaataagtattccccttccctgaagtccatgatataaaagagtatcataagtagagtccagtttaaacacagcattttcagcaataaacaccctcacatgtagttggtctcaactcatatcaacttccacattatagtagctcatgttcaattgaacaaacttttgtggagtgtgtgcaaatcacagtgctggcagattccaacatagaaaaagacatactctttgcccaccaaaggctcatcctctggtgggttctcagacaggtgtacgcaagataatggtgcccttgtcttgtcactcactgtgctagagaccgtatggggagtgtgcagacatggagatgtgctgctcagacctcccttgaagaagagacttgcccagttgcagggggtgtggttagctgaagcctccaactaccagctctttcagggtccacttcagctttcaagctgtggtcatgttcttttgggtggttcctgcccagtgactgagccaggtggtaactgagatcacattcttcctggggtgaccccatgcaatgactaagcaaggtgattatacatgggcctggcaatttccacccaaagcaggacttccccgttgggtaatctttgttcctaggcttcctgttgggctagcgtagaatgaccagctatcccagtttgcttggactgagagatttcccaggatgtaggatttaccatgctaaaactggaaaatttccaggcaaaccaagatgtttagtcatcctcgctggtgtagacctgagaagctccctctttctatcctacttcctcccctttttcctttcacaggtattgctcctcaataaaatttgtatttcttacttcatctcagtgtctgcttcccagaatactcaacccaagacatgggcacaaatagctcacaaaccaggaagaacctaaatacttcaagagaagataaggctgagatcaggaaggcaagggaaaaatcaatgtgaaaattacagggattctcctgggtattactttttcaagggaccatttattatgcatactttgaaaaagaaaagaggcatatttaaaatactcaacgacttaaggttccctgaagtggatctgaatacgcaaaatgaaggttttgccaaaaaaaaaaaaaaaaaaaaaaagccaacctccttgtctctgtgtcctttaactagcaacatgccttgttattaatttctatgatttaagaagaaaaacaaagggaaattcagcttttctaagaggtattcttaaaatcaagagagagtgtgaattgtacaacatggtgactatagttaataacaatgtattgcacactcgaaaattgctgagtcgattttaagtgttctcattttaaaaagataagtatgtgaggtaaagtatatgttaattagctcaatctagtcattccacagtgtatacatattttaaaacaccatgttgtatacagtaaatatatacaatttttatttatttatttttaattggctttaaattaagacaaaaagagaatataagcggaatggtacttgtggagagaagagaaggcatccttcagggctagattagaatgaggcaagtggctatttggagtacaaaatttaaggaggcactcactctcagggtcacagagctcagagtcggcaccctcaggacccgaaagtgagcacctccttaaatattgtacgccaggtgtctcgcttgcctcaacttagtcctggccctggtattcagaataatattatgcaactgatggggatgcttctttcctgccctagatacaaagccattgtccggccaatggatatccaggcctctcatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcattccactgtcgatcatctctgtttactactacttcattgctaaaaatctgatccagagtgcttacaatcttcccgtggaagggaatatacatgtcaagaagcaggtaggtgctcaggattgattcatttcctccttggggatataatcccttgcatttcttttggaccccactgacaagccatgacacttgaatctgcaattagatgaggtgggtgatgtgtggccagatgctaaatggaaatgcctagccatggaaacccaaggtgttctttatagtcttattctcctgttaaagacctaagctagggaggtgttgtgaacctgaaatatttcaagtgtgggtttcttttggagaaataatctgaaaaagagttgtatttttaaaataaataaatgaagctttgaagctcatggggatgtgacttctttaaactccagtcacattgtttgcctagaaagaggattaccacatggagacaaagcaggaggctggaaagtgagggcagttgaagaaaaagagtagtttgattaggataggctcacactgatttgggctcaagtccaagccgcatgatgtattcagcctctctgagcctcagttttcttacctatcagataggcttataatccctacattgtaaaactattggaagaagattacaagagagagtatatgtaaggcctacagtgcccagcatgcaagatgccctccatatgattagactctctttcttatcccccataacactccataatttcatccttgagttacaaacaaatggtagaaagcaagggctccggcttcctcctctttgtcagtgcttgccttctagcccaggtgtagatcatgtagcatctatgatggaaaagcagaaacactccccactccatttcagtgaatagctgactcacttggagaccttaccctttaacgttcattatttatgtatttgtctcagttgtgggggaagagtggcagtttctaatgaaactaccttcctacttgaaaagcctctcattagccaacatccattgtaccccaaactctttatggagaaacatgtttccccttgaggtagtggatggagttgggagcaaaaggagatgcccatccctctttgccacagtctctttctatagactatagtccagagataactcaagattttaaaatcataataatagagagttatcttggtttagccagtgaagaagaacaaagctggctgctctttctgagcatgagagggaataagaaattattaactgtggagaaaagaaagacatgaagtagtatggctgataaactgcaccaatgctctcctgaggaaaaagggggcacttattagaagttcatgttgcagtccattcaaacatgtaatcaactttgtttaaagatctgttctcagtggtatgttctaactctattcttcctcgtgggtttctgcttcctggctcatccatttctgtgtttctgactctttttttttccttttctgtctgtttctgttgcctttctctcattttactggattctctcttgccctctcctattgaactctttttcggtggctttgtgaactcctctattgccctaattgtttttccctttctctttctctgcctgaatctttgtctctctgcattcttctgacactgtcccttggttcctctgtctctctccatgtgattctctccttagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctttatggctagacaggaacccttgcatccattgttgtgtctgtgccctccaaagagccttcagaatgctcctgagtggtgtaggtgggggtggggaggcccaaatgatggatcaccattatattttgaaagaagccatcaagtcttaagtttttcatttcaacttgtgaacgtttcttctgatgtgaagcaaaccttcccttttcagaaaagggaacaagtagaaaattattttttaagcctcaagccctgttaaatggtcgtggccaattatgtcatagaaactgtatgaacaaccagatttacatagcagagaaatcatacattgaatgcttactt

SEQ ID NO: 3119 - DNA, 28763 bp, human
ggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacaggtaagtacaggctgaaagttacatgctctccaagggtgatagacgcctgggtaaatgaactaccatgtcgggacagggagctgattgcacaagggaagttttactcaaacacggattcccttccaggcaggtttttattctgggtatgacttcttgagtgtaacatattggtttaagaaagaaaagtgaatgatggggacagaaggagacagatgagaaaaaaaaaatctctaagcagaaaactgaggtgcctttttctggagacatatctatttagcattgccttttcctaacttctccctccttgcaaaattaattgaccagtgagaaagacaatcacacccaatagagtttaaacctcaggcaaatgttttttaggagcaattgaaacccctcagagaacaggaaagttccactggatttcttcaaaacgttctttcagaaataaccaagaggagaaaataagcctcatttctctgaaattcattttcctcagacagtttaacttttctcacagctgattttgaatttgactctctgtgatagaacaattgtatgccggttttcctaagtctctcttaaatgaaatcaaacattatttgagtttttaaaattttctggagaaagctctattcaaggttgatttctaattttaatatctttattgacaatacttcatataccatgcttttggggcttattgtggggaggaagagggagttcactacagttttttattctgggaaatatacatatttgcaaactgcatttcttgtgtgagcacattgcataaaagtttacgtttattcagtcttaaaactatatattcattctttgaacatttatcaagtgtctagcatgtaagaaacacttacctgaattagcaagtcaagaaatagctgcaggttgttcacataaattactgaacatactttatgtacttctgtgttctggaaattggacatagtaatgaatagactttcagacacagcatagaccatatggtcaaacccagaaaaactgctgcaatgaacctagactataaatttttcacttataatcaactgtatgttatgtgttaaagatacagaaggatttgagagtgttctggaaaagacatagatgctgctcttgaaagtttatactccgaagaaaatgtcccacattttaatacatgtggtgctggattctcattttgtagaggaacaaacagtcctcaggtgatctggctttgttgagtaatggacaaataaagatagtgttatcagtatttatagacatgtgtttatgcttagctacctgaagcacactgcccagcacacgacattttcaaagtctgaaaagtaatagcacagaagtaaggtttgcacattgtaccgactggacagagtttctccattccctccattccccttcggcttgcacatcctcccctgcacatctgcccacagataccaatgaccacagacagtttcatgtattgattcagggctggcaaactctggagctggcagaagggctgtggcttgttaccaatggccgagggctcttcaggatgagggtaattttcttaatgggaaggagagattttggtttccgggttggtgagtgcagtggtacagatggtgtttactctcttcttagggagaaaaacagaaaggaaagtgagggcatgaactgtaaagatgcagctgcagggaactcttctctggagtttcaaagcagaccaagttcaccatcaacagaaagggaaagctctttcaaaagccaggttgcactccttcgcggctccagtgtgttcccagtaagtttatagttactgcctgtccttgccaagttcagaaattactagaagctcccatatagctaactttttgtgttttgctaagtctttaaaaagctgatggatcacctgaatcacaggtagtgcatctaaccaattccaatagaaagaataggtattgagctaaatgattaagactgtactttttttctattcatctcatttttgaaaacaatgggattcttctatcttatatctctgaggttggcagggcaaatatatattctatattattttttcttctcaacaaggtgtaatccatatacacagtaaactgaacaagtaacagctcaatatatttttacatatgtctatagaactgcataaccagatggagatatagaacagttccagcatcccccagagtttctcttatgccctttcctagttaatacccccatacagaggcaatcactattctgattccaatcaccataggttatttttgccagttctttaatctcatataaatggaatcatatagcaagtactcctttgtatctatcttcttatgcttatcattatctctgtgatattcacctgtattaatacgtgtaacagtgtggtttgttctttttaattgtgtgtggtgttccattgtatgaatacactttggtttatttattccttctaataccgatggacactgggttgtttttagtttggggatgatgataacctgctctggacattcttattcatgtctttggggaaacataagtgtttatttttcttggatatatgtctgcgagtgaaattgctgggttataggggcctatatttactaaatattgtcagttttcaaggtggtagtctgtattaggtagattggtgaaaaagtgaatgaactagaagaccctccaaaccagatgatcaccagagtcacaggggagctttaaaaacatacagattcctaggccctgtcctaaatctactgaattcagggttctgaggcatgagtggggcacatagtgataaccatccatccctgccccctatacattgcccagcattgccagtcctcattccagcttcccttctgcagttccccccttcaccgggtgaattcgagtctttgtcaatatgaaaagaatatcaagtttctagaaaagtttacactggcatcaccgggtaaaagggagacttcaaggcagtcccagaaaccagaattctggggatttgcacagctgagcagttgtaggtttgcattcaaccaccttcaatattgatccccatcctccctctcctcccatgctttctgtccttacacacacactgatatcctcatacacagtggttgcactgatgtgttcctggctctgtttcctggcttatgctgtgtcccacccgctctccagaatgctttctcctttcctaaatacagactgtattcctcatcccatgtggcatttgggcttggaatgggtatcaacaaacctgcattttagacattttcctgccattactacccgtatgagaaagtgggactaagtcacttaactctctgaccttagtttaatcatctataaaatgatggagtcgagctaggcaatgtctatggtcccttcaagttctaaaatcttgtgattgttttttctatcttcttgtctatcattcagaatctgattcaaatctcctccttaaagccctaagttgagccattctagctcaaatttcctgaccctcttgaaatatcagacttattatctgagacatgaattatcttgtgacaccttttatattgctgtttggaagtgttttgtttgtctgtttattttagcctctcatatattcattgctttacattttttaggtagattattaagaatgttgaaggcagagattttcaatatattcttaaatcttccatagtgcccctcaagttttcttgtgccaaatgggtgatcaataaatattgactaattaaaattacgtttagttaatgcatacaattttcctcattcttattcttcattctattttgaggattaatctgaaagcatactcttaaaaataatgtattggccgggcgcagtggctcgcgcctgtaatcccagcactttgggtggccaaggtgggtggatcacttgaggtcaggagtttgagaccagcctggacaacatggtgaaacctcgtctctactaaaaatacaaaaattagccgggtgtggtggcaggagcctgtcatcccagttacttgggaggctgaggcaggagaattgcttgaacccaggaggcggaggttgcagtgagccgacattgtgccactgtactccagcctgaatgacagagcaagactccatcccaaaataataataataataataataacaataacgtatcacatagtcacctgctcatctgttctctattaagctctcattatctgggtaaatgaaagaaaaactattttttgtgggtcagtaagtagattcaggggataaatagatgggtggatggatggatagatggctggctagctgattgggtgggttacatgtatgagtggacagatggatggatagatggctggctggctgattgggtgggttacatgtatgagtggacagatgggtggatagatggatgaatggttggatagatggagatattttttacatactggtccttcctattagatgtccacctttgtgctaggtgcctcattattatgtaaatgaaatttgagacctgaattggaccctcaacagaaaaagggtgagcgtggtttgtgttttcttttccagtaagtgtaaggtttaaagctgaatttaatgttgacaatatatgtaatgcccaagttatatcaagcctgcttcagtgccattattcagtgttatttttactagaatggggctggcagaatggattctaaggacagatggatatggcggttccactgtaacatgattcttctttgattctatggaaagactggttataagtttctttgttatttggaatgtggaaagaaacaggaaggtgttatatttctgcaaacttcttgaagtacagattctttgaattttctgcaaggaatgtatgtgataacatggtttgtagctttcccgacatctagagttgtatggtctaacttggtagccactaaccacatgtggctatttaaatttgcatttaatttaaatgaaatggaaaatttcatttcctcatcacaccagccacacatcaagtgctcagtagccacatgtggctagtggctactctattgggcagtggagacagagaacacttcagtcattgcagagggctctattggacagtttagaaaagagtttgctatatgctttggggtccaaatttcttccccaggatacacgtttgctcctctctctcacagagggtatcaggaattcctcagataggcaaatatcaaatgcctcccagctgcacaggctctttctgtctgtgaaatatcttctgttggaagacacacacaagtgaagagggaagaaatgaagcagccccatatcatctgtagtcacaggcttggggaatttaggcatcccattgatgaggttttgaggctttccaaagacatgaggggtcagctttccaggtctccactgtgaacttgtgtctgatcctttcattctttcttgtaggtcctcttccagctgccagtctctcttttatatccccctgtcccaagacttgccagaacaaacactgctctagccaaactcttctcactgcctcccacatgtgccaccagacttctccccctctaacttcatttccccttctctgatggctgggccctattctttccatctacccaaatcctatcaatccttcaagggatagttcaagtcctttctcttctatgaagcattccctgatctttggctttcattgattttttttcccttcctaagatgtttctgcctgtattgttcattaaatgccaaatctatcctgtactactaggtctttgttagagatgtgttttatacttccttaatcgtatggggtggttcatagggatctgtgtcttctacagtagccaggcccactctgcattcagtaagagtacaataactacaccttggttgatgtttgagcagtgacaaaaggataaagtccagcagctagaagtaaaagtcatcttgaagttcacacccttgtttgacacagagaccaaaagaggtgatgggatttaactttgtcacaacaaattcagaatggactcagattagaaagaaccctttcatcctcattccaagtcttaattccttcaggggaactggaaacttttcttcagaagccatcaaacacagagtctgattccatttcccttttctggacagtgggagctactgatgccaaaactacccttctgaaggaaaataccctgagtgactccagggtaatccccttctaatggggtcaccccagtaattccaaaggctcctttaccattctggaggcccagcttcattgattgcaaggagattggcccctttctcacaagagaagacttacttaatatcattccttgtaaagcatccttctagaaatgctttacaagaaagtccctctgctggaaccagtttacataagctgccagttcataacttctgtatagtttgatttttctgaaacacatgctgcccctctctggaaggaaactcaactcatgtctctccacggcagtggaactaccacagctgccagcagcctctgggaatgatgagaggacaggtgctgttgaagtgaggtttcccagcaaggctctttcaagcggatcaggagaggagaagggcagcaaagaactttgaccttgtctctcacttgttatcttttaaagtgttaggcttttatgtgactaattaagtatcatttctggcaacttaatatgcatagaggcaaaaaagaaagcacaagcttgatcatgaaacatagagtatagcctgaaagggctccctgctgaggatttttgaactgtgcctgtcaataacatcctttgaaaataggctaaatttacatttttgagcttgtaagtcctcctatgtgtggggtttgcgtaaattctctcttaattaaaacacatgtttttcagaataaaagaaaaaaaaattctccatttcttctttttatctcctagtaataatagaacaagggattttgaagaagttcgtttcacatattacacatcatttcctgtaggaggtcttccttggccactgaatctgaagaaataaccaatactaccccataatccaatttctttttttcaggtctactgaggcgtagtttatatacaataaattttttacatttgtatgaattttgacaaacatacagtcacatcactaccaccaccagcacagtcaagatagaggacattttcgtcatcccccaattctatcatgcccctttgtaatctatctccttcctccacctacagatcctggcaaccactgatcatttccagaatgtcatgtgaatgatatcacatagtatgtagctattttaggtctggcttcttttaactcactttttgcacgtatcagtaatccatttctttttattgctgagaaggattccattgtatggatattccacattttgtttatccattctccggttaatgagcattagggttgtttttggtttgggtgattatgaataaatctgccataaacattcttgtacagtttttgtatggatatatgtcttcatttcttttgggtaaatatcatccagtattattttcttgagaattattttgttcatttgtttgtttactgtctgtctgccaccactagaatataagctccaaaaaagtgggaggccatctcattctttggtgtattctctgacactggaacagtccctaacctgtagtaggtgcttgataaacatttgttgaattgatgaatggatggatgcatgaagagaggaataaaggaattaatgaattctagtaggtcctactgggtaaacccagaatactggattatggtctgtaaatcatgttgctcattacttttcatgattaacagagtgattgcaggagaacaatggttccaaccctagatgacaagagtttatccagattttatggggactcttggagtgggggcatttttaaagaaaaaccaaataaaattatgactacaaaattagggagagaagtggatattttaaaacctttagaaatcacacattagatttagaaatcataataaatctctcatttaaataagctgctaaatttcaccaacatcataaaatccagaaaaagaatataatatctattaaataactgtctgacacacctctgtcatacttgttttcttaaatattttggcttcatcctcatttgtctccctttaaaatgacattatttggtaaaatccatttctatagagaaaatagaaggaggaggtcagtcttctagcatggttgattaaaattgtctttttattaatgagagattagaaaaactttctttcaacttcatatctcattattggtagtgtcatatatatgtttaggattaacatcaaacttggaaaagccattatcaaatttctttcttatctggactgtaaaaacccaaagcatttcaagttttcttctgcgttgagtaatcttaaatacttattcaattgatgactcctagtaacctatttttcatggatatcttcacattatgagttttgtgctatctccatcaatgtcagtattttgtgagtttgcacaacatctgtgactttacacaaatatattcgctatttgtaatttggctacatgtttctgccctataaacacagacactcataaattcaattctactcatatatttggatttaaatctaccatcttattgtttgatttccattgatctcacctgtttcataatattttttccttcccttcttgctttcttttaaattagatattttaattattctatttcccctgtctctgagtttgttaattatacaaactcttcttaatttcttttaggggcttccctagagtttacaacagcgtgtatccctgatagaatctactacaaattggaactttcctacttcctggacaatgtaaaaataataggacacttttaacttcatttaaaattccctcttgcctttttgttggttattgtgattctatagtttaattctctctagatttaaaaacctacattatttttactgtttgtacatactttacatatactcacatatttacctttagatttagatttagattccgtttatttacctttcctgttgttctccattctttcctgtatctctgtggcttcatctgagatcactttacttctccccaaagatcttccttcagtatttcatttagtgtacctattttctcagtctttgtttgtctgaaagtgtctttgtttcatgtacttttggaggatattttcagtgggcatagaattctaggttggcagttcttatctttcagcacattgaagttgccattcattgtcctcttactgtatctgacagtcatatgtcagttttattgttgctcctttaatagtattgattttttctcttggactgattttaagatttttctctttctttctgattttcagcagtattactatgatgcacttaggcatgatttcctttgtatttctgctgcttggagttcatagcatttcttaaatctgtggcctgaagattttaattagttttggaaaattctcaaccattacaacttcaactattgcttctatctcattatctctttcctctccttctttgtcttggctacagataaatagaataactacaggttaactttaagcttttaaagtgttttcccctttggttatctttgcttttactaaggcaggcaatttcatactagagtcagacctctgttactgagaagtattttaagcacaatttcatttcaccattttgccatgtcccataaatttcctactctcttttctgtatttgccatctttttttcctcactgtacttcagtctggccattttcagttctctaatcctttcttcagttgtgtctaggctgcttctgaagcttccatttaattcttcatttcagttattatatattgcaattctagaattttcattttgttccatcttgtagtttaatttctcaaattagtccgaatatattttaaaatacctttctggtaagcctaatatgtagaacctctataaatctgtttctatttatgtatcaagaattatagataatttgaggctctagatggtattatcttccagaagagattagcttttgcttcttgaaggtaattaggaagtggcattacatctgatgcagtcagggattgaacagattgaaggatggactttggtttttgtgagagttggtctatttaatctagttttcccctgtcactgaggcttaccctttcaggcatctcaactaaaagcctgaggtgttaacctgggcttctctccttggtgggccctggactctacttattgttctccttcatcctaaaactcctggaagctcggatcagctctcactttctctgctgctgcttgacatttggttaatgccttaagggggaaatgatgctgaataacaacttcacgtttttgcacatcatttctctccaggactttggactctcaaatccctattaccttggtatttctctgatgttttcaaatagatttttaaaacttttccttccaggagagtttgccatcaaaaagagtacatcctatactactacctcccttaaagacctgatctgctgccctcaaaactacacacatcccagtttctttaaagaggcattcagagctacctattcaggcctatgggatcaacattcacagcctcaaattatctcagcaattttgagtgagagaagtgagttctggctaacctcaaagtgaataagtcaggaatctcaactgatgcctgccgcaggggacactgccaagcatgtaggtacatcaaagcctctgggatctttaaactaagccaggacttttagccccaataagcaggagctacaaatgacattttgctattcagtgattgataacagctaaaatttcatgggaaggaaagagccagaatgttcctaaggtacatttctttaaacttcacatctttattactttttctgtctttctttgtcttctttctcttttttaatattgtttttgtattgtactcaggctagctggccagtggtgatagctaaagattacatgggaaagaagtaggggaaaaatgcaaaatttgtcacataaagaatttattttccaatgtaaggagaatttactgtgacaatattgtgtgtatgtgactcacttctttcttcatgctgtctacatataaatagaataactacagatcaactttaagcttttcaaggtttcttttttccgtttggtggtggtgattttttaattgagtcaggctgtttcatattagccacaggcctctgttatgagaaatactttaaatacaatcttaaaacaatagaaaattatgtacaaaacaaaatcacagtagttaccccatgagtacatatgggaaatgcttatttctttttaaatgaatggtgatcagaacagatttctaagaatttcattattatcttttcttctccctttacactttaaatgtttggaaacatcatagaaaaacagaaaaatcagaatttggcatcgtttctttcctagattgtgaacagaagtgaaattgaaggttaaaatgatgatttaaggaatacatgtactgcgggatgaagacaagtacagtcaatatttagttttaagtattctttacttgtgctttaaaaagacccgagcatctaaagtgctataggtaaacataaaaatctctgctgacttggggatcaagagacccaggtctagtcttggttctcagctaactggctgtgggacttctctgggcctcagtctctggtctcagtctcctcttctatgacctctaagttttatattccatagttacatatgaaacagatttgtgattagacgttgactcatttgtctgtaccaggatagcagcactttatatgctgacctagcagcatctattctaagagctcttcataaaggcatatgtcagtattcttatatggctcattaagggcttttcctagatgtatcttgcttccccaattagattttaaaccctcaatggccgggaactattatatccatggtgccaagcagagcctgagatgccaaattagtacttaaatatgctgttagactaagcatcctgagcgatgagtgcttagtactggaagaccaacgacaggggtcagtggcctattgtcttcattatcacaaattaataagtctaacagacggtgctgtgtgagatggaaaatgagcttacctctgtttaaagaaggaaccaacagctttggtgtggacaggcagagaacaacagaaacggtaaaacttttggcaaacattttctgcagcatattaggctttgtggaccatacagtctctattgcaactgctcaattctacccttgtagggtggaatctgccacaatgtgtaaacaaatatacacggtgataatacaataaagcattatttatgtaccttgaaatttgaattttatgaaatttttacatctcaaaatgttcttttgatttttttctcaaccatttaaaatgtaaaaaccattcttagctcacgggccatataaaaacaggcagtggaccagacttggttggtgggtcttagtttactgtccctgatatagagtgtgcatgctttctggggtggttatttagcagtgagaatttcctatttgaatggagtgggacctaggggaatccacgacccctttccagttagccaggacagacttcctaaggaatattataaagaaaaggcatacatctgtgtgatgcttcagggttttgaggcactgtcatatcatgaacattaactttttagatcatttggaatccttatcattatccctgtttttagatggtgaaatgagggttctacatcacacgattagcaaacagtgaaattgagaatcaagctgaagtctttaagccaagtgtcctttccagcatgacctgggtcccgtgtgatgctaactgttgtttaaatgaaacaagtaagagggttttaaatggaggtttagctggattccaatttccatgggtggcagacatgagggcagggcctggtaaattgtttactagggaagtaaaggtgtaaacagatgcttctcaccacctccttttaatgtttctccatcatgcaaagtgctgctttctctaaggtcttttcattataggctcatgtgagcaagttgccttaaaattgtcaaaaagaggaactgagtttgggagaatcacttctttggttacccccagtgatttttctagtcttgaaatgattagagaaataggaagtgttttggctctaggagatctcttgggaaaaggctaataagctggtatccagagtgattttgggtaaaagggcttgagagtagtgtgtgtgactgggagcatggcaggggaggaatgggttgtcttgagcatcttgaacccatttccttatctgaaaggaagacatcacaggccagacaaattggatgaatagttctagacttttagttttagtcatttatttatttcataaataaagtaggcagaaaatgaacaagacctagactctacccttaagaaactgatactcctgttactcagggtacatcaaccttcttaatttccaaaatggaatgaacataaatgtcactgagtgtccagagcttatgctttgtttaaactcttgtgtacctagcataggaccatgcaaaagtagctgcttaaggtatgctttggatttggatttgtatatgctagaggtattactttttgggaagtagggggtgctttgtgtcattttagcatgatgtgttgcactgaagctaattgtaggaagaacctgtgaaagcagggacattgccctctagcgagcaccaaggttctttgaaaagtcatggtgcccagaagcatgagcagagcactgcctgtttgctagaagggtcttggacatctgtgtgaaactgggagatgtttatgctatagatcattaagaaaagatacagaattgtatgctctcaattctgtacaaaagacaaaaggaaaaattggaaggaaatatatcaaaacatgacatgcaaaacttacagatgatttttgtttgtttttagaattctctactaagattttacaataagctctttgtagtttgataataacttttttgaatgaaaaacgtccttcaaaatagctaaatgcctcctaaccaccttccttgttgatgcttttgctgactcaaagcgactatttcagttagttcttacgataaccctgaagttgcatgataacaagcttgaaaactatttcatctttcttccctttcttcttttcttgctgttttgttttttttctttttaaaattgtactggggtaaaatatacacaacaaaatttgcccttttaaccatctttaagtgtatagttcagtggcagtaaggacattcacagtgctgtgcaactatcactgtcattcttctccagaactttcttcatcttcccaaactgaagctgtatgcccattaagcaacaagtccccttatttttgtcattttcttttgtttgctttcttttgttttatttatgaattttgggggatcacatttagtacatcactattattcatagtggggataaattcaaaagcattaaatttgaagaaatgtctgagattgagccctggttcttccagttgtcagctatgtgactttgggcaaaccactttgtaagcttcagtttcctgatctttaaaatggggagaggatcatctacttttcatatatcataggactgttgtaatttttgtaatgatgtaattaaataatatatgttgacttctttatgacatgttacgattcctagtcaaaagagtgagtgcaccgttagcatgactgctatttaggttcataggggagccaagaggttgtcgtagaagttgactttctagtggactcgctttccttttcaggaaatacaataataaccttttatttaaatccaacttttccaacccgcagcctgcggaccacctgcggcccgggatggctttgaatacggcccaacacaaatccataaactttcttaaaacatgagatttttttgagattttttttttttttacttgtcagctatcgttagtgtattttatgtgtagcccaagacaattcttcttcttccagtgtggcccagggaagctaaaagattgggcacccctgatttaaataatgctgtttttcaaagtgcgtttgaaaaatttagctcatttaaatcctcatcatactaagtaagattggtatctttagctctgtttcacagatgaagaaaatggaggcatcaaaatcttgcagtttaaagtatggactcagacgctagatggtctctgtttaaaccccagctcttccacttgctagctgtatgaccgtgaacaagttacttaacctctcagtgccttcgtttcttcatgtgttaagaaaaagatgacaatagtaatacctatcttctagtattgttatgtaggggcagagggaaagcttcctctaattcttgaaaagtgtcgagaactttgtgctaggcacacagtgagtactatgtaagtttttgttaaataacaaaaaataaaaagaaacggagacaacatgctttcacaaaaacagttaatcatagaagtgggactagagtgcagggttcccagtcttcatccagtccctctctccccgtcttggacctctgcaccatatggtgatgcctcaccagcactgccaggatcaacctcctgggccagtggtcccagtaagctacaaagttgggtcaccatttcaccatttataaaacctttcccaaacatttatttaaatctagtgctgttaaatttttataattagacacagtgactcatatgccatgatggtatttttgagctgtaatgattcttattttggaaaaaaatgataatgtattttattatgataatttagaagttccatttttatccttaatgatttgaaatatatttaaaaactgaaaattatctgtgatatttcattttctatatatgtgtttgataaactgaccggatcaggagaaaaaatgtacatagtgagggtgtccatatcccctggcacaactcagaggtcacttagagggctgggcttcctgtgtttctctgaccaagggtgatctctggccaaggaaaggtttggggtaggctgaagtgccccagaattaccaccaacagacaattgtcaaccagagatgagagttggtgggtaaacaccccacccacctcatcctttggtggcacagttctggaacgtgttaactgtggtttctcaggggattcccagcaagaatgtgccccagttgcccaccgtggtgccctttactggctttttctacctccctgtgcttcctggcatcttcttccaaataaattacttgcacctaaatccttgcctcggggtctgtttggaggtgaacgacaatttacaaaggcaatttatgaccctgaatctattatcccttccacctagagcacggttaatttttctttgtcttcgtgatttgtttttttcccccgttctctgtgtatcttctttgctacgcagtaaagtaattgcaggctgtgtctaactacaatttgcaaatgggattttgaaatgtttttcaaacattttggctcataaaattttaacaagttataaatacatgttcttcctccataacatttttgaggaatgaacaatgtgtgccaggatgtttgaacacctactgaaattaaatggattactactttcctttgtcatttcaaacatatccactggtaactgtaatatttcatcctgcatatacctttctgatgggctcccttacaggattagcattgagctttgaaattggatcactctgctgaaactcatttttggcccaagggtcaatagttgcccaactccttatgagaaagtgccataagatgtccaacaactaattgcatctctctttccattttatccctaagcttctacatccctcatatcccaggatcagtaccttctcaatgtcagtagctctttctctagccttgttccagcctctggtttctagtccttcactggtgccatttttcaccttggctctaaggtcaaagtctcactcagatgaccactgctggccctgaggcctctgaatattttaaggagcccagacactgctctaggcctcaggccatagggaactgcaaggcgtgtatatgggggtgaagagaacctttgaaaccttagccaagttttctggaaagtgtcttctgggacaatgaaccccaaagtgaacttcacatgctcccggagaggtgtggcctgatctgagagataagggaggaaagtaccaaagcctctatttatattgatttttattttaatagaaggatgaattaaacatgagtaatatgtagtatccaaactgaggctcacccacatcagaggattccttatcacatgtggctcaggcagcaggagtgagtggcccactatctagaaggctcaaataggacacccttactcttctttgcacttttagcttaagggaaggcatcgccaagtgatgcttgttgtgcataatctagttttaattaaagtaacctcttcaaatgggcaagtggcttaaaaatattcctgctgaaacaaaatagacaaaaccaaaccccacagattgtagatgatattaaaattgcaagcccaagagagtaatatgaatataacagagaagacacttctctcattcccggtataggctctaatcagatatgacacattcaatcacatcacagttataataagcttttctggtggcaaaaggttcactgacaataaactaggataaaatatttaacaaaaaatatttaaagtaggctttaaaattttattttactgttagctcatcttttaaaaattctacattttagcatatgttttctccctgacttgtttatgaactcttgtataatacccacccacattcagcaattaccatttcctagattttttttctctctttctttctgtgtgtatgttgttgtgttttgttttgctgagctttggaaagtaaggtgcaaacatcctcacctttcacccctaagtatttcagtgtatattttctgagaacaaagatagtcttctacacaacccaatgccaccatcacattgaatgaaattaacaataattcctggtaacatagaatgaaattgtacctaatatattagtacagtagtacatatatataatttatacattaacatacatacaatgtaggtgtatgttcaatttgttattactttcttaaagctctgttcttcaaggatttttaaagaatgggggttggtatacttccctaagtgcccccactccccctccaacttcccaccacccttattccagcttcttcttgggcatccgagtagactgacaaggtccagatgaatgtgtctgcagggaactggcccaacttgtgttgctagctggaatataacttttgttcctttcttctcttctccatcttttctgtcttctcccctttcatctcctctcctcctctcccttgcctccttctctcctatcctcaagtttcctttctttttctcttgttccttttttttctcttcccctccttccatccccttatttccccagtgattctgctcttttccttttagtccctcaggcattcctgctcatgtctgacagcagaaaagttggggaattatttatttaattgcccttttgctggagctcttcacccctccatgccctgttgatcacacactcagacctgtgagctataaagctgaaagcttgttccctccatgcagggacagaaattctctcctgccccatattactgctcttttttacccatcctggtgggaaaaactaaagtttcacccctctccaacactttacctctccctgttgagccaaaagcaaatcccaagacatttcttttccccagcttagcttctgcagtctctctgaatcattgaggttttccaagaagttggtgctcacgcacaaattaaagcaatgaagaaaaggagccaaaagatggaggactgctggagtaaacaacctgaagattcccaaatattaatattccccaaatgcaacaagccacccaaagttctagaacctccctgctctccttcctttgttcgttcctattggaggaataccttttgactcttccttagcttctctaacaggatgtggctttattccacttctccccagtcttccctcatcgatgttgtcaatattacttgaaattaccacaaagactccttactcctttctttagaggttcctcaaaagcttgaggctaagaattgcaagtcccttctggagggtagaatagcgaagtgggatgtgagttctgtttgttcattcagtgtagcacctcagttcttaaagtaatggggaatgtaatacctaatatctagagggttctttctagttattttgttaacatatccccacgagctccttgtcggtaaagaattgtctcctgttcaaggatgagaatactgaagtgcagagtccacgattcatccaagaccatacaactagttgggagaatcaccattaggaactacatctcttgatcccaggtctgcattggagcccagaggaaactagagtatattaagaagaggtgaaaaggagcattggagatatttatcctggagaaaacagaaaagcataactgcaatctgttacatacttaaagataacagttggattggcaccaaagaccagtaagttctccatttgtggagtaatagctcagagagataagattccattgctctgggttataatcatcatataagccagctaataattgccttacttgttcagaaaaattcttggtgctattctcaggagaaaataaagctgatgtttagtagttttgtcaaatctcatcaggtagaattctaattttaaggcaggcaatgtgtcagttaccctagagaccatttagtttgtttaattatcgtcttcacctcagtattctccacatagtatacattaggattgcagtggagttttaaaaatattgtagtgcaacaattcctacagacttccgtaggtaattatggacaaataagggctgaaatgctggatccttaaaaataaacaaactgcccatatttgaataaaagacatacctttctgtgggcaaaggtttccaacccagagtgtggcagccagctacttctagttgccaagaatctctttgacaaattaatcttcccacagagaacgttttgtgacctttccaatgtttgtataagaaaaatgaagcacagatgttttcagaagtgggaaacaattgtttgagccccatattgtcagaggaccaaatttgtcagtctattgaagaatgatttttactgacttaatgtgtaaaagggaaacttctctctctcatttgtgagaagttggaaataagagacacaacggcaagtcacatactaatcatcaattaattagcaagtatttgccgagtccctactttgaaataagtgatttgcagagcaaggaacctggaacatttttagtgagacaggaaaaagagaagaggaaagcatgtaagcttctgacctcaggaaaattaagaaaaagtcaggtagaaaagacatacccatagaatgtaaattagtataaccaccatgaagaacagtttggaggttcctcaaaaagctaaaaatagagctaccatatgatccagcaatcctgctgggtatatacccaaaagaaaggaaatcagtatatctaagagatatctgcactcccatgtttgttgcagcactgttcacaatagccaagattaggaagcacactaaacgtccatcaacagatgattggataaagaaaatgtggtacatatacacagtggagtactattcagccctaaaaaagaatgagatcctgtcatttgcaacaacatggatggaactgaagatcattttgttagtgaaataagtcagacacagaaagacaaacattgcatgctctatttgggagatttaaaaatcaaaacaattgaattcatggacatggagagtagaaggatggttaccagaggctgagaagggtagtgggataggcgggaggcagtggtggttaatgggtacaaaaactaattagaaagaatgaataataaaacctactatttgtcagcacaacagggtgactatagtcaataataatttaattgtacattttaaaataactaaaagagtataattggattgctttttacactaaggataaatgcttgaggggatggataccccattctacatgatgtgattattatgcattgcatgcctgtaccaaaacatctcatgtgccccataaatatatatacctgccatgtacctacaaaacttaaaaatggaagaagaaagaaaagacatacccatagaaaactagcaaacaattcaagatagtgcataataagcagaaaatgagaggagctgataatcttgtcataaaagtcagacaggttgggagaaagaatgggaactattaaggcctagactggtcagcaaaacttcatcaagatgatacttaaactgaaatttggaaggattggatttaaatgaatcaagaatctggaattgggcatgatggaaggagggaaacaggaaagcaatggaaaatttaggaatgaggcatagactagtctatctcttgagtacaatgaaaagtggacagctctttctttcagagggtagcaagtggggaatgatctatgtaaaatgatcttggaactaaatctggtgataactttaaagggttatcacatctaattgttttagataaggctcttttgttggcaaagaacagaagccactcaaactaactcaaggaaaaaggggatggtagtattgtaaaattataacaggacatctcttgtacattcaaaactagtacataagccagaaaccataccctctgtatgacttagggccacattatctcagcttctcctcttatgtctgcttcatttttttttctctcagtccatttactcagcttattcatcttctgcatgtttaaatatggctgccctgatcttttccttgacatcaaaatcttatatttccagcatctattactaactatattctctctatttttccgtttaaatgcttaagagaaagagaatctctttagtagctagccaggcagttcattggctggtttagatcgggtatctactctaatccaaccagccattgctcctaaacaggaactaccctgtggtgtctccctgcattgggagctctgggcagagcaatctaggccagaagaggaaatagactgatatgctccatgctatacaaaaccattagacttgcaggaaacattttgtatgttctacatacatttgagaaacatctggtctatctctctccctctaggaagaatttacccaaagctctcttctgaaagaactgtggtgttctaaaaaacattggttctaaattgaatgttgactctaccacctcttaaactgagcttcaatttcccatctgcagagtggagataataatgtctacctattggagttgtctggaatataaatgagataatatagattctattctctgcttggaaaaaggcaagagcttagtaaatgggatttctttcgtttatttgctatgttctgaacataccacaacagaaaattgtttgcaatgcattttaacttatttttaattgcacaagtgatatattaatatgtcaatactttaaagcaaatactagatattatattatttcactggtaaatactttagcttgtgtcttttataaacaaggtcttttaagaaacacatagccgcaatacccttatcacactcaatacattaaaaataattccttgatatcaccaatagtacatttatatttgattttcttcaatatttatttcacaaatatctttttattgttgtttggtttgactcaaaatccaaaaggagcctacacgttgcatttggttgatatgtctttcagtcagtctataaccattctctcattttctatgccatatatttgttgaaaaaaaatggggtaattattcgtgtaggattttccaattcagaatttggctgattgtatccttatagcatcatttagcaggttcttctatcaccatatttcctgaagactggcacataaatctagaggcttaattagatttagattcaaattaattttctagtaaaactataaatgctttatactatattttatattttaaaagttgtgaatttaaaagaaagagcatagttcccatggtattttgcacctaggaagacaagattcctaaaagagaaggacgtaagccatttactctggtttctgactgagtgaatcacctttactcagagagttagtgtaattatgactgctatctgccagaaaatgcagatagaagtcttagttatcattttatctctaacaaatttattagcgatatctttagccatatgcatctttggctgaagatgttctcatgcctttaattaaagataccaatttcttgcctacattctaagctaggaaaatgtttaaaatggctaatgaataaagaagatccaaaagaaaatagaactttattttaaatttttatttttatttgtatttgtttaaaaataaagcaaatacaggtacattgaagcaggactgtagtattgttctggaattttggggtttggggatgtttaataaataatagccctctcttccctacctaatttgagaacaaaaagccagataaggaaatcagagagactatgataaaaatagttgcatctatgtctgataaagctgtttggggaatgtaactcaggtctatagcaataatgaacttgcagacactctcttatcttctatattacacttgccattcctctagacagggccagttaaacaaccataatcctccctgagcccaatgcacaagccaggttctttttcccaaacttgccactgaataattcccccttccctggtaggaggaggaaagtgagtgaggagtcagggtgcagccaagagtggtaaaccaatggaggtctaatcaacatgaaaacaagtggaaataagtattccccttccctgaagtccatgatataaaagagtatcataagtagagtccagtttaaacacagcattttcagcaataaacaccctcacatgtagttggtctcaactcatatcaacttccacattatagtagctcatgttcaattgaacaaacttttgtggagtgtgtgcaaatcacagtgctggcagattccaacatagaaaaagacatactctttgcccaccaaaggctcatcctctggtgggttctcagacaggtgtacgcaagataatggtgcccttgtcttgtcactcactgtgctagagaccgtatggggagtgtgcagacatggagatgtgctgctcagacctcccttgaagaagagacttgcccagttgcagggggtgtggttagctgaagcctccaactaccagctctttcagggtccacttcagctttcaagctgtggtcatgttcttttgggtggttcctgcccagtgactgagccaggtggtaactgagatcacattcttcctggggtgaccccatgcaatgactaagcaaggtgattatacatgggcctggcaatttccacccaaagcaggacttccccgttgggtaatctttgttcctaggcttcctgttgggctagcgtagaatgaccagctatcccagtttgcttggactgagagatttcccaggatgtaggatttaccatgctaaaactggaaaatttccaggcaaaccaagatgtttagtcatcctcgctggtgtagacctgagaagctccctctttctatcctacttcctcccctttttcctttcacaggtattgctcctcaataaaatttgtatttcttacttcatctcagtgtctgcttcccagaatactcaacccaagacatgggcacaaatagctcacaaaccaggaagaacctaaatacttcaagagaagataaggctgagatcaggaaggcaagggaaaaatcaatgtgaaaattacagggattctcctgggtattactttttcaagggaccatttattatgcatactttgaaaaagaaaagaggcatatttaaaatactcaacgacttaaggttccctgaagtggatctgaatacgcaaaatgaaggttttgccaaaaaaaaaaaaaaaaaaaaaaagccaacctccttgtctctgtgtcctttaactagcaacatgccttgttattaatttctatgatttaagaagaaaaacaaagggaaattcagcttttctaagaggtattcttaaaatcaagagagagtgtgaattgtacaacatggtgactatagttaataacaatgtattgcacactcgaaaattgctgagtcgattttaagtgttctcattttaaaaagataagtatgtgaggtaaagtatatgttaattagctcaatctagtcattccacagtgtatacatattttaaaacaccatgttgtatacagtaaatatatacaatttttatttatttatttttaattggctttaaattaagacaaaaagagaatataagcggaatggtacttgtggagagaagagaaggcatccttcagggctagattagaatgaggcaagtggctatttggagtacaaaatttaaggaggcactcactctcagggtcacagagctcagagtcggcaccctcaggacccgaaagtgagcacctccttaaatattgtacgccaggtgtctcgcttgcctcaacttagtcctggccctggtattcagaataatattatgcaactgatggggatgcttctttcctgccctagatacaaagccattgtccggccaatggatatccaggcctctcatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcattccactgtcgatcatctctgtttactactacttcattgctaaaaatctgatccagagtgcttacaatcttcccgtggaagggaatatacatgtcaagaagcaggtaggtgctcaggattgattcatttcctccttggggatataatcccttgcatttcttttggaccccactgacaagccatgacacttgaatctgcaattagatgaggtgggtgatgtgtggccagatgctaaatggaaatgcctagccatggaaacccaaggtgttctttatagtcttattctcctgttaaagacctaagctagggaggtgttgtgaacctgaaatatttcaagtgtgggtttcttttggagaaataatctgaaaaagagttgtatttttaaaataaataaatgaagctttgaagctcatggggatgtgacttctttaaactccagtcacattgtttgcctagaaagaggattaccacatggagacaaagcaggaggctggaaagtgagggcagttgaagaaaaagagtagtttgattaggataggctcacactgatttgggctcaagtccaagccgcatgatgtattcagcctctctgagcctcagttttcttacctatcagataggcttataatccctacattgtaaaactattggaagaagattacaagagagagtatatgtaaggcctacagtgcccagcatgcaagatgccctccatatgattagactctctttcttatcccccataacactccataatttcatccttgagttacaaacaaatggtagaaagcaagggctccggcttcctcctctttgtcagtgcttgccttctagcccaggtgtagatcatgtagcatctatgatggaaaagcagaaacactccccactccatttcagtgaatagctgactcacttggagaccttaccctttaacgttcattatttatgtatttgtctcagttgtgggggaagagtggcagtttctaatgaaactaccttcctacttgaaaagcctctcattagccaacatccattgtaccccaaactctttatggagaaacatgtttccccttgaggtagtggatggagttgggagcaaaaggagatgcccatccctctttgccacagtctctttctatagactatagtccagagataactcaagattttaaaatcataataatagagagttatcttggtttagccagtgaagaagaacaaagctggctgctctttctgagcatgagagggaataagaaattattaactgtggagaaaagaaagacatgaagtagtatggctgataaactgcaccaatgctctcctgaggaaaaagggggcacttattagaagttcatgttgcagtccattcaaacatgtaatcaactttgtttaaagatctgttctcagtggtatgttctaactctattcttcctcgtgggtttctgcttcctggctcatccatttctgtgtttctgactctttttttttccttttctgtctgtttctgttgcctttctctcattttactggattctctcttgccctctcctattgaactctttttcggtggctttgtgaactcctctattgccctaattgtttttccctttctctttctctgcctgaatctttgtctctctgcattcttctgacactgtcccttggttcctctgtctctctccatgtgattctctccttagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctt

SEQ ID NO: 3120 - DNA, 206581 bp, human
cgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcatagctaccaccttttggctgttctatacttggaaaagtactaggggatgatacataccagacgctgtttttgttttgtgctttccttggagcttggagaaagactacttgataagcctttgtctgtcatttcatgtcaccagcacttcatggtgataagactgttaatatcaggttcaaaacgtgaaatgaagcttttcctaaaagcaatagtatgaatgttattaacaccaatggaatatttagagtggcgagtggtattttaaaatctagtttcaaaggagaactgagggttttatggttcacttgcaatgtcattgtgttcatacgtatttttaaaaaaattgcttaagactgcgttttatactgctggagtgtttttactgctatatgtttgtgagcataactttagacactttgtaatctttcacccttttgaatttgggatttctgaaactgtaactagtattcacagaacttagcatggctgtttatccctaaagaagtccttgatatgtagacagttctgccattgctgatgagtagttgagctggatcaggtaaagagaaagtcagtgtcttaaaacacaaaccgtggctattacatgaggccctcagaatagtcccgagcataatacatttattcagtgctgtagctgcttcccagctgaaagaggaataattgactgaggctatgcagcaagtaagtgacagctgggtacctattaaggcttattttgttgtcagtaatgcatcggataagaggaggtgggcatagtaaatctgaatatgttggttgatgcctctttaggaattgggaagaaggatttcctgatgttagaacccatgctttcttgaggtacatatagttttaaaaggacccaaggcacagtggctgtgcgtgaatgagattatatttttgatgtccagttgaaatctgcttgcaaaagactgcttcagatactggcaaaaggggacatccctgcgagattgcttggagtaaatctctcagagctcgaagctcccttattcagcctagcaaagcaaaacacatcatccacctttaatccaacaaaattaccataactcaatattcttggtacaggtgaaaatgaacattgaaggcatcctggacatgtgatcctaagagagtcaaacaaagtcagcaaccagcagacacctaattttcacccatcactttggtggtggtggtggtggtggtggtggtggtggtgtgtgtatgctccatccactttaatttgcattaccccatcagtgtattagccattctttaaaacaaacgtagatgtttttaccctttctctgttaaacaggaacctgtaagttgagatttaagtgccccaacaggtataactgctcaaatcttggaggcactaaccagtcctgatattttctatggtaacaaccaggttttcctcttaataagcatacaattaagattaccataataatgttccaggaagagtgagaatcttgcattcttaccacaagtaaatggtctataaaaatacttattttttatttatttattttttgagatggagtctcgttctgttgcccaggctggagtgcggtggcgtgatcttggctcactgcaacctctgcctcccgggttcaagcgattcttccgcctcagcctcctgagtagctgggactacaggcgcacgccacctctcccggctaatttttgcatttttagtagagacggcgttttgccatgttggccaggctggtctcgaactcctgacttcaggtgatccacccgcctcagcctcccaaagtgctgggattacaggcgtgagccaccatgcctggccttaacatattttttaatagactatttttttttttcagagcagttttaggttcacagcaaaatttagcagagtacccatatatcccctgccccgacacacccgtagctttccttactctcaacgtcccacatcagaataatagagtttttacaattgatgaacctacattgacacctcattattccccaaagtctatatattagggctcactcttggtgttgtacattctgtgggtttggacaaatgtataatgacggttccaccattgtagtatcatacagaatagtttcactgctctaaaaatctgtgctctattgattcatccctccctctccactaacatgtggcaatcactgattttttttttttttttactgtccccatagttttgccttttttagaatgtcatatagttggagtcatacagtatataggcttttcactttggcttctttcatgtagtactatgcacttaaaattccttcatgtctttttatggtttggtggctcatttctttatagtgctgaataatattccattgtctgcatgtactacaatttatttattcacctactgaaggatatcttggttgcttccaagtttgggcaattatggataaagctgttataaacatctgtatgcagccttttttgttacatgcaggagataagcttttgactcatttgggtaaatagcaaggggcatgattgctagattgtatggtgagagtatatttagttttataagaaactgccaaactgctttccaaagtgattgtaccattttgcgttcccatcagcaatgcattggtttctttacagagtatttattttcctttgctgacttattttaacagcaggattctagcactaggtggaaaacgtatatgagtttctgatgtgtgtcaggtactgtcctaggtgctgaggttataatagtgaatccaacacaatctctgtcttcatggagcttatgttctcatgtgaatgtttttacacttcagagtttttatttggttgagaaaagacttgaaatataacatccaaaaataaaatgtcagcctggtgctgtggcgcacgcctgtagtcccagtgctttgggagaccaaggatgggaggattgcttgaggccaggactttgagatcagcctgggtaacatagtgagaccctgtctctacacaaaataaaatagccgggcatggtggcatgcgcttgtagtcctagctactctggaggctgaggcaggagaattgcttgagcccaggagttcaaggttatagtgaactatgatcgcaccattgctctccagcgtaggcaacagagcaaaaccctgtatcaaaataaagtaaaataagcctgtcaaacccaaaccaaatacatgtcaaacccagacctgattcttaccacacactatgccttctagtaaaattctggcctttgaataccaacaaaatacttcataacctgggaaaccaactactctaacgtttgttgctctgtcttgaaatactaaacaaaaccatttacctgttcgtagacatattttctttttctagtttaaaagtatcccattctgccattttccacctagtgctagaatcctgctcttaaaataagtcagcacagggaaataaatactctataaagagaccaaaagacctttcaaaataggctatggccaggcccagtggctcacgcctataaatcccagcactttgggagtctgaggtcggaggattacttgagcccaggagttctagactagcctgggcaagatggcaaaaccccatctacacacacacacacacacacacacacacacacacacacacacacacacacacacacacacccccgctacctacctctctctggggcatgcctgtagtcccagctattctggaggctgaggtgggaggatcccttgagcccaggagtttgaggctgcaatgagccattatgacaccactgcactccagcctgggtgaaagagccagaccctgtctcataaaataaataagtaaataaataaaatatctaccttaaagcagcaagttttgtatttgatgtaatgaattaacagaccgctttataatatctatcttttaggatagtgtcagtctcttggaatgctgtgcatgagtcatcattaaaattggttttcattaaaaaaatttttttaacatatacacatcttattggagttttcttttaaaattcaaaaatgggaacattattttttcaaagccaagtaacagaagagtatataaaaaagtcaattttgtgcatatctttttacattttctatgctcatgtaaaacatacatgacttatgtaattatacacatatgctccagatctcatctgtattaattttttaaattatactttagttctgggatacacttggagaacgtgcagttttgttacataggtatatatatgtgccatggtgatttgctgcacccatcaacccatcatctacattaggtatttctcctaatgctatctctcccctagccctgcacccctgaataggccccggtgtgtgatgtttccctccctgtgtccatgttttctcattgttcagctcccacttatgagtgagaacatgcggtgtttggttttctgttcctgtgttagtttgctgagaatgatggtttccggcttcatccatgttggttttcatttttgtgatagttaattcttggacattaaggggaataattataaaacactgttgcttccatatcaagggaaatcactgaatgattaaaaaaaacccaataagtgttgtctgattgtttaaacagctttcattgaggtaaataagtaaaacaaagctgtgagaagtagggaatatttaaacaatttgtgcgcatgccctcacctttggggagaagtcttttctgaaggctctcttctgattttttgaagcaactgtttaatcattaaagaaaattataggtaaaagacaaattcttgtgaactttcgctcattgctagattattaggcagaactattttttaaaaatttaaatgaaacaactttatatttttacatctttagatcatatcattttgtaactatactttagggaaatagaggccagcatattaaaacagtaactaggggctgggcagggtggctcattgcctgtaatcctagcactttgggaggccgaggcgggcagatcagctgaggtcaggagtttgaaaccagcctggccaacatagcgaaaccccatctctactaaaaatacaaaaattagcaggagaattgcttgaaccggagaggcgaaggttgcagtgagctgagatcaggccattgcactccagcctgggagacaagagtgaaactctgtctcaaaaacaaacaaaccaaaaaacaaacacacacacacacacacacacacacacacacacacacacacacaaacacacaaaccagtaactaggactaactatatgctgttttagattgacagtattctttttttctaaaagagaatgaatgccagcagatgtaggaagtaccagagctaaaccattgcctggttaaaaggagtacctctgcataatagttacttgttgactcttttgtaataaaatatttcaggcatgtaaaactagacagttacccaagaaataactgtgtatccaccactccgtataagtaaaacagcccagctagagtgaaagcctgctatgtccccttctctggtcccattcccctccctccctaccctggagttaccagagtcctgaatttggtgtgcatgatttgaagatttctttctacttttattgtatgtatatgtggatatatatatttgtgtatatataaatcactaaaaaagatattattttggatgtcttttcaacttaaggaatatcgtattctgtgtaaccttctgcaacttgcttttcctctcattgttttgtttttggaattcatcttgttgacacatgtaatttcagttcatttatgtttccttttaaaaaatctttactacttacgtttacaatgactcattgttacagtgcggtagagacccttatgccaaaaggaagtaggtggcatttttccttatttatatagaatgtcacatgactgggggactgttcgaaacgtgtatgaaaattaagaacaccttcatagatagcagaatgcacacttatattcttgagcgtgctaggggatgtttgagctaattaattgactttcatgggctttctttttttctcatcttttatttttttgagacagggtcttgctgtgtcacccagactggaatgcagcaatctgatcatgactcactgtaccctcaacctcctgggctcaagcaatcttcctgcctcaggctcccgagtagctgggaatacaggtgtgcagcaccaagcctggctaattttctttttaaaaatttgttgtggagatggtgtctcattatgttgcccagcctggtctcaaactcttgggctcaagtgatctcccgcctcagcctcccaaagtgttgggattacaggtgtgagccaccacaccctgccatttttcatctttttaaaaatggaacatctcaaataagcaagtagatagaataatgcattaaaccctgctgcacttgccactcaggcccaacaactgtcaatgcaaggttaattcaattccatctacatttctatctttgttccctctcacctttgttatcctgaagcaagtcgcaaacatcatatggttcatagggcttatctttaaggaaggaaccagggtgggcagaaggaaatggaaacatgcaggggtttaggttggccagaaaaggtacctgtggcctatggtcaaatggcaagactgatgatggttcaatactgtcaagcctttggctgtcatggagatagacgtgcttgagaactgatttagaatagttgggaaacctgtagggagattgaaaaagtaaccaactgaagaccaggaatacaagatggatttgaatattgttctagcttcacactcctaagtaggggctgtcctattttaagggtgtagacaattggttttgaggaaatcttgggttgtttttgctaattatttataactttttttttttttttttttttttgagacagagtcttgctctgtcgcccgggctgaagtgcagtggcgcaaggtcggctcactgcaacctccgcctcccaggttcaagcagttctccctgcctcagccttctgagtagctgggactacaggcgcccaccaccatgcctggctaatttttatattttttagtagagatggggtttcgccatgttgactaggctggtcttgaactcctgacctcaggtgatctgcccaccctggcctcccaaagtgctgggattacaggtgtgagccaccgcgcctggcctatttataactttaaaaagagggtttggttcctttccagggtttttcaaactttctgtttgtttcgtataggcaagtttctcatgttttgtattgatggcattctattattcatacctatctgttggtgggcaactaatcaacctgggttgcgcaggactgaaggatttcctgggggcatggaacttcagtcttcagacagtcctaggcaaactgggatggtcaccccctctcttggttgctgcattagttatctattgctctataatgaattaccacaaacttagcagcttaaagcagcacacagttattatctcccagtttctgtgggttcgggagtctggacatggctcagttgggtcctcagctcagagtttcataaagccacaatcaaggtgtctggagcttggagtcctctgtggaggtccaacacttggttgcagaattcagttccttgtgattttagaactgaggctctcaacttcgaggcttcctgcagttccctccacatggccttctccataggcaattcacaacatggctcttggcttcttcaaggccagcaggagagtgtctctctccagttagctcagacacctttgccatagtccattagttagaagcaagtcacaggttttgtctgctctcaaggggaggggattatacaaaacaacagagaccaggaggtgagaattttgcgggggacaccttaggatctttccaccacacttgctttccaggatttgtctgaagtagaaaattattctgttgagcctttttgtggccagaatatacatatgttttgctcagccactaatttagaattcctttatctttttaagaaacattttcatgcgtaattcatcctaagtagaactggcaaatatgtaacttcttaggtattttcaattttagtctttaggcaattgtttttcctcttaactagtaggaggcaggaaaaaaaagtggaaaagcagatgcaaatgccctgcctggctactcctgcacgcagtgctctaaagcaggccttctcagcctgggttagttcaggggtctgtgaatttagatgtggaaaagaactacatctttttttttttttttactaactgcccttcccccaactgaaattgagcacttccttctattatgcatgtaagcaaaaaaccacagcagtttttttttttttttttttttttttttttttttttgagacagggtcttgctctgtcacccaggctggagtgcaatctcacaattttggttcactgcaacctgtgcctcctgggcccaaatgatccttccatctcagcctcccaagtagctgggactacacgtgcatgccaccacacccagctaatttttgtattttttgtagaaacgggattttgccatgttgcctaggcaacagggttcactgctttcggtcaaatgacagcaatgctgctggcaagtccatggtcaggagtgagattccctcaggctgctgtggtccctcctcctccagtctgtcctgcaggaagctcagagtgaatggatgctcagctgtttcctctgagacctcaccagggacagttcctgcagtcccggctctgagctctgctcctgaccgttttatctggccctctcagctgtgcttcactgcaaaggaggaaggacaaggccctctggagccagtgccagctgcttgtggggcctgttttatttactactgctatctctacttcagagacttgggctaggacatagacttgaagaaaaaagccattttaacagacttgagaaactcagccatcctcataataccattcagaaccaggagaggccattattaacactaggctagtaggaaatgttcactttgactgaattcatttgtaacactttgccactggtttacaagaaaaatactttggttcagtctcctggaggtaggtaattaaatgtttcacctgtgctaattttccaaataattaaagtgaatcccataaatgccagcaattaagaattgttgtttttggccaagtgtggtggctcatgcctgtaattacagcactttgggaggttgaggcgggcggatcacttgaggccatgagtttgaggccaacctgggtaaaatagggagacgctgtctctacaaaaaatacaaaaatcagctgggcttggtggaatgtgcctgtagtcctggctacttggtaggctgaggcaggagaattgcttgaatccgggaggtagaggtttcagtgagccaagattgtgccactgtactccagcctaggcgacagaggcgagattctgtctcaaaaaaaaaaaaaagttgtttcttaagtgcagaccttctgagatgtgtagtgcttgccccatgccttcaaaagaacatatttaatacaataatctctttgtctctcctttacttcaaagtcagccttgtgaaaaacagatgatgatataccaacagttttttgctcttggaggtgtttggtgtgctctgctttttgagttttgttttttggacttctttaaaattattttaaaatgttttaactcctctcctttgcatactctctggtacccttatagtcccaatactgagtaaagcatgtaaaatttagcatgcagatgttttagcctcttttattttttgttcgagatccagattttttagtctcagcatgactgacactttggggctgtatcattctttgttgtggaggactgtcctgtgcattgtaggttgtcaagtaacatccctggtctctacccacaagataccagtagctattcttctcctgattgtgacaacaaaaaatgtttccagacattgtcagatgtctcctcggggcaaaatttagttctacatatatgatgataaaaaccatggtagcagccaacatttgttcactatcatccccattttgaagaaagcaaaaacggaggcactgagggtgaggttcacttacttgcccaaggtcacatagataaaagtcacttcttgaaatacttttcataatatatatgggttgaatctcagtcttaattgaggaggcagactaaaaaagaatgtaaaaacggggagtttcctgatgatgtctcaattgagaggctattgctttcatagtgattctgtgtaaatgctggaattcttgcttaaacggggtgattccatgggcatgtgtctgagtaaaggacttggatcatttctaagaagcttctgtggcatggtgaagcagaacataagacagtctaggatcaaggataactgatcaaactttgaaaccaaggaagccataggaaattggggtaaggctatgtatcacttagggtcccacaggaaatggcatgctcaaagggttttagtgaaaacaggaatgttgaggcacgaagggactagcagcaggaagctattgccattcctagacctggtggggcaaagggaggggagggaatgtcgttgctggagctgtgaaaggtactccctctacaggaacaatagtcatgaaagaatacagcctttgctagaactatggccagagaggggccagtgggatgaggggatgggagagaagtaaccaatttctgtttcctgccctctcatttgctgcagtgccttttgttgttctaacccaactagaagccacaggtaacagagcctgggtgttgaagcttattgaggttagcctcttgcgctgagtggatggaaagggctgagagtggttcaagggggcaaatagagcaacagccagcacaggctatgagcaggagtgggaaacactaccctggatcctaggaaggatggggcatggccagtgataggagcaatgaaagtctttttgtgtgaaaaagagcctggggatacagacctccatgaaggagaagagagggttggataggagtgactggttcatctgaggttcttcctatttctccaaggaagccttgaggaatgtggggttgtctgtttgcatttggatatggaagtatgtgtgtgtgtatacttttatttattttgagacagggtcttgttctgtcacccaggctggagcacagtggcaccatcacagctcactgcagcctctacttcctgggcttaagtggtcctcccacccaggcccccccaggtagctgggaccacaggcatgtaccactatgctcggctgatttttaatattttgtagagacagggtctcactatattcccctggttggcctcactcctgggctcaagtgatcctcccaccttggcctccagaagtgctaggaatacaggtgtaagccactacacccagtctgtttgtatactttttggtcagagtgaggctttccgtgagttggagtgtttgtccttattcatgacactgggaaacatacaacagtggagtgaccctcttgcagattctgctaggagtagctacatatggtgggaaaggttgctatgggaatggagataaattcaaggcagtagagagtgctttataatgtttgggggtatggccaagcattagttttgctttttccttcccagtaggatacgatttctgtagcaattcttccttacccaaaaatagctatatgtgctcccaaaaagaaaaagcccaggaccagatgacttcatggctgaattctaccaaacattcaaagaagagttaatactaatccttcttaaactcttccaaaaaacagaagtagagagagtacttccaaactcattttttgaggccagcatcaccctgatttcaaagccagacaaaagataccaagataccataagaggagaaaaccacaggttagtatctctgttgaacatatatgcaaaaatcctaaataaaatactagcagaccaaatttaacaacacctcaaaaagatgatacaccatgaccaaagtggcacttatccctgagatgcaagattggtttaacgtatataaaacaatcagtgtaatatgccacattaccaaaataagaggtaaaaaacaagccaggtgtggtggctcacacctataatcccaacactttgggaagctgaggtgggaggattgcttgaggccaggagttcaagaccagcctgggcaacatagtgagacactgtctctacaaaaaattaaaaaaaaatgagctgggcatagtggcatgtacctctagtccctgctacttgggaggctgaggcagcaggatcgctggagccgaggattttgaggctgcagtgagcactgattgtgccaccgcactccagttgggcagtacagcaagaccctgtcttcaaagaaaaaaaaagagagaaaaacccatgatcatttcaatacatgtagaaatagcatttgacaaagttcaacagcctttcgtgataaacattttcaacaaaataagtttaaaagggaatttcctcaacacattaaagaccatttatgtagagtccacagctaatatcataatcagtgggagaaaactgaaagctttttttctaagatctggtacaaagcaaggatgcccactcttgccacttttattgaacacagcactggaagtactaacatgagctatcagacaataaaaagagataaaaggcatctaaattgggaaagaagaagtaaaattatccctgtttgtaaatgtcatgatcctatatgtagaaaaccctggactccacaaaagccctcttaagactaataaatgagttcagtaaagttgcatgatacaaaatcagcgtacaaaaatcagttggaaatcaagaaaactgtcccatttatgataacataaaaataataaaatattcaggaatacatttaatgaaggaagtgaaagatctgtacattcaacattataaaatattgatgaaagaaattgaagacacaaataaatggaaagatatgccatgtttatgcattggaaaaattaatagtgttaaattgtccacactacccaaaacaatatacaggttcaatgcaatccctatcaaaataccaatggcatttttcacagaaatagaaaaaacaattctaaaattcatatggtgtgacaaaagacctagaatagccgaaacagtcttgagaaacaaaaacaaggttggaggcatcacacttccttagattataatacagtataaagcagtagaaattatgatagtatatcctggcataaaaacagacatatagatcaatagaatagaacagagatccgagaaatatacagtatatatacagaaatccaagtatatacagtcaactaatttttgacaaggccaccaaggagacacagtggggaaaggatagtctcttcaataaatgatattgggaaaactggatattcacaggcaaaagaatgaagctggatgcttatatacaaaaatcaactcaaaatgtgtctttaaaatatacaacaaaacctgaaaatggaaaagaagacctaaatgttaataactcaaaccattgaactcctagaagaaaacataggggaaaagctccttgatatcggccttggcaatgattttttagacatcacaccaaaagcacaggcaacaaaagcaaaaagaaacaggtggtactacatcagactaaaaagcttctgcatgacaaagggaacaatccgcaaataaaagggcagcctatgaattggaagaaaatatttgcgacccatatatatgataaggagttaatatcaaaaatatataaggaactcccagaactcaatggtaagaaaatgaataacccgattaaaaaataggcaaaggacttgattattcattttcccaaagaagccatacaaatggccagcaggttgtgaaaaggtactcagtatcactaatcataagggaaatggaaatcaaaaccactatgagatatcagctcacaccttttagaatggctattagaaagacaacagataacaaacgttagggtgtggagaaaagagaacccttttatacttttgatgggaatgtagattggtacagccattatggaaaatggtatagaagtgcctcaaaaaattaaaagtagaactaccatatgatccagcaattcctctgctggatatgtacctaaaggaaatgaagtcagtgtgtcaaagaggtatctacactcctgtgttcattgcagcattattcgcaatagccaagatatggaaacaatttaagtgactgttgatggatgagtggctaaaaatatcgtgggatacacacacacacacacacacacacacacacacacacacacacacacacagatgacagaatattattcagccttaaaaaaggagatcatgctatttgtgacaacatggatgaacttatgctaagtaaaataagtgagacacagaaggaaaaatacttcatgatcttatttatctggaacctgaaaaaaagagtcaaatatatagaaacagaatagaaccacggttaccaagggtgggaatggggaggaaataaggcaatgtaggtcaaagtgtacaaacttgcagtgatgtaggctcaataagtctagagatgtacagcaggaggactatagttaacaatattgtattgtatatggaaaatgtgctaagagtagattttaggtgctcttacctcttctccccacaaaggtaactatggaaggtgatgagtatgtcagattgcttactggtagtaatcatttcactatggatatgtatatcaaaacatcatgtcatacatgttaaagttatgccataaaaatagctatatgtgggccaggccaggcatggtggcttatgcctgtaataccagcattttgggaggctgaggcaggaggattgcttgaggccaggagtttaagaccagcctgggcaacgtagtgagaaacctgtctctccaaaaatgtttttaaaagttatctgcgtgtggtagtgcatgcctgtgatcccagctacttgggaggctgaggcaagaggattgcttgagcccgaaaggtagaggctgcagtgacctgcgattgcaccactgcactccagcctgcgtgacagagtgagaccctgtctcttaaaaaaaaaaaagattaaaaaatagttgtatgtgtatatgtatacgttcaggatttgttctatttgttttctttttcttttttttcataggcagtggtcaatggcctaaggatttctttatacattgctcatatccactaaggctctattgagcaaaccacgccttaaaaatcttacaatcctcttcatatattttaaaggcaaatgcaaagaaatagctttgttctgttttgcattcttcatgggttaacatatcttctggaaaacttgttgctatggcaatgggatattatctatcttggtaatgtactacataaaaatagccctttgtgtttgagaatgatgttagtgacaggtggttgggtgaatgtatagcaggctgctttgtcaagaatagtttcccaacattccattgtttaaagttgtgaaatcaaaatgagtataatttttttctctctcaaaatgtaattttatctggaaaaggcaggcagtggtgctctgtttaattatgaattacaagccttcctttgcaggtcaggtcaacatgatgattgaagccacctctcactgtaataagtaaacgacttctctattctttctgtcagggtgtgcagcacaaggttgcgctgggggggccagtagggataattttcccattcttgaacacatcgttcttcctaagcacctcgtacttataaaccaagaagtaggaagtggtcaggtggaagagatgagctctgagctgttaatcaaatccgaatttcttgtaggttcttaggtgaaacagttccttgggaaaggtcagatttccatgttgcttttagtattgaactcacacatatagccaaggatagaatctgacccaaatcttaatttttcctttgaaaaatcctttgggcaatttttttttaatttaatttaattttattattattattattattttttattgatcattcttgggtgtttctcgcagagggggatttggcagggtcacaggacagtagtggagggaaggtcagcagataaacaagtgaacaaaggtctctggttttcctaggcagaggaccctgccgccttccgcagtgtttgtgtccctgggtacttgagattagggagtggtgctgactcttaaggagcatgctgccttcaagcatctgtttaacaaagcacatcttgcaccgcccttaatccattcaaccctgagtggatacagcacatgtttcagagagcaccgggttgggggtaaggtcaccgatcaacaggatcccaaggcagaagaatttttcttagtacagaacaaaatgaaaagtctcccatgtctacctctttccacacagtcacggcaaccatccgatttctcaatcttttccccacctttcccccctttctattctacaaaaccgccattgtcatcatggcccgttctcaatgagctgttgggtacacctcccagacggggtggtggccgggcagaggggctcctcacttcccagtaggtgccgccgggcagaggcgcccctcacctcccggacggggcggctggccggacggggggctgaccccccccacctccctcctggacggggcggctggccgggcagaggggctcctcacttcccagtaggggcggccgggcagaggcgcccctcacctcccggacggggcggctggccgggcggggggctgacccccccacctccctcccggacggggcggctggccgggcagagtggctcctcacttcccagtaggggcagccgggcagaggcgcccctcacttcccggacggggcggctggccaggtggggggctgaccccgccacctccctcccggacggggcggctggccgggcagagtggctcctcacttcccagtaggggcgcccgggcagaggcgcccctcacctcccggacggggcggctggccgggcggggggctgacccccccacctccctcccagatggggcagctggccgggcggggggctgacccccccacctccctcccggacggggcggctggccgggtggggggctgacccccccacctccctcccggacagggcggctggcagggcagagtggctcctcacttcccagtaggggcggctgggcagaggcgcccctcacttcccggacggggcggctggccgggcggggggctgatccccccacctccctcccagacggggcggctggccgggcggggggctgacccccccacctccctcccggacggggcggctggccgggcggggggctgacccccccacctccctcccggacgaggtggctgccgggcggagacgctcctcacttcccagacggggtggctgctgggcggaggggctcctcacttctcagacggggcagctgccgggcggaggggctcctcacttctcagacggggcggttgccaggcagagggtctcctcacttctcagacggggcgtccgggcagagacgctcctcacatcccagacggggtggcagggcagaggtgctccccacatctcagacgatgggcggccgggcagagacgctcctcacttcccagatgtgatggcggccgggaagaggcgctcctcacttcctagatgggatggcggctgggcagaggctgcaatctctgcactttgggaggccaaggcaggctgctgggaggtggaggttgtagtgagctgagatcacgccactgcactccagcctgggcaccattgagcactgagtgaacgagactccgtctgcaatcccggcacctcgggaggccgaggctggcgggtcactcgcggttaggagctggagaccaacccggccaacacagcgaatccccatctccaccaaaaaaatacgaaaaccagtcaggcgtggcggcgcgcgcctgcaattgcaggcactcggcaagctgaggcaggagaatcaggcagggaggttgcagtgagccgagatggcagcagtactgtccagcttcggctcggcatcagagggagactgtggaaagagagggagagggagaccgtggggagagggagagggctgggcaatttcttagagcagtaactctcaaacattttgtcgtcatcatctcacttttcttctacttatcaaaatgagtattgatttaattgtaatgagtaaataacagctccctgctactgaaatgaaatttactctagctttgagaatttgagagaccctcttaagaaaataccacagctggaaatttgagacctaaaagtaatacaatttgagtatctcatatctgaaatgcttgggaccagaagtgttttggattttggattttttcagactttggaatatttgcgtttacataatgagatctcttggggatgggacccaagtctaaacacgaaattcattaatgttttatatacgccttatacacatagcctaaaggtaattttatacaatattttaaataagcttgtgcatgaaacaaaattttgactgtgttttgactgtgacctgtcacataaggtcaggtgtggattttttcatttgtgacttcatgtcaacactcagaaactttcacattttggagcattttggatttcagattagggatgcttaatctgcagctctaattctgatatgcacggtactactgcagagatggaaccattgcctttgtcttttctgttggagtcagtatagatatcttgctactaataatatcagaagagagtgttgagtggtttgctgggtgcccaatactacttttagaacattttatgtattaactaatttattcctgtaaacattcttgacagtttttgtgactatttcccaaatgaggcgtacttgttagcatgtctttctgtttgtggtgagtaagcattcttgtgtattggaagacttgcttactagcatgtcacagtgttcttcatattgaaagcattcttctatcaggagttgacgtaattcagcctgtgggccaaatccatcctgccacccattttttgtgtattttataagctaagaatggtttctgcatttttaaatggttgggaaaacataaaaagaataatttgtgacatgtgaaaattacatgaaatttaaatttcagtttccataaacagttttattggaacacagctttactcatttgtttacatattgctaaggctgcttttgaactagagtggcagagttgagtagttgtaatagagaccatatagctcccagaccctaagaaaaagtttgccaatcccttctctatattcttctgtatctagaatggcagatggtcctcaataataacagcagattggtcaggtgtcatagtttatgcctgtaatcccagcattttgagaggccaaggtgggaggatcacttgagctggagttcaagaccagcctgggcaacacagtgagacctagctctgcaaaaattagccaggtgtcatggtgcacgctggtggtcccagctacttgggaggctgaagtgggaggattgcttgagcctgggaggtcaaggctggagggagacgtgatcacaccattgtgctccagcctgggtgacagagcgagaccctgtctcaaaaatatataaacagattggatttatgtacaggttcatatatatattaattttcttttggtatgcaatatatttttctttcttccactaaacgtttctcttgtcataagcttgatgtcatgtactatggcatatctcaaatatacgtgatttcagctctttgcatacccatattggttttcttttttttttttttaattgatcattcttaggtgtttctcgcagagggggatttggcagggtcacaggacaatagtggagggaaggtcagcagataaacaagtgaacaaaggtctctggttttcctaggcagaggactctgcggccttccgcagtgtttgtgtccctgggtacttgagattagggagcggtgatgactcttaaggagcatgctgccttcaagcatctgtttaacaaagcacatcttgcaccgcccttaatccattcaaccctgagtggacacagcacatgtttcagagagcaccgggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcagtgagctgttgggtacacctcccagacggggtggtggccgggcagaggggctcctcacttcccagtaggggcggccgggcagaggcgcccctcacctcccggacggggcggctggccgggcggggggctgacacccccacctccctcccggacggggcggctggccgggcggggggctgacccccccacctccctccgggacggggtggctggctgggcagaggggctcctcacttcccagtaggggcggccaggcagaggcgcccctcacctcctggatggggcggctggccgggcggggggctgacccccccacctccctcccagacggggcggctggccgggcggggggctgaccccccccacctccctcccggacggggcggccggccgggcagaggggctcctcacttcccagtaggggcggccgggcagaggcgcccctcacctcccggatggggtggctggccgggcggggggctgacccccccacctccctcccggacggggtggctgctgggcggagacgttcctcacttcccagacgggatggctgccgggtggaggggctcctcacttctcagacggggcggctgccgggcggaggggcccctcacttctcagacggggcggctgctgggctgaggggctcctcacttttcagacggggcggttgccaggcagagggtctcctcacttctcagacggggcggctgggcagagacgctcctcacatcccggatggggcggcagggcagaggcactccccacatctcagacgatgggcggccgggcagagacgctcctcacttcctagatgggatggcggccgggaagaggcgctcctcacttcctagatgggatggcggccaggcagagacgctcctcactttccagactgggcagccaggcagaggggctcctcacatcccagacgatgggtggccaggcagagacactcctcactttccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatcccggcacctcgggaggccgaggctggcggatcactcccggttaggagctggagaccagcccggccaacacagcgaaaccccgtctccaccaaaaaaatacgaaaaccagtcaggcgtggcggcgcgcgcctgcaattgcaggcactcggcaggctgaggcaggagaatcaggcagggaggttgcagtgagccaagatggcagcagtacagtccagactcccacggcatcagagggagaccgtggaaagagagggagagggagaccgtggggagagggagaccgagagggagagggagagagggagagggagagagggagagggagagagggagagggagagatttggttttcataataatcataaccctttccaaatgagggagagtaatgaattttatcattttattagttagtgtgcttcctttgctagatcaggaattatatctcctagtaattataaccctctatttattatttttaactatattgctttctacttttgggctttcagccaacgtgtaaatattgacagtttaataatctgaaccaagccacctggactgattgtaatattttaatttaataaatcttgcatatggttaagattacatcttctacattcatcagattggatttaatgcactcaccataatcaactctggaacattcttgcaattattattgttatttttaaaggttttctcctttgtctgttgttttcccactttttttttttttttttaagacggaatctccctctgtcacccaggctggagtgcagtggcgtgatctcggctcactgcaacctccgccccctgggttcaagcgattctcctgtctcagcctcctgagtagctgggactacaggcgtgtgccaccacgcccagctaattttttgtatttttagtagagatggggtttcaccatgttggccaggctggtctcaaactcctgacctcaagcagtctgcctgcctcggcctcctgaagtgctgggattataggcgtgagccactgtgcctggcctgttttcccactttttaaagtaacagccttgttgagatgtaattcacataccatatagtcacctatttaaagtgtacaattcagtggttttagtatattcacagaattgtgcaaccatcacaactatttccggaatatttttgtcacccaaaaaagaaaccccatactcactagcaatcacccccagttccaccattcctaggcagccatggatctactttttgtctatggattcgtctattccagacatttcatagaaatgaaaccacatagtgtgtggtcatttgtgattgtcttctttctcttagcgtgttttaaatgtagcacgtatcagcacttcttattgccagttctgctgtatggctataccacattttatttatcaattcatgagttgacagacatttgggtcattttcactttttgcctcttatgtataatgctactctgaacacttgtgtataggtttttgtgtggacatatgtttttatttctgtcgaatatatacctagaggtggaattgttgtgtcgtatggtaactctatgtttaaccttttgaggaactgccaggctcttttgcaaagctgctgtactatttgacattcttgtgagcaatatatgagggttccagtttccccacatccttaccaacgtttgttattgtctatctttttgattatggctatcctagtgggtgtataatggtatctcattgtggttttagttggaatttccctgatgactaataatgttgcatgtcttttcacgtgcttattggccacttgtatatcttctttagagaaatgtgtatttagatcgtttgtccattttaaattgggttgtctttataaaatgttgaattgtaagagttctttatatattctggattcaatacatatgatacaatacatataatacatattttagtcatctatcagataaatgatttgcaaaaattttcttccattttgtgggttgtctttttactttcttgatggtgtcctttgaagcatgaaagcttttaattttgatggagtttatttattgttttctattgtcacttgtgtttttggtgtcatatttaagaaaccattgcctaatccaagatcacaaagatttcacttatgttttcttctaagagttttgtagttttagctcctatatgtcagtctttgattcattttgagttaatttttgtacgtggtgtgaagtaggggtacaacttcatacttttgtatatggatatccacttgtcttagcatcatgttttgaacaaactgttcttttcctaatgaattgttttggaacccttgtgcaaaaccaattgaccttatgtaaatgtaagggcttatgtctagactgtgtcagtatcacactgtcttgatttgtttaatctatttttgaggcagactttcgctccctgatctaaaattaaaatgtttcacaattgatgatgtcttatatgcatcaaaacttgcagactgggtgtaagtggcttgagaaaatatattggagactaaagtggggctgttggagactcataggaatcaaatagttagaaggtgggggagtgagagaggcagtaagttggatgcttcccaggtgtttagcagccatcccaaagtggcagtcaaaaataggctagctttacataatttcaaagttaggtactgatggttccagtttctttttatggattcttttaaaaagtgctgtatcaccaaatgctgttgatggcatagaagacaacactgtggaaaaatgtggacattgaccagtctgagtcaaaaagatggacagatattcagttctaaatgtgaggaatttttaggaaaaccttgagcagttaattttgcttatttccctttctatgtgtatatgaatgataaatgaaaagtctaaaagagctcctttaataagcctgagataaatgctaagtcgtagactactgcatcatatcttatttggcttttttttagtgccacctaaaatactggtgttttagctttgagatgctcttatcctcctgcttccagctctatctacacctcagaaggagctgggtcctttcccagagtctattgtataaattaaccttcttcctgtagtcactctatgtccatctgtttcccagccactttaattttgttctttttcctttctcttgtgcttgtagatttaagtcttaaaaacaagccaggtattattgtttatagtggaattttgagtaggagtggaggttaacctgtacatcaatctagtaggaatattcattcaatcactcaagggatgagcttatggaaaagttacaaaaatagtagcattcctttatattcctcaccctgctcccttaatgttaacattttatataaaggatcaagaataggaaattagtcttggtacagtattattaactaaactacagagcttatttgaattccatcagtttttccactggtggtctatttctgttctaggatcctgtccaggatcccatattgcatttagttattatttctccttagtctcatccagtttgtaataatttcttaatctttaatgacacctttgaagagtacagatcaatattttgtagaatgttcctcaatttgtatttgtttgatgctttcttatgaataaggttgttcatttttggcaagaatataatgatgcatatttttcagtgtatcatatcaaggagttcatgatgttgatgtgtcttgttactggtgacatttaccttgattccttgtttaaattgctgtctgcagggtttctctacagtaaaattattactttttctctttatggttaaaatatcttgggggagatgctttgagactaggcagatatcctatttatcctcaaatttttgtccattgatttttttcattctttggtggatcactctgtatcatagagtatttgtgacaaatatttgattagcagaaataaagctatgccctacaagaagcaaagatcaattacattgaaatcctattgtattggttaatataacgctagcagctgtgttcctcaactttcaggagcttaacacaacagatgcttttcttctcaatatgggcatttctggttgtgtaggcagttttctgccatgttaattcaagtatccagactaaactttttatactgaagtaacttcaaactgacagaaaatagggatgcaagaatagtaccaggaaatcctgtataccctttactagatttacttaacatttgctacatgtgccttatgattttctttgtctattcatatatgtatatgtattttatatatattttatatatctgtatttatatattgattgccatatactaaatcacttgagattaaatcacatacatcatgttcttctatgccttaatagtttaaacttaatatatttatttgtttaaatctagtatacagtttcagaattgctaacccatatctgtttgagaaacactttcactaactggattacagcatttatacaattcttttattctttagttttgcaatatctagtcaagatacgattttccagtttcccactgaagtattaagtttgaaaactgtacataagcacactgttattcaaatttaggaaatttaatatcagtactttagtatgcagtctgtattccagtttcattaattatccccaaaatgttcttcagtggaatattttttttctcctgatacagtatcaagtccaggatcatgtattgaatttatttgtcatgactttttagtttcctttgatctggaacagatcttataagcctttctttgtctttcatgacatcgacattttgaacaatgacaaatttatgacattgttttgtagaatgtaccaaatttgggctgggtgctgtggctcatgcctacaatcctagcactttgggaggctgaggcaggtggattgtctgagttcaggaactcgagaccagcttggccaacatggtgaaaccccatctctactaaaaatacaaaaaacaaaaaaaattagccatggcacctataatcccagctactcaggaggctgaggcaagagaatcgcttgaacccgggaggcagaggttgcagtgagccgagattgcaccactgcactccagcctgggcgacagagctagatgctccatttcaaaaaaaaaaggaacgtaccaaatttgggtttggttgatggctcctcttgtttagattgagattatgcatttttaaaaaaacttttaggttcaggggtacatgtgctgatttgttgtataggtaaattcttgtcacgggggtttgttgtacagattatttcattacccaggtactaaacctagtatgcagtagttttttttttctcttctccctcctgccaccctccatcctccaataggcctcagtgtctgttgttcttctctgtgtgtccatgtgttctcatcacttagctcccacttacaagtgagaacatgcagtatttggttttccgttcctgcattagtttgcttaggataatggcccccagctccatccatgttcctgcaaaggacatgagctcattcttttttatggttgtgtagtattccatggtgtatatgtaccacattttctttatccagtctatcattgatgggcatttaggttgattttatgtttttgctattgtgaatagtgctgcaatgaacatacgcttgcatgtgtctttatggtagaatgatttatattcctttgggtctatacccagtaatggggttgctgggtcgaatggtatttccgtttttaggtctttgaggaatcgccactctgttttccacaatagttgaattaatttacactcctaccagcagtatgtaagcattcctttttctctgcaacctcactggcacctgtttctttttgactttttagtaatagccattcttactgatgtgagatgttatctcattgtggttttgatttgcatttctctaatgatcagtgatgttgtggtttttttttcatctgctcgttagccacgtgtatgtcttcttttgaaaagtgtctgagattatgcatttttgtctggaatactgcataagtgacatgtccttctcaggcaatgcatcaggaggcacatgatgtctcaacccctcattggtgattgtaattttgatcatttggttaaattactgtttgcttaagtgttaactatttttagatatgacgtatcagagtgatcaatactgtgaagcctcttacaacagtgtttagattgaaaaattatgagtgaaaagcctttcacagtcattcggattgaatatgcctaacatgaaatccaaactgtttcaacatttctttcaagtcattttctactatggaaataataatgcatgatttagccatgcctgagttttatttcctcacgcaggcatttatttctttaaaaaatttaatttaaagttcactataaaacttaccattttaaccatttgaagtgtacacttcagtggcattaagtacattcacaatgttgtgcaaccatcactaccatccatctccaggacttctttatcatcccaaacataaaccatatctactaaacagtaactccccaattccttctccagcccctggtaacctcattttatatgccatcacaatattttagaataaacgccaacttcctggggtaagatcatttgacttttgctcccagatcagaactatgataaaaatattatttgctatatactaacagggaaatttctggattttggcatgagttactgtattataactctaaatcctggtaagggaagcatttttattctgaaagtaaacaaaaataaccattagtatgataatctttacctctgggggtggggtattttggagggggtgagtacaaagagaggtgaaattattcctctagggtggcagaccagagtttaaattgtttcttatgtttttcatcttggttgtctaccaattggatatagtcactcagatcatccatgtttttgtacctggtttgataggtataaatacctataaattggaataaattctagcaattagaggtccatgttccttggtctgtaaagtgaatataacaaaactgacttctctccaaagggtgctttgagacaaaactataaaacactttggagagtagaaggggggtccttatttttagtaacattcctcagtgttcttcaagaactcacctactgccaatcattcctctgagttaagaatatatattagaactagttttaatagcactataaactatagatagcatggccatatgtccctgtttgcctggagctgaataaattacaggttcaaaaatactcaaataataaaattgcctaggtggtgacccacctagtttgttgctgtatggtgttgggtatctcttttttttccttgacaaatttgaaaaggccttgaaaccatgagcagattccttggttcagatggtctgtaataggagacaccaggacaagcctgagtctcctgctcttgaaagattagcatattgatagattgcgtacccattatcagttaggtatctgccaaaccatttgcagcgtttctctggagttcatacagttgggaagacttcctagaggcaagaggtcttttacctgaagattcagcagttactataggggccttcttttggcttcttgctcttgggacacctttacttgaatgaggtagtcttttgccattagtgcctgtggggccttaatgattcctattgggatgagttggccagaagtgaggctctccacttcatgttgaaactaacttctgcctgagtattaaggatgggtgattctgaggtcctgagccagctggaaggactttcattcactttctactcttgtctgaagaatgcttaggctaccttactgttacttctctggtggtaccaaaggccatgtaatgacatggctggatgcgatcactcacgtctgtaatcccagcactttgggaggccaaggcaggaggatcacttgagcccaggagttcaaccagcctgggcgacataggaagacccccatctctaaaaaatttttaaaaaatctagctgggcatgttggtatactcctgtagtcccagctactcggcaggctgagatgggaggattgcttgagcttaggcgattgaggctgcggtgaaccatgatcacaccactgcactccagcttgggcaacagagcaagaccctgtctctaaaaaaaaaaaaaaaaaacaaacaaaagatgtgatgattgcctctttcggttatatcctgctgcctaagagcccaccccagaatttagtggcttaggataaccattttcatagttttgtcagtgagggattagggaagatgtcagctgagctcttcatttctgctccagatggcattggttgggcaatgggactggaggttctaattctaagatagcttcttcactcttatgaatagctcctcagtgtctgtggccagtctctctccatgtggtatctcatccaccctggcctttccacatgccttaggcttcccacatcatggtggttcctgggtagttactcttcttacagagtagggatgaaatgaaagcctctattctaaattcagttaaatactggtacaaatatttagtactgggattgtgggatcattttcttatatcataattataacccaatcagggtagaaaagtgaaagaaagaaggacacttcattttctttgctctttgtgtggatgatgggttgtacaaatagcaggaggttcaacttttggcttgttttggattactgagtactatccttcagaaatgatttcctaatactttcccggccatctggcatgagcacagaagaccttttactcaataaaagtaagctaataataataagttgaaacatcttgataataaatatatttgtacagcttttcaaatcccaggttattgaaattctgtcagccttggctggtttccatgctccttctgtgcccttgtgtttcctttttttctttttttttttgttgagccactcctgctgacttccaaaggatgctctgagctctaaaaggaggagcagttttgctggcatgcagaagtggtgaaggtaaggcttggattcaattacagtaatctcagaagttcttggtagaagaggggcacagaatcccagcctccattttgcaggtaaggaagaagaattataaaaagataaaatggcttttcttaatgtcagcatctgattctttaccttctttcaccctagcaaagattgttaacataaaacagatgttccttggacaagagaaaagtaatagagctggatcttttcatgatcctgcatttattatttgtagcactggatctctaaactaggaaaagcaatgtcgattctaactagaaattatggggcatttaataacacgtgaggcaaaattatgaggaaaggcaagaaaccaagtggctcctagcttctaacaccttattttctatggtgtaagttaatgaatgatccatttttaatgccataaaaaaggaaatttccgataggctttaccttaacttcacgttgctgtttatattacagacaaaatgctaaagttaacaagtgtaaaatgccctaggtcagggtttcgagtgcccataagcaattctctagaattattttgagtgctcagattatagatttgcccccataccatatactgtattacctatcactgcaagattctttatagggtgtcaagtatgtgggaggatttaaactaattgtcttaaatgcttcatgggataggagatgatccaatgggaactgaatgttttcaattaggatgtttccatggatactattaagcatgccaagattcatagccacaggagatttttacttacttcaatattgattaagaaatctgagaacaatctcaagaagtgtaggatgtaggcggaggataaattttgaggatagtctaaaatttgctttctcttccatagttaaggcctagtccagaaaaagtctaggcagtcagccaagtctaacagcaggatttatgtcaagagaatgtccagaataaaagtgaacatgggttgtttcatttaccccaggtgtatttattaacatttatttaatgttacttattatttgtttattaccattagctttcttatgtactcggtacaaagcattagaattacaaccctttgtatctttgttgtttatgaggaaaacatcctaaatagtgtctacagacatcttaaaattcacattcctctgagaaaggtttatcccttaggttattacttttttttttttttccacacatgggttttttacctgggttctcagatctccaagaaatcggtggatagaattcaaggtgacttcttggatggagaaaaagtacgtctttattttgaccaaccatggatatttagcattttcatcaattaatgaatgcaggtgacaaatcacagtactattggccccatctttgagtttgtcctcaatagctcacagatattttcatattgtatcacagttgttgcagatatcttgaaatattgtttattctaatcactccttcaaaatttgggtggttattggcattatcaccagttttttttttttttttgaggcagtctttctctgttacccccaggctggagtgcagtggtgtgatcttggctcactgtgacctctgcctcccaggttcaagtgattctcccgcctcagcttcctgagtagctgggattacaggcacatgccaccacggcccggctaatttatttatttatttattctttattttttatttttaaattttttttagatggagtctcactctgtcgccaggctggagtgcagtggtgtgatcttggctcactgcaacctccgcctcccaggttcaagcgattctcctgcctcagcctcccgagtagttgggactacgggagcgtgccaccacgcccagctaatttttctattttaagtagagatggagttttaccatgttggccaggatggtcgcgatctcttgacctcgtgatccacctgcctcggccaaaatgctgggattacaggcgtgagccaccgtgcctggccacattaccaccagttcttgatacttaatgccataacaaaaggcacatgtatcactatatcacaaattagcattttataatattttaataacgttttcaatataagtggcttcccttgtaatcatatattttatttttgcacttaaaaatataattcctaaaagggatccataaagcttcaccagactgccaaagcgtccatggcacaggacgttaagaaccctgttccaaatggaatgaagattagaagcactatcatatgttcattttctgatcgcagtttaagaaagagtttcctacttaagtgcttttcacagaaaatctaaacttaaaggttaaaagggaattcttttgtgctggctcatgtgtgggccctacaaagtactttgcagtcatatctgactttcgtttgagagtttgtcttcagaaatggaagaagaaaaggcattcaggtatatgacaggttgcattctgtagaacattgttaaatctatgggaggggagaaaagttccattcagtgtcttgtggattgtggtaggagtcagttgtgttcttgcagaaatttccctagacagtgcctcttgcctcctcctttcttgtcccacagtactccatggagcagatgtgggaacttggatgcctgatgggaattgtaaccccatgctttgccttatcctggtggggactgatctgaggtttatccattaaactgtatcagttcatggctgggagtaggaatgcagaaaacacaagcaaaatgactgcaggaaggtttaaataaaatctcatatgtggcttttccttaacacattattttgcaaaaagtggcagagtgaatttgctgtgatatgataggatcattctggacttttacttaatttacgtgttctctagcagaatgctgaaggagcacacataaggagtggggagttggtatttggttctgtgacaagtgctatcttataacagaaaaatacatatttttgtgaaacttcaaatgcatttttattccccagcacatctgtgattctggatccactaccttcttccaagtgtgatcaagcactgtacctgacagtatcgattatccttacccgtaggcaaaaattgtattacatttattttacagtgatctggaaaaaaaaggatgacaacaaaaaccagacacacttcatttctattccggtaacattttttggtaataatttattactgtacaagtcacacaccatataagtcacacatttaaagtgtcaaattaaatggtttttagtatattcacaggatcgtgccatcatcacagtcaaatttagaacacttattacccccaacaagaaacctcatacgctttagcagtcaccctccattgccccccagttttctaaccccaggccctaacaaccactaacctactttctgtctctatgaatttgcctcttctggccatttcatataaatggaattacacattttgtaaccttttgtgactggcttttttcacttagcataatgttttttaaggtctacctatattagagtatgtatcagtactttattcctttttatggccaaataatattccattttctggatataccagattttgtttatccattcatctgttgatggacatttgagttgtttccactttgtgctattattatgaataatgctgctatgaacattcatgtttacatcatgtatacattttaatgtggacatatgtttttagttatcttgagtatatacctaggagtggaatcatatatatatgtttttaaaccaaaatcaaattttaatgttgcagaatccctgaagcacttttaggaactgttcacttccatagaacagtttgcaaatcagtgttaaagtggagagagtgttgatttttttgtgcatgtatttggtagacatcgtttgaatcttgattttataggctgtgtgaattttgtcaagttacctgtgaacatctttcttctagtatagaatgttagtacctctggatgtttcacgagttgatagactgtattattgcttgaaaaattcactgtccatttattaccatcaactttggccacggatttgctttggctagtggcctgtgaggggaagtgatgtgtgccttcttccaggcagaagctggtggtttgcctcatctcttttcctttctgccatgatgaccattgatgttccagttggacacaggctccatcagcttgtgtatcagaatgaaaatgatgtggggcagagccctcatagattttgttgcatgagtatggaaaaagtgtcattttaagccgtcaagatttggtgactatttgatactttagcacagtggtcctcaagcaatggcagttttgcatttctcacactgagatatctggcaatgtctggagacattttttggttatcacacatggggaagtgctcttggcatttagtgggcagatgctgctaagcatccaacactgcacaggacagctcccacaacaaagaattatctgatccaaaatgtcaatagtgctgaagtttagaaaccctgctttagtataacctagtttatcctggttaagatagggtgttgagaagattaaatggaaaaaaaatatataaaatacagcacacagggtggtctttttttggtaattatgtgacagagcttggcaatggctctgaggtcttcccttgcatttgtgggtcttttccaacttccctagggttcagtattcagtttaattgtagttgtgtttataaatcaaggctcgtttttagcagaatcatataccctttaaaaaagggggagaactaacattagatgcctgtttggcaccaggctctttgtatgtgttttgaatttttacagatattctctgaaactgatattccttacctccattttgttttgttttgttttgttttgttttgagacaggatctcactgtgttgcccagactggagtgcagtggtgcgatcttgtctcactgcaacctccacctcctgaattcaagcaattctcctgcctcagcctcctgagtagctgggattacaggcatgcgccaccatgcccagttaatgttttgtattttcagtagagatgggatttcgctatgttggccaggctggtctcttaacttttggcctcctgtgatcccccagccttggcctcccaaagtgctgggattacaggcatgagccaccatgcccggccctccattttgtttttgatgaagacattgaggcactgaagttaagtaatttgaccaagatcacatggcttataagtggtgggcctagaattcgaagcacatctgtttgcctccagaaccctcttctttccacactgctatactacctctttagcagtgactttaacatagagaaatgaaggtaatacctgatttctaacaattatgtgttgtattagttatctattgctgtataacaggttacctcaaaacttagcactttaacacaacaaacagttattgtctgacatagttttgagaatcagtaatttaggggaagctaagctgggtggttctggctcaggatctctatggagattgcaaacaagttgtcttccagggctgcagcgatctgaagacctgattggagcaggaagatccacttccattgtggtgcactcacagggctgttggtgggaggcctcagttcctcaccatgtgggtctctctttagggttgcttgattgtcatcatgacatggcagctggcctccttcagagtgagggatctcagagagacagcaaggcagaagccacaatatcttttgtgacctagccttagaagtcacagatgatcacttctgctcttttctattggtcacatacacaaccctgatataatgtgggagaggatgatacaagggcatcaagaatactatgagatggaaatcactgggggccatcatggaggctggttactacatgttaatgatcctcatttgccatagttacaaaattatgaattatatttccttttcatattctaatattccaaacacctgttttgtactttaagatacttaaatcatttagaatgtgagtgaaaatacaaattggcttttgtaaacacttactgaatgggtaaaataaaggccgtggtacagatacttcattggggaattttttttttaaataggtttgactagctgaggcttcttgaatcctgaaaagtttggtctgatgtacttttttttttttcctggaaaatctccttgtaccaaacactgaattcttcatttgccaaagtccacccaactttctgatgtttttattgctggtttgatgtgcttgaatgccagccagagtataaggtgaatggtagatgcaaggactgtgcagtttccacggagacttctttcaggagcccttcattttttcattcagctattgctgggaggcatccccttccagttaatgtgtggtacacatcaatttgagtggctcttagaaaggggctcagtttatacaaattaagaattgaggttttttttttctctgtatatcttcaacgttaaattagatttctatgaaacttgaagatgttaacaggaaatcttcctgaaacagtttaactatacttttgtttattacacttgattttgagcttttgggaataaaagtagggtcctggctaggtacagaggtatatggatttactgtgtctaatcgtgcaaccatgaaataaacgtttgcacttcaggaatcaacccatcactttttaaccactgttgtttgcattggcttagagctttgtgcttccttcaactattttccttttttctttcaaaactgtgttcagttggttgtgaccaattttacacagagactggctcactcacttatgttcttgactcctgctgtcccaatatcatgcttcatttacacagggatagcttttcctggctttatctgttgacttgacatcctgtgcatcatatttcttttcttagatatagagaagactgaaaaaaatccacgatttgaagaaaatttgcaaaagtgcagagcaatgtgaaagagatagctttaattttaattttcactgtagtcagaataggtggcctcctgatgggcagacttgctttctcattttactctgtccagtgtagatacccagatcaatcaaggtcaagctggtctggtcattaatacaacttttggttttaaacacagctgtgtacgggggttcttagcattattaatagaggttataatgaaaacaaggtatagtcatacagttgtctgtgtgggtagtggcatggaggtggagttgttgcttaagatctgaaagtcaggaagctggaggtttttgtaattttattcattatcaatcttaagaatttattttgatcattataaatgcatgactggtgctattttccaatcctgaggttttttgggaaatttttttgaaaagaggccaggatgaggataaaaattaattttgaaaatccatttcaaagactcattatgctatgctccatcactgcaattttaatgcaacttatatattgtgcttttacctttgggactagcattcttaaaagctgacttttaatttggactttctaatatgtgtcggctctgtcagctcacgagtgtgtttttatctgtgcatcatgttatattgggacctgggtggaatgtaaatcttttactggcctaaatctgagtctaatcctctgcatggctttggtagaaaatcaatttcctctgctctgtcaagatttttcaggtcagtgctctttggaagtttcccagttctcttagattaaaatagattttgtttctgtgctacatactggtattagttagtaggacactgggatctaaaagcaagagaacagaggcagacaagatatccatgagttcttctatttcagttaacttgttgacacactgcacctttgaggaaccaaggagtttgtgtgctttcaggcatcatttgggggagcaattgtaaatgactcctgtaggtgaggctgtgcacttaattttaatgagttcaggttcattaagtgacctgctcactgggtcattagaagtgacctcactagaagtgaatggtaaagagaagaactacctaagttccactcagcttgtttcactactgtggggtattggaagtagagtgacaacttggactttctcagttttagcactgaaaagtcccacatcccaggaacttactcagtccccagcaaactagggggagcgggggatggttggtccccctagcagtgaaaagtaaggggatggatgatttggaactggttagtacccttatagatttttttttttttttctgagacaggttcttgctgtgtcacccaggctagaatatagtggcatgatcatggctcactgcagccacgatctcctgggtccaaatgatactcccacttcagcctccccagtagctggaactacggggacaagccaccacacccagctaatttttatttatttatattaattaattaatttatttttttgtagggacagggtctcgctttgttgcccaggctggtcttgaactcctgggctcaagtgatcctcctgccttagcctctcaaagcactgggattacaggtgtaaaccaccatgcctggctgtcttataaatactttaaggagggatttattagagacatgtagcaccttgctgcccagtgatgctagtaaatgagtgactctactttgatttgacagaagaaacaatggaaagaggagagatggaagtttttctacctaaacttcctaagaggatgtgtttaggggatgtgttggtaaaaagttattagcattaatgtttacctgtatctttctcatagataatgcaaagacctttaactccacttatccctccttttaacttatgttgttattgccttgtattttaatactatatattaaactctacaagacatcattattttatgcaggcattgtttatttaatcagagttcagtaaactttttctgtaaatgccagatggtaaatattttaacccctgcaggccttatagtctctgtcacaactactcaactccactcttaatagtgccaaaatggctatagacaatatggaaatgattgtgtgtacccatgttccaataaaatttatttacagaaacagacagtgggccagatttggcctgcaggccttactttgacaactcctaatttagatttatctacatatttatttattttccctttatttcttgctatatctttgaggttctacctgggatcattttcaaggcaaggatgtctattctcatcactgtttttcagcgttgtgctagaaattccaaccagtgcaataaggcaagaaaaggaaataaaaggcatacagagcagaaaggaaaaaaaaaatgaaactggccaggtacagctgctcatactttgagaggcgagctaggaggattgcttgagcccaggagttccagaccagcttgggcaatgtagggcgacccccatctctacaaaagtaaaaataaaaaaaaaattagcagggtgttatggtgcatgtctgtggtctcagctacttgggaggctgaggtgggaggatcacttgggccttggaggtgaagtgagccatggtgactgtatcactgcattctagcctgggcaacagagtgacaccgcctgtctcagaaaacaaaacaaaaacctgtctctatttgcagatgacatgattgtctacatagaagaccctgagaaatctacagtctacagaataactcctagacctaattaagtgagttcagcaaggtttcaggatataagataaacatacaaaaatgagttgtatttctacatactagccataaacaaatggacactgaaattaaaaatacaataccatttacattcactcaaaaaatacttgggtataaatctaacaaagcatgcacaggacttgtatgctgaaaactatacaatgctgatgaaagaaatcaaagtctaaatagatggggaaacataccatgttccgggtttcaggatataagataaacttacaaaaatgagttgtatttcacatactagctagaaacaaatggacactgaaattaaaaatacaataccatttacattcactcaagaaatacttgggtataaatctaacaaagcatgcacaggacttgtatgctgaaaactacaaaatgctgatgaaagaaatcaaagtctaaatagatggggaacataccatgttccaggattggaagactcaacatagtaaagatatcatttctcccccaaattgatatacaggtttaatgtaattcctgtcaaaatcttagtaagatttttttgtagatataattataaaatttatatggaaagggaaaagaactagactagctgaaacaattttgaaaaagaataataaagcaggaggaatcagtctgtaagattttaagacatataactacagtaatcaagactgtgtgatattggtggagggatacatgtatagatcaacggaacagaacaaagaacctagaaatagaccaacagaaatgtgcccaattgatctttgacaaaattgcaacagcaattgaacggagaaggaaagatagcctttttgacaaatggtgctaggtcaattaaacatcaatatgtcaaaaaaaaaaaaaaactcttgctgtaaatagtacacgttatatgaaaaataactccaaatgtatcacaaacttcaatgtaaaacataaaactataaaaataattagagaaaatcttcaggatctaaggctaggcagagttcttagacctgacaccaaaggtatgatccataaaagaattgataaattggatttcatcaaaataaaaaatacttactctgagaaagacctcataagaggatgaaaagacagactacagagtggggggaaatatttgcaaactacgtatccgacaaaggactggcatctagaatatataaataactttcaaaacttaacagtagaaaacaacccagttagaaagtggaaaaaatacaagaagggacatttcactgaagagcatatacagatgacagataagcatgtgaaaagatgttcaacataattagccactagggaaatgtaaattcagaccaaagtgagctatcactacatacctataagaatggctaaaattaaaaatagtgacagcatcaaatgatggcaaggctgtagagaaatggaatcattcatactttgctgatgggatgtaaaatgatacagcccctctgaaaaacagtttggcagtttcttaaagacactaaacatgcaactaccatatgacccagcaattgcactcctgggcatttatcccagagaagtgaagatttatgttcatataaatgccagtatgtgaatgttttataggagttttattcataatagcccataactggaaacaatacagatgttctttagtggatgaatggttagacaaactggtatatccatagcatggaatactacccagcagtaaaaaggagtgaagtactgatacatgcaatgatctggatggatctccagagaattatgccgagtgagaaaagccaatcctgagtggtttaaataccatatgattccatttatgtaacattcttgaagtgacaaaattatggagatggagaacagattagtccatgccaggggttgagggggcaagggttgggagtaaaatggatagctataaaaggcatgatgaggccaggcgtggtggctcacgcctgtaattccagcactttaagaggccgaggcgggtgaattgcttgaggtcaggagtttgagatcagcctgaccaacatggtgaaaccctgtttttactaaaaatacaaaaagtagctgggtgtagtggcaggtgcctgtaatcccagctactccagaggctgaggcaggagaatcgcttgaacctgggaggcagaggttgtagtgagctgagattgtgccactgaactccagcctgggcaacagagcaagactctgtcttaggaaaaaaaaaaaaaggcatcatgggtccttgtgagcatgaaaatgttctctattgactgtgtcaatagagacacacaattatgttgtgtgtcacaaccataatcacaacattatggttgtgatattgtactgtagttttacaagatgttaccattgggaggaagtgggcaaagggtacataggatctctgggtatcatttcttacctctgcatataaaactacagttgtctcaaaaggtttaattaagaaagtatttaagaaaaagaaccccaggatctaaaaagatcagagtcagagaatcacaaatgctaaataagaagcacttttgtatttggtgatgttctgaaattctggctcagttttgttatgaaatggagccacgtgggtccatgtgagtgagtccctgtgcacaggtgtatgattgactttttccctcaagtgcttctaatttgggatgttcttcactgtgtgccctttgagtgtctcttgcctctggttttttgttagacaaaaaaaccagtttttaaatgtcagttccaaggtcttttctgggtacggttaacttttatgatttcatttatgcagtgggttttcacctaagggccatggtttctagacactagactcgtttttcccaagcgattcatctctttgcctgtgggatggagagattcattctcttcttctcttttgcagtagaaactccagttttgagctgggcacctggatgcccagagtaaaggttgtactgcccacatttcattgtagctaggtgtgcctgcgtgaccaagtatgaaccttctatttagattaagccacaagataagtggagctatcaattggctttaacaaatatttagtgaataggtaaaataaaatactttatataagagctgtgtgttctgggttgaattgtgtcccccacaaaaagatatattaaagtcgtaacccttagtacctcagaatgtgaccttatttggaaagagggtctttgcagatataattaatttcaggtgaggttataccggagtagggtgggctcctaatccaatatgatgagtgtcctcagaagaaggcagtcaggcacatgtaccctaaaacttaaagtagaataaaaaataaataaataaataaataaataaaaaagaaggcagtcaggtgaagacacagacacacagtgggaaccccctatgaagatgaagatagaagcaatgtatctacaagccagggaccgcctgcggctgcaagaagccaggtgagacacatggagctgattctccctcacagcccttagaaggaacgtgccctgctgacaccttggttttggacttccagtctccagaaccatgggataataaatacatttctgttgtttgaagccacccaatttgtggtactttattatagcagccctaggaaaccaatatactatgcttttgatattatttttaggatgttgtggtttgaatatttgtgtctcccccaaattcctatgttgaaacctagtctctgatgcgatagtattaagaggtggggcctttaggaggtgcatgagggcagagcccttatgatgggattagtgttcctagaaaagagacttgagggagcttgtttgccccttccagtatgtgaggatacagcaagaaagtgccatctatgaggcagagagtgagccctcactatacactgaatctgctggcaccttgatcttagacttcccagcctccagaatggaaagaaatttctgttgtttataaattactgagtctaaggtattttgttgtagcagccccaacaaactaagacatggagtattttaaaaaatgggttgaacattcagaggcttcttaatctgagtccttagatatttggactgactctgccttctttttccagtgaaaagatctcgctgtatgaaacatagacattcttcattgccccaaagcccttccaccttccttatgtttttattgctggtttgatgtgcttgaatgctagccaaagtataaggtgaatggtagatgcaaggactgggcggtttccatggagacttcttgcaggagcctttcctttctcagttcaacagttgtcaaggaaacatctagtttcaattaaataaatgtttgtggggtctgccaatttgagtgtctcttggaaggggatttggttaaacttcttaaacatcgtaataaacaaattcagagcagaggctttttaggttcccttccagttatattaggtttttctgtaacttagggatgttaactagtcctctgtctgaagtgatcagactatttattcatatccagaaaatattatttttgagtcttgtggggaggaaaactgaggcttaaagaaagagaggccaaagccagggagctggtgttacatggcaccagctatatatacatgactatagtccatgctctttagtacgtcctgcaggataagagatccaaggggcctgacctttacaaactgtttacaggctatggagtttgctggctcagcactgtgtgtttattgcttctagttagctattgttgtatcagtggctggagttggtgatggttcacggaaatagtggtgagagtacagattctaggtatatgcaattctaataaatgagacttccctagtgttatctgtattgtgacagcctccccattgtgctctttatcaaacagtaaggtatggtatattgcaaaatgctcacaatactttgcaactcttcccatcaagaggtagagtcagtttctctattcttaggatcttggctgtcctgttgatttggtctgaccctggaatacagtagaaaagaccctgtgtgggttttgatcctaggcgtgaggtagagcttcagtttcttgctgctttgggaactctgccaccttgtaaaaaaagccctggctggcctcctggaggaagagagactatgtggaggaaaatgaaggtacccagacaacccaatagtcaactgcagaagcataagtgaccctcatctgagatcaatggtgcctggctcggatcagtataattgtccagctgaactcagcccaaattactgacccccagagttatgaattaaataaatgctgttgctttaaggcacttaagttttggggtggtgtgttatacagtagtagataattgatacagccaagtttggaagctctggaatgatcagggctcacctttgacctgtcctctataaaacccaggattcttagtaacacagtcctgttaataacagaacttgcctatggcaaatctaagcggaaaagcagtttattggcaggatattgtgtagctacatctttctttaggaagaccagggacaaggcttgaaaactgcacaactagggggcagtactgccagaactacagccagataacctcacagaattggtagctactgaatattggatgcctccacctacaccaccaacattgcctgcattggacattgggtatggggctgctcctggaactggatgttgttcctgtcactagaaaacaatcatctactgttcttgctgtttcacagcactcattactgattcagatgcccgtgtgccacgtgtttatagcagtgcaatttgtaattgcaaaaatagggaaccagcccaaatgcccatcaatcgagtggataaagaaaatatatcaaaaatatattttatatgtgtgtgtgtatgtatatgtgtgtatatatgtgtgtatgtatatgtgtgtatatatacacacacgtacatatatatacatatatatacacacacgtacatatatatacacacacgtacatatatatgcacacacacatatatatacacacacgtaacatttataatacgccatggaatactactcagccataaaaaggaatgaaataatagcatttgcaacaacgtggatggagttggagaccattattctaagtgaagtgactcaggaatggaaaaccgaacgttgtattttctcacttataagtgggagctaagctatgaggatgcaaaggcataagaatgaaacagtggactttggggcctcagagggaagggtgggaggtgagggataaaagactacacattgggtacagtgtacactgctcggctgatgagtacctcaaaatctcagaaatcagcactgaagaacttaactcatgtaaccaaataccatctgttcccccaaagctatttaaataataataaaaacaaaaacaaatgcctgtgtgggtggtgtctggcagagcgtaggtcttgtgcccataccctgattgaaaagaaatcaggaaagtgagaatctgacacttttagcttatttagctgaaagcaggtggaaaatttcataaacactggcaaagggttcggataacaggcagccaaaagaaaaatggcaaatgttcattagtttctgttgtatactctggttagctcagttggttacagcacagttatgatgaagccagcattgtggtttgttcttaagttttattgaaagaaaatagttctgagattgtcccccttacacctgctccctctctcacagatgtgtgctgatagccatttgtaaggccaggcaatagtggggcctaacttgcatctgtctctggctgctaaggtacaaagattatgtgtctttcagttggtgggcccagagactccattcactggcatagtgtgccacataagagaactgaatgaatggtatctgtgtgaatctaaggggttggctaattgcgcagtgaatttggttcatgtaacatttataatacaaattgttgggcagcaagatctttcaatccagacggtttctagtttttcagaatttctctgataacttctctgaactctgaaattcttatttgcaaaaccatctatatagggttcatttaaatattagaaatagtactcataaagagaaaagcataatgcctagaggatgtgtaatagatgttcaataaatgttgatcatttccctcaaacttcttagattcacacaccccaaccagattagaaactctgacacggcttgccctttttgtgttcaattctctctcagttgttaagtgaagacccaatccagttgttaaaataataaatgcacctcttgcctccctgacattctggcaaccttactctgaggaggctggcccggttcgaagctggctgctccagggcactaaagctggagaagggcccttccaccctgttcataactgtggacagtaaactgtatttgggatagaggatcttgggaacaataaggacctagatccaagctcatgcattgtggtgggactgtcaatttagggggatgggtagattttatcagatctgtcagtggaaagtttggggagatggaatagtatctacaggtagttccaggtaggaggaagagatctacctggctcctagggatgtccatcctggcaagcattgctcagtggcaggagttgtaagagtagggaaggtttaggaatttggatatcagggaagtgtcagcaggtagctggggatgaggtgcaggacaaagacagacgagaggaagaccaagccttaaagtgatgagtatctagatagggaagaggatggatgggtatagcttggacacagaaaggggattcagtcatggaaagaggtcagtctgcaatgtaatgtggctatcaggtcacaggagggccaagagcaggacaggtttggggcttggttctggttagtcgaggcagagccccttagaggtgtttggatttgccatggtgatgcaggggacctgagtgtgctggttgtcatgagatcttgttgctgggagaacagtcaagaacagggtagaaaggcccttccccagctttagtgtgccttggagcaggcagctttgaatagggccagcttcttcagagagagctgccagaatgtcagagaggcgagaggtgcatttgttattttaacaattggattgggtcttcactgggagctctacaaagaaaccaaattagtgaagttagattgcctatcccaccaacaatggatgtttatggtatgagtttagctctgtgctagagaatctcaatatatttagatttgggcttgagagagagaacttcagtgtgatctgagactgaacttccattcacattcattcctcgaggaagcatgttgaggatctatgtgtaatatactggtgttccatttacttgaaatatcctggcttgctctattcctctcacttaggcactcactcctctaaaaaataaatgtgtatatgtgtatgtgcatgtgtgtgtacatgtaggtgtaagtgtgcataaaatatggaatagactgaaatcaacaaacttataaaaataccaaataacctcaatctgtaattttatttttgagaagcactaaaaatgtcaataaatgaattgtctgaaaaactaatcctttggctggtgagataagtctgagttgccagaaccagttaaagctttatataatttggcagtacatttgcgttcacctgagatttctctgcctccagctgtacaaaaattctgtgatatgcagagcctcgaaacctgggccagaatgctaaaactaattttctttcgtaatctgagccgtaattgcattttaactcagttctagtgtgaagactgcttttgtatgtgtgtgtgtttacttcatgtcattaatttctggcatttaagttagtgcctggcacatagtctaccctcagtaaatgttagttcttactgccgagtctactgttctttccttctaaaccagtggggtagatgcttcctttgtgcctcagtggttcattcccttgccctcttcccctctcctcacccttgagttgttagatcctggttttgccccaggcaggtgccaaccccgaggaactcctgaccctgtggtgatgcatgcctgcatgtgtgcagccagctgggcagcttggaaagccatagtattgacttgccaaataaggactagtttacaaaagtcataagagatcactgtcatcaactgctatcactatctattatcctttctctttccaaaacacaatttaggtgcataataaaaacatctgtagaattactctgtcaagcctatgtatgcccatcagttgtgcaagagcctcagttcctacttctaatgaattttatactgattatcccagacctttctgccagctccctaatagcagaggagagaatacactgttggagtcaggggcaaccaaagcagctagtctgagtatagaatttctttgaattctcatctttaagaaccatgctcagctgggcacagtggttcatgactgtaatcctagcacttcgggaggccaaggtgggaggatagtaatggcctggtgtggtggctcatttccataatcccagcactttgggaggccaaggtaagcagattgctggagtccaggagttcaagaccagcctgggcaacacagggagaccccccatctctacaaaaaaacaaaaaagtagccaggtgtgatggcacttgcctgtagtcccagctatttgcagagggctgaggcgggaggatcacttgagcctgggaggttgaggctgcaatgagctgtgattgtgccactgctctgtagcctcgaggacagcgtgaccctgtctaaaaaaaaatggatgatatatccacatgattcagaattgaagaggtacaaaacaataaccaataaactctttctccccactgtgtcctagccaccttgttttcttccctggaggcatccagaagccaattttgttagtttcaacttctggagatggcttatgaaaatataagtaaatgcatctatattcaaccccattttagaagaaatgatacctactatatcagctgctttctgtgcaccttgctttttttctttttcacactttagcatgatgatttttctgtattggcacataaagagcttcttctttgttagttggtggttcttatggcagacaactgaatccaccctagatggttaagccaaaaagggattcggattttaggtaactcatggaatcctttggagggctggaggaacaggctagcatccgggtgcccagaaacaaagccccaagacacacgtagtactagcattaagtggaagccacctgtgctgctgcctccactgaacagcagatgctaggtatttgacttgactgcaactgcctctacctccactcctgcaccgggaaggcaacctagcagtgacacctgcaaaagtagaagctctgagcagagcctctttccttacatttctcacttctaaagcaaaatctggtgtggatgtatctgattagtggtgactaggtgacacatttgcatcttagcttcaatagagtctaggaattttattctcaacttttaaacttggaggtgggacttgtaataggtgaaatttttgcaaatagagaaataattttcaaagtatgatggacagtcacagatatggcaaatgtccactagagctgcttagaattccattgtatggatcaaccacaattgattaaactaatatcttagatggtagacctctaagtgttttctagttttctagtctgtgacttaggcaatactgtattaatgaccatatacatgtgtcattttgctaatgtaaaatggaatataaatttctagcagtggaattgctagatcaaaaggtaaattgtaattcttgtggatattgccaaatggtttctggatgctatactgattttttgcttccactagtgatgttcctgattttttttttttttttttttttttgcacagagtcttttccttttttagattccttctgagccagagtggcaggctgagtgttccctgctactggggtgagttttgggccttgggccaagaatgctgacaaatcagatctgggccataacctatgccaatatagactgtatttagcatctggactggatttggcttatagtttattgtagtccttctagccctaaattaaatggcatcttggggtatctaaaagataatgttgcttccaaaattgatttgcaatgtgggagtagcttacatcttggattgttatgtgttcacaaatgcataaagatgttttcaaagaatggttctaaagaattataataccttttctttttaaaaaagcaaaatcttggccgggcacggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaaatcttatttctagtgtgtgaactattgcatagattttgccaatatctgaactatggcatccaattgctctggttggttgccatgaaagtttatagtaacataggaagctcctgtttgaaagctcctgaaaaatttaaacaaatgtatataaatgggtgaaaaatgggggctgaggaagaaggtgaatacatgtgttttcttctcatggaagtgttcactattttttattaaattttttttagagacagggtctcactatgtttctcaggctggtctcggactcctgggcccaagtgatcctcttgtctcagccttccaagtagctgggactacaggcacgggcctccacatctggctgtgtttgcagtctttaagttggcatttacctagtgcagttgattatttcaagaaaatacactttctacatggctactgagggtatctgaaaggatataaagtatagcccagggaagtagcatgttgttaggcaggggttagtaactctttctggaaagggtcagttggtattttaggctttgcaggccaagaaacagaatcaaagatattacataggtaattctataacaagagaaaaaataaacttctacaagctttttattgacaaaattcaaaacataataactgaggacttttttttttggtaatacaggtctactcataagaagaacagcattcttactttggggataacattttgcttaatgggattcaaagaatagtgttccctttcatcaaatcgattgcaaatgttcatctgtaaataccatttattttctccttgtgggccatagaaaaccaagcagtgggctggatttgacccatgagcggtagttttccaaccactgatgtaatggaaagaccatgagctttggacctggatgcatgtaggtttgagtactggctctgaatttgtgaccttgaacatatcacttaactttctgaattgggaaggtttatttgtgtataaactgagtgtaatgacacctatctcatggaaaaaatattacccccatctttgtgattttgcattagtattctagttctgtagatgctgatatgatttagctagacttacctagaaaattagtatttaactgattttaaagctgacttttcaagggatagaacactcacatggtcttaaagtacaatgtaaaaacatagctttgcaatgaagagatctggcagtcaccacattaatcaaatgaccaagctttgcaatcagtaccaatggtgggatgttctgacattgtgtgcccctcactgctgtgtacctctcactatatctcagtatcacctgtgtggtgttcttgccagaaacttttgactttaatgtaatcacaataaaacagacaaatccaaaacatgggatgttctgaggacaactggcctggattcttaaatgattcagtgtcattaagaaccaagggggattgttctagattagggggagactaagggaaaatgagataaaaatgcagtgcatgaacattgactaaatcctggatgaggaaaagaaaattcagctctgtaggcattttctggataatcaagggaatgtgaatgtggaccatatgttgtatgttagtccattttcacgctgctgataaaggcatatccgagactgggaagaaaaagaggtttaattggacttacagttccacatgcctggggaagcctcagaatcatggcaggaggcaaaaggcacttcttacatggtggtggcaggagaaaaatgaggaagaagcaaaggcagaaacgcctgataaacccaccagatctcatgagacttgttcaccatcacaagaatagcatgggaaagaccgatccccgtgattcaattacctccccctaattgttcaagtccctcccacacacgtgggaattctgggagatacaattcaagttgagatttgggtgaggacacagccaaaccatatcatgttgtatgataatattgtgttaaagttgatttccttgggtgtggtgatgatggtgcggtggtgtacgaaaatatccctgttcttagaaggtgaatagtaaagtacttaggggtggtgtgtcatgaggtgtgtctgtaacccacttttcagatggtttggcaaaatgggagggaaggagggagggagagagagaatgtgtgtgagtttgtgtgtatgtagaataggtgattctgtgcattgctgctcagttcttagcatagcactcagcacattgcttttgatagggaggtgcccaaccaaaacttgttaaactaacaagtactttaaggttttagtaggattctctgaaatcacacctcagcactgcctgtctgccctctctttagcagtgtcatttggcttaggcatatactataatgcctaatgttgggtaatcagatatgggggttcatgttttcttgagtagctcacccatgtccctctggactgaaagtctctcttgaatgttacagtataaatgaatgggaaaggaaaacccagcatagaggttgacctgcgtgttcagctgttccctgagaggctgaggtacaatttgtaagcatgtacttcagattctcttctgtatttctgttgctgagtttgcccacttggggagggttgacacctcctggggctgtgctgagtaggaggtgcatctctggagttctgactggctggagcatcactgaggtattctcctgggctatgagggctagggccaggataaagaatggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatatagcaggcatagtaaagtatgagtcctgggggatacaaataataagaatataccctcgctttctgctgggcacttagggcatagggaaaggagatgggctacagtggagataattatcaaaataccaattgtgctgtgttgcaaggctagggatgtgttagaaagctagtaaaaagtgttatgggaatgcagagaacatgccatgtggaattgactacagtttcaaagataaggttggtcttgaggtgacttgaagaatgagcctggcaggcaaagaaatgggcatctggtgtgactaaagtcttaattagctgtagggtggggaggagagagacatgacgatgttggaaaggtagtttgggccagacaggagggcctcagaagccatgcttggtttcacaggaagggcgtgaagagtcccagaagccctttgaagttggagggtgatgtggttttgataagaggtcacggagggaatgtagaagctggtgtgtgaaggtgtgtgagtctggagacaggacttgaaacagtcgaggcgagagcaaagaatctggattttgctagctgcagcagagggagagtagaaaatggggtgctcttggagaattcttccagcccctcctactaggagtttttacattttcaaatctttctaaggaaacctttaataatacttgagagaagcttatttaaacctttgaacagttctgaaaatgtattacatttcagccaggaaagaaagtattatttcaggcaaactggaacatggttactcagcacagtcgcctaatcttatagaattaggtaggagggaagctatgttagtggccttcaaccttcttccagaactttgttcagatttctcccaaatggtcggtgaatttttctgatttgtatccagcatcccagccatttagtgtacatccgtaagctgtaaggaagttgatttaatctatttctttttttcatctcttgccttccacctgagaaaacactactccataggttcttattctgtattaggaatttgcacaatgtgtaacctaagatggatccagctgggagttggatccagctgggagtgttacaggtttggagtttagactaaagaagaggagtggaatcttttcatttttttcccctttattttgaggaaagcccagtgatttggattgtttgaaggatcaattatatcaaatatctccactaattgagtatctgggataaactttttttttcaccttattttctttagataccattaagcatttcgacccacaacttacagcttttccatggagattttaaacttagaaaactttgaaccttgatgaatgaaaaaaacctttcagaactaacctttttttttttttttttgattcagaagtccatgtgtaagttccaaaggcttataattcttttctcttccttgaggcttgactatttcagaacgttcttggtatgtctcttggaggtttggtgtacaaagagcaaggaaagtaacctatgggcttaactcacttatgtgtatatattctactttggctccaaagcaatgattctagtggtgatatgggaccaagggacagatttcaaggtaaataaggctgtttactaatgtcagattaaggtattagtcttcaagtaccataaatgttttactagcaatttcagttacctgtagtaaagagctttccagttccatgtggtagttatggtaaaggagcaactgaaagttaacttgatagtagattaacactcactgaaaatatagttgttattttttcacataccaaggattacaatgtctttttttttttctatttttaaaatagagacagggtcttgctatgttgcccatagtcttgaactcttggcctcaagcgatcttccttgaggcctcccaaagtgctgaggttataggcatgagccattgtgcccggcctacaatttcttaatattaggagttattttgcaagacaactatctcaatgttggaactacactaatgttggtgtgtttttttccttgtgtgggatagtctgtatcttaagatgtgtaatgtatatattcacaataagggctacattataaaattcagagacattttatttttgaggtaggtttcattcacttaattgagaatttgttgactgtatcttgggtgcctatccttatgctaggagatgaatggaagttgccccctgccattgaagagaagacattttaatgggaggcagagataaacagataattaattataatgtgatacatttggaaatagtcacaaaaaacttgaatatggagattttcaaaagtacaaagaataggatattgaaccctcatgaacccactaccaaacttcaacaattactaactcttggttatgcttgtttcacccatgtgccccacctcctcccttcccccttttattttgaagcaagtctaagacactgtatcatgtgatggacattaatagatacttggatagagtactctgagaatacactgggaaaacatactgtatcgggacagggaaaggagctacagaaaagtaacatttgagttcaatctaggtggggaggaggatgttgttccaggtgatgggatggaaactgacaattattacaatgtcttgaaaaatgtgtatatacaacttttttgttcctctgaactgagcacccaagatgtaatttccaagattaggaaattgttttgcctgaggactttataaaaataattaattcacttttaatttagataaactagaataatccatgagtagtggtaatgactaatctgttctcttttcaccccagtgactttctagactttgaacattagaatccactccctgaaaaagtcactctcctttgtaactagagcaacagctatcctttgtcacctttatttttctctttggaagaggaggaataatcagtggctcacttctgaaacatcatgaataggtagaatttagtaatctgaattaaaaacctccctgtaaactgaaggaagaggaaattgaccagtgggcacacagaggttctcaagggacttttttggttagccactaggtgaaatccttgatatttcatcatgtaccttgtctcattttcctgttgtgaaattgggtgttcagcattgtttttcttgtctgttctcagatcacagaactgtgtggtgcaaagcgggttggttattttggtccaacacagttttacattgccctgaaattaattgctgcagcacaatctggcctcccggtacggatagagagtattaaatgtggtgagtatctcacatttgtatgttttattgtccatggcgagtcgctcatttatgagaaccatttttaatgagtttaaacttttgtggaatttctccttgcttcctccaactcttctgcaaaataaaataagaaaacttggcaggtaggtagcttagtttctttcttttttaaatggggaaaattctgagagtaacctgagattagttcattttaactgatttgcagttaaaatagattttattctttagcaggaagagattgggccaggaattctagagcctgtggcaaataatcacattgactttaattttccacttgaggtatctataatgttattgaaggctctgttagaggagtaacaagggagtttgagtggaactatgccttttctctttcccatacctgccagtgctcagcctttaattcttagtttccaaagcactgttctgatgctagtaagtacttgggtgctaccaaaattttggcagaatgaatttatcttcttaaggttctgatttaatattttctcatcttgccatccctgccctcaacccactgtatgcttgagcactttctacaatttaaacaaaaagcaaaacccccaactattagcagtatttctgctgcctcaggattggttttaaaaatctgtatgaaaaaggtgattattcaaggggtgtgccaaggtcctctgataattcagtttgatacagattactttcatatgtccatacaggtatgtaggaactttttttctttttctcattctgagactaaaaacctcttaactgctcatgcctgtcctgtgaagtctctgatagacatacaagtggattcaggatttatggtgagcccatggaaacctcgtaggacaatccaaatggccgagaagattgccatagatggctggctgtggaagaccaagcccttcacactaaccgttagcaggtggcagtcatcatgctaatctttatcagggggctagcttgtgccagacactttcatttaatcctcatgacaccctactaaattaggtacttgtgtcagtttgattgcttaggataagctgcgataacaaatgtcacaatctcagtgcctcaaccagacagaggttcgttttccactttgcagtgggtcagggtgaccctccagggcagctgccctctatgtggtgaccatgtgatcctggctgctttatcttgtggcacctcccaacacaacacctgttcccataatcgccacaccagggaaagagtatctcaccctagcggttaaatgctttggcccagacatgactgaagttattgctgcccacactgcattggccagaacttgtcacattaatctgcttcagtgcagagcaggtgggagaacacaattctctcctgtgcctgcaaggagaggacaactgcgagtctctactatggctgcacactgcaagtctctactatggttatggctgcacactgcaggtctctactatggtgctgccgttgttcgtatcttacaagtatggaaatttgaactttagggaggttgagtaacttacctaagaatataaggttagtagaatttggagccaggatctacttccagtccccatgctcttaatttctatgcaaaatagccttgtctcaattttttctatttagtaagatgctgacagtaatctgttatacaatattttctgaatgggaaaaatattggacttgaaaggcatctcttggtatgacagaattttgttctttgaaataggtttcttgatggagtgtcatttgacaggcaggcttagtattcattgctgcaagacacagcggccatttgctttgattagttgaaagttgcatcacactgaatttggatttgtggtaggcactgatagtttttattccattgtaaatgatcattaagctttattatagtatcttccaattttatcttctggaaaagttagagctgctttattgtatacagaataaacttttgacacttttgttacttattttaagttagacctaagtcttttacctgatttgtgcccagattgacagtttaatttcctgagggcagggagcaggattgttgaagttatcacttgtgtaaaggattaacagtttatcacaaatataaggctttctcagttttattttataaacccagttgctgccttttacctctgagagtttatatatgtccagagttaattctgaattatcttccttcaccactctctactaatccatttaaagattgattaaataaaattatttgcagttagcatatgttgaataagaattagggcaagattgggccaaactttgagctgccacttagaattttccagtttgttgcttgaaatctattagcttaatgcttgatgacacaaatcttgaaggccaaagggatcactctgtgagaacctaatctgaaaggctgtgctagccctgtcacacccagggcatcatacccagggagttgtggatggatacccttatgtcatgaataacatgcacctgtgtgtatgtgcgtgaccctctaatccctagtccttcccatttcggtaaatgccaccaccatcctcagctgcacaagccagaaactcagcagccatcctggattcctccttttccctcactccttaatagaatccatcaaaagtcctagcaatgtggctccaatctcactccctgttgcctctatctctttgtccctgctagaccagacaaccttcatctacttacctggacaccacaatggattgacatcctagcccctcctctcttctctactgtgatctctcttttcccactggttttttgtttgtttgttttttgacagagactcgctctgtcacccaggctggagtgcagtggcacgatcacagctcactgcagccttgacttcctgggtgcaagggatcctccaacctcagcgccccgagtagctgggactacaggcatgcgccaccactccctactaatcctactaatttttgtattttttgtagagatggggttttgccatgttgcccaggctggtcttgaactactgagctcaagtgattggcctgcctcagcagcctcccaactttttttttttgagacagggcctcactctgtcacccaggctggagtgcagtggtgtgatcacggcttgttacagcctctgcttcccaggctcaaatgatcttcctgcgtagctgagactacaggcatacatcaccatgcctggctagtatatatgtctttttgtagagatgggggtcttgttatgtttcccaggctggtctcaaactgctgagctcaagtgactctcctgtgtcagcctcccaaagtgctgggattataggaatgagccaccatacccagcctcttttcctacttttgaaagtgtgatcttttcaaaatacacagcagattattccatcctcatcctttaaaccctccagtagtctgcttgttgtactttgtaaaacattcaaagtccctacactgatctgtaacaccctacacaatctagttcttgcctacttttccatcctcatctcaaatcttaaacccttgctcactacctgttccccagtctcagtggccttctagccatttctgggtgacttttcctgctgcaggccatatgtccattttatcttgcagtcttgggttcctagggatctgtttttcctttctgcttcccctggttggctccttcccaaccttcaggattcagagtctgtccctactatcctacctaaagtagttctgtcagattcattaattcatgaaggaaccagcatatggtaaaactggctcaagaaagtatagagagtcagatttatttatagtcatagaaagaaaggatgctggaatagaattgctaaattaggtataaagctaattaacgccctacggggtaatacaagtgcagcctggctattgtacttttttctaagatgaaagtatttgcattgccgtcagacaagaattacttgttagctaacagttttttccaagttaatatctaccctttcaggattatcaaatgcccaaccaagagtaaacagtaactcagagcagaagtccatatccctaggaagtgaggtgatccttgggtgggcctgctgggtaatgcttctgcagggcaatctcctccccactttgttctttcccagcatctgtttcctgatagcacttagcagagtttgcaaatattccttacaggtttcactattttttttgtctgtcttcctcacttgtccagtttgtgtaagggggagggaagaggatctgacaccccttgcattgtggggcattataggcactctgtgtgtattggttgaatgaatgaatgaagaggtgcatgtctacgcatgaggagggtgtcttaatcatctgccactctttaatctaaaacgattggaattcagattctcctggaactccagaggagtttttacagaagtcatctcagtctgcatatcatctttcttaggcactgattttcaaccttgtcggcacttgagaaccacctggagagctttaaatataaaataaaaaaatacagatgcctgggtccatctccagaaattctaatttcatatatctgcagtccggtctgagcatcagaatttttaacagctctccaggtgatttttgtatggagacatgtttaagaataaaagctgcatcaagcatttttaagagctttgcttaaactgtgtgtgtgtgtgtgtgtgtgtgtgtgtgtgtgtgtgtgtgtagttacagtagctgcatctgaactagggtgctgtacgacacagggcacatgatttaagggggcacttactctcagggcaagtgccgactctacatttacaccaccctgagagtgcgtgcctccttaaatgttggcactaggtatctctctagccccaccctcgtctgagttggggttaaacagatggcaaaacagctagggcagaaggaaagaaggtgaaaattaaggactggtagagaatttctgatgaggaaatcatgtggtgaacatttgccctgggacctgctgttacctttctttccagggtctgaagttgagcacgtgtgaggactgagggaaggttaggcagaacctagagtagggtttctcatcatttttgtgccaggagcccctttggcagtctgaagcctgtgggccctttctcagaattatgttttaaatgcaacaaagacataagattataatggaaaccaattatactgaaataatcactaaaatagttaaattgttatataacaacatacatgcttctaggcctggcacagtttctcatgcctgtaatcccagcactttgggaggccgaggtgggcggatcacttgaggccaggagttcgggaccagcccggcaaatgtggtgaaaccttgtctctactaagttcgagaccagcctggccagcatggtgaaaccttgtctctactaaaaatacaaaaattagccgggtgtagtggcacatgcctgtaatccctgctactcaggaggctgaggcaggagactagcttaaacccaggaggtggaggttgcagtgagtcgagattgtgccactgcactccagcctgggcaacagagtgagactatatctcaaaaaaaaaaaaaaaaaccaacccccaaaacatatatgcttctttattaatgcattaaataaagcatctaacagtgtttgaaataaccactactttttcaaattagtaatatgcataaacagtacttcaagatgttggcccggcatggtggctcatgcctgtaatcctagcactttgggaggccgaggagggtggatcacgaggtcaagagattgagaccatcctggccaacatggtgaaaccccgtctctactaaaatagaaaaaaattagctgggcgtggtgacacacacctgtagtcccagctactcaggaggctgaggcaggagaatcacttgaacccgggaggcggaggttgcagtgagccaagatcacgccattgcactctagcctgggcgacagagcgagatgccatctcaaaacaacaacaacaacaacaacaacaacaacaacaaacaaaaccctaatgtgataggtgacaaagttaccggtattgctagtgataatacagtggcttgttgcctacattcataatggaaagaaatgctaaatttcagttatagtagggaaaatgaagttgtaatttttttttttttcctaatcaaggtgacagaccccgtgatttcttttcactagtccctttgggagcctgtgaactctgatggtgcaatgacatgattcatgtagtctttggggctgtgttccccaaactggtttatggtctggttgcagtctggcacagtttagaattaggacaaaaggatgagttatttataaagctaaatgtattcaaatctaagattgggttttttttggttcctcttgttaagtgtcctttgtgaaactgctaatgggtaatagtttggggtaaaattcttgacgagataaaacattggcaactttatgttggctttcttcatttctttttttgttgttgttgggggagagatttttcctattttgtgaaatccccaaatttgtgagccactgttgtggtcacgattctactgccaagaagatactgaggcaaatcattgaattccctttgactcctcccttatctgcaaaacagttgttctccacctaggtgatttcgtccctttagggactttcggcaaggtgaggagacatttttggttgtcccagctgcggaaggggactgcctggcatctagccggtagaggccagggatgctgctcaacaccctacactgcagaggacaggaccccctcttccaacaacaacaaacttatctaatctaaaatgccagtaatgttgagactgagaaagccttctgtaaaataaggatcaagacttaggaactctaatcctgctgccttgcttcctgtgctctagttagtttttttgtttttttaatcatacaagaaaggtagaaggattttgcagcattgagtcctatttctgtggcttttgttttcaaagaagaattattttattcaaggaaaaataaaagcagttattctctggttgaattgagggtggggttccctgtgctttgcctatttgacaaaccctccctatctcttagggctaggagagaaatcttttgagtgtgacaaccagtttggtaattcatagaaaagacaggataggaagcccaagggtaaagaaagaagcccaggaggtaaggttgtagctggctctgtgtgtgtgtgtgtgtgtgtgtgtgtgtgtgtgtgtgtgtccacacagtgtctctgtattttgaacactaaatactatgttgggatgtctcattaagctaaggtcaactcatcctttctgactgacgtccaacccaatccccctttccttttttttcctcagtgttcctttgtcaatttcctttaccccctctcccagccctgctacagggacacagagctgctttggacaaagttcgcctatgcaggttcactgactgtacggctggacatttgtgttttctaggggtctgtccctctaccccatagcgctgtcattagctctattgttgctcctccccaaaggttctccccaaccttttgagctgtggattttcaccttatttgtaaaaatctttgttgtgggattctttgacaatctagtaaaagctctggatcttagcaggaaaatacacattgacattatgtaaaaaatgttgccttcaatgtcaggggtttctggacccctagagctggttcatggagcccagtgaagagcccttcttccagagaaatgcagtgtatgggatggatatagaggaggtaagttggaagatgcatagtggggaaattgaaggccaaagaggtaaaataaaagggatgctgcttgctagcagcagagcccagtggattgtggacctcctaactcactcctggggttctacccgtggtatggccaggaaattgaacttatccaccatcctcctctgccaaacatttacaagatcacccttcccattgtaacctccaccccgccatctagcgattacctacccatttcctaattgacaagaggtatttcagatcaatgggcagataggaggataataggagactagatagctttgattactcaggcctgggttgataagactggcctgatttttttttttgttttgttttttgttttcccccaaagtaacttcaggaaaatgtgtagggatggtttcactttggaattatagaacattattgtcataattctttgttaacgtataagtagctggtataagtgaataggtaacaaaaagcagtgggagagaagggagccagcagtcaggagtcaagaatttttgttacggtcttagctctgccactgtattgctgcatgactaaggcaagtcttgctctctctttcctgggcttatttcctcacctgcaaaatgcagacatttgagcaggttttctctagattattttctgaaatgccacagtttcatgctaaatgttcaaatctgtactagaaagaattttaatgttcaggatggtagtatagccttgtggctgggaatgtaggtcctagcaataggctacctcattatgaatctttccttcattaccttttatttgtgtggcctccggccagtttcttaatttctctgtttcaaatgactccctggaggaaaaggtataccaataacacctgccttatagacttgttgtaagcacaaaatcagggaatcccttatcaaacattgtagaaaagcatctacaactttgttatttaatatcgtagccacttgccatgtgtggctattgagcacttgaagtgtggcagtgtggctagtgtgactgagaaactgaatttttcattaaatgatttaaataaaaggttttaaacagtgtaaaatattttctgttaaatgcaaccttattgatttagtaggaccacttttcacttcaaccatcaaattctgtaagacaagggtcaacaacctttttctttttttttcttcttttttaaattttattttattattattatactttaagttttagggtacatgtgcacaacgtgcaggtttgttacatatgtatacatgtgccatgttggtgtgctgcacccattaactcgtcatttaacattaggtatttctcctaacactatccctccccccttcccccaccccacaacagtccccggtgtgtgatgttccccttcctgtgtccatgtgttctcattgttcaattcccacctatgagtgagaacatgcggtgtttggttttttgtccttgcaatagtttgcggagaatgatggtttccagcttcatccatgtccctacaaaggacatgaactcatcattttttatggctgcatagtattccatggtgtatatgtgccacattttcttaatccagtctatcattgtgggacatttgggttggttccaagtctttgctattgtgaatagtgccgcaataaacacacatgtgcatgtgtctttatagcagcatgatttataatcctttgggtatatacccagtaatgggatggctgggtcaaatggtatttctagttctagatccctgaggaatcgccacactgacttccacaatgattgaactagtttacagtcccaccaacagtgtaaaagtgttcctgtttctccacatcctctccagcatctgttgtttcctgactttttgatgatcgccattctaactggtgtgagatggtgtctctctgtggttttgatttgcatttctctgatggccagtgatgatgagcattttttcatgtgttttttgactgcgtaaatgtcttcttttgagaagtgtctgttcatatccttcgcccactttaaagggtcagatagactttgtgggcagtatgattttggtcacaactactcaaccctgttgtagtatgaaagtagccatggacagcatgtaatcagaggatcatggctgtgtgctaataaaactttatttatgaacactgaaatttgaatttttaattttttttattttttatttttgagacagagtctcactcttgtcacccaggctggagtgctgcagaggcacgatctcagctcactgccacctccaccttctgtgttcaagctattctcctgcttcagcctcctgagtagctgggactacaggcctgtgccaccacgcctggctaatttttgtattttagtagagatggggtttcaccatgttggtcaggctagtctcaaactcctgacctcgaatgatccacccatcttggtctcccaaagtgctgggattacaggtgtgagccactatgcctggcctgacatttgaatttaatataattttcacatcatgaaatatttttcttttttctttttttttttttttttttttgcaaatattcaaacattgtgcttgcgggatgtacagaaataggcagcagactggatttggttcttaggtatacacccaagataaataaattcatgtccatcaaaaaacatttataagaatttcacagcagctttatttacaatgggcccacactggaaacaacccaaatgtttatcacaggataatggattaaaattttcaatatattcttttagggtcttgctctgtcacctagactggagtgtaatggtgctgtttcagttcactgtaacctccaccttccaagctcaagccatcctcccacctcagcctcctgagtagctgggactataggtgtacaccaccatgcctggctaatttttgtattttttgtagagatggggttttgccatgttgcccacactggtctcgaacttctgagctcaagaaatctacctacctcggcctcccaaagtgctgggatcacaggtgtgagctactgctcctggctcaatatattcttaaaagtggattgctccatagcaatgaaaaagaatgaactatgtgtacaatacattgggtgattatcacagacaaaaaggtcgtaaaaaaagcttgtcacaagaacaaatactgtatgattcaatgtatgaagttccataatggcaaagataatctgcaagtatagaaattagtacagaggttgctcggtggaacaaagggaggggattactggaaatgaacatgaaggaaaattctgtatcttaatttgggaatttgggtgttggttacagggatatatatatatatatatgtatttgtcaaaattcttcaagtggaacacttacaattccctataaatcatcccaccatacagaatactctttacataatttaaaaagaaatcaattagttgcttacatttaacattgtaataataataaaatacagtaaaatacagatttctggccacaatggctcacattcccatgtagcaactatcaactagagctgtgctgtttcagtatggtagccagtagctgcatgtggctgttgagcacataaaatgtgacaagcacaaattgaggtatgcaaggagggtaaaatatacatgggagtttgaaggcttaatatgaaaaaaaatgtaaaatatttcattaatagtttttaatgttgattacatgttgaaatgataatattgggttaaattagattattaaaattttgccattaaaaatgttttgaaatggaaaatttttaattgtgataaaatacaaataacatttcccatcttaaccattttaaatgtataattcagtaatgtgtaaatatagtcacattgttgggtaactagtttctagaaccttttcacctcaccttacaaaatggaaactctgtattcattaaacaccttcccattttctttttcctacccagatcctggcaactgcctttttttttttttttttttttttgagtgcagtgacgtgatcatggcttactgctacctctgcctcccaggctcaagagattcttgtgcctcagcctcccgagtagctgggattacaggcgcatgcaccactacacccagctaatttttgtatttttagtagagatggggttttgtcatgttggccaggctagtcttgaactcctggcctcaagtgatctgcccacctcagcctcccaaagtgctgggattacaagtgtgagccactgcacctggcctgcccatctactttctggttctatgagtttggctactcttgatgcctcatataagtgaaaccacacagtacctgtctttttgtgaccagcttgtttcacttctttctttctttctttttttttttttttaatgtggctcacattcttttttggcagataacattgaaagactgtgaacagctgctgccattttgatggaacatgagttctctgcccagcaccctccactccatattgtctagctaatgaggctcaatgtcacttgccatttattattgcatttatgctgtttacattttttctaatggattgaggaaattgaggtatttttttttcttttttgagtgacagggtttcactgtcacccaggctggagtgcagtggcatgatgcagccttgaactctcagactcaagcgatcttcctgcctcagcctcctgagtagctgggactacaggcatatgccaccatgcccagctgattttttatttttatttttttaagagaaggggtcttactgtgttgtccaggctggtctcaaactgctgggctcaagtgatcctcccacctcggcctcccaaagtgctgggattacaggcatgagccaccactcccagcctaaagtattcctaatatatctgtatctctatcaaatatggaaaaacaaaggatttttctctcttgtagagggtcaagtgtttaaaaaggagcaggcataattttctttgtggaagggaaaaatagtcatttatgtttaatatacaaagcatttctgtgttcaaagaatgtaacctaagatgaaacaacaatgaagcaaattgtcatcttggatggccactctcattgtctcctcagaccctctaaacatttagtgtgaactcttactttgtttgctgtgtgtaattcaattcagtttgggagacaagattctaaccaatgactacaaatagaccttcttcttgacagacatcattgtatagcaggtactttattgattaattttttcaaagtttcactattaaattttgtgtatgtgtgactaggaaaaacattcagttgagtatggtgactcatgcctgtaatcccagcactttaggaggccaagacgggaggatcgcttgagctcaggaatttgagacctgtctgggcaatatagcaagaccccatctttacgaaaaataaaaaaagaaattagccagcatggtggcaagcacctggagtcccagctacttgggaggctgaggcaggaggatcagttgagtctgggagttcaaggctgcaatgagctatgttagtgccactgcacttcagtctgagagacagaccttgtctcaaaaaaacaaaaaccaaaaaaaacattcagactgaaaatttacaaactacttttacctttcactttttaaaagcttgcatcagtttaagggaaatggcaccttcatgaaagttttccatgataagaatattattatgtatggttatacttctgttaagtgagagttgcttggaaccacctgaccaaagaaagtatgagagaacttcagctgtattttgtcttttgctgtttggtggctgtctgggggagagaggtggttttctaggcacatagctctaaagaaatgccatagacagggtggaagaatgtgtgaagtgacaatgtcctagacaatatctgggagccctacttaagtcctaatataataattgatattcataattcagttagtgtattccattgttccttggaggtatctgttgaatgccagtaaggcactggtcagggagcttataaatactgagcatttatttcttttctccctcaagaagtacttggaagtagagtcatcctcttatgggtagatcagggtgcaaattattttatgtgatcttgtttcatctttttagatcctttttcctgactgagctggagcacatacctgagaccaaaaccatagagttagcttatatttgatttactaagaatctagagtttcttttctcttgcttttttgcttttgaagcccattcctgctttgagtgctggagagctgcccgagattgggaaacattaagattggttactctatttatgtctcttgggcccttggctgattgatcacacagggatttgtcatattgcctgcttcttttttttttttctggtacagaattttgctcttgttgcccaggctggagtgcaatggcatgatcttggctcactgcaacctccgcctcctgggtttaagcaattctcctgcctcagcctcctgagtagctgggattacaggcgcctgacgccacgcctggctaatttttggtatttttgtgtagagacggggttttaccatgttggccaggttagtttcgaactcctgacctcaggaggtccacccgcctccgcctcccaaagtgctggaattataggcgtaagtgagccactgcgcccggccgcctgctgctttgaatcaaatgtgaacatagcaactaaaagtaaacatcatgtggatgttagagaaccaggggccttctttgcctggggaactctaggatacttgcttgctgttgctaagatgttttctggccttagcacagcatcagtcattgaaagtgcagctgtgtttttggaatagagagctgatggaagtgcaaaggcacactgatgagtattatcctgaacaatggatacagatgcaaatcattatgcataatccataatgtccccatttttgtagggttttgtgctacgtgattgtgtgtgatttgatgtgctgagaactagaagtgtgccaaagtatcatttccgctttcagaatagttttgttagaattttgaaagatgagtaaatataccagaccgttgcttttcaactctttgtagcattttgagtggctaatggttttgacagaagaatgtggctgaatgatagattgattgctctgacttgatattgttttccttattccattatgaaaagacaaccagagattggatgtgaaaattccttaaagaattacataggatgagaaactgttctacccactaagtttgccataggaacaagggaccattctgtagagcactggtaaagtaccagcttgcctgcattcaaaccgtggctctgccacagatgagttgtgtgatcctggggacattacttagctcctttatgactgtttctacttttgcaatgagggggtggtaatgatagttttatcatacagagttgttgtgaggattaaatgagttaatatttgcaaatctttaatactgtgcctggcatatttaagcattatatgaattttacctgccaccatttgtcacttattattgtattatacagtgtcatatcctttttcttggttattgaaggatgaaatgggagatcagtcccaaatctgaatttattctgcgatttggcaacattgaaaaatgttaagccagaatactttggttaaaccatagcattttaaaaatcaggacgttattataggagtactcattgtatctaaatctaaatttatatttagtgctctggaatttttcctcaaaaatgattcatcgtttggccattgagttccccttttttgcagtttttaaattaagtctgactagagcttctctgatttctggtcccaaagaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggtaaacagtttgttcagatgtgttcatttgattctgaccatgaaaccgcatgtagcagggcctcgtatctactgttcagcttccagcaaatctcaccatctggaacccaattacagacttggaagtgagccagtaaagttttctcctagcaagaaagagagaccgacacatatgaatcaccaccacccacttaagggccctttagagcctactttaaagtagaattgtgtctaaaataaggctaccgatttaatacatttattgatttcactagctcagtggttttctaaatggattcttggaaatgtaacttccaggagtttttaataggttctcttctccaaaaagaagtctgtagaaaaggtttctcctattataataaatgtgtttggagaatgctgcttcatattcccttgttgagggaaggactaaatcctcagtcttggaaattcgtagtgcacattagcacggtaaaagccctgagaagttctgcagtgaagagacctggaaatgtgtgtttactaaacttctttcaccaggaaattctttcttggggaacatatttggaatactatcttgggaaatgctgccattacccatttagcaggtttggaaccagaacagggaggataggcttttaaaattagaccactaattgcaatggtcagatgatgattggtggagacaacagtataaaatctcagaagagtgggcagatccagaagaagtaaatagtctacacattggtgtaccctgcaggcatcaaggtatagctcatacttccagcaaagatactgaatcatgcagagaagtcaaattatgttcaacatagtgtcttctataaggtaaagaaatttattataggaacacttgaggctgggcacggtggctcacgcctgtaatcccagcactttgggaggccaaggcgggtggatcacaagaggtcaggagttcaagagcagcctggccaacatggcaaaaccctgtctctactagaaatacaaaaattagccgggcgtggtggcatgtgcctgtagtcccagctacttggaaggctgaggcaggagaatggcttgaatccgggaggcggagattgcagtgagccgagatcacatcactgcactccagcctgggccacagagcaagactgtgtctcaaaaaaaaaaaaaaaggaacactcgaatgaaaatgtttttaaaatgcaatgaatattaaatgattatgttggaaaactaacttctgtgacttaccctgtgatgttgtgtagatgaggtgttgctacagaagttttatatggatagttaggggaggtgtagcacatcctgttaaacaattccatgtactgtcactttcataattctgacacattttaaatcagttcttcagggatatatttaaaaaggaagaggtataggaattttcagtcaatattctttggcatattttcccaccagcatttggagaggaatgagggtccactgtcccacggtggttgatgccctgggaaatttccaggcccagtccctgattgtgtgaatgagaatacatcctttcacttcaggctgagtttatgcatgccccacccaatctatgggtgtgagctcatgctttagagcaaacatattttgctttttcttgaagaagagtatttgatcagtatttcagattacatatttctctttagactaagggagcctatatatatagtctgtgtgttgatagaaagcattgttttggctgggtgtagtggctcatgcctgtaatcccagcagttggggaggccgaagcaggaggattgcttgagcccaagaattcaagaccagcctgggcaacatagcaagacctcatttcaaaaaaaaaaaaaaaaaattagctgtgtgtggtggcgcatgcctgtagtagctactgggggtgctgaggtgggaggattgcttgagcccaggaagtcaaggctgcagtgagctatgatcacgccactgtgccccagcctgggtgacagagcgagaccctgtctcaaacaaacaaacaaacaaaaaaaagcactgttttcttggtacttgaatactccaaagttaccagtctactagtaaagttttttttttttttttttttttttaaagaggaaactcagcagcagataaggttgcttactttgcctagggttctacatcaggttcatatttgaattgagattcaaattgtagcttgttaagatttcatcttagtgtttgggagtaagctggttggaatggtttacctataatgaattgttttgcagtctctcattgttaaaaaaaaaaagctagcattttactttgacatggtaagctccaagaatattaagtattaagcatttagaaatatatattttaatattcacatttgctggaagacttgataagtataaatccaggaaataaatttattaatgaatgaaaatgaaatctatccacagagagatcacaattgggagcgggtatgaatgttatttcatgtgatcagtgtctttcattttccaaaggaaaatattattggaataaccaaaagtgtttcaggctggttttagtaatttaggtaactcagcactgatgagattttattctctgggagactttttgaatcctcagacactgctgtttaaccatgctgcatttttgagaaaacatttccccccatttgttaaaccagctgggtcaccagcagtagagttgcgttatgcttcctgactgcagctcagaacgccaggcttgagtgagcgcctctgaactctgatctggttctttgaagcaggaaacacagtctcccacgatgtcacccctcgcctcccctccttcttccccgcctcattaccagagggtgcccttgagccatggctacagcaaactgcggagcagcgcagaacagatgcatccaggtaagaggcgacctgggggccagctgtcccaggcagtgtcttagagactccttaatttaccaggcggtaacgcttcaagctgcttaatttcctgatttaattacccctgtctttggaaacatggctcaatttaattttatattctcaagcaaggtttttttttaaaaattgatttaaacatatttgagtaatgtttcatctcctgtcctagaaactagttcgtctttagacttgtaaacagctagatgatttaatctttcatatacagattttattgaatagaacataccatattaagggcttgtattttttttggaattgttattcctttctgtaagcacaccaaagatatttatatagtaactgctttaatgaaatttcttaagaaatataactgcaaaagcaaaagagttgatccaacctttgaagactgagcacgtaaatgaaaatatataggtcctgtgctttggaataaggataaaggaaatgctaggggtagcattttgctgaggggtatgtagcatgcacagttgtggggttgccttcttgctcacatttatgctctgctggcctcgttaggtggtaaaatacgttagttctgaggatgacttgcagagttggctgtttaggctgcagtgcctaaagcactggaaattcactgcagcatcttgtgcctcctggggttcagactcctagtttaagatatgaccaattaaaggtattctagaactggatatctgtaaacccccacccccccagttttgttttgtgggctgtggccccaaatgacccagtttctgcaggtttttactgcattaaaaatagtggtgacttttagagggacacagaaataaaactgcgcgctaggctgaataaagagaggctgtaatcttgcagagagaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatgtgagtataaaatctgtttggaaattaagtcctatgcacatgcaagatgatgttgctaatggatagtaacaaaaaaatcactgtcctgtaacttgaatatctcagtggggttagaaactaaatggagttgagaattcttcattttcctcttatagtttccctgatctgatttccctattttcaggagtgggttttttttttttttttcctatttctaatcttacttgggtttggaagttggtttttaattcacaggtgaaactttttgttctactgagtcagcctgtcagcaagttctacctttggtattccttagaaaacttttctgttcctcctccttaatgccccattccctcctcattccatacaaattgggcttccatttccccagtggtaaggaagcagcttgcttctctccatctttcttgactctcagcagcctgtgccaaagctgtccatgccttcatttcttttcatacttttttaaaagtgaggtaaaatatacatatgataaaatgtacccgttttatttgttcatttttgagacaggttctcactttgtcactcaggctggagtgcactggcgcgatcatggctcactgtagccttgatctcctaggtttaggtgatcctcccacctcagcctcctgagttggtgggattacagacatgtgccaccacaccgggctaattttctttttgtatttttttgtagagatgggatttcgccatgttgcccaggctggtctcgaacccctggactcaagcgatccgctctccttgtcctcccaaagtactgggattacaggtgtgagccacaatgcctggccatgcacatgttttaaatcttcaatttgagttttagcaaatggataggcccttgtagctaccactttgatcagtaattgaacatatccattatgccagagatgaccctctccggtcactccctgccccctaacgcaatcactgttctgattttcatcaccatcattagttttgcttcttctagaacttcatatgaatgaaaacacacagaatgactgactgtactcatatgtgtttgccatctttccttcagcataatggttgaaatttatctgtattgttgtatcagtagttcattcctttttattatttagtagtgggatatattgtgtgaatgcatcacagttcgacgatctgttctcctggtgctggacatttgagttgtttccagtgtttggctattatgaataaggatactatgaacattcatgtatgagtccttctgtgacatatgctgtcatttccctggctcctaggaatagagtcactcagttttagggtagttgtatatgaaactgccaaagagttctggtttgacactgaacttcagagtgatgaaatctttaggtttttttttttttttttttttttgtacacctccccttggagaaagatggtacttccagttcttattaaacctcttgtaaggggatcaaagaattatttgttttgcactgtattgcatgtttggggtttcatttgggaagaaagagagttgagtaatagctactttttaaccttctgaattcagatccaattaaggaaggagccagaagtcagacaattgatggcctgaatatcagctttattactgatatagctgatcagagcacatgtcttagatttgtgaccagatgggctttagacactcacctttccagtcacaggcaggcttggccatcccagatttcccacacaagtaggaagagaaaatctgcctctccaaaaaaggccccccatgcagctgagtcttcatccaagccctactgatgagataggtctgtctcttccaagggaaggcccttgtaggtgagggatagaagccaagggccagatggtggcctgttcccccatgtgtctcccctggaagtagaagtagaagctcttatgggaagcagaggcacgtgggattcacttcctaaggaaagctcatgactgctagcaccccaaccatgccacagttcactgtgtttcaaaccttttggcagagcgcaattggtattagtgatttaattcagtgctccatcaacacagaatgattttaaaaatcctacttctcagaagacaatggtggcctaccagctgagacttactttttaaaatttggattatgtgctctctatgtatgtatgttttgcagtttttatatctgtattcattcttagcaggttctgaaaatctacttgatgggttgccaggcaattgttttgctattttaatgtgtgttaatgtattgtaacattgtgttccagttactaggaagaaatacaaaaagcagatgtgagcccaagagtgatttatcattcttgatgtgctattgttgtaccttctttattttaaaaagagcaaactatgttaaacatgaggtcataacaggctgctctgctctctacctaattttatttgtaagtaagctacagaaataaaacattttacttatttatatattttcaaaaacttgaactattaacctatagagatgagaaagaatttcaacttgggtgataatttctgctttctgttggagctgcatactacctggttatgtttaactgtctccctgccatattggtaaggtcattattaagtcttctggaaataaaaggagtgaaaacatacattcatttttgtggcttaaaaagttattttaaaggcagcaaaattgttttttaaaagtttggttattgaatagtagaataataaatataaaatatatttattcattttcgtagtcttctctacatgattttacattctgtttgatttatttttcaaaaataatgttggttcttagtgttcaaaatgcacattagttttcttcttggggaagtggatgatcaatggaagacatttacttaggggggatatatagaatttacctcatatttagaatttgaacacttatgacacttttctagctattgttgctttctatcccaattgaagttctcactgttccaccttcacaatttattcctaatcataacccagtgtaaatatttttctgcttatcatgaattggttgaatgtctttagattgtttagtgaaattgtgccaaagagaatcaggggttgtcagtcctagatggccctatgagtattctgttgccagttctttcctgaaaagcagatgctgtatcagtttgaatgtgaagtcataatttttgaatggaatctttgcataccatactgactttcctttctgctgtttcagcaccttatgaagctaggcagccccttgtccagcccgagggatcctcatcagggggcccaggaaccaagccccttcggcatcaggcttcccttatccgggtaagtgatgatgcagggttatgccaatgggacagtagagtcaagctttgggcttcggggacatggctttttgatggaccctttttcattgcaaggaagatataaaactgatccttcatgcaaatattgcatgtcttgtttggttgcttgtataaattactaaatcttttctactgtgtatgtctctacgccttctcagtgtctctagaataaactaggctgcttcttgatctttagtatatctaaaatgtccctctgccttcacctatctaatcattagccaccactttcaggagagcttcactttttctaaagcagcccatcttgtctctgccttattctttattattactcatttaatgcatagttaactgttttccatttgttttgtgcctctaattacatggtaaacttttggaaggcagaagtagttctgtattctctctcagtgcctagaccaagagaacagttattgtacaatggcagcagctgctgtttccttatgtaataaatacaaaagaaatattatggcaaaagcttctggctataccacagcttagacaatttcagcttccctttctgcagtgttttcctttggataaagagctcttattttgttctctgtctgcagctgttgccttgtgtagtgtctctgggtcctgtgctggggaagttatattctcaaagaagggtgtgtgtgtgtgtgtgtgtgtgtgtgtgcacgcgcgggtgtgcaggtttactatttgacactaaagaggaagtggggcagtttgtataacatttcagtcatctaactcgggaataaggaacatttttgcacaggcacttctactcagaatagaagggtggtgtcagacactcccataaagatgtgggctgctaggttggaataggataaacaaagtctaaagaaggtcctggggttcatggaataccttctggggatggggcactgtgttagatgtggtgcagaacttgattttctaaggtgggactctgtgtacaaataatttcttaaagataataatttagccataggctattttttatatttaatgcttcctacaaccataagatctagttactgctgcttctaatagtataagtgagttgactgtggttgagagaggtcaaatagctggtttaaggtttcattcataactagtcagtgacagagccagaatttgaatccaggcctgtccaatgtcaaaacctgctcctttcattactttgtcctacattagagtcccatattacaagaaggctaggttctagagttgctacataaagaaacgttgggtgtagtaaaaaatactcttgaaaaatcccttattgataccacactggagaaccaatatgccatttgctcccagggccagtacagctcagttttatccccaagttggaaaacacatttgtttcttcagctgagctccagatgtagtagttggctgtgtttagagatcctgtggtacaaaaatatgtgcctttaaacacgagaatcacacccactgtggagtgaggtttacgttagaaaaggtatcagtaggactgggatttatccctaagctctccaaaatgtggctgtgtaggttcctacagagtgtgtcctgggaatacagaggccagatcctgaatggttaggatgatagtcaaactaccagtgcatactgagctttacagcagtgtgactgggctcactagaccctttctacctagcccctggctggcatgggcatggatgctcatttggattggcaccctgtggcttctcttctaatctccatgttcccttttctgctgacaaacatgcttcatgagcccttcactcaactaatatttagtgaacacctattaagtgccaggcactgtgttgagaatacaaaaatgaggtataacactaacagtttctgccctcatggagctactggagagatggtcattaaccaaaccaccacaaagtaaatgtataattatgatatgggatatcagtaggaattacactgtactttaaggatgaaaatgggcatggggtatgacctagccttgaggggcaggggctgatcaaagaaggcttctggtgggggagcaacattcgagttggaataagggtacatgggtgttatccaggtgacagggtgggagtgcgggagcaaggtgacaagatggagggaaccgcatatacaaagacatttcctatgggtttgccattttatgaacattatctctttcagtgcccacagctatcttatgaaataattagtgttgttatcccattttcagatgtcagaacctgaggtttagagaccttatttaatttgcccaagttcacagctaggaagtggcagggctggagttcaaacactggtcaaggttcctcagtctctggctcaggaaccagatagatggtggtgtcacctgttgagctaggaagccctagatgaaatactggcactggggaaagatcacaggttcagtgtttgatgtcaggaactgaggttttgagatagtccagagaagctgttgaagaactggtagattacatgggtctggagcttgggagagagcttaggctggacataggtatttggcagcaattggctatcagaaggtctcatggtatagtgcagaaaaaaccagacaggtgctcgcccaagtccagcaaaactctgtgtgaccttgggcaagttccttctcttttctgtaatacaaatgacttcgaatggatttaacagcccattgtaacaatcagcaacagtccgattctcttaatgtgtctgtggttttcatggctggtgtgtttttctttcctctgttcttaggtttccttcttatgcctgttaacttggtttggctggactccgtgttccagaaagcaaaatgccaacctggattagtcatgtagatgaggggatttgaagtgaaggttcttggtgataagggattaatgtttactgggcatggtgctaggcctaggctggggtgactaatccccctcatgttgtcacgttgatgtgccgatggcaaccttctttctcttctaactagttctctggccttgtattcaagttcttcctgcctgattacaagggggcatgtcctctgggtcctgggggaagcctttagggactcccagccagtgctgttgcaacccatggtgttggcattttagaggtgcttatgccaatccagtgcctaaacattggaatgatttgtctttttgcttactattttaggaatttcacttttgttcgggtgttggatttttttccctttgaaatttcagacactaagcatatcctatgttggtagatgattgatagtgctttgtaaagaaattataagacttattttctgcttcatctgttatcatatgtttagatgttgttttgtggtttgtttttcacaaattaccctcaacatctagatgatgtagtcatttgtaattttgctggcaaaagatttagaattgcacgctttattcctactgttctcagctgcctctgtttttgccagggtcatgagaaactttatgttaagccgttgtctttattgtctccttggcagctgtggacactgaccatcttctcgaaatgctctcatcatttggtgtccattatgcctgctctcctggttttcctcatgcttctatggctgcccctgcctcatttgtttcaatcctccttcctctgccctccccttgttatgctggagactgctgggcctacttctcactctacttactctttagatgtgtggatgctcatgaccacatagcaccatctgccagacatcttcactctaatgttccactgtcactttcagctgacatgtctttctcataaaatcagctttcactcttccactcctagctccacccacccatcagcacaggccagaatgctggtcattgtctttgacttctctttctctccttatgcctgttcagtccccaagtcctgaccataccacttttcaaatagcttgtgtctgtccatgcctctgtacttcttcgttcaggccattatccttttcactgattgtattgtattagcctctctcttgtttcttcttgcttccacccttgccttcttccaattcattattctcattgcacacaaaaacaatcttaaaaacacaaatctaatcatcctgctgacttgattgaagcctgtccctctctgcccatggctcttaacatgtcatccatgttgctgtctggccctcgcctacctcctcggccacagcagctcactgccgctttccctccactctctggccatttcccggatggtcagtgttctctgcgtgggagccttactcttcaccctcacttttgccttctttgttttctcctttgtctcaattcatctatgcttttttccccattaagaacgtgaaacgtaagtgttttctgatattttcttgtatatgcgatgtttcctttttttttcattcttaaaaagaaaaagatctattgcttgtcagctcatttatgtgtgcaactcagccagagggatgggcgtctgatcattattggtttcccatctcagaggcaaccagggttgcctgtttcttttgtatcattctaggaacattttacgcatgtacatgcaaatataggtattcatatatattaatatgtgtgtgtatgcactatatgtatttatatatttatttatttttttagacggagttttgctcttgttgcccaggctggagtacaatggcaccatcttggctcactgcaacctccacctcctgggtccaagcgattctcctgcctcagcctcccgagtagctgggattacaggcattctccaccatgcccagctaattttgtatttttattagagacggggtttctccatgttggtcaggctggtcttgaactcctgacctcaggtgatctgcccgcctcggactcccaaagtggtgcaatatatttttacctgaatttagggagacatgtttggcaaatgaatatattcttccagctagattgcactagaaaaaattatcttttatttaaaaccaaaacacattcacttttcaaaccctcaggatactgttgtgatgttttctttgctttttggagggatgaaagtaacagttttctagaacatattctcaacactcactactcttcttcagagatgaaaaaatgacaaacagaatttagatacctctattactctaccattcctcagggggcttagctatatttttggtgtaagttttctaatgatcaggtaggggaggggatgttaggcattgttagccagcaccatattcatctcgaagtgcataacttgaaaaatgtttatttaacttagttatctcctttcctcctcatctcagtttcttgccgtacctcctcccctagatataactgcaggtacttacggccagaagcaggtgatctccactccttgggtcctcttggaacccaagagaaaaggcaagtatatgaaagatgattaaagaaatgaatattcctgaggctctgtcagagtggtgttggcctgagtcaaaagataattgatagtcaccacaaataaattgttcattctaagagctttgatgaaaacagcaggaaatagcctttgggggaggctgatattgcaccgagagatcttcttgtggcatgaaagatattttatgggtagactggaccaggatgcaagcaggataaggagagcggaggagtgagaatgactgatggtttgggatgggattgagtgaggtgggttagagttgagtcatgagagagttggtcatctgagtttggaagaagagtgaagcaggtaaacaagcggggcatactgggtactgtcttggctactctggttgtctaacctaatactcagcccagggaattgacccacagagcaggtcaggcccgcccggattcttttggggttcaagaattatttaccaaggcattacttggtaagtaagtgttcatacgaacgtgtgtgagctctcaaacacacttgttcttcagagcaaatacagattttaaaaatatgtcaaacattcaacagatacaaaagggcacagtgaaaactgtccctaccatttccccgcacagccactcatcccaggggcaactgatatgacccatttattttgtatagtactatacaaaacatttatataatattgtatatgaatatcttttttatatacaagtgaaaataggtattatatataattacatgtaatatatgcaaaacacagttatgcttttttacacatatggtggcatactatacatctaacatgcatttagcactaacaataagctttattaacgttctatagcagcacataaagtacttcctcatctttttgttttttacagatgcatagtatttccttgtctgcgtcttgtgtaaatcatttagccagccccttttgattgacatcttgtacttgcaatcactgcgttgtttgcagatatatgggagaccaattcctagaaattgaattattgggtgaaaatgcctatatatttgtaatttttgataacgactttcaaattggaggtatagcagcctatgtacttgccaacaatatatgaaaatgtctgttttctcgtacctttgtgaaaacaatgtgctaacaaatttatgggtctttgccaatctgataggtgaaaaatgatagctcactgtagtttaattagcatatctctttattagtgaagtgaaatatcttaagtttatgagtcacttgtatttccttttctgtgaactgttgattcatatcaagtgcccctttttcttttgagtattggtttgtcattcttaatggcatgaaaccagaagctggtctgtcttttcctttggaccagagatatactggagtgtgtgtggaagatttctccctgagtggtgagaggagatgctggcacctgaggctctcgaaggaggttatggaccccagctgcttcccagttctggagaaccccaggcctgcctgcagtgcagatttcttgtttataaggtcatgacagtaaagttgaattacttagtttatgggtagagattagggctaaaaaaaaatcctctgttgttagagatggtaaatgtcaacactgtgtgtgtgcgttgatctctcagcattgcttagacagctaaattatgttcctttcactgaaatgggtgggaggaggagatagaggtagagataaagatagatagagggagagagtataagtgtgtgtgtgtgtgtgtgttaggaagagtgagtttgatgccttttctaggtatgtatgtgccttattcttgagatcttctttcaccaaattcattcctcgtttcatttgagaccccagctggacgtttataccatctcctaaggggtcaaaggttaacatgtcctccaggtgtcctacttcactgagtctactatagaacccacatatacctgaacggacactattgccacaaggaggtcctattttttcatagcctccagtctcctgcttacttattttcttcacctgcttgtagttctctttctgattttctagcccttaacttttgaggaaggatttctagctcttaacttttggggaaggaaacatttaatctcaactgatactgaagtttattttctcagtgccaatcttttctacttgtttcttttttcttttttccttttcttttcattgattgattgattgattgattgagatggagtctcgctctgttgcccaggctggagtgcagtggcgcgatcttggctgactacaacctctgcctcccaggctccagcaattctcctgcctcagcttcctgagtagctgggactacaggcgtgcgccactgcgcctggctattttttgtatatatttcttttagtagagacggggtttcaccatgttggccagggtggtcttgaactcctgacctcaagtgattcacccgccttggcctcccaaagtactaggattacaggcgtgagccaccatgcccggcctctacctgtttcttagtgtattcctcaggtgctcactgtgtaccacacttcttgacaataaaagagatgtttagttaatttagcctcccagaggtagctgaaaacactggtttgaactgctggttccaggcagtactttgtaaatctggaaaggatagtagcttattccccaggaccttttggtctcagttatatgccaggctatggatatggaagacttctttacaactggcaccattttagcccctgggcccatcagtctttcccttgatctcaggcgagcagggagtgtcatgcccccccagttgcctatcccaacaatagtcactactgactgaggtgcttctttggtcccagtgctgtgctggcccttttcagtcctcccaacaatctcacaaggtaggtattattacatcttccatttgtccatttggaaatacttaagtggcttccatgagtcagccaccatgccaggggtacactgaggagtacacctatagcctcttgctctctaggtgcttgcagtcaaaaggaggagatagatttgaatcaaatgatcccacctatgcatgtggaattaaaaactgacaattgccctaaaggccttaaaacatggtaccatgtagcaaaggaatccagcctatagctagaaagtgagagaaggctcctttaacaaagtatgtgttgagctgagctgtgaaggatgaatagaagttaaccaggctaaggaaggatggtcctgggaggtgaggagaggagtggagtgtttcctgtagaggtaagagcctctccaaaaccgcacagcagagctgggctgctgagagagctttgcttctgtcacaatcagaaagctacagcattgggaaactgctgccctagtgtcagctccaaccagatccacactacaaactaccttggcagccaaatgaaagctttgttccctgcctgtaacttgggtctgcatccgtcttccgtgggtgtatttgttgagtggaacctaagtcctatttggaattctagcagcaaaggtgttttgacagtggagtttttagctagccagcttgtgcagtgctgggacttatgctgacgggtggaatggactcgtgacccagtctctaccatatttcacagggagagcagatacatttgaagaactgaaagaaggcagctgtggctagagcctggagtgggagggagatgaggtcggagagggaggcagggccctgtgggctatgtgactgccttgcaggtgggagctgatggctcagaagttaatttactggttagtaagtgaccatgccaaattggaacccaagtctgtctgcctctggaacctgtactctttttgcacctccagtcagtagcctcattctccaaagcattcttgaattctgtccaagttgtggatgcatctgtttcccatctgaactcagactgccttgagtgtgaaggggagaacgtagtgaagagacaggcagccttggcctgaccagcaaggacaggggtgggaacgtcatcgcttcgttaatggaagtctgcagccttgtcagagtctcctcttactgctgatttctcatttttcttggctttctcctctaagcagagcacaaaatcctgataatagtgaaggaaaagtgcccttctggaacagcaaatcttggcccctgaggggagaattggaggcagtggttactaatgagcatttcttatgttaatcaaaatactgttagcgccacatactgcaatcacagtaaaatgattacatacctggattgtatggctagctctaggattcttttgtgatgacgtgccagatgcttacctgcaaaaattatgtgagaaataaaatggtgctctgtcagtatgatttaatagttcgccagccaaaatctaaaactaaactagatgatggggaggaaggtgtaatacagcatagtcatagctcaagcacagatcctcaatctgcaaaattgcagcaatgatttaggcattgcagtgaggttctttttgtaataaatgctctatttttacaggatggatgaacagatagagataactatagagcttgatgatcaagtgtacgtactttggacccagtttgtattctggctctaccatgtgccataggtgtgtggtcttggtaaattacttcccttacctaatcctcagtttcctgttctgcaaaatgggaattaccggatttacctcgcagggttgtgaagatgaaaattgattgtgtgcattaggtacttacagtgcctggcacttagcaaagcaatgaatgcttgttacctgacattcttctgtgtctaagtgatcgtttcaaaaagtatagcttattgtaataagcagcaactgtgtgttgcacattaggctcagagagattcctacagtttggcagtcagccttctgaactattgaaattagatccctaagtaagttaggtaatatgtggttaaaggcatctttgtgggtttatttccctgaagaaacagataaggttaaatttctctgttgggacttaattttaactaacttctctacagaaaaaccaaattatttattgcaacttcctgtgaatctataattattttgaaataaagactagaaagaaggagttttttaaaaagttctctgacttcagaggtaagggagagggctcagcctttatagtgttggatgacattatgtgataaatgcatataaagttcagcttcagtcagcttaagagaactcaggttaacctttctctgtctctagactgggattgagaattttttcgaatgtttgtttgtttactcattcagcaaataacttattgagtgttttgtatgtgttagtgacttttccaggcatttgggatatagcagtgatcaggatagacaaaattttctgtcctcctgggttttatgggatagcatggggtagggtgagaggcagagcataaacaagattgatcaagcataatttggaatcgtttcatgttaaaacaaaattgctaagctctgtctccttttctaggtccttttcttcatttctcattgaacactttccccacaattttacttgagctgtcttttctttttaactgggaatctccttcaaatccatggaagatgaacctatattactcaaacacagaaagactactataaaaatgaatcagcatcctggtcctatagattgtctgcatagataatcaaattagaatgagaaagttgtttgggctcataatggtctaatgtcattggtcagattgcaaaaccacaatagcttcaggcttccatctccaggatgggctttgtggttgtgaagggcagatcttcctttcctttgggtcttgcttgaaggatacattcattgagggaacagctgctataacaaataggccccacattttaatgactttgcacagtaggtatatttctcactaatataatagtttggcaggccgctgtcctcagcatggtgattcatgcaccagagctccttctgtcctgtcactgtgccatcgtctgttcagtgggcacataggaaagagagtagaggagtgctacagggtactagtcctgcttggaagtagggtaggccactggtgctcacattgcaatggctacaactcagtcacatggctgcatgtaacttcaagggaggctggaaaatgtcatttctggttgggcagccacttagtgacacctctacaccaggcatagtagagcatgaattattggaggagtctgctgtaatcccacctatcagcactgccaccacttgcttctgtgacttttttttctcagccccatgactgaccaatttccttgatctttctttagacaaattgatattcacttgggctatagtgtagtctcaccagcccattagctatccttttctttacagtagtcaagtcttctcacatctttgctaatgagatcgttttgatcagcaattgccttgtggtagtcttatttccaaaatatttttggcggaggaggcatcctcagatattcactgtgggcttagtatgagcttttgctactccaaatagtttgtttactaaggcactaacaggacactgttaaaagatcattacccctcataggtgaaatggctggactctaaaacagcatttataggatgccttcggggtaggtttatattttaaacagaaatgttctatgattgaaacaatacacacacccttcttaagttctctccaacaatgcttccttgcaattcatattatttagctttgtttgatttttaagatagtttgatagtaggggtaaatgttaccttttgggattttattaatagtattactttttaatgagtcttttgaagtctttcattataaacagcctgctttccccagagataataacttgccatgccaaatatttgcatttcacttgaaacaaaaccaaggggttgaatgttttaaatataagcaaatctaattctcctgtgtctagagaaactgtataatgaaccatatgtatgtggcttaagcagacagatgtgaaagatttctccctctctccttttatttaaaaaacaaaacactggcagagctcaaaattggcaccaagtagcaaacatctctgctcagccaacaaaaccactggagctggagttgatggggggaggcctctttagggtgcatgcaaaagtggagcttttcctggtcctggcttctacttggaaagctaaggctccacagcttatttgccctcatttctcagtgccttcaggcttcaaaatgagccattctcaggtgactgacttttcagatctttgagaagattgttgtggttgattgttggactggttcagaagacatgggtccacgcatctgggtcctgcggtgacatggcctctagctgctgacagagtggtgctgagctaccaaacagactcataggcttcctttcacaaagaacatcatagggcagtgtttccacatctcttgcaatacaagacatacctctgaacttcctcaagcttgccaataagtagagctcacactaccttttagtatctgtgatgtacctgccagggactataggtgggataaagtatctgatatggctcctgtccttcacattgaaacctgggtgaagatgtttaggaacactttaaatgttcaaactgtggtacttaccatgactatcataaagattcatatatatttttttgagacagggtcttgctctatcacccaggctggggttcagtggtacgatcatggctcactgcagccttgacctcctgcgctcaggtgactctcgcacctcagcctcctgagtagctggaactacaagtgcatgccaccatgcttggcagtttttaaatattttttgtagagatggggatttgccatgttgcccaggctggtctcaaactcctagagtcaagtggtctgcctgccttggcctcccaaagtgctgagattatgggtatgagccaacatgcccagccaagattcatattttttaagacgctcaaatcacttggcttagtaaatcaatttcaagcatacagcgagaagcaaggggaaagagatgggggggtaggttagcacacttagtgcaaaccagtagaagggccactctatgggttacacagaactcatgtgccctctccctttgtcctaaggcctttctaggtttaggagtaggaactctccttgcccacttaagttttcttggaagaggggttgggttctcatgggaatctaagaaatgagagccaaggaatggcccactggtctgtaggggtgggagttcttggctgttcatgcttgttctactgttaacaggccttgccctggttgtgttaagtttgctccactgtccacttatctttaggcttctgcagcctttcttgcccccccccccggctttgtgtcctttctgtacctacctcccagcttgtgctgatgcttggttctggcgccctcataactttaagtcccacctaccctttctctatactacagccccactgagcatctgtttagggtctactttctcttctcattggccttgatatttctcatccacattcccaagaatgagcatctgacctaagcccttgtcagagcatctcaaaggccagtatactgtgtgcccatgaacccttactcccactcaggtgacgccaggtgtgaggtgggtcatggtgcccacacaaggctgccaggcccacctttgcagcagagcatgggaacgagcagtgccgtctgtcatggccgtgggtacggcaggtacattggaggatttgagcaggggaagagtgttctgggaagaagacaaacatcttacccctgaggagtgagcatgtgcagtcggaaagcctgctgagaggaggctggggtgcgaggcttctgaaggccaggtggaggaggtggacttttctgttaggcagcaggtcatctctgcaggcttttaagcagaggagttaatcacccccttctgttcattcctgatttctgttgttagagtagacctgagacctgcctgctaagaggccactaatgccacgctggagtgaggtgatgtcaagaggagctagaaagcagatggttatggcattgaggaaagagcacacatgggctgacagggacagctaagcagcagcttcatgagcaggagggaaagggcgtgttctaggggagcagcagcttccatgtcagactcaggaatgcagcagacccaacatccagcttggagatttcttctctttttcttttttttcaatggaactgtattttcgcaaaatgttacagatcacttatagcaaacagaatggtgatggtcaaggaaactgactctgggctcctttttgaccgcagcagctatgtggaagcagctgcagctgtgataagggccgcccagcatggatatttctgtgtcttcgttcactgggaagtggagggacagagcttccgacccacatcccaccttcttcacgaatcatctttgccaccaaatcgttggctcataggtgtctgttcttgtctttcctgcccatgcctggcttttaggttcctttgctccagctctttctgtcagggctgacctggagggcagtgctcctgtgagttctccacattatatcatggccggtaatctaatccaattcaagctgacattctccaccctatgttctaccaatggaacctggtcagacatctgggctcattcaggaagtgctgctagggcatggctctggaatttggtgggagtattttggaaggttgtgtggtctgtttggttgtttagtgctcggactggattttgattttttttgctttacttatttttactgagacggagtttcgctcttgttgcccaggctggagtgcaatggcgcgatctcggctcgctgcaacgtccacctcccaggttcaagtgattctcctgcctcagcctcccgagtagctgggattacaggcgcctgccaccacacctggctaattttttgtatttttttagtagagacggggtttcaccatgttggctaggttggtcttgaactcctgacctcaggtgatccacccacctcagcctcccaaagttctgggattacacgtgtgaaccactgctctgggcctgtttatttttataataataagaggtttttgaaaaaaattcagatagatgcaacccagttaaaaaaaatcccggtatacaaaatcctgcctttgaataagagattaaaaaaagatggtcattatttgctgcctgcaggggttcactaagggatatgggtaagttcccttagctcggaaaaaggataataattaatacccgcttacatctccaaagtcttgaggtgctcaaacaagtaggagtgtgtgaaatgctttgtacatatcaaaacactctgtgaaatttaaggtattaactaatggataatgacttcttgaacatttaagagtggtttgatttacgtttagtagaaactcatctagtatgaaaatgatacatttattacaaatgattaacaaccctacagctctcaacctctttatgtaaccttccttctgactaaaggacccagatgactttgaggaatagcctgtttgctgggtgcattctcactcagcacttctggaagtatccattctacagttagtatttcatctcattgtcctggccttccgaaagcacccttaacccaaggtgtgagatatcaaagtaatacatattttacttcagagatgacatctcaaggttttacagtagctcaacattttctagtctcctttctctgaacattgtcagaggggagacaggcgttcctgggaagaattaattcctggaatggtgtgtgtgtgtgggtgtggggaatgggaggagatggccggccttcttttctagggttagtgggtggaattgcccgcccaatgattaattccctccttgacagtgtgttcagaagcaggcaccttgatggctctttagcagcaataccctcctcttctttcctagcctccttttgtcataaagcctcatcttttttatttatttttatttatttttttttttttgagacagagtctcactctgttgcccaggctggagtgcagtggtgcgacctctgctcccaggttcaacttctgcctcccaggttcaacctctgcctcccaggttcaagtgattctcttgccttagcctcccgagtagctgggattacaggcacgcaccaccatgcctagctaatttttgtatttttagtagagatggggtttcatcatgtcggccaggctggtcttgaactcctgacctcgtgatccacctgcctcggcctcccaaagtgctgggattacttgcgtgagccactgcacccggccaagcctcatccttctggtgttcacctcttggtcctgttaaggtggcccttggcaagtacctctttagtcttagggttcatgggagggatagaacaaaggcccacgcctccccctagcatcgacatttcccttcgtctgccaatgcctaccatagctttgttttctcccgcactgcttccctggttttctaggctcttaaatcctcaaatttgacttgcatgccctctagtggcaggtctgatgcaccccttgttaccctgtttattgtggtaccataacagctgttctcaccacccagctctgttactaaatattgtctgtaattcacaaatgccaaatgagaggttcagtggtcctgacttgccactcaagtaggagctggaaatgtgggatttgaattggagcttttgattcctggatttatacagcatttcagtgtaacggcaacagtaaaaaagatgtggttatagttgttctagtttcttttttgtcatttaaaaagaatccagattattttactatccactcagctaatctgaaagaatgaaaatgtgaggaatagtggaaaataagaatgatcatctttttttaaaccctttattacaattagaaatttttttgtcacttactgagtattcagtatttcatgcctcagtcctgttaactttgaagaatacaaaaaatacataaagcatgatgtctgcccctaagtttctgttctagttagattctagttatgaggcagttaaatttcttcacctgaggaaaaaaattaagcataacacatgataacttttattggtgtttaatttttctacttctcactaaagacaggttctctgagcatttactttttaatttattcttacagtccttttcagtggagagggaactacaggataacagcagttaccccgacgaaccctggaggataacagaagaacagcgcgagtactatgtcaatcagttccgatcccttcagccagacccaagctctttcatttcaggtaagaatgtgggctccctaggcatcactctcaccagaacatagccaccatcttgagaaatcattcacgcaaaatgagtatggcagccttctgtgatttcagtttgtttttcatctaaagtcgaatttcttatcagatgtaaaccatgcagaagaaaagttgccaatgacgtttggaaaattatatttccatttcaaagggcttaagtgggaatttgggggcaacttggcccagaccctgcaccttatcagctgaggcagttcttgaaatgctagcgtgtcgccccaaggggccacctctcattgcttcctcgttatattagagctcgggcaaggacagaatgtggcctcctaaggagttggtgtcacaagtctttttatgttatatgtgccttcaaacttcaaactcaggctcgttttctttggctcaaatgtttgtcctccagtttttctgagagaaattaaaatgggggaggaaaattggccagtgctttcccacttgtcagttcttctgggttgtcttcagatatatagattcctgttgagttctcatgtaaaattcaagctcagaggaactggtttaatgccagtgtggctacattttaccaggctgaaagactaacagtgaaatagtagagtctagaagaaaaattcataaagctttctttttagactttaaaatttgaagaataacaatatgtccttaataattgtaacctgccatattgaagtgtgggcaaagattagttttatcttgtgaaatgaggcacataattgaaatatacttgtataagtaattgcaaacatcatttactgattggtggtaatggctttattgacggcagaatagtacagatacaacaaattaatgttgacgtcatgattaaggaaaataagcagaaacccatattgcacgatttgaccacttgctaaccttaccccgtgctcaggtgagtttctttacgacatgtgcagatatttagccaaatacaaacaggtacttgttagaaatgtttttgttttcttttaacttttgtatcttgcagaatttcagatatagacacaactagtctggctgatacaacaaacctctgtgtacctatcacatagccccaatgattttctcttacctacagttaacacataaggttgtttcagtcagtcaatgatggcggtaccataacagtatcacggagctgaaaaattccagctccattaatcacctagtgatgctgtagccatcatgatgttgtagcacaaggcagtgctcacataaatgtgatgatgctggtaaaaacaaatctgtgctaccagtcgtataaaagcctagcacatatgattatgtacagtatataatacttaataataaatggctattattagcttattatgtatttattatgctatactttttttctttcttttcttttttgagatggagtcttgctctgtcgcccaggctggagtgcaatggcacgatcttggctcactgcagcctccgcctcccgggttcaaatgattcttctgcctcagcctcccgagtagctgggactacaggtgcatgccccacaccaggctaatttttgtatttttagtagagacggggtttcaccatgttggccaggctgctctcaaacccctgacctcgtgatccacccacctcagcctcccaaagtgctgggattgcaggcatgagccaccgcacctggccttttattatgctatacttttattgttattttagagtatactcttacttatatataaaaaaaagttaactgtaaaacagcctcaggcaggaacttcaggaggtattccagaagaaggcattgttatcctaggaggcggcagctacctgcaggttattgtcctcttctagtcacctccacagtatagaggtggaagacagtgttattgatggtcctgaccttgtgaaggtctaggctgataagtgtttgtgtttcagtttttaaccaaaaagtttatacgtgtttgtgtttcagtatttaaccaaaaagtttaaatggtaaaaaaattaaaaattttaaaaatagaataatagaataaagatataaagaaagaaaatatttttgtacagctgtgcaatttttttaaatttttaaatttttgtgggtacataggtgtatatatttatggggtacatgagatgttttgatacaggcacacaatatgaaataagcacatcatgaagaatggggtatccatttcctcaagcatttatctattaagttgaaaacaatttgactacactcttaagttattttaaaattgtacagtgtgtttttgttttaagccaagtgttattacaatggagtcaagaaggttaaaataaattttaaagtttatgaagtaaaaacttacactctaaggttaatttattattgatgaaaggatttttttttttggtaaatttagtgtagcctgagtgtgcagtatttataaagtctacagtagtgtacagtaatgtcctaggccttcacagtcactcaccactcactctctgacttacctagagcaacttccagtcctgcaagctccattcatggtaagggacctacaaaggtgaaccatttttcatcttttataccatatttttactctgccttttctatgtttcttctttctttcttcctttcttcctttctttctttctttctttctttctttctttctttctttctttctttctttcttttttttttttttttgacagggtcttactctgtgcctaggctggagtgcagtgatgtgatctcggctcactgcagccttgacctcctgggctcaagtgatcctcccacctcagcctccctagtagctgggactgcaggtgcacatcactatgccttgcctggctaatttttttgtagagaggaggtctcactatgttgcccaggctgttttctatatttagttgtgtttagatacacaaatagttactattgtgtcccaactgcctatagtattcagtacaggaacatgccgtacaggtttgtagcctaggagcaataggttctaccatctagcctaggtgtatagtaggctataccatctaggtttgtgtaagtacaccctgtgctgttcgcacaatgaggaaatcacctcatgatgcatttctcagaacgtatccctttttctagaaatggaatctcataatatgtggtcttttgtgtctctttcatttagcataatgttttagttttttttttaattaaaacatttgtgtgggtacataggtgtatatatttatggggtatgtgacatgttttgatgcagacatgcaatacataataatcacatcatggtaaatggggtatccatcccctcaagcatttatcctttgagttacaaacaatccagttacattctttaagttatttaaaatatacaattaagttattgactatagtcaccctattgtgctatcaagtagtaggtcttagtcattctttctaactagttttttgtacccattagcaatccccgcctcgcccctactctctccctgccactacccctcacagcctctggtaaccttccttctactctctgtgtccatgagttcaatcattttgatttttagatcccacaaatgagaacatgcgatgtttgtctttctgtgactggcttatttcacttaacataatgatctccagttccatccatgttgttgcaaatgattggatctcattatttttttttaatggctgaatagtaccccactgtgtatacataccacattttctttattcatctgtcaatggacacataggttgcctccaaatctcagctattgtaaacagtgctgcagcaaacataggagtgcacatatttctttgatacactgatttcctttcttttaggtatatacccagtagtgggattgctgggtcatatggtagctctaattgtagttttctgaggaacttccaaactgttctccatagtggttgtactaattcccaccaacagttagcataatgttttaaaggctcattcatgttgtatgtaccagaatttcattcctttttatggctgaataattccattatatcagtacatcccattttatttatccattcatcagttgataggcatatggtgttcttccacttttggagtattaagaataatgctgatttgaatatttgtgtaccagtttttatgtgaacatatatttttatttcttttgaatacatacctaggagtggaattgctagatcaaactgtactgggagctgaaagcattcaaattcaatctcagtaaggtctaacatttcaagaacagctgggtcttgcagttatgtaacatgtaaagtggaatgattgcctgatttcagttgatacaggtaaatcaacaatgaaggaagaaagattcctggataagtttctcaaaatgccactaggaattcttaaatctcaccaaaagctttcccaagatgtctgtcttatctctgtgtggtgtgatcaatggtattaattttcttctttttggtcagttttctattacttttctatttgaaatttctatttgaaatctgccaaatttgttcaaagttttgaacttcgtcttctaaatttttggaaaaattttgcagattttggtaaaaatgaagcagaaattaatttatgtgatttgcatctttcatgagcattatgttattgcttcttttgccctattgtaatttacatatttttaaaaaagctattcatgtgttgcttttggtcccatgattcataattgctttgaggaataaatatgtttgtggttatacagaagagattgctgaatgaaaaaattgtgattcatttgtatataaatgtaaaagctactctagctgagtaattaatggtttatttaaacaatggcacttgacaggttctgtggccaagaacttcttcaccaaatcaaagctttccattccagaactctcctatatatggtaagtacaattaatgccatatgacattcataccatcatccataactcatcctttagttcctacctttgcattttttaaaggcttatgttttgaatgatgtttttaacagactacaggagtgaatacaactcagatttttgttgctgtgaaaattaaatgttatatgaaaagtacaatgaacaatgtctggcacgtattaagcactatgagtgttaactattattttaaagtaatttcctaattattatccccatctcaatcccttttcagtctaggcagttgtgggcacatgagacttaccatcctgtagatttcattttcagacttttctgctaggtgtgatacaagtaaccagaggagcttgacaaactattttttatattttataaggctgagtgaacagaaggttgaggaatattttggagttaggttagatttgactattctagctgcctctgagctttgcaaatttggctggtgtttatcagttgggccctaattcagacttgcagctgtggtatccactgcacctttatgcactctggttccaaaagggctatgctgggatggtccagatggctctatttgcattcatgaaaatgcttggtgctgctgtaaactctcggctgtgtgtgggctagttcttccccaaaactgggcaggagatcgcactgctataaatatataattaaaaacattataatgtttatataaagctttttgcatgaggatttacagaattatgataggatttaaaattgcttgtcatgttttgtgcatcttattggaaaactactccaataatactcatgcatgtcaatgtatctgggattctgagctggatttaggttcttcaacaatatatactctggcataatttttttgtttttacaagccttatattagttttgtttttgttttgttttttgtttgtttgtttgtttttttggagatgagggctcactctgtcacccaggctggagtgcagtgacatgattatagctcattgcagcctctgactcctaagctcaagcgatcctcctacctcagcctcccagctagcttttcatttttttctagagacagggtcttgctatgttgaccagtctggtcttgaactccttgcctcaggcaatcctcctgccttggtttctgaaaactctgggattacaggcatgagccaccatgcccggcccttatattagattttctggctagggaagaataaagaaattatcattttgaaaagaataccatttgttttggcagaattcccagtctaaacattgttggcatgagacctcctatctttttgttgagacacgcctatgaaagctgaatggtattctttcgatctggcgtatgaagcagtttcctgacccctcactctggggaacagctatttcagggccccagtgcattcgaaattggaggaggaggatgtaaatggtctaaaggaaagttatggagcttaccttagaaatatattttctttcaaatagtaatacctttctagaataattttgtatttgtcttatctctatgcttgtcctaacacaagtacacttgtccctgtctacctaagagatggttaagcttatggggtcttagatataatactttggcaaataagtttcttttgtgctgagtaaataggtctgtgccttttagtgggaaataatgactgaagttaagcctgtttgagactccccctttcttcctttttgtcttatctggttccagtcagctttagttactagttttatcctaaaacataattcattccattttttattgagcttacttgtgttttcccaggagggagttctcaagcaaagaacagtttggtacaaaaatttacgtgacttgaaaagttcacggttttcctttaaagctgaaaaacaaagagcttatttctgtgctccaggtaaactgcataatggctaggacaactataaaatggctggggccacccttcctctgactgttttgaacaccatgtccagggcttttcaccccatgcagcctgcatttactgaatgactgtggacttctgggtatcatttttatttctgtgccatagtttcttgtcctatgtcctcagtgttgtaagacacaccaactagggaacctgaagaatttaaatttttatttataaaatgctactgatgctgatcccatcaatcggcatttttcttcctcggagtggcccccagagatttcaaatggatttggctaggagggtttgggtatctggtagggccatcaccacagagtctgggagttttattggcacgtttgggccaagtaacttgttctgtaagccccatggtaggtactcatgacatttgtttcatttagggagcttagtgatgctgactgtgatggagccctgaccctgcctgagttctgtgctgcgtttcatctcattgtggctcggaagaacggctacccattgcctgagggcctccctccaactctgcagccagaatacctgcaggcaggtaaggcctcaccatcaactgtaaaccttaagtacttttcctccaggctgtgtaaaaaacttttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaataaaaaataaaaaaacaaacaaacaaaaaaaaaaaacaaaaaaacttttgtttcttaaaatgatgtccagatactttggggagtccttggtatttacagttattgttctttaactgctattagactttcacatctcataatgtgaggaatagggctgatctgggtaagtgtgtattacctgtttttctcattctataccctctggatggatttgaaccaaagtcacttaccctttcatgacagttgtgaaataggcaagtactgaacctcccagctggtataaaatgaagaggaagatcctgtagagccaagtgttaacttggcatttttaggcacacccgagtgtctccgggtggccctgggcaatggagtggaatggaactcttatacctaatttaaaagtcaaaaaattagccgggcgcagtggctcatgcctgtaatcccagcactttgggaggccgaggcgggcggatcatgaggtcaggagatcgagaccatcctggctaacacggtgaaaccccatctctactaaaaaatacaaagaaaaaaattagccgggtgtggtggcgggtgcctgtagtcccagctactttggaggctgaggcaggagaatggcatgaacccgggaggcggagcttgcagtgagccgagatcgcgccactgcactccagcctgggagaaagagtgagactctgtctaaaaaaaaaaagtcaaaaaattacatgcagtgaaatgtgcaaagtgttgtcaccttaaatgtatgcttgatgaatttttgtatatgtatacacccatgtaactacaatcagatgaagatatagaatattctagcatatcagaaggttagaatagaactgttatatttctccttaataaaacagtctcgctcaaattattgttttggaccctttagatgggaaagagtcatggtgagtataacatatgtattaattcctttgggagagtagaaaaattaatagtgtgtcttgcccttttcaaaggcaaatgggcactggtctgatttccattattcatggaagtatagtgctcattgagaggccccagaaacagctggtgctttcaacaacctttctcactttttagggaagggctgttaaagaaatgagagcttagtcatgggtgattattagcaagagagagcagtgtctaaagaaactttaattacttattagtagagtatgaattttgtgattagatctgcaaaaggccttagattatcttgtctagccccttcctcatgatgacaccagattcaaagtggcaaatgtcttatctaagtttgtctcggggcctctgactctcttaaataaaaagtctgtcattttctgtgttaaatagtgagaggagaggaactcaaccaaagggcagaggccaagtttgtggctgctgctaagtgacaggtaaacatgttgggggaagagtgacccattctgggatcttcttcaaatgtcctcataaaatatgtgaaggggagagttcagagagcaaaacctactaatttctggacttggattttgctaacaatacctgctttctgcctattgcaggctgtaactctagcctgctgcccttccttagatgcttggaagactctcatgggtcccaggaattagcttgcaattgaggagcatgggaaactcctcttttctctttggtgtctttctgtctccatttcattctctccctcgtcttgtcttgtcttgtctttttcttttcttttcttttctttctgtttcttctgaatcagggcaaagaagcactggcattctgggggctatcttgacgcctacatggctctcattgccaaggcagtgcggggtcatagaggagccccttttcttgggattggagacacatggggcttttgtctctctctaaagggaattaatagctggcaaagggccaagttctgttctagggttatatttaataccttcgccgtgtcctctttcaagccctggagagagtcctgggtaacctcatctcccatacccacactgagttttctgtttgggggtcatgactagtactgttttattgttttgatgccatatggccatggaacctgtgggacatgccatgactccttatttgataagtcacttttgtaggtgtccaagtgtttcacagactatttcaaaagtcactgacataacggctgggtgtggtggctcacacctgtaatctcagcactttgggagtccaaggcaggtggatcactggaggtcaggagtttgagaccagcctggccaacatggtgaaaccccatgcactaaaaatacaaaaattaaacagatgtggtggcgcacacctgtagtcctagctactagggaggccaaggcaggagaatcacttgaacctgggaggcagaggttgcagtgagccaagattgtgccactgcactccagcctgggtgacagagctagactccttctcaaaaaaaaaaaaaaaaaaagtcactgacataatttttagacatctgaaagccctgagctaaaagtatgttaacaggaaagaagtaatctcttgattcctttcctactgccaatggcttcttttgacctgcttattcagtagaggggaatctataaaaaagagtgccaatgagccccatgtttcttcctggacttttatggagactgtcagcatgcatttatacaggaacaagggaagaatccatcatatacacttcaattaaacaaaaattgcacatcatttctagggcttgtgggattaatcttaaataataattatatagttctaacagaaaacatgaaagaacccataaaactctatcaaactcagtgacggtatattttaaaatgctttatcacctatgtttatcattgtatgaagcttaagaaaatggccagaaccacctaggtctcctctgtgctttttttgcttttctttgcaaaatatgagtgatcctattcatttttttgttcattttaatggcatctcatttagtgtttttcttttttctttctttctttctttttttttttttttgagacggagtcttgctctgttgcccaggctggagtgcagtggtgcaatctcggctcactgcaagctccacctcctgggttcatgccattctcctgcctcagcttccaaagtagctgggactacaggcacatgccaccatgcccggctaattttttgtatttttagtagagatggggcttcaccatgttagccaagatggtcttgatctcctgacctcatgatccacccgcctcggcctccgaaagtgctggacaacacgcccggcctagtgtttttttttttttttttaaagcttaactcttacctttttccaacttttttctaattgatctatattcagtctttaaaaaatctaatccagtttttgataagattggtgaagagtataaatttggttgatatcttcatgcattcataactagacaagcttgttttctaaaataataattttttttttgagatggagtctcgctctgtcacccagacttgagtgcagtggcatgatcttggctcactgcaatctctgcctcccgggttcaagcaattctcctgcctcagcctctcgagtagctggaactacaggtgcctgctaccatgcctgacagatttttgtattttagtagagacggggtttcaccatgttgaccaggctggtcctgaatttctggcctcaagtgatccacccacctcggcctcccaaagtgctgggattacaggcatgaaccacccaccacacctggcctgttttctaaaataatggaacaggaattgtatctgatgccattttacttgcaattatggaaatagtcccttttccctaatagtaaaacttcaaggacagagttgtattagttggtggcttacccgctagccttttgatagtttcatcaaaagtctccttttgatagtttcatcaagagtctccttttgatagtttcatcaagagtctccttttgatagtttcatcaaaagtctccttttgatagtttcagctgggtggggtggctcacgcctgtaatcccagcactctgggaagctgaggcaggaggatcaattgaggtcaggattttgagaccagcctgggcagcatggtgaaaccctgtctccaccaaaaaatacaaaaattagccaggtgcggtggcgtgcacctgtggtccccagctactcgggtggctgaggcaggagaattgcttgaacctgggaggcagaggttgcagtgagccgagattgcgtcactgcactccagcctgggtgacagagtgagattccatttcaaaaataaaataaaataaaaataaaaaaataaaaaaagtcaccttttgataggtgattgggtgggttctggtagaaatttttgccatagagtttgttaaaaaatacctatggagtacttactgcgtgagaggtaccacattgttcactgtggtcagaatgctgtatgacagagctcctactcccatgaacttgtgggcagttgatacgtgccatgaaggggaagtacaggtgcagcaagagggtgcatgatcttagggaagatttccttaaacgtttgggctgagatgtgaaggctgagctaaggactacataggtgaagaagagagaagcttaggttctgggaagggggaacagcaggtatgctggggaggctctgagagggggcttggagcataggaggagtgggaatttcaggccacagtggctggcgtgcacagaaccggggtagagaggctgggttgaagctgaggaagaaggtggggaacatatgacgggcaataatgtcaccttattttaggcagataagtgacacaatcagatttgctatgtgaaatgatcatgcaggttactgtccagagaacaggttttgaggggcacgggtagaaaccagaagactaagttgtggtagctggccagtcaggagcagcggggtgcttgcaatggggaggtgacagtgatatggagagatgtggacaccttggagagagatttagcaggtaattgacaaaattatagttttggaaagtgttagctttcttcacaggaagatccgctcatgataaagcatcagtcatataataccagtcagagccttgattgatagactagaaagagaaatcggtgaaattcagaccagagtaagcaaatgaacaaattaaggtgcttgtactcaactccatgtggtgctgatactcagaccagtacttccttacttacttactgtatgtatgtatgcatgtatgtatttatttaaattagatagacacgtaggtaggtaggtaggtagatacaaagacagatgaaacagggtctcactatgttgcccaggctggtctcaaactcctgggctcgagcaatcctcctgccttggcctcccaaagtgctgtcattacaggtgtgagccaccatgcctggccaatggccagtactttactgcagaaggatattggcatttcagtccctgatgggagtgggagggtggggaaggattaaaaacaatgccaatccacttttcacatttgattcaaatttttttaaaccttgcattacaattttatttcctaatagcttgttgtgacaaatttgatttgtagcttctgtttattatctgccacagtctgcttttcctctttggaatattgacaaattttctagctgttgagatatttctttcctaattactttgtgacaaagtagtgaagcagaatccgcttctaagacatagcctggtgtgaagtaattagcttaccaagtagcctgatctttcctcgtgtgaattcactcaactaccgaaataacagccagtgtcactattgcatattgaaagaaacccttaatgtgattctttttttctttgttgtaaatcagcaagaatttatgctcttatttttatcattcctgccaaccaaggagataaatatttcgtaaaatcatgttgggtgcacatcattataagatcttgcctatttctaacaatagttaaatgatgtatttccttagttaatgtccctatacattagaaactacactagtaacatagttaagacttacatattgtgatagtgatggttattgtggaaaattactatgctataacatgaagtgttcagagcacatacccttcagccagactgctgagagttcaagtccctgctcttccatttatcagctgtatgaccttgagtaagttgccctgttctcagtttcatcacatgtgaaatggggataatagaagtactgggttgtccatataaagaactgaaagtactacctcagcatgatgaatgccatatgtggtctatcagagctagctgattttgttgttatatttaacaagcacagaaaagctgatgggaaacactgattactatggctataggaaatattctgatatattctttttgtttcttcttagcttttcctaagcccaaatgggactgtcaattatttgattcttattctgagtcactgccggcaaatcaacaacctcgtgacttgaatcggatggaggtaaaagatcttcatatgctaataaataaggatgtgtatggagctaaatccattggcctatgttctttacaaattctggaaaatgaactttttttttgtttgaaaatgagcttttataacatttccttttcatacttggtaattattaatactttgatgctcagcctttcagatctagacaccagatgtatctataatttttttcccttttctccctaaaactggatgtggtaaagtaagtaacataatctctagaccttctagatgtgaaatgtagatatagccaaactaagacagaaaattctagccaagttatttactttaaccaagctttaattccctagtaaacaattttgattctatttttatcagttgggcattaataagctatactgaatcagaactgttttgagaagaggtttgagaactttatatgagggccccaaatcacattcggaactccctcagggtttttagcttttgaaccaaatgaggactgatttggatgatccccagaaggaacttggagaattcccccagtgttgggccatggatggaagggcttagccaagtgcttaggaagccttagctatggatcaataaataggagttgttatagttattgttgtcatcaccattgtcattatcatcatcatcaccattatgattactgtgatgacaatttaggatacctgcttttcccttccttaaaagatctggaaatgtttaataaatggagctttattcacagactccataatagtcagagactattagagtcctctgaccctagttgaaaccactgcaagatgatagaagtcaaagtcagggaacagggacatttctttaatttcttgtgactgtgcatgatgatttattctctcacatgaggccctcatgcctgtagcatgtgttatggatggcaccgtctgctcccctgtgagccagtcaagcctgcctttccagtgcccctctgactaacatctctctgccattttgcttctctttctttgagttgtgtcctccatggtactttcctcagatttctactcatgggaaaaagacataaagaaaagtcacttcaggaggaatgacagatgtgcatttgaagaattttggttaaaattttttttttctgcagaatgcttatgacaaagagagagataaaatagtttgccacttttcatggccctcagtttactttggggcttctagcagtgtttaaagagctttgtttatcaagccaggatggatacatctatggctctctgactatgtgtgtgtgtgtgtgtgatgggccccctgcttgcataaaatgatgaagttattagttggtcttctttaaaacggccataaaatctgttacacatgcacacgtctgttttactgttacacacacacacacacacacacacacacagtctctctcgcttgctctttctctctctctaatgtcctggatggcgttacatatattcacctttgtggattttatatgcagctagttttatatacttttgcatactttaagtggcctccttggggaggggagattaaaaactacctagtcttttttttttttttgccctatccaaagaagaaagcaaaacaacaacaaaaaatcccctcttttccaaccaaattgttatttttgaggatgctatggttttagacaatgaatgcagtaaacagaattcaaggacaaagtaatagggtttattgatggtttgttcatttaagaagtacgggtcagattgcaataatgattcaatatttcatgttcttctaaactattactgattgttctttctactagtcttttaatctatcatgaatgcatggagtttaattagattttggaaccagccctgtgatcgatgactccagtataggtggttgtgttctgaacaaagctgcagctgatttaggtctcacgtcatgagaaattggcttagtgatacatctttttctaaagacagcagagctgttagccatgtacttatttccattaagaattacagatgataatttcaagtatatttctttttatgagtgtctcttacattactggatttctttctttttctaaacagctttattgatagagactttacataccatacccatttaaagtatacaattcagtaatttttattatattaacagttgttccaccatctctacagtttaattttagaagaacatcatcagcccaaagagaaacccaatactcatgagcagtcacttcctattccactgtctctgccagcctctgataatcactagtctattttctgtctctagatttgcctattctggacatttcatataaatggaagcatatagtatgtagtgttttgtgaccgtattctttcacttagtataatgttttcaaggttcactcagatcataacatgtatcagtgcttcattcctttttaatgctgaataatattgcattgtatggatatgctacattttgtttgtccattcatcagttgatggacatttgcattgcttccacttttggctattgtaaataatgctgctatgaacatagatgtacaagtttttgtgtgggtgtgtgttttcggttctctcgagtgtatacctaggagtggagttgttggattgtatcataacttaactttctgaggaaccaccaaactgctttccaaagcaactatactattttacattcttccactagcagtgtatgagggttccaattttcccacatccttgttaacacttattgtctgcctttttgattttagacaccctagtggaatgaagtggtatctcattgtggttttgatttgagtttcctaatgattaatgacgttgagcatctttttgtgtgcttattagccatttgtatatcttctttcgccaagtgtctcgtcctttgtccattttaaaattgcattacttgtctattgaattgtaagtgttcttgtgcttttggcatcatatctaagaaaccattgcctaatattaaatcacgaagatgtacttccatgttttcttctaagagttttgtttgtttgtttttttgttttgttttgttttttgagacggaatctcgctctgtcaccaggccagagtgcagtggcgtgatctcagctcattgcaacctctgcctcccgggttcaagcaattctcctgcctcagcctcctgagtagctgggactacaggtgcgtgccaccaagcccagataatttttctatttttagtggagacggggtttcaccatgttggccaggatggtcttgatctcttgacattgtgatccacccacctcggcctcccatagtgctgggattacaggcgtgaaccactgagcctggcctcttctgagagttttatagttttagacctttacatttaggtgtgtgattttgagttaatttttgtgtatgttctgaggaagaggtccaactttatttttttgtatgtggatttctagtcgtcccagcaccatttattgaaaagatgtttttttccccattgaattgtcttgcacccttgttggaaatcaactgaccatagatgtaagggtttatttctgggttttcagttctattctattgatctatatgtttatgattatgccagtaccacagtgtcttgataattttagatttgtagtaagttttgaaatcaagaagtgtgaatcctttaacttttttcttctttttcaagaatattttgctattctgacttccttgcatttccatatgaaatttaggacaagcttgccaaattctgacaaagattgcattgaatttgtagatcagtttggagagtatggccaccttaccaatattaagtcttctaactcatgaacatgagatgtctttccatttatttagatatttaatttctttcaacaattttttgagatttctttttatctacattgcctacttctaaattatgttattctccaaaggggcctgatttataatgcaggtgggaaaagacaatgaaagaaatgcactgttatgatacattgtctgttctattggagatagtagactttgaatagaaaattatatctggatacttcgttttaatgagtaaatcccagcactatgtgaggccgaggtgggcagatcacgaggtcaggagattgagaccatcctggctaacacggtgaaaccctgtctttgttaaaaatacaaaaaattagccgggcgtggtggcatatgcctgtagtcccagctactcaggaggctgaggcaggagaatcacttgaacctgggaggtggaggttgcagtgagccaagattgtgccactgcactccagcctgggcaacagagcaggactccatctcaaaaaaaagaattacctgagtgaagactgttaaatcttagaccagttttctactgagtaatacttcagtctctttcttcagaacagtttaaaaacaaaagtattgcttatctctctggggttgtttaggttctgagaggtaaaccaattaactttttggaacaccagatggctccaggcatttactctccttccttcaagataaatgttacaatttatctttatttaatttgtgactatgttttaaatataaacaatatcaaaagacatatgttgacaagtcttcctcccatctaccaactcacctttcaattcttacatatctttccagagtttgtgtatataaataaagcaaatgtgaatatatattattcttgaacttaatcttataggcattagagtgcatattcttttccagctttgaggtataattgacaaaaaatatatatttatgatgttttcatctatgtatatattgtgaaatgattactgcaatcaagctagttaacatacctgtcacctctcacatagttacctttttttggtgtggtgagaacatttaacatcaactcccttagcagttttcaagtataccatacattgttattaactatagttagaatgtgtgttaaattgagaatttacaagaagtaaatttacagtaagtagattttaaacggtttaaaactaattcatacttgatagatttgggtattcatattagtgtgaggacttcccccctgtttgcattaggagaaaattttaatctgctcatcagtaaaattcttttatcccacaacaagaaggctggtttaatcaggtttagacaccatctgcatgacagatcttggcaaacacccacattgtggggccacttgtcagaacttctttgtgtttgtgaaaaaatacataaagaacaggtttgttcttggccaaatggaccagagttgctatgcaattctgtggctgaatcccagtctgaattcagatttaatacatgtgccttaatctgaatcatttttttcctctgtgtatgtaaaatttcaatacaaattaacatatacctcactaggaacctaaaaaaaataaggtagtattaaatgcagggtttactgcagatggaaatggtggcaagaaataatagcttttaagacattttcggctgggcgcggtggctcacgcctataatcttagcactttgggaggctgaggcgggtggatcacgaggtcaggagatggagaccatcctggctaacacagtgaaagcccttctctactaaaaaatacaaaaaattagccaggcgtggtggcgggtgcctgtagtcccagctactcgggaggctgaggcaggagaatggtgtgaacccgggaggtggagcttgcagtgagccgagatcgcgccactgcactccagcctgggcgacagtgcgagactctgtctcaaaaaaaaaaaattttttttcatcatatgtgcgcatcacttaatttctgttccaaccagtttaattcatttacttttctttttcaaagaagacatctgttaaagacatggctgaccttcctgtccctaaccaggatgtaactagtgatgacaaacaaggtaggagaagaatgagttttcttctttaaccagcgttctacctgttaccttatctactcctcttggaatggtggcttctagagcatatgagggtggttctcagcatgtaaacacatttggatagactaagtagttcaaatcattgtcataaaacaatagttcacaaagtggtagcaagagcttgagtgtccagagtcttccaactcattggccccttagtcattgctgaccctcagcctactcttaacaccttacactggaatctgatcgtagcaattaggaaatgacaggaagctgaacgaattgagaacatgttgtgtttgcggatgtgatcccagacatcagtgtaaatgcacatttgcatacagctctaatccatgaggaagttctcttctggacacagcttctgtccttagtgtttatctgtttcttggctttgtgagtgtgggagtgtgacatggagcccagctacaattttcctatcttactgggcagctgagaagcagtgcagcacagcattccgtgttagagctactcccagggaagagttggcttgggaatatctagaagtgtgggagggaccctctcccccacctcctatactttgtatagtgctttataatctaccaggtccttgctcatatactgtcttattcagtcctcacaaaactgaatggaggctggtaagttttatcacctgaaatttagagatgagtaaactgaaattcagacactatgaatcatttgcctagttattaagaaaaagatttgggacaagaaccaagattttttctaagcctcaagccagtattctgcctgttatttgatattgatttactacccatgaatgagaggcttatttgaagggactaaaaatcagtgaagctatttcaggttttattgttaaggcctgccattgattaggcattgtatgggggcttaacatgaaaaataagttttccattaagtgacagtaattgcatgttctctatttaaatacttgcttgggagagacaggtagaactggacattgtctgcagtagcgtgtactctgaccattctcctaactgcacagtggaataactgggcaaactgtaaaaatattgaagcctggatttcactcccagggattctcatgtcatcagtctgggtgtcaggaatgaaagagggagaaactcccaatacttcctggtaatacttctcctatctgcttgaggtgctgtctctggaaagttgaaaatacatctttgctctttgtagaaggagaacctatttccatactccaggaggtctttattgttttagtaaatgctatagcaacttttagaggtttgtgagacctgtttttgtaagtgatgactagcgattctttgtttgaatccaatttgcctcagaaataacattttatagttttaattttttttcctcttttctctttctttttgcttaaaaaacaaaacacaactagctttgaaaagtactatcaatgaagccttaccaaaggacgtgtctgaggatccaggtaggagaaaaccatttttgtatactttatatataattattttaaaataaaaaaacagcaagtcagtgagtagaagattgatacctctgtgatagtgtgtctgtttctctctatttatttgtcttgtattttattacaaggaaaccttttggctttttaccctttctctcttttcaggtatgagaacggggtgatatcttttcaagtttttaagtttcactgaaaggatcacgaaggatcactccgtgtgaatatagggtcttgttactaagtgcaaaattgagaaggcttgaggttgagatgatttcaacaagccattttgggttttgtgtagagtaaggaacttatagggtagatcaattggaggcccagagttggtattttccatttccaaagcagaaatctcaaatatttttattatgcttcaccaccaggaaggcaactatatgtgcttatatatggagtggattccaaggagaaaaataaaagttgtccagttttttggagagtcagacctgtgtctgtggagtcatggagaatggctgcccctgtgtccgcagctctctgttgatggagccatcattgaaccaagttgaatctagttaaaaacaaagtggctacagaagacattactatttggagctctagttataaggacatgaaaaaagttgttgctttctcttttgctgttttatttcttgtatatttttaataagtcaatcatgtttgttgtgataagctagctatcatcctaggcttatttgttgaacattggaacagaggaatcaatataatgttgaggcttatgctgtggtacaatattttccaaatgtcaagttcattcagagtttcaaagagagatgggtggagggagaggaaggagttgggggagtgggagaaaaatatggtagggggaaggagagagagagagaacatgagaatgagaataaatatgaatgaatgtggatgatgaatttcaattatggaagcctgagaaggtgtatttttaggcagctccccagttggttctggtacatagcctattttgggaaccaccagctctggaaggtgatgctacaaaatagaaaattaaggttatagatcaaccatgactccaaaagtgatgggaattcccaagcttaattttgactcttgaaacagatttgaattcattccttattgggtgaaatgctctgttaatgtaggccaacgcctggggtcagttctttctagctcttatttctggagctaaagtggatgcattccagtttttgtaaacttcatgttgtagtattagtaaaagctgtttaaatttggagtgttaaattggtgcttctccaacagcctttgaggatcataacttttcctacttttttttttttttttaagggattttagcacaagatcaagtgtcctctggggcatgagctttagatctcatttttaacattccttcattgactaggacatggcatcaccaaataaaacttgtcaggtgtgccacagcatgagaagtatgtcggaattgatttctcgttgtgcctggcagcatgctatgtgttttctgatttgttcttcccactactgcccctctctgggtatgagggagttcctcatcttaaacatagttaatccctccttttctgggaaatgtttggattcccagtgggagacacaagcgtttcaaggtggtgatttagaattctggatggctgtccttgccatgtggacctcagttcagttgctgctttttggagggttaatctctaggcctgctcctctttccattcccatttcctggaaagatgacatgccttgagtgttctaggaaggtggcagtccttttccctctttccagctacacgagaagctatgatccacttgttgtaattgctgagagtgtctatgttagtggagccttaagagattttttaaaccaatatcccattccaacctaattcagcagagcaccatgcacaatggtggtctttttcttgatgtttctggcccatgttgaggtgttttcagctggttcaccctcacagtgctgtctttagactgttgttggtgattctagcagctgctccattgccaactatcaccccatgtttttattggagtagagcagttctgtccttccattacctgctcctacctgcacctcctttgctgtcctagaagaaactaaatttagaaaccagatttccaggcttaaaaaattaggagcctttatttatgcactctacaatagtaatattttgcaattctaaagtacgttcagtttttaaattactttcaccttatctgtccctgtgagaaagaaactgcatttttattgcctttgttttctaggtgaggagactgaggttcagggaagtaacagctagttagtgtcatggccaggaggagggccttagtctcaggactcctggcctggtctctagtcctgtctctccactactcatccacaccctcaccccatctgtctgtctgtctatctcttaccagcagggctcacccctccttccacacccatccctaccagcaaaaagacaaagataatggcacttgacaaaggaattaacagtcaccatggtctgatttggggaacagtattttatcatggcggggacctctcctacccatgtatttcttgaaagcagtggggcctgagggagaagagggccacggagccagctgcaggcagcctgcgtagagggcttccccagctctgtggtgagtctggtccactctgtccacccagccccaaggcagcctcctgagctgggagagaggcttcctgaggtcgctttctttgctgcctggggtttgtaggagggagggaggtctttttctgtctatatccaggtgtgggtgcacgataatgggcaaaaggggactcaaactccttgggctttccaggctttcctgcactctggcagcgtttcagctgtttgaagttggaagatctctgtgttctcactacaacaagccaaaatgcttgggttgggagaagtgtatctcttgtgcagctgaccagtagtttgctttgtgccttgttagcatttatgaggattttcacctcccctctctgtcctgttatctaacccaaggattttaatgatcatcataaattcaggctgcttcataccaaggagggtttttatctttggagcaatgtaaaagaggatgagataatgcagtgagacattttctttttggaagaattcatgcagacaaagaaattacattcttcttgttctgtgttactagcaccttttctatgattttttatgacattttatgatgaaaaatttgcaatgtttgtaacacctgagcatagctactggttcctaaagttgtcttccatagaggattgaaagcataaaaagaggatcagtgtttttgtaaatgtttctaattactcctcacaacttgtgatggggaagaaggctgtatgggcgttggtagtgagcaagttagtttatgatttaaatttgatgaggaaaagtcatatggctgggaaaagattcagcgatattgttcataattctctgtatgatttggtcacagacatgtgggacacaaggatattttcttacaggagaagctgtatagctcatttccacttacttgtgagagctttgtttttttgtggccatgctgctctggtagtgtatttttttttttttaaaacgtgtagttagatagacttcttcctatccttcagggtagactagttcaaaatctattactagactatcatgatagaacaagaaaccctgaagtgtgaatccatcattatataaaaagacaaccccctttcaagggggttgtctttttatactggaatgtcttcattaattaacttggatttgagaatggcctctcaaatagtgcttgaccaaaggaaaaatatgctggtttttctttccttttaatcgtttctttagattttgaaataaaacaaggaaatcatgaaaatgtgggagccgtccagttctccacatgggcacttttacctcacatttacctgttgatgtgttctgtactagcccaggtgctgcatataaacttgtttaactgcagaaatgaaacccaagcaatatctttgtttcagcaactcccaaggattccaacagtctcaaagcaagaccaagatccaggtagtgttcgtttaatttctgctttaatgccctttgtgccgtgcccctgcctagaaataagaaccacaaaccaaaacccaacccatgatttcctcttcctttagatgtaaagcttaggatatgagccatttcgctcgtgcatggcctgatgggaacatgcagtaatgctgggagccttggtttctgtggtcattagtgctagaaggtgaccatgaatgccctacggcccctcaacgtgaagtggattgtgtgagacaacccagttgttgcaagatgataacttatagggggaagtagctttggaaagaggaaaatatgggtaaggtaacagacacgaaaatttgctatcatgacaaggtgaacaccaaaaagtaaaaagtctgggtaataaaatctacagtagggaaagaaaatgcttctgataacttcagtgaagcttgcagtttcaggtaagcgatgtttatggtctgtttgagcctatcttagtgcccctgtaagcttcacattttttaagaggctagtacaagagagaaagccagtaaggcagagctgtggttgatgtgagactcagaagagaggtgcagaggggaaatacagagacactaatagaattaatccattaaggaagggaaatggtattggtactgtatttcactggtagaactgcagtgtaagataggataacgaggataccatgtgtgtgttttctgttttgctttggctgttagtgacatttttccctcctttgcctactagacacaatcctgaaaaagtaaatttaagtctgatcatattttatatgcttgaaatactgatatttaaggaacctcatctctttgtaagtcaaagagttatcctttagtttatatgtgcattttccaaattggggttttgtttccttgtttatgtaagatacagatatctatatttttatatttatgtgtatttaaaaacaatagagtaattcatttaggtaggaagaaaaggtgtaggcattctttctgtggtcaacacatttactcatcctttgtaaaaggatgaatggatcttttacaaactagtctgtactagttgtgggatatgctttcatagtaggaattgcctttgaattgcagaaatctgttatgtgtactatgttaaccataaatcgaacctcaaagttttagcttctgctgacttcctctctccctgaaagccagtgaaattataaaatctcatagccacacgttctgttattaatgtgtctggctaaattttacatattatcctttcagagattgcgcttttggtctaatttggaggattttattttcattacttctcactgggaagaagagaattgaattgtttttatcctcctttttgaaataataaagttttgtagaaatataagggaaagagggaaaatcaccattttaacaccactgcattcatcattttgttaactccctgcacatttatgttttaattggttgcagcagtcatggttatacaatctcacttattttatattcagtaactttccatatgaagatataaacatacaggttatatatgaaaataaaatgaaaatgaggaatgtgcgctgtgggattgtgtgcttaacagtgtgcacgcatacacattatttacacacacattatttcttttttgagtgaaagatgtcactaaagctatatgtggcatagaaagctcttttcatttctagctagggtctctaattgtcttttttaagtgaagtgttcccatttaagaaccttgtccttccgtatcagttccctttgattcttgttgaaagagccagagcattcttccctgctagtttctgcctgttgctgccttgcctgtcttgccagttatgttacagggaccaccccagaacacgtcacatgccattatggtggctttattaaagttacaaccttgtaagacagacagaaccctcaactaccacaaagaatccttgagaaatttattcaggaaaataaaaactcacaatgtcaaaaacagctctgtcaagaactgaaggggtttaatagtaactgatatattctaacttcataaatgccactctaatagctaagtacgaagaaggttttcagaggttaatttgtctctctaggatgtacctctgactcagaggtcgttttctgctttgacatgaagctagttgagaagctaaataaaacagatgtatacatctacatcttagggccttttcgtgatcatcgtattgggaacccgtccttaaacctattcctaagcagtgtatggagttgaattttatttggaaagtaagtaggtctccaataaatattctagttgctatcaccaaagtattcccccgccaactcataggcagtatgagaacattttaaaaatgggatatagaaacagagattggagtttgaatcgaactgtgtaactttctatctgaccttttgcaagttatttagttcctttttaaaaagatgatattaccagagttacaatctcagaagttgcctagttaattatgccttgctatagattgaggaagaaggttgaaaatgagacttttgctttctcagggaaagacaagctagacccctcaatctgattgatgtgtgttttcctttcccagcttcgtttgtggcatattcccctgaacattgaattcttaccctcagcttatctgtcccaattccacatgagcctgtcatcacatttgcaagtgaacaggagaaaagttctctgatcagtttataccatgaaataccatgaagcccttctgttagaacatggaaatgcctaagctgaggggctccatattattcttattaacaattccaatagaaatggatttgaatttacacaaagttttttttggggggttgattcagatctaaggtataataagaacaaagaggttgaaaagatcccaattcatagttggatttggacaattattgtacatagtggcattcaatgggtaatagaatttatggctgctttggtagctcatcggttctttgtagtcactttgacttcgtgggtattttccatttcaccccaacttcagagagtaaagctttgctatttcgcttctgaccttcccttattttgctacagatcttactctagcacctccatagaagaggccatgaaaaggggcgaggaccctcccaccccgccacctcggccacagaaaacccattccagagcctcctccttggatctgaataaagtcttccagcccagtgtgccaggtgaagtgccccttgccccctgagcccttccatttcctgttggagccagcggatgtgtgtctgccacagtggcctctgtgagtccggagaaagagcagacctggcagtttcgcattccgtgaaggtcttcacgtggctatggtattcttgggagagaaagcaattctagacacatatgtagcacatgtgtctggagccttgcccacacttgttatggatcaagaattaggaaattctctaccaagaggataaaaatgcttcactcccatgcagcctgctgagtgtgtggctggggtcttactctctgcatcattggtaatttgtgaacaagatagatcgctgtctgtcatttcctcagatgcctgtgtggtcttctatgaaagatcttggagattaaggcctagccagaaccttctcctgcattttacacttatggagaagatcctgtgtcctgtaggatttaatgctgaggggactctgaatctgactgatggttgggtggttggtggagggtcctagggcaagggctccttcaggtgggctgctctgggcttctggggatgggatgttcttgagcccgcagttgtgtagtggggctggaggtgggggaggcccagaggggccctgtctgctcccttggcttcctgtgaagtagaagataccctcctaaggaacctaaggaatagaagatgggaggcatgcctttgctttagtgaaggtgataggatacggtgctgtcccaagtgttattttgggagcagcaagggcctttccactgactcatgcaggcaagctataaatacaatgatttcctggaactttttctccatctatgtgcattttaaatcaggccagcctcagatgctagtgatttgcagattattatcttttctgctaaagcaagaaaagactttccttggctcacacattagcatgacctctgtgtctgggcagagctcagcatgttttatttgttctaataaagtattctcctcacagtaaagttatagattgttttttaatatactaaaatctggaactctctatcaaatttaattctgtgccatgagttcatcagacaaaaatttgccttgaatttcctctcatactttgatctgaattctggcataaatttcatagtgactggtatgtagggtgggagtaaccacaggtgatgatgctataaaaatttcacatggctggcggattatgacctggaagattttcctatggatgcgagaaaattaaaacaatctgggaagctatctcagtacctttaccttgcaagaagggaggctggaaatgctcacaggtctctctcaggttgtgtgacccagtaaggagatgccagctgtactggagaattcacatgctgtggtttttacgacactgcatcacatagtggaagagacaaaactgggtttggagctcagctcagctgcttattcactgtttgattttcagcaagtagcttaatgtttatgcatctcagattcctaatctgtacagtagagccaatactccatggagttgtaaggttttggtgagataataaacataatccaaatatgggttgaatattccttatccaaaatacttggggtcacaagtgtttcaggctttggatatttttggattttggaatatttgcattatatgcttaccaattgagcatataataaaaaaatctgaaatgcttcaatgaccatttcctttgagtgtcatgttggcactaaaaagtttagggttttatagcattttggattttggatttttgggattagggatactcaacctgtagtactgtatttggcccacaggccttagtaagcatgtaaggcccatattcccgtggcctgcaagtatcaagaatttaatgcctgaaatggcaagcctccaccgaggaggataacaccccgacttccttgacccctagcagacaattctgtgattcctcctacccagtttctcagaaggctcgcaaaaggactgaaccccagttgcctgccgtagtacaccattcattgatgtactttttcttgttttgcttccctcctgccctgtctcactttcccctcactcgaataatatacctgttctcaagttcatatgtcaggggcttctttagagaaaacctgaattaagacagctttctttgatatctctgtgtcaatgtgacttcaagatgaaaagtattttggtttgataatgccctgacgatctcccttgtggtagggcctgataaatctaagatttagacaaataatagctaggtgggtgatgtctctgttcatagcctaattccattgtcttttcagtacaaatttatacagatgaaattttaatgagcagtttaaatttatcacatgaagaatagaacatttctgcagtatgaaaagcaggtggtataattgcatctactttatttattttcatgttggttaattctcacagaaaagtataagggtctgtctaaattatataaaattttagtgtattgcatattgctagaaattatcgaaatgctgacaaactagaaatgcatgaaatagagcttaaacctaccagaagagtctactcactgagaatcatggtgtacatttaggcatccctttgctgcacttatctttatgtatcactttagataaatgggatcacactatgcttgctgttctgtatcctgatctttccaattaaccatctttctatttcatatagaggattgcaccgttccctttaaggtgtgcatgatatggatataccatggttgactgtgctttgatggagagatctctcccttcttctctctgccttttctcttccccatactttcctcttaagctcacccaccaccccacgaccccagcccccgttcctttctcacccttgcaaacaaacctctctctctctccaccccgacccccgtgtcctcttcatacccctctgtttctctttttgtccttctcccccatcactccttcacaggtatgagcctcccctcactctccccttgccaagctcccccacaccaccaccttgttcttataatataaacgaggcagaggttattaataatttcatgtccgtatctttgtttcatcatctaattattttcttaggttaaatcctgctggttggagttgcagggtcaaaggctgtagatgtttaaagtgtagctatatgttgccaaagggtgaggtggaacacctgtcaacttgctccatcatcaacactgtctgaaagtgtttcctcacaatcttgccaacactgcttcatgttcatctttttaatcattacctgtgtaataggcagtttcatgtccctgattcctagtgaggctgagaatctttttgtattgttattggccataaatattccttctcttatgatttgcctgctcagaaggcttggccagcttctgttgctacatctctctttgcctaaccacggggaccacttctttcttcttcattttgcctacgttctggacctccctcctgtcaggcacttgggaatgtgagggtggccatggggaagcctacctcacctgctgctgtgctgttccttgtccctccagccccgccccccatatcccctccttctgccaactttatcacttaagacagactgcctgggtcaccctgtttatgacaatagaagaataaggaaaggtaaagaaaagaggggaaaataatgtgagatgaagcaagatgtggacttgagttgaaagggaaagataaaatgaagcccttgtttaataaaatgagactcaggattgtgaaaagcagtgattgaagctaaggtgctgatacagagtggcttaaagtggagtgatagtgtggaaaggaaataggatggagagaagatgcaaagaaaaatgaaaggaaaatgaagggaaagatgggatggttgttacataggagtgatgatgtttatccaaaggaataagcaggaaatagaataaaaaattgtagaaccaatggaaggagagtccacagactcttggtgtaggattcaagcagcatttaaaggaatagcttagaagtaggtggcattaatgcctttacatttatgaaaataggtaacatgatatggggaaaaagaacaaagggctgatttagaatgtaaatctataaaaatgaataaggccaactttggaaatatagaacagttggcttcaactttggtgtctgtaaagagagtgtgaatgtgtgatttatagtagcctagatgattccagggctctctaggtactggcatcagacccgaggcatgtgttttcataaggagaagcggatacactatgatcgctgtgtgtaacagggagatcaccatttgtaatagctgacccagttcttggagccattgcctcacagtcccacacagctgctgtgtttgagagatagcaaaaatgtgcaagaaagtctaagtcagtgacaatgcaagtatgcaaaacctagaggcagtcagacctggaatttgctcagtgatgtttggattttatgtctctatatttatagctatgaaacatcttttattactgagattcctgtaagaaaaatcacactaagctggtacctaacctccttttcctcaatgaaacagttattttcatgaggtaatttttttttcataaaaaggggtttcttctgtccacggagtcagtaagaactacccctctcttctactcttgattcagacctgcctcttctcaaagccatgcctgaggtttgtagcctgaggtttccatggtgacagtaaaaagccttagctctgccttgttccagtcattgagcatctgcctggcagaaggggcagagatggtgtggaggagacatagccattcctttaaagtttcagaccgggcattttcatcatttccactcaaatctagctgggggacctaggcccatggatagacctagttgccaggcagctgggaaatgtagtccttggcagggcagccatttcccagaaatacgtttcttactgcaaaaaaggagaaggggatgttgatggtcagttgtttttttttaaaaccacatcccatatggccaaatacattgagattcacacattaaaaccattgtgatggctgaacagaacacatccagggctagtgtctgtccatgggtagctaatttcctatctctgctttagatatactgataataacaactcattccatggttaagagactatggtacatccatcctatggaattgtatgaagctgttaaaaagaacaggcacgtatactacatggagagctatctcggataaattaagtgacaaaagtatgatgcagaatgtgtatgtttataaatgtgtagacaatttcaggatgatgctaaagaaactggtaatgatagttgcttctgggcaaggggaacagtatgactgaggacaggactgggaaacaagcttactttctgttgaatgcctatttgtatctttttaattttggctcatgtacagatgtcacctattataaaaaatttgcttttcactctttagctgcaatgatggtatctgaaagtaccagagatgtctttcctgcctgaggttacctatctcaatcttccctacgattctgtattcagggtatctttatgaccatctgctaccacctcctggaatgcagctgaaatgacagaaatgttccgagcactttttttttttttttttttttttgagatgaagtctcgttctgtcacccaggctggagtgcagtggcgtgatctcagctcactgcaagctccgtctcccgggttcatgcccattctcctgcctcggcctcccaaatagctggggactacaggcacctgccaccacgccctgctaattttttgtatttttagtagagacggggtttcaccgtgttagccaggatggtctcaatctcctgacctcatgatccacccgcctcagcctcccaaagtgctgggattacaggcatgagccactgcgcccagccccgagcactcttttaagctctgatgcgttcttcagattccatttcagtgcctttccaacactgaggagtagttctggaggacctcccaaagattacattgtgagatgtatagttgggtaaaacgtcatggtaagggctctgtcttaacttggaagtggctgtgtttattgagtggcgaattgagaagtctttcctcggttttctataaatgaatatttgtttctgtaacttaagaagtaggtaaactccttgggagtaagagatgttcctaataccaaacttacctttcaggttctctaaaagatgaatttggccacaaaagcagctctgaccttatatatttccttactgtatttttcctgtgagtgctacttgtttcttttaaaatctggtaggactatgggattcctgacccaccccaaacctttgggcccacagtgcacagctatccaagggttcaatttggcagtctgggcagtttttttgttttgttttgtttttttgttttttttaaatgaaagcgttattgagatgtaacccatatactataaaattcacctttttaaagtgcacaattcagtgatatttagtatattcatagtgttatatataactatcagcactatgtaatttcagaatattttcatccccctcaaaagaaaccccatacctattagcaatcattcccattccccccttttcttcctctatcccttggcaaccactaacttactttctgtttctatggatttgcccattccggaattctgtattaatagaatcatataatatgtggtcttttgtgactggcttcattcacttagtataatgttctcaaggttcatccatgttgtagcatgaatcaatacttcattccttttatggctgaataatctttcattgtatggataaaccacattttggatatttgggttgtttccactttttgactattgtgaataactctgctatagacattcatgtccaagtttttgtgtaaacatattttttctttctcttgagtatataggtagggctggaatttctggttcatatggtaactaactctatgttgaacattttgaggagctattgaagtattttccagagcagccaaaccaatttatttcattagcaatttatgaggattccaattgtgtttcttcacgtcctcaaaacacttgttattgcctttttaattttagccatcctagtgggcatgaagtggtattgtgattttgatttgcattttctaatggctaatgatgttatacatcttttcatgtacttattggtcatatttatgttgtctttggagaatgttcagaatctttgctcatttaaaaattgggttgtctttttattgttgatttgtaaatgttctttatatattttgcataaaagttcctttacagatatttgatttacaaatattttccttcgttctgtgggttgtcctttcatctttttgatggtgtcctttgaatcataaaagattttaattttgatgaggtctaatttatgtattttgttgcttgtgcttttgctgtcatatctaaaaaaccattgcttaactcaaggtcacaaacactcctcttttcttctaaaagtcttatagttttaggtcttacatttacgtcttcgttctgttttgagttaatttttttatatggcatgagttaggagtccaaattcatttttctgcatgtggatatacagttgtcccagtaccatttgttgaaaagactattaattatccatttaattttcttggcacctttgttgaaaatcaattaaccataaacataaggatttatttctggactctcagttctgttctgttggtctataggtctatccttatgccagtaccacagtgtcttgataattgtagatttatagtaagttttgaaattgcgaagcgtgagtcctcctgctttattctttttcaggattgttttggttattctgagtcccttgcatttccacatgaaatttatgatcagcttgtcaatttctgtaaaaacaaaaaagccagctgggattttggtatggcttgcattgaatttgtatatcagtttggttagtattgcggttttaataacattaagttgtccaatgcatgaacacaggatgtttttccatttatttagatctttaagtgtctttcaacaatgtttcagtatacaagtcttgcatttcttttgttaaatgtattcctaaaagttttattctttttgatatacattatacattatttcttggagatatccatgtcagtactgataattttgtatttcttttatatatcatctatatgctggctgctctgttaaaaaccgtattatgaaaaatttcaaatttatgcaaaagttgagaacctccacccccatattattttgaagcaaatcccaaatatcatataattgtatatataaactctttgtatatctctctaagagataaggtcttaaaatacttgagcacaatacctttgtcatacataacaaaattaacaataattctttaatatcatttaatatttggccagtgttcctatttcctgaattgtctcaagtttgtctttttatactagtttgttccattcagaattcaatcgagggctacatgcacattgcacttgttttggcatattttaagtctcttaactgataggttcttctctcagtcttttttttcctctttgcttttcatttattcataaaaagtcatctaccttgtagactttttcacattctgtattttgctgattgtttgttcttccatcccatgtatttcctataaactaataggtaggtctaggcttgattagagttagtttagatttttgacaagaatactacctaaagatgctgtgtacttcttactgcaccacattaagagatctctagtgtctaatgcctttatttttgtggtgtttgattgattaatgggtttacgtagtattggcctgatccatgtgttatgataaagatcccagcgacctttcaaataatggttttatcagctattgatcatcattgcctacatccagtggtgtgtcagtgaatgtttaacaaccggccacttgccaatttttatggtgtaaacactcctgccatggctaatttcattcctactgatgtgttactgaatgtggagtttggaacagatgcacacagttggctctcacaagctggcatgagctttttccagcaaaccactgcttagatccattatttcattggtagttgcaaaatggcgatactctattttttctacctttattaattgggactatggtttatttaagcattttcctattgttggacatttaatttgtgactattatgaagcttgtgagctgaaggagatcataaaacataattctcagtacatcagtaaattctttatatacatctgaatttatagaattgtatgaaaactgaaatagacttcagtaatggtgaccagaaaagtgtcttattcaaccagtatttaatgagcatttactgggtacttggcactttggaggatcccaagagggatatggatatgcccccaaactctgctaatcaatgtcacagttgtgtgtgattgttagaagggtttagagtttgggtggttgctaactagaatgatcagtggatttgtgggcagggggtgcacagggctggtgagctaaactttgaaggatatgacttttcagtcaaatcctattcttttttgacatctgtcttgatttacttcttatgactagtttcctgggtgtctactatagtagcctcaaatctggcttgcttgctttgttctttccttcataaagcaacaggattaattttctgcagcacacctatgatcacttccctactcaaaactcttcaggacctactatgtaatcaccaaatttctggtggaactgaacccgaagccatgtgattatattagctcagtaagggacacagtactgtggcctggagtgcctggggaggagtgtattacaggaaggaagtagagactagaagattcaagttggctggctggccaagaaaaatggagactggtggagaaggagtttgtagacggtgtctttgggaagtcttaggagaacatcccattagggtggtagggttaagccagattgcaaaagattgtggcataagcaaggaactttggtgtggagaagttgtcatcacaaagtcattttgaaatgtcgaaggtttagcagttgttctgactgtatgtcacattttaaaaaataatggtagtggccaggtgcagtggctcatgcctgtaatctcagcaccctgggaggccgaggtgggtggatcacctgaggtcaggggttcaaaaccagcctggccaacatggagaaaccccatctctactaaaaatacaaaaattagccaggcgtggtgatgtgtgcctctaatcccagctattcgggaggcttaggcttgagcctgggaggtggaggtttcagtgagccgagatcgtgccactgcactgcagcctgggcaaggacagagtgagactctgtcgatagatagatagatagatagatagatagatagatagatagatagatagatagataaagatacataagatagatagatagaggtagaagagagccagttccaagatgatagactgtttttatagattgccttcctcctaacacacatttgtattctctctctctcccccaccgcattattcagcgctaatgaaagtgtgatggaaacagctgctagtgaatgaatactaactaatcctgaaaaaaagatgtgtacttcttgaaattttagtttgatttacctgaaaacatatacagaaacacaactagtgatttcaaccaaccctagagttttaatagtaaaatgcttaggaggaatgcatttgtgtaaatgtaatatgagagaggaaaccagacacccatctttgaccaagattgaatctcatgcatttttgtcacttaagtctgcccatgtctccatccaggacctagttaacccttattgcgtatcctatggtacaggaaaaatgagttattagtaaacatggataaattttagaatcatgaagtgtcaatgctaaaagagaacttgaatgtcatcttggccaactctcacatattaccaacaaggagactaagatccaggcaatataatggctttgttctccatcagaatctttctttccttttttttttttttttttaagatggagtctctctctgttgcccaggctggagtgcagtggcgtggtctcggctcactgcaagctctgcaggttcacgctgttctcctgcctcagcctcccgagtagctgggactacaggtgcccaccaccacgcctggctaattttttgtatttttagtagagacggggtttcaccatgttagctaggatggtctcaatctcctgacctcgtgatccacctgcctcggcctcccaaaatgcttggattacaggtgtgagccaccacatcctgcccagaatctttcgaagttgggaaatctttgtttagatctttgttgcagcagatttggtatcaaagaaagctatctacattaaattaatttggagggcacaccctactacttttctacgggcaataacactaattaatatctaaagttaaaggatgtattaaagaatgaatatggtaacctttgcaaggcactcttcaatgtgtttttttctgtgtttccttctatgtgatttaaaatgttagtagatttctctgaggtacttcagggagataggaaaggagcttttgccctcatagatacttggaaataatatatctattttctttttttaatttcaaaaatgaaattattattaaaagctctaaatatagcaagaatataagacaaatagtatactgaacatccagcttcaacaattaatcaactgtgtcccatcttgtttcatatctgtcttcccccacattattaattatacttttttctacccttagcttaaaaaaaactttattgaggtatatagatcataaagtttatccattttaagtgtaaaatttaatgatttctagtaaatttatcaaatagtgcaactttcaccataatccagttttaggtcattttcagcactccaataatactgcacatacctgtttacagttaatccccatgcccagccccaggcaaccactaacctattttgtgtttctgcagattttccttttctgaatatttcatataaccgaatatacaatatgaggtcttttctgtctgactttgtttacttagcatgatgtttttgaggttcattcatgttgtatcatgtatcagtacttaattcctttttattgctgaatagtattccattatatagctatatcacattttgtttatccagtcttcagtttgacagacatttgagttgtttctgctttttgtctgttatgaataatgctgccattaatatttgaatacaagtctttgtgtgaacatatgtttcatttctcttagctagatatataggggtggaattgctgggtatgtggtaaatttatgtttaactttttaagaaatggacaaattgttttctaaagtatctgcaccattttacattcacatcagaaatgtatgagggttactatttctttatatcctcacccacacttattattatctttttgattatcctacatcctagtgtgtgtgaagtgatatctcactgtggttttgatttgtattcccctgatgattaatgatgttgagcatcttttcatgtgcttattagttattcctgtattttatttgatgagatattgtgttagtctgttttcacgctgctgataaagacatacccaaaactgggcaatttacaaaagaaaggtttagttggacttacagttccacgtggccggggaagcctcacaatcatggcagaaggctaaaggcatgtctcacatggtggcagacaggagaagagagcttgtacagggaaattcccatttttaaaaccatcagatcttgtgagacccattcactatcacgagaacaccatgggaaagacctgcccccatggttcaatcatctcccactgggtccttcccacaacacatgggaattatgggagatacaagatgagatttgggtggggacacagagccaaaccatgtcagatgtctactcaaatcatgctcattaaaaaattgggtgtttgtcttattgttgagttgtatattctgtaattctttatatattctggatacaaatcctttatcggatagatgatttgcaaatattttccacagtctgtgacttgtctttttgttttcttaatgatatgttttgaagtacagaagttttgagttttgacaaagtgtaatgttaaattttttccttttggattgtgcttttgatgtcatatctgagaagtctgcctaacccaaggtcttgaagattttttcttgttgtaaaatttttatagttttagctcttacgttaagatcttgaatccattttgatttaatttttgtataaggtgtgaggtaaggatctaagttaatctcttcgtatatgaatatccagttatcccagcactatttgtcaaaaaatactctccttttcctgttgccttggcacctttgttgagaatcacttgtctgttaaatataagggcttatttttggacactgcattctgttctgttgatttatatgtttatttttatgctagcactatactgaatgttttttaacacaggggagtcatacataatcttgcaaagaggtaatcccacgactcagaagtctttaagtatttgctacaatggcatattttttagatagtatatagtagcttatttacttcatttgtggtttgtagcatgttcagaaggatcctttgagctccttgaggttgcagtacttctttgctttgaagccttctgtcatgtttattccctgaatgtagaataccctctgtctagctgtttatcctccatctctgcatttttctgctctacctgccctgtaggttcaaaatgtggtactgattactgctcgatagtagccttgtgtccttggcaaggtcattttatttctccaggtcttaattttctcatctgtaaagtgaaagaatcagattttatctcactacttttctaaactctgtcgttaatattttccttgttgaacagttacaaggatgtgtaagttaatctcttttaactggtgaaaaagtatattctgttccatagagaattaaatgagcttgtatttcggggggtggtgtgtggtcatcaggggatagaggcaggtatttctggaaaggtgttcttggcaaacattttgttacatacactggtgtatatgacatacatgtccatcactgtatgctgggtgatcaagagatatgtataaggtcatacatgcttttatgattagaaaggagagaaagaatgaacaatttctgttacaaagaaatagccatttttatgaacttgccaagaagaggaatggtccttactgatgaaatccttaaagctttgcatgtggctctttacttgattgatatttaaaagtataggtcccactgggaggctcctttcaacattttccattccttgagtgtttttcccccctttggtattcgaatgcttttattttcttcacataaaatattcctagttaggggggatgggagcccctttccacagctgaagttattccaagttttgttccccctgaagaatcggctctctgttcctgaagctttcaatggccacatctgctgctttatttccactcaataagttggaatatattttcatttagttattgattaggggctatgtaaaaatctgaaggaaattagtaaatagtaatgtttatgaataacattttacctagaaatttctaagcgtaatgaaataagaggataaaaattgttagaggttggagttttggatgaaggtaccaggaagcagagatccaataaatcagtatcagaatctgcatgtctttcaataaacttaagaaattgttttaaacactaggaattattagtctgtcttctgaatttaggattaaatgacagtttcttttcctgaagtttttaatgtggttttcaggattggggtatttattattttcctttggattacacttataaaaatttttggctggacaaagccttgctgatacctagtatcccactttattaactataacacttgacgaataaacctgcaattgcttgacgaatatggtcactttttaaagtatgtgggaacaacattcttctctcgtcttcttgccttcttttccctcccaggaaagcagttgttactattaacaagtatattgtcatcttttgcaactgcacactagattattcagctattttttttcttttttttttcctttgccttccaccatgcgatcaaagtattttttaaatttcactttgcatgaaggtgtactttttcttttgactgattagggcatactggataaaatatttggatccaattttaagtcaagagcagactgaaaatattgtaagagaagatttttaaaattaaatttaattccaattttcaaccactgtgtgagtacctactaaacataaggcagtgtgtttaggtgctgtgggagacaaaaagatgaattagacagaattgatagaatgtagctagattaatatctcccaccattaaaggaaaggaacacagaattataaatgcaaggaagagatttttcagcagcaaccgaacaaggaaaaatgcatgagttaatgctatatatatatatatatatatatatatatatataattttttttttggaaagagtggcaactgagggaaacctgaggctttgggtgcacttctgactctgcctgcttccttgcagaagctgtgtgtgtgagtaggcaaatcttgagagttctcatcgagaccctaggtctagagcaaagtgaaatgaatgagtactcgtaattttcctttttcttgactaagtggaaatgacttcaggaaagagagttggaaaagtaaataatcatagctgatatcctgatattgtagaggggaaggcccagagcttcatgctgaactggggacaaactgaagtctgagaagttcctccaaggccattgatagaactccaagacttaggagaatgcactctgctgcagggttttaaaatgttgattattttggtatttccttcgtaattctaaatagcatatttgtgtaacttcttgtagacttcaatttttgccatcatcttccctcccccattatctttctcctccacccttccaatatagttatattataattttggttagattaatatttagtgtttatattattattgttatagccatgtaagacatatagtaaattactttttttttttacttgcacaggtttttgtttgccttggagtgaataatcaacttgtttcttttcaaagtacttgcccttgattcaaccacagacgtcttcaattttccagagttcctcttatgaaattctcacacctcaggtgttctgtcagtttcagctttttgaagcaatagaaactgattgtcttcaatgcctggtacatagttttcatcatgggatctctctacactgtcatccaaggattcccttcctctttttcccatgttggatttcttttattactgtatcctgtgtctttctctttctttgtttactttcttgttttggtgaagcacatccttcagcagcttccttagaaagggtgcatggagctcaatttgagaccctgaatgtctaaaaatgtatttaattatatcatcatgcaggctgctagtcttggatatacaatcatcagttggaaataagttttctttagaattttgatggaattgtgccaatggattctagcttctaatgatatatgaagaagtctaaaaccatttggacatctgatcctttgtatatgacttgctctcttctcctatgccctgctgaaaacttgtaaattattttgactctagtactttgaaatatcatgatataccttgtcatgagtctgttttcttccattgtcctggatattcagtgagtcctttaaatttagaaattcatattcttcatttctgggaaattttattgaaccatttaattgattatttttcctgctgttttctctgtttctctttgtggatcttttatttggctactaccctattttctggaagatttcctcagattatttttgacctttctattctctttctgctatcttttaatttccaagtattctttttgttttgttttgttttctgaatgttctttgtaaatagcatcccattatttcatcttagcaaatagcatttcttatgtcttactgagactttctctggtgactctagttaaaatttcatctgtcactctctaccccattgtctcttttctcagtagaatatgagcttcataagggtatagctttttttttccctgtttttcccatggatattttcccaataccttgaacaatacctcccacatagttagtgtttaaatgtttctggaataaacttaatgatcattctgatgatattaataatatatattttaacgttttctcctagtaaaggtctagtctgtttctttgaggtcatttcttcctgtttttattgatccctaccttaggttagaacattttctgcagatatctggtaatacttagtcatccacttatatttaataatgaaggataaaaagttgcttggaatatatgagcaaattgatggaagttgccagctattggcttcatggtagaatggtctggccaggccatcctgttggagatcccttgatatcaactctttagatgtctcttcctggctgatctgattctctggaacacattctcctaatctctagaaggaagcagcagtctgggagcagaagggaagaaggctggaagaatctcagcatccaaagtgcatatttttactgaatctgtctgttttcagcatggccctcatgccttcatctgggcctggtgccttccctgaaaagaaaactatatctagcattttgctggagtgagaaacatgctgaaactgtgcagaatgtgggagaaaaaactgctcctaaactgcttcaatcagtctttttttttttttttaatgaggatggaacataatcctatagattttaagatagtttaaagaactatttgttgatcacttactgtattttgagttatcaggtgagacagatataaggcatagctactacagcagaggggactgtaagagtagggcccctgaagccaaaaacagcatgaagaatagctagaaccagatcctgaagggtcttgtcaaagtatgcccttttcctgaagggtaggaaataaatccactattagttcattgctttaggtttttattgctttcctcattttacccctacattcagaggtgtttgatgccaccaattcctgagaactggggggcttctgtggtacaaatttgttactccctgctttctcagatctgtctagtcagctattagttgctcatctgttttcccagttccaaatttaaacaagagcatttaaacagttctcttcatttttgtgttaatgagttaagagtgagattagttacatgtatttgaactgctgtctatactcaaaagtctttggataggacatttaataaaacgttgggtcatacacaagaaacaaggaattttacacagtatcaagccaagattttagtttaaagtggtcccaggttgatagtaccctcagatttctggcagaagcgatagagggaagaggaattcactttccacatgcctcaaagttttcctgtcggtaaagttccaaggaatttgagtttagagtcacaggttgctaagcacactaggaaatgaagcacaatgagcaagaacaaacaggaaatacaaagccctcagatactgaaattatataaatatgttgaaagaaaagaggaagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtcgtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaagaggaagaaaatgaatggccaagaaattataaaaatgaaaaaaacattttcaaaaaagaccaaatagaacttctagaaaagaacaattctgtaacataaactcgaagactggattttgttagacattaagaacgactaaagagggaattggttacttggacagtagatcgtagaaaattgtctagaacacagtacagttagaaagctcttgaaggagaggggagagaaaaatggtagaaatacaacatttaaagaatcactgagaattgaccaaaattaatgggttgctacatggttcagaaattccagtgaagctcaagcaagtgataaaatgatggtagagaaatacatgtgcagacataggataaagtttgatatttcagagtacccaaaacaaagaggagatcttaaaagcaaccagagagaagatgggccatctaacaaaagagtgatttgactgagagctggcttcttaatagcaatagtagaaaccagaaggcagtggaatgttaccgtcaatgtgctgggagaaaatagctgtcaatttagaattctatacccaattaaatcctctttcaagaggggaaaaatgacttttcaatcaaataaactaagtttgctactaatagacttctcaattaaggaaattctaaaagacatactttagacatcataaaataaactgtaatggaaattaggaagcttttagcactgagtgataatatcacaaataaaaacctatgatattctactaaagaggtacttggaaaaaatttataaccctaaatgcttacattagaaaataaaagctacaaattagtgaactaagcaaccaatttaagatagaaaaagaacaagatatgcccaaagaaagtaaatggaagaagataagcagcattaataaaacagaaagcaaacatacaatacagaggctcaaaaaagttaaaagttggttttttgaaaagagtaacaaaactgacaaatgccagctgagattagtgaaggaaaactggagtatgaggaatgggaaaagacaattacacatgcagagattaaaataataataagaggggggtatggacaccattatgctaataaatttgaaattttaggcaatgaataaatgcctagaaaaatatcatttatcagaatcgacttaagaattagaaagtctgaaaagtcctataacaattcaagaagcagaatcatagtttaaaatcttgtttaaagaaaactccgggctcaggtggctctcctgggaaaatttttatttgatattcaagaaaaaatttccaatcttatacaacctatttaagagtataaacagggcatggtaggggtttgggggtggtgctctccacctgaatgaagcataatagaggaccatatgagaaaggaaatcacttgcaggtctcactcatgaagatagttgcaaaaatcctaaacaaaatatcagctaaccaaatctagcagatataaaaaacttaccaagttgagattatcccaggtctgcaagggtgttttaatattagacaatccagaatgtaatttaccacattaacaaattataaggaaaaaataataccataatctcaatggctagagttacagctctgattaaaatccaacaacaaattatcctgaaaagaagtctcaaaataaggataggaattttcataataatctatttttttcagggattatatatctatagttttattaagacaaaaactgagagtgtggtgtgaagtttacattcaaacaaagttttcaaagaaatctaacacatgcctaaaaagattttacaatgtagctctagatccaagtctagataatatcaagaactgatggatctcatgactcaagacagagcattttgggtatcagttacttcttaggatttgttaaaaaatggttttgtgtgtgtgtgtgtgtgtgtgttttaaagtgaaccactgcccagtatgaaagtttaatctcctgagaccaaggcttttgaaatcactcaactcttgagtcaattcagtgaaacttgtgctgtcagtgactgaactctgccaccaatggtttcagagttcaaagctcaaaagagaatggctccaaaagttgtcccaactaagagcatgggccctttacttccctcctgtcttatctcctctaccaccctctttcccttccccaacacctcagccagtggctaggatgaacaagctgatatttataactttattattggaaaagaaagggtcttctaatttcaggaattagcacctctgaggcagaatgatctgcttgtactgtatactctccaataaaagaccttccttcctcagtcaatttccatctccaaaatggcaactctggtaacttattaactggcttagtcctttgtgagactaagtacattaagtttaggcagggaacaccatggcttatagatttcagacattcacagcttttaaagtctctcacagtccgtatttatggtgccagtgacatttttttcaaaggtaaaatattctggacatagaagcaaatcattagttttctgttctttgcattgcttcaccatgtcccctatcaggccccaaattttaatcaaaatgatgctacccatctccctttccaccctccccattcctccctctcccacataatacaccagtaatagccaaaaactacacatttgctacgctgtaaaaatgtagagttaacactattgggaagaaagttgtgcgttgcggagatgctctttgattatctacagtatttttttgctctcccacacacccagttctgcaagttttgtccttcataaagggccctttgctttttctcagcaaagtgcagaaaaggttgccttgaagcacttatcccccttcccctccactgggacgggtgtgcaaactatacagcttggaatggctttaaaacacttgggctgctgcagggcacagaaacgatactggctcttcaaagggcatcttctcaagctacctctatggtgtcaagacaagtagaacttctttccttcccacctgaaacccacagtcagatgtgatagaggctggtactcaggagagttaattcttgtcatcatcctctttggggtaggaatgccacgtcagcctttcctcatagaaggatatgacaacccgtgggcatttgacattgacttccttggcagggacgaggtcagcctcatcagaatttttccctttcatcaggaacatgagctctccactggagtctgtagctccaataatctgctccggctccaaaccctgagcaaagcctcgtggcttttctgactcttctttcttcttctttggtttgctctcctctcccttatcttcagaatcagaatcagctttgtgcttgcctccctctgatttgtctatctcatgtgctgttttctgtgacggcagaaactcatgaggtcagggcaatccaagttctcttctgactcccatgtgttgtcctcatctgagaatcccttccactttaggaggtactccactttgccctttaccaatcgacggtagagaactttttccaccacatattcctgttcctcctcttctagcacctcctccactttcttcttgttttgttttttctccatagcgtgtgtgtaaagggtgatgctgctcagagcagtgcccaggagccggaaaggaatcggtgctgcgctattggcgcattgggtcggccagggcagtggcgctcagaaaagcagcaagggtagctgcaaaggagccccttgctgaaatggtgtaccgcaggcctcggctaatggccctcctctcagccgaacaaaagagccctgcactctgtgctgcccactgcccactgcctgcaccgccttcataatctattaaagggtatctacaacatacctacagcaaacaccaacaccataccttatggtgagctagtaaatgctcccctttgagatcaagagaagacaagaatgcccattatcaccatttaaattcaacttttacagtagataattctaactaggtaagactggaaaaataaaaaacgtggcaaaggtactgaaaagaggaaacaaagctgctcttagtatttgtttaatatggttgggcacagtggctcatacctgtaatcccaacactttaggaggccgaggtgggaggattgcttgagcccaggagtttgagactgcagtgttaatgatcatgccactgcactccagcctgggcaacagagtgatatcctgtcaagtataatatttttgatataaatgtgggggcttccccccaaaaaatgctctcagaatttaatgaggaaaataacctatgccaactcttgtttttttttctttttctttttctttctttttttttttttttgagatggagtctggctctgtcacccaggctggagtgcagtggtgtgatctcggctcactgaaagctccacctctcgggttcacgccattctcctgcctcagcctcccaaatagctgggactacaggcgcccgccaccatgcctggctaatttttttttgtttttgtatttttagtagagatggggtttcactgtgttagccaggatggtctcgatctcctgacctcatgatctgcccgccttggcctcccaaagtgctgggattacaagcgtgagccatcgcgccaggcctctatgccaactcttacaatgagagattcagaatgaacaacggacacatacctgtgatactgttttgttgcttgaagctcaattgtgagaaattaaaacaattccatattaaatggcctcagtcttttaccctatttcttcttcatatttggggcaatttctgataaaccacaataaatgatgttgtaggtgacatgcttttatctaaaagtgtattcagaaatagacccacacatcatcttttacaagagcagggcatttgtctttaaaaaaaattaaatcatacaaaagaacttaatgagatccgaatcaggatctaaatactgtttctaataactctcaaggcagtgagtagggacagtcagccacagggctcacctggttggttcctctctctcaggggtcactgtcttttgttgcctgattttctagtgccttgaaaactgttgtttcatatttttttttctatgtgtttttggttgttttaaatgggtgggtaaatctctctgttacttcatcttggctggaagcacaagtcaatttaattaaatggctcatcatttcttgtatagtcctcttttttgttaataaggagttgttttaacacacgttaatacaattgcttggcctttcccttaaagtttgcgtagatttattttattttattttatgttatgttatgttatgttatgttatgttatgttatgttatgttatgttattttattttatttatgaatgagacagggtctcactctgttgcctaggctggagtgcagtggcacaatcatggctcacggaagcctcaactcctgggttcaagtgatccttccgtctcagcctcccaagtagctgggactacaggtgtgcactaccacgcctggctagtttttgtattttttgtagataaggggtttatccatgttgcctatgccagtctcaaactcctgagctcaagggatccgcctaccttggcctcccaaagtgctaggactacagcatgaggcaccatgcctggcttgtttcatttgttttgaaagtaactgttaattttaaaggtccaatctgtgaggatctaaagagtaggagccctgagatgaataattcctgaaggctttcagcattctctcctgctgtgtgctttgttattgacagctgttcaaggtctcaccacctctggagttttaacccaccgatgtgtttcataaattttaatgaaagacagatagagagaaatcatagataggccaacatgattgtaccatatccatgcactggctcaaaatgaaaatctctgtgatattaccctgagttacatttgtggaacacaccaaactccgtcttctagcttgtctgatccagctagctaagggaaatcaaaagtaatttgcaaaatcttttatgttcttttatgttcttggtacattgctctgatttattttttaaggcacagaaaattgtccaaatgcatagtacaaatttgcaaataaactacatatagttatttggacgatggtgtttttctaaggagttttgtaaagaatgtggtttaacttgccagtgtgtaatgctaaacttatttcttgtgtgttattatgaactttatttataatttcatagcagctgtttattttcattgctaaggtacaattcagatgttcttggcttaactcagtattctctatctcacaaaatttaaaattagactgatactttgtaaagattcttcagatgtggccagattattttaggaacagctttagttatccctgataataaatattagggagagaaaaagaaattgaggtctttgaagaatccctaaatatcatttcagtctatcactgtcagcctccctcactgctttcagatccattcccaggagcatttacagggtggccaagcttcctcatttgggttccagctctcttagtttctgtagcctactcattgagctaatgagcagtgtagtggctgagagctagggagaaatatgagagaaatcaaagaagaccctttctgacttttgccctagattgtttgaaacgaaataacattagaataatgaggaattgaccacctttcccttgctgcgttttaggtgtcttttctgtaccattttattatgtcgtcttaatcataacagcctacataaatacttgagtttgggttaggatgacaatgaaaaagggattagaaataacgtgtactcttttttcttaagccttcagaaggactgtaaaaacttaaagatgttaaatgcaaatgccattgccattccaagttaacaagcataagagttttttgttgtttatttttggggggtgatccttaatagtatgtgtttttcttttcagctaccaagtcaggattgttacccccaccacctgcgctccctccaagaccttgtccatcacaggtaggagacatatttgatttatgtaaactgttcggtggtagggaagttgtcctatcgctgtgcttctttgcaagggttgatcgccacagatctggtccatgagattcccaagctgataccctgtgaagagagcagagagtggtttaatttattctcatccagccagctccccagcctcatgtggaagagagaaagtttcctcaataagccaccaagcatacatatactagttcactcttggctgtccaggggtgcgtctgttttcatccccagagaagggtagaagaaggggcctctctctaattggaggtggagacatggtttttctgtatagtatgtgcaatctgggtgcctatattttcgtcagtactttaggagctatgttaattctacataaatgaaaaataaatggttatcaacatggggttagtgccgtggttttggcctatggtgctttctgtaggatggtatttttcctcagaacaaaaagctgagatagcaggagggggagaacatgtcaccaagatctgtttcacccctaaattaattctgccttatttacatgtgccactatggccttattcatcaacactttgcagagctgaaaatgagaagcaaacagtggagtgtggtatatggtgctacagatctttccttttgttaattgctgctgaagaaactttctatctttaaagaccctttctgatttttggcagaaaattttgggaaatttctctgtacacagtccctgtttctacttcattgttctgggtggttcagagctatccttccatacggggacatctcaggactcatgagtcactgaaaccacttttaacacatgcttgtccttctttcagtgaatgaaatggtttttagcatccactcaaccttgagatgcaaatactatgagatattggcttcctgctttagtgcgaagggtaataaaaagcccatttcttcctgacctgcatataaaccagcgagaactcctttccaggatgtaacattggccttaagagatattggttgaaccgtcaacaagtatttattgagtccctgctgtatatctaatgccaaaccttagttttgccctaagcctttcattggctgtaatttcttctcattcaaattattagctgtgtctgttgagcatctccaataaatcaggcattgtgctaagtgctttcagtgcattatttaatcctcacaaaacccctctgaggtagatacaggtactaatattatcccttttttttttttaacagataaggaagttgaagtatatgggggctaagcaagttacccaaggtggcatagctagtaaatagtagagccagctcccaaattgcaatctgtctcctaaaggctcctcctgtcaccatcactggagtctgagtgtctatgtgtacagccagacagcagatccattacacttgcaatggaggctttcatcacaggcccctaaggaggaccttgatgagatgaggctcctgctccacaccaacagcaaacctggacttggtcacaacaaaatgagcaggcatttgctagctgctagttcaagcctggggcttgagagccacctggttgaatgcatggaagacctgtctgaattgacttttgtaaccaaccttctagctttctcttcctgcacaaatgccagtagttactacccggtcccaaaatatgctgctgctatcagcagtcttcatctgagctgcttgaggtgggcttcttgcctgcttttggagcttagtcaccaaagatctgactgggggatctgggaattctctagtcactgttaatgaatgagtctgcttctttgtctaccagatttcccatcacaatataaacagtgagcccagtactcagcctatcagctgcctaactatggagatttcagatttcaggaacaggtgtgtaagaaatggaggcagaagatccacattccatttctctcccctattccctcctttcacccactgtaagtgggacacacatattcagatatatgaagtcctgggcaataaacacatggttatatttagtttttgtgccatgtcaagttggtattgaccctatgagcgtcttactaaccactttgtatgggacacctatatattctagtctttcccaaactgcttgtgataaaacagtctctgggagatattaatagggctctgtggtacagatttgcagactgctgcccctctacccctctgggagagtcgctgtgcaagtgagctcactaaaggctttggaggcctacagtaagtaaagctagtaaattttgttaaagccagcaatttcctagcttctgtgaccattgatatctttatttataaaatacctgttaggatacaaaatcagtgtgcaaaaagcacaagcattcctttacaccaagaataggcaagcagagagccaaatcatgaatgaactcccattcacaatcactacaaagagaataaaatacttagaatacagctaacaagggatgtgaaggacctcttcagggagaactacaaaccactgctaaaggaaattagagaggacacaaacaaatggaaaaacattccatccttatggataggaagaatcaatatcgtgaaaatggccatactgcctgaagtaacttttttttttttttttgagacggagtgtcgcactatcgcccaggctggagtgcagtggggtgatctcagctcactgcaagctctgcctcccgggtgcacgccattctcctgtctcagcctcccgagtagctgggactacaggtgcctgccaccacgcccggttaattttctgtattttttagtagagacgggatttaactgtgttagccgggatgatctcgatctcctgacctcgtgatccacctgcctcggccttccaaagtgctgggattacaggcatgagccaccatgcccggctgcccaaagtaatttatagattcaatgatattcccatcaaactaccattgacattcttcacagaattagaaaaaactgttttcaatttcatatggaatcaaagaagaccccatataaccaagacaatcctaagccaaaagaacaaagctggaggcatcatgctacctgacttcaaactatactacaaggctacagtaaccaaaagagcatggtactggtatcaaaatagacatatagactagtggagcataacagagacctcagaaataacaccacacatctacaaccatctgatctttgacaaacctgacaaaaacaagcaatggggaaaggatcaaaggtcaaaataaagggctctattttaaagtgaaatcaggttctgataaatttatcatttgccctagataacattgttttaagtttatcaaggttgaatattcaagtggaatgcttgttttgtgtaatgtatttttcctttgttaactttggcagtaccttttactgtatgttccctagttatagaatcggttcatagattgctcagagctactcatatctctggattcatgtattatgaagaaacaattctgtttcagaccagcttgtgttgattgaatctcaagttttggaagttctcttgtgaggatttcttaaatttgaaaactactattctcaagtagttagggaccataggcacacactaccaaacctggctttccaggttttaagtatgtaagaaaaatgagtttgtacatttgcaatatgcatacagagatatataaagattgtttctacatacaccaaaagcatatattcttttatcaaatgagagagatgaagtataggttttcagcataacatgcagtttagctggctcatacttattcaagcaccactgtgatatgaacatctggattaagttatacaaatggggccctggagttaggaaaaggaataagttaaaagaaacatctttttatttttcatactataggtaagatcaagaagaacctagtgactatatacaaaattaagtagtttgtgtttcacattttcctgtggcaagactagagactagggcatggtcttttggctcagctcagaagaggtgacttttttttgaaaaaagacttatttatagcataaataaccaaaaagcaattaaagtaaactatttcatatagagcagtgcattcttttgtttgtttttgttttgttttcttaagacggtctcgctgtgtcacccagactggagtgcagtggcatgttcagggcttactgcagccttgacctcccaggctcaagtgatcttcccacctcagcctaaagtgttggggattacaggcgtgtgctactgtgcccggcctagagcagtgttaaagtgagagttaaatgtattagcccactgtttgtatcattttaataaatccagtaaattgccatctgtagagtttgtgtttattcttttttttttttttgagatggagtttcgctcttgttgcccaggctggagtgcaatggcgcgatcttggctcaccgcaacctccacctccccggttcaagcgattctcctgcctcagccttccgagtagctgggataacaggcatgcaccaccacgcccggctaattctgtatttttagtagagatgggggtttcaccatgttggccaggctggtctcgaactcctgacctcgtgatctgcccacttcagcctcccaaagtgctgggattacaggcatgagccaccgtgcccggcgagtttgtgtttattctgtaggtcagttctctgccaagggactgtttggtacttcagtagctaagtccttttaatagtgttgatctcatgacagttttcttatggcaattgtgatagagccacagcttcagtgtaactataataaagaaaagattttgggggtgcaagacattatcttttaagttttctattagcaccacatttgataaattggggttccctgcagactaatgtgctcagaattttcctatttctgccactaatttctcaccttatatgtaacaaagttttcctcactagcaatgtaatgagtactaaaaatagcactggaaggtgaaagcactgtgggagaagcatttgatgaatacctttaagcttagagagaccaagaagactcatggaaggggtgagatgaccaatgaaattagttttaaagaaacaacagaactttttttttttttttagctggctaaaagatacagagctttactgcagatttaaaaaaaaaaaaaaaacccaaatgcagagaaacaggcttgcaagaggtcctggtatgtttgaggagctgcctgagatttggaaagccagattgtagggaaaatggctgtagtgttctggaagtggccatggggagcaagcctcctgctcacttccagttccagttctggtagggatgtgggagagaaacagcccctaccaaaggagttctgtctggggagcagaaactgacgggaggacagggttttagcctagtggttctcacccttggctgcacagtggaatcatctgggggagctttgaacgtgctgaggcctggagcccctcccagagattttggcatggggtgctgaggtccggccactgggaggtttaaaaacctctccaggtgattctgaagtgcagccagagttgagaagcactgaattagggcaagaggaaggaatgctcagagaagaggttgagaatatagggaattttattgatgagttcttatagggcacaatgaaaggggttctggagttggggaggcatgaggtcagcttaggggatgtactcagaccctatggggacaagaactcagatcacaaggggcctgggagtcaagggattcttgtggtgactgatgtgaacagggctagaggatgtgacaggaaggtcctgctggaagaactagtcactgtgtgcctcaggtcctgtgtgtactactgtgagaggctagccatgaacacagatggcctcaagaggaaaccagaacaactgtggtccattgagttaattcttcatctaacttcataatctggctagaatcaggtcctgaaagtgatattgaacccaataggaatatggcagtcatgctactctttttcaaagactaattttttagacacaactttttataaaatactacatttgttttatttggaagtaaaaactgcagctcacttaaacttaaatggcagttcgtaggccctgaatttgtgaaatattcaacaccattttaaatactctatccttttaattaatatcctgtcatttaaattattctttccacaagttaatacacagttggtgattcaaaatagtaaattcttctgggagaaattaagagttttagaccacacatacttttttggggcaggggaaggaattcctggtgattatgtaagtctcttacagggctatctaatccatttttaagtgttaattttattaaagcataacatacatactgaatctatttttaatacatactaaatcaatttttaagatagtaaaatgaagtataggttgagtaccctttgtctgaagtgcttgggaccagaagtggtttagatttcacttttttttttttttttttgggaatatctacgttacacttacctagttgaccatctcaaatctgaaaatccaaaatcctaaatgctccagtgagcatttcctttgagtgtcatgttggtactcaaaaagttttgggaggccgaggtgggtggatcacctgaggtcagaagttcgagaccagcctggccaacatggtgaaacctcatctctactcaaaaaaaaaaaaacaaaaattagccgggcggggtggcaggcgcctgtagtcccagctactcaggaggctgaggcaggagaatctcttgaacctgcaaggcggaggttgcagtgagccaagaccacgacattgcactccagcctgggcaacaagagtgaaactctgtctcaaacaaacaaacaaacaaacaaacaataaaaaaagaagaggccaggcttagtggctcacgcctgtaatcccaacactttgggaggctgaagtgggcagatcacctaaggtcaggagttcgagaccagcctgaccaacatggtgaaaccccatctctactaaaaatacaaaaattagcctggcgtgatggtacgtgcctgtaatcccagctactcgggaggctgaggcaggagaattgcttgaacccaggaggttgaggttgcagggagccgagattgagccactgcactccagcgtgggtgacagagcaagactctgtctcaacaacaacaacagaagttttgggttttggagcattttggattttgtattttcggattttggatacttaacctgtattatattgttgtcagctttcaaatatctataagaaaatagcaagaaacattatttaatgtgaacaatagagaaatgtcactgcttttaaaattgcatgttttttttatcaaattaaaactccgtgaataaacaccaaacatcatgaaatctcttgctgtaatatattcaaatgacctcatgtaatatataagtcattgaatcaccttaagatactgcctgttaaagcatatttatgaactttcaaaggtatatacaacatcctaatttttactcatcaaaatacgaatttaatatgtatcaagatagtttctattcatgcatgtattagaaaatcagaaattattccaaagtgaatttataaacgtatatcacttaagatgccaccttcattttcttccaaagtgttactttgttctgtcctacagtgtatgctgtagattagctgaaaatcacaacatgttaatgagtatttcagtgattaaggaaagaagatataaaccaaggctgtaccttcatttgtgatgatgaaagaacatactgaaagctgtaccacactgtgctgaatgtagtaatatgaatgtgtctgtctgtggtcttatccttagtcctgctactgtgtagctctctggctttgtgggaattaagtaagttagtctcatggacctatcgccccttctataaagtaagaagattggactagagggatcctactagtgctaagatgtctgattctattttgtattctctgttcaagaattttttttgtaatatagataaaacttcatgaaacacagttgagggacaagataggttggactaattttctctgctcctccctgctaagtacaactaaaacccccagaaatactataatggaaagaggattttttttttttgagacagggtctcgctctgttgtccaggctggagtgcagtggtgtgatcatggcttactgcaccctcaacctcctgggctgaagggactcagcctcctgggtagctgggactataggtccttgctgccacaccgagctaatgtttttattttttgtagagacagggtcttcctatattgcccaggctggtctcaaattcctgagctcaagtaatcctcccacctcagcctcccaaagccttgggattacaggtgtgagccatcatgcctggccagaacagactttgaaaggtttaaagaggaaagaggactggcatgacagtgaactagagacttcaagtagacagaagaccaataaggaaatagaaagcttgaacaataccatggttcaacttgatataacataactatagaacacccagcatcagcacaatagacatttttctcaagtgcacttggaatattcttcaggatagaccatatgttaggccacaaaacaagtctcaataaatttcaaaagattgaaattatattaaacatcttctctgatgtcaatggaatgaaactagaaatcaataacagaagtaaaatggaagattcactaatatgtagaaattaacatactcttaaaaacacaaagaagaaattataagtgaaattagaaaataccttgagatgagcgaaaacaaaatcatatcaaaacctatgggatgcagtgatagcagtactcggcgggaaagttttagctataaacacttaacattaaaaaagaagagatccaaaatcaacagttagctttacaccttaagaaactggaagaaggctgggcacagtggctcacgcctgtaatcccagcactttgggaaaccaagacgggtggatcacgaggtcaggagatcaagaccatcctggctaacacgggaaactccgtctctactaaaaatacaaaaaaaatgttattctgggcatggtggcgggcgcctgtagtcccagttactcgggaggctgaggcaggagaatggtgtgaacccaggaggcggagcttgcagtgagccaagattgcaccactgcactccagcccgggcgacagagcaagactctgtctcaaaaaaaaaaaaaaaaaaaaaaaaagaaactggaagaaaaagagcacactagatccaaagctagcaggacagaaataataaagagtagagtggagataaacaaaatagagaacagaaaaacaacagagaaaatagttgaaaagttgattttttgcaaagatcaacgaaattgacaaaactttagctagactgaccaagagtataattaagcatgtgttaacctctggtcaaaataaagggctctattttaaagtgaaatcaggttctgataaatttatcatttgccctagataacattgttttaaatttatcgaggttgaatattcaagtggaatgcttgttttgtgtaatgtatttttcctttgttaactttggcagtaccttttactgtatgttccctagttgtagaatcggttcatagattgctcagagctactcatatctctagattcatgtatcatgaagaaacaattctgtttcggaccaacctgtgttgattgaatctcaagagttttggaagttctcttatgaggatttcttaaatttgaaaactattctcaaatagttcgcactgaatgacaaattcaaaaggcaaaggaaatggccatagtgataagtgcaaggagaagagagggtgagaattagtaatgaaataccagcattggaatggaggagaaaagtgtaagcctgtcccccttccttctttttgaaagaagtactcagcattttgctctttatcaataagtgtctttagaattaatcctagtaactaattcaaaagaaaggaaaagttctatgatgacatttattttagtattataaaaataagaacaatacagaccaccttaatatctaggaagaaggcactggtcaagggtaatgtatatctgcctgattagaatattaggcatctattaaaatgattacatgacaaaacagtagaaaagaggggtaacagctgaatacagaggtgtttcctgattgtaccacataagtatatggtagacctttgatggtaaggttttctcatctctgaggatgaccttgaaggtccatggtgcatggtaattggcccctttccagtggtcggatttcgaattacttttacattagccactgttccctccccagtagggttttgagattcttagctgcttagtgaatttctactaactctttttaggggtctaaagggatcgcttaggtgactcatttataatttacctatcttgtcttataacttgtttttataagtttttatattttgggagatgatgtatgtgtagtatttatgtgaattgggatatctgtgaaggtctccagatggttcagtcctaaatgtcaagtgcctactgttaaatacttggagaagactgctaagtaattggtagaagtttaaatggctgttttggtggggaagttatgcagtttttcttttaaaaattttgtcttaaaattaaggattggggaaaagaaaaaaaagtcctctgatatgacaactagaataaaaagtcatttgaagatttaccagaataaaatgacctttggaaactacttttagagaccagctctcagaaatagtgataagacatatattgcataattacattgttacgatgactctagcaattgtgaggttcaaagaaatagtgtactgaagtattatcatctagtcattttttaaatctatgttctttggatagtaaactcttattgccctcactcttaaatagtaattctgctgtgtacagaattttagactgaaagtaatttttcctcagtattttgaatgcattacctcctcttctagcatttattgctgccactgctccggattgtactgtcaatctattttttattcctttggtgcagctttgtctttcctctgggattgcttttaaaagtttatttttactttctgaaggggtgggttgcccctccacacctgtgggtgtttctcgttaggtggaacgtgagacttggaaaagaaaaagacacagagacaaagtatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaagtgctgtgctttagatatgcatacacataaacatctcaatgcgttagagagcagtattgttgcccgcatgtcccacctccagccctaaggcggttttcccctatctcagtagatggaacatacaatcgggttttataccgagacattccattgcccagggacgggcaggagacagatgccttcctcttgtctcaattgcaagaggcatgccttcctcttatactaatcctcctcagcacagaccctttacgggtgtcgagctgggggacggtcaggtctttctcttcccacgaggccatatttcagactatcacatggggagaaaccttggacaatacctggctttcctaggcagaggtccctgcggccttccgcagtgtttgtgtccctgggtacttgagattagggagtggtgatgactcttaactagcatgctgccttcaagcatctgtttaacaaagcacatcttgcaccgcccttaatccgtttaaccctgagttgacacagcacgtgtttcagagagcacggggttgggggtaaggttatagattaacagcatctcaaggcagaagaatttttctcagtacagaacaaaatggagtctcctatgtctacttctttcgacacagacacagtaacaatctgatctctcttgcttttccccacactttcagtgttctgttttgatggcgctgcgatgggtttaagcgtagatttaaatttgtttatgccaggtgacacttggcatgcattttccttctggaaaatcatctttaattttaggacatttagtgatatctctgtgggttttgcttctctacttatttcttctgttttcttctggaactaactatatttctgtcaacacatttaaaaaaaactctagtaatgtgtctttcatcttttttttttcttttttgagacagggtcttgctctgtcacccaggctgtgcaatgggatgatccatggctcactgcagcctcaacctcctgggctgaagctgtcctcccacttcagcctcctgagtagctgggactacaggcgcatgccaccacacctggctaattttttgtattttttgtagagatggggttttttcatgttacccaagctggtcttgaactcctgggcccaagcagtcctcccatctcaacctcccaaagtgctgggatgtacagatgtgagcaccgcaccttgtcactttcatctatttatgttgtgatctttctgggcttgctctggatgaaatcttcatcttccaaattaaaaatcctctgcataactatatagcctagaatttttcctattctgttattaagcctctatcactattctttgattctaggttttataatccattcttttttataacaacctgttcttgttttacttttccctatttttgttttatacccatctattcttttttaggatctattctccacttttaactttgaggattctaaaatacttactttaaagttatttttaacttgttctatttttgtttttgtcaggagcgaatttgccttttttatttggctgttctaccatgctttttggaattttgttttgtaggcttattttgagttggagttcaatctcattctcagttctctgagctcctcactttctgccagttcagtggctgtctctaccaactattcctggcatccatggcctccagtcaagagctgattcttatacttgaaatacagtacttccatctggtgcaggtgtcaggggtcttgtagatggcacccaatggtgcttagcccagaaccaggcttcagtgttatatctgcttcagttcctttcctaagtaggcaacccagagcttctccacaggcttcatcttggttttgcagcttcacaggtagcaaagtgataccttagcctctggcatcagggaatgagcttggtaccagtcccctgcctcatgcgggacatttatttatttttattttttattattattatactttaagttttagggtacatgtgcacaacgtgcaggtttgttacatatgtatacatgtgccatgttggtgtgctgcacccattaactcgtcatttagcattaggtatatctcctaatgctatccctcccctcttcccccaccccacaacagtccccagtgtgtgatgttccccttcctgtgtccatgtgttctcattgttcaattcccacctatgagtgagaacatgcagtgtttggttttttgtccttgcgatagtttgctgagaatgatagttaacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctctgggtatatacccagtaatgggatgactgggtcaactggtatttctagttctagatccctgaggaatcgccacaatgacttccacaatggttgaactagtttacagtcccaccaacagtgtaaaagtgttcctatttctccacatcctctccagcacctgttgtttcctgactttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccgtttcctgactttttaatgattcatgtgggacatttaaatccctgttattaggaactctcagctgcctctgtctgcttctgcaccctctgcctgcttctgcaccctctgcctgacctaccactttgtgatttggccccacagagacctttatcttgcttctgagtgggactgagtcttttaaattttaacagttcatgctaacactctcacatctgtcattgcatatcattttatgtaaggggaagttgagattcagagagcagaagttaactacttgggcctcgcagttggtaagtaagccagcctgctgtagaagaaaagggctggaaaaggtttctggggaagtgctagaaatttaataagcatgtagagagagaaaaatcattcattatacatcacaaaaattaactgtagatctgctaagtaaaagttgattaaatttctacactctgtgcccaccaataattttctaaatgtgaactctttcctacattaatctcaaatgcttatttttaaagtgccttccccagtgcagacttacattcatcttagccaaaatggccttcacatttggtctgtgggacatatttgatgtagcaaaaggccaagggtaacccttattctaccccctaaaagggaacagaaagagaacttttgcataataaataattatttatgcatttcaaaattgattttaagagtacacaaaccatagaggctttgcgattcttcatgtattttattaatttatcaagcacttcaacagagtgcccgatgctcttctagatgctttacaaatattaactcatttaagcctcacaacaaccacgtgcagtgggttctattgctatcctaacattgcagataagtaaacaaggcacagagaacctcagcaacttgcttgaggtcagtgacagaaagaaagagttaaggctatgattcctaccttggctatttagccccagtgtaccagctcctactatactactatgctgtgctgtgaaaccacgtctcacaattattttattaacaatcaaactgacacactatctttgtcagggacacattttatttcatggaactagttaaaaattagctttaactcacttctggtgacttgttttctttcttaggttcttcctcattatattatgcccatgctattgttatataaagctcactctgctggtatcattcttctggaagatgccataaattcatctaatcatttcatcagatgttaacggaatgtgctcactgtaggcccacagtttgctgagaactataggagcacaaagattgtgatgtgatccttatcctgtagttcctttatcctgcgtcaccctctcacagcagtcatgcccaacactatctattctatagtctctcatggttcttacaactgagtcattttctgtgtgtctcatttaaacccatttcttaatgctttattgacacaggttgtaagcaataaactggtcaccatgtttctaataactaccaatatagcccagttttcccctggggggctcagttatggtggttttctaggtttctgagcaatggaatcctcatttctcttctctgctgtcccctatcgcactgtgacttttttttttttttttttttttttttgagaaagagtcttgctccgttgcccaggctagagtgcagtggcgcgattctggctcgctgcaacctccgcctcccaggttcaagcaattctcctgccttagcctcccgagtagctgggattacaggcacatgccaccacgtccggctaatttttgtatttttagtagagatagggtttcaccatgttggccaggctggtctggaactcctgaccttgtgatccacctgccttggcctcccaaagtgttgggattacaggcgtgagccactgtgcacggcccacactgtgactttaaggaagcactcctgagggggtcaggggaggagcagatgtggattgggaggatgcccaaatgtgctactgtgctaatgggaaaggacaatggaggacaaccaggggttgggctcagggaggcagcttgacagaggatttaagagcatgggcttggggtttcaaatcctatctgcctcttactggctttgtgactttgggcaagttagtctctctgtgcctcaatttcatcatctgtaaaatggggatcatggtagtatccattttcatagggttatgatgattaaatgagtgaagatctctaaagcacttagaatgatgcctggtgccatagtcaaccctcaataacatttagctgttataattatcatcaccacaggcctagtgaaacagaggtggggtctagttggcaaacacagaacagactccagatagctagaaattagttgcaaccagcccagaatgagtgctgaagtggctcgctaaagcacttgcagtcaaagcacattgttaccctcatctgtgacctttcatgggctgtctctctgcctatgtcaggggttggcaaactatagcctacaggccaaatccagatggtcacctgtttctataaataatggaaatgtgaaggagaatcaattggcaagaggcacgcatagcgcatcttcaaccttttccatcggggaacatgagtcttgagaatcctgccatagatcaaaagaatggcaatgagaagaaccagtggacaggtggataggcctccccatcagcctttaaccctcctgctcttatctcaaggatcatatgcccgtgtctgtggtttctgatttttccttgaggacctttgaccgagatgatctgtctttcagactttactagcaaaattctgagcagtatcttttatacaactggcagcttcaaaggcttgcagtgggtaggcctccccaactctgtttcgcaagataattaaaagaagccagactccttcatccttgaaggagaggaagaagaaaacaagcctgtccagagaaaatggggtgaaggaatttttctccccaacttcctcctaaataccctgctctgcccatcaaattttgtaagtatcacccagtggtgtgttggtaaaccttctcccctgcggggtgggggaaagccccaatttgcagccgttgttgctgtctgtgttgtgaatgctcccaccatgctgactgcaagtggagctgggaagagatgtgtaccatcggctcactaacactagcatgctctgtggtagacagcttcccttgcctctgaatccttgtgtcaggattctacgtgccaggcaacaagagctttttttctttatgtatcatgccagtgattttagtctagggcactgttttagcccaatcccagaatgtgctattagaaatggggccatatttttgaagttgctaggggcaaaacttccctcttgtttatgtttaacttgtgccactaggtggcactttaaggacattacaggaaatcggctctactggatttttaaaacttttttttttttgagacggagtctcactctgtcgcccaggctggagtgcagtggcatgatctcagctcactgcaacctccgcttcccgggttcaagcaatttagctcactgcaacctccacttcccgggttcaagtaattttcctgcctcagccttccgagtagctgggactacaggcatgtgccaccacacccagataatttttgtattttagtagagatggggttttgccatgttggccaggctggtctcaaactcctgacctgagttgatctgcccacctcggcctcccaaagtgctaggattacaggcgtgagccactgtgcctggcccaaaacactttttattgaagtataattgcatatagaaaagcaagctgcacatttaatgtgcaactcaattttcacaagcagaacacatgcatataatcagcacccaaatcaagaaacagaatattactagcaccccagaagccctccttgtgctgttttccagtcgctatctcttattcttagggttaccactattctgacttctaacagcataaattagtttgacttgtgttctactttatataagtggaattatgcggtatatactctgtgtctggctttttattaaatgatgtttgtgtgatttattcatactgttgtgtgtaattgagatcattgctgtatagtattccattgtatgtgcaaatataacactgttttctactattgatggacatttttgtacttttcagatttgggcaattatgaatagtgctgctgtgaacactcgtatccaagttgttgagtggatgagtgttttcatttctcttggatatatacctaagagtagaatttctaggtcatggtgtaggcatatgttcagctttagtaggtactgccaaacagttttacgaagtgtttgtactgatttacactccattaatggtgttcccactccagttccatgtcctcatcaatgctgaatttattttatggatggttcctaactcttaacataatttttatagctccctttctggccagctatttctaattgaaaaattttaaagccacattattctgatggacatggctcatgcaggaagggctatgtcaacccaaaaggggacatttatcacagtctaagtgtgaactatcagtaagtcggaaaggatgttactctaatactccatcacactgatacacagagcaaagaaaccaggaaaggaattcagattgtaagtgtgataaaatatcggttcataggccagggctctgaggcattttgaaatttgtatatacatttgttattattgccaggcctatatatgtcagagattggggcccaacagaaagaatttctaaaggcctcataatgaagtgcctttcaattgtgctgctggtgggtgcctgttttactaagggtctctttggtttggcaagaggcatgcatggggcatctttcttcaacctcatccctggggagcgtgagtctctagagaatcctgctttagatcaccttacctgtgaggctcatgttgttgactctgcagatggtgttataatatggctttaggtatgtgatatagagagtacagttcagacttgactcagatttctgttccattactagaaattggacatagaagaacaaaacccaggtcatggtcaaaatatttgtcttttagaccaaaataaagtgctcatagtcctttagttgtaacagtaagtctgtctcatggatgttgtccataatctaatgggttccaagaatccccaaggcattctgccatgtgactcttgaatccagcaactagttgcccattatagtcactggtacccactttcaccaaagttgttcctgagcccctctgtcagtgttttcctgagtgtctccagtgttggattggtctaccgaggggggtgcccaccagagatgttcactgcacactgcctgagatatccatgttaaagcagccgtgaaacatgaaagtctgaccgggcttttatttttaaaattttctccccccaatattagtagcggtaatatccagtggcacagatttagactgtggatagcctgctttgtgggatctgcttatattctaaattggagccagcattttctcagcctaggttttcatctgtttggcaaggaggaaaatgcccttatgttggattggctgctgcttgcagtaggaggaactatgcctgggaaaccaatcataattttaatcctaatgataatagtagctgctgttgtcaaacagttactgtgtaattgtgcttagcacactagacagatattttgcttaatcttcacaatattgtgagttaggtgaattatcccactttgcagatgaagaaattgcagctcagagagactaagcatgtgaccagctcacacaatgagcaactgcaaagcctgggtttgactccagagcctatatcctgtaactgttctgtgctctgtgggtgcagttaccaaggaatgaattactgacctcttctccagtggaacatgaaacagtattgggttcattgctggcttattccacacattgattagaggacctgttgtttgctggcatgcagcttaggtatcaagaaaatgatagggaagcaagacagatcctgccctccaggtgcttaccattcgtttatcatgttctgtctctcacaggtgacttgagtcatggattttggtaatcattcttgctgagaattcagtctcttggaccttcttgaggctctatttacccctctctctgagcctggttggggaatgatggggtggaacagtggtgtgctgggccattggttctacatcttctgtgactgggtttagcaaatggctttctgttgtgttcttgcctagcggagatgggggacaggtgaaaactaggcaccaaatgacatttagaatactgacagaatgctggaaaggccctggaggcagcagcaggattgtcttcttgtctgcctagaatttagctgctgcctttgtgatccccattcttggaatccacctggatccttggatgataaagcctgagttcgtttttctgacctgccaatattgcaaacctaaaaaaaaaaaagttacctattatccacaccttggcaaagttctacagatggacttcttttttttttttttttttgagacagagtcttgctctgtcacccaggctggaatgtggagtgcagtagcgagatttcagctcactgcaacctccgcctcccgggttcaagtgattttcgtgcctcagcctcctgaatagctgggattacaggagcgtgtcactacgcccagctaatttttgtatttttagtagagacggggtttcatcatgttggtaggctggtctcaaactcctggtgtcaagtgatccacctcccaaagtgctgggattactagcgtgagccaccatgcccggccagactattttttaagtgggatttgactttttttttggttgcaaatttgacttttaaacaaaatcttactgctgaagattttgcccagctgcaaatatttatctatagaaccatgtggcatatacccccattccctctatgatgaatggatgagaaaacaattaagaagcctagttagttttgcaagagcacctgtggccttgcccagactagggccttggagacttggttttctcatctcttaaatgaagagtttggaccatcagtggttcccagttgatctgggctggctacataaaaatcacttagggtgcttgttaaaatataagtttctaatgccccatccctaagggattctgatgagggaagtctggaatagcatctacaaatctgaatttataaaaagttccccagataattatcctgctctggttatatttgggagccactgggctagagggtctagaacaaacataattaagttagggagaaacttctgatgtgcttgaagatttggggaatacctatatgcctggagcaggttccatatgggcgaactaacccagttatgttgcagaggtaaattggagccagaggatggaagacctttaactggctgagggattgtgttgtgtgccataggctttggggagccagtgaagggctttgagaaaaagcattttgattagatggtgctttaccagattaatttctcagtggtgtgcagggtggatcagagtgcactagaactgaaggctggaaaaagacccagtgaagtctttgcagtggcccaggtgataagtgtgacgagtacctggactcagatgggaccagtgggacctttgtaaagctaacctgcctcagtggaactggaatctgagacatactgttttaaactccttaaaaaatgcataatttattaatgtcatgttcatctgcctaaactattataattaactatttttattgtgtttttgtccaagaggttttaaaggagccctgtaaataaattcatgcaaagaagtagttggcagcagcaacagctgctaccgcagggagaagggacccccttctggccaggcagcaacctcattctcaccctgtctccatactctaagccaaagcgagaggggaggggagtgcaacaggggcccctggagttggatctgccaaccacagtggagaatgcacctccccaagggttaggtgtggaatatggcgtttggcattaagtcaaatagaatattcttcctttgttcctctaaaatccagtctatagtcaatgtttctcaaagtatgttccacagaacattagttcttcaggatgttaatagaagttacatgagaataaggagatgaaaccaaataaatttgggaactgatgggctacgcaaaggcaagtgacttcctttcagaatttcagagtgtgtaatgttctgtgtgctcagtgaatctccaagagggagatagaccaggcagtgtttcctaagcttatctgtagattcttcttccccctaggccaggggctgacaaattatggctcataggcctcatctatcccaccactttttttttgtaaataaagtttattggaacacagttgtgcccattcatcgtattgtctgtagctgctttagcacaacaggagagttgcagagtggctacagaggtagtctggccctcaaagcctaagatatttactatctgcccattacagaaaggtttgctaatccctgctctagacaattcatggaactggtgcttcctggtaccccctttcagagatgctactagaagaagatatacatgggttgttctagcactgctttatgataaatctgcctcattttattctgtttccatactgccatcattcctgcctcttgctttaaactactttatctctcaaccatttacccattatccaggatccaaacctgggttccatgtgtccttatcttttcttgcactcacaacattccaaaaatggccaagggtgtcttcaatttccagtctgggtagctcttaagtcagcccgaacccattcctaccaacctggcctacatgaccgtcatcttttctttttcagcattcgaattaggttccttttccccagatatgagttacctctagtcctttttactcactgaatctagaataacctttgtaaaatacaaatctagtcagattgattccttacttaaaatccttcagtggtccctgtggccctcaggataagctcagatcctcaggatggatgtgtgtcagtctggttgggcaaacagaaactactcctggtatttcgtactggaagagatttaatttaaggaattagttacttaagaaaaggagtagatatttccaggcttctgcctgctgtggcatagagaagggcatggaaatgggggatggtgttgagtgtttagcaaatgacccagaacaaaccaggtctgggaaaccatgtgttatcccctgctgcccttctccagcttcagctctcccatttttctcctgactcctcacccttcctccaccctgcaagtccccaaattctagatatatcaggatgcctttttgtccccccagaaacttaaaacaactgacatttacgaactcacagtctctttgggtcaggaacttgggagtgacttagctgggtggttcggggttacatcctctcatgaggcttctgtcaagatgtcttccagggctgcagtcatctgaaggcttaactggagctgatgatccacctctaagatggctcactcacagggctgttggcaggaggcctcacttctttgctgtatggaccccttgttaggactgcttgggtgtcctcacaatgtggcagctgactgtctccagaacaagtgatatgagagtgagagatagagatagaaacagagacaacaaggaggagcatactagagtgctttcagtcccctctcctgggagtacgttgcatagtgtctcaggtcagcttccctagaagcagaaccctgagatgaggattcttcaaaagtgatttgttgaaggagtgctctttaggaaaaaacctagaaggaggagagggaagaaaagtagggaaggggaaggagccaagcaatgatatagtctcagataaaatctgaccttggcctgatccacacaggcaggattctggtacataattgcataatagagttaaccctgtttgagacaggggactggccttttatatccttctctaagtcagtcattataggctgctggaggtgggggtgggaggtaggctcccattagttgagaataagtctctagagaagagggtggctgtgagtcctcagtagctaacactcagagcagctgggggatggtgtgccagccagggaaaggtgacccaggtggggccaacacagcacctactacagtgggcctccccgtacccatgtcccaagcacctaccatggtccctgacataccagaggtacgaaaaaaatatctgtgtaattgaataaatgaatgcatagaaatgcttagcctctctggacctgtgtccatttctgggaagtcagctcagcagggatcatattgtcccatcaaccatgggaatggtcgaagacccaggacagtttgccacatcatgagtggcagcactgtctaagtccaggattttcattgcaaaattagagtgaaagtatatttgccatttgtgaataaggaagtattaatattacaatattatatatttttaaaaggaactttagctcacatttcagtgagctctttgctaaaagtacattttcctggtttgtcacatcctgactgggtacatgttgttacacatggaaccgtgagggcagaactgccatttgttatattaattgtaatccatatatctgtttttttcccacaagaatcagtcactggatttcagttcagaaaaccaaaactgtcggacaaagccatattatcgtgttggcagagttgttccccatgaccccaaatacacagaggaggaagagaaccactgaggccccttgttttcttggattatcattcttccaaagttggtaactaagaaaagtctcaagaaatagcaaagaaacctccccaccttattctgctttccacatcccaagcctaacataagcctcaaactatttttatgaaggaaagcttattgtgaagagggtcttttacatgcctaaatctcatctttagtttttcttatcacacagccggttatctttgcccatctcttttcctgggataatgtctggctctgtcaaggctgtgccttattctgggaccttcctaatgcctgtgttccaggtccctcctgagattcgctcctccgaatgcttgatagatggatcaatttaggggattgatggtcagatttagcctgacataacaccatgcagtggtctgttaccagacatagagctggaaaacccaggcccttgcatacaagttcaggaaggtaaatttgcaaatgaaaaacattttaagacacatctcacagctgcttcctcatcccccaccctattgtttgtgtttttagagatgtttaagagaaaaggaggcaataacaaagacgctctgctgtgctttggaatcctcatttatgttgaaaaagggtccatttatcatctccttggatatttccacaaggagactttgctcatctcaccagggaatggagtggtagagcaaacacttctctgtccacctgatgatggaggagaaccaactaactgaaaggcagagagcctgaaattattatcctctctctgcctgcctgctgcaagatattgctgcatacctgtggtccctgcaggaggctgcatgcgtagacttgggccagaacatatattaccttccaagcaatagatttctaggtaaaaggcaagaaggggcctcaggttcaagttgcattcttcagtggggttcacaggaggccctgcattcagggggttactgggccctccttcagctgttaataaaactgacttttggctcatagagcttggagtatgcgtccatttgtatgaacctccagggaaagcagggtgagggcttgtgttccctagactcctggcagtgaatggctcctggacagctttgcttggttgtttcccaggtacttcaaactcaatctgcctaaagatgagttccccctcactcctgcttctcctgtgtttcccatcttggggattgaccttagtgttcttgtggtagccctggctgaaattatggatgttggagcatgggaggccctttgtgaacttacttttgggtctttctcaccattcccacacattgctcttttagcccaggcctcagctgagacatcacctgctcctgagtctttgccgacccatgagactgggtgcttctgtattccccatacttgccctccacagtccactgaagcaagttggctttgtcacttccctgttgctcccactagacttcaagcttctcttaagcaggatctgtatcttgttcatccttgagtgccagtgctagcacagggcctgcctgtagtagctgcttaataaatatgtcttgaatgagtaacactcaggcctgagaatacctgagactgtatggcatagtggttataagcttagctttggaaatcaaggcctgtgttcagactctgctatttgtgtgattttgggtgagttccttaacttcttgatcttcaatttcttcaccaataagatggggataataactacttcctagggctgtgatgatgaattgcaatgatccatgcaaagccctttgatcaatgtatgacacatagtaagtgttgtgtgcatcatagtacctattagtaacaacaacaacaatatagttatcgttaatggaagggagaaagctataagaactagttggaactagaagtcaggaatattgagtgcttgcatagtggatttagaggagatggggaattgcttgggataaaatgtaggaacagatgggattaccctgggagagaatgaacagggagggaaaaatgggtggagcaactaaagacagaaccttgagaaatcctacatttgagggataagaggagtcaaaacaggaaaaagagtgaatgactacagttaggagattgcagcttctcagatgccaggggcaggagtttaaaaaagatagtcaaaggtgctatactgggcagaagatcaatgaggagaagacgagaagaggtagccataacgtgttaaatgggggtatgttagcgcccttgggaactagccatttcagtggagtcagaggaagaagccatgctctgaaggaggttagagaaggccacgttagggatgaagtgggcatactaagtcagtttgttgtgctacaatgtgtgtttctgtaatgaggattatctgtgggtcagtagatgactggtgtcagtatgatgtagaagtcacattggttcatatgtagggttcattctcagcacatgaatgttttggcatcactggctactagtggctgaaagcagactaacacacctgaaggcagaagactgggggaaatgggggacatagagagctgctcatgaggcgcagtcaccctgtgttcttccacttgactgattggcacccactctgtcttgaagtgctttggggacattccttgccaatcttggtgagtttagtcactgattccattccactcagcacccttgacccttctgataactccttcgaccacagtcccccttccttttttaagaagggccatatttactagagtttttttttttttttttcccaaactgtgtccaggtttattaaagatactttttgtgaacagtcatggtatttcaggcaggacatgagcgacaatcattaacagtatacaactttcagactccctccttcaatggacttccaaaatcagaaagccatggtaaaacccaatgaagtcttcatttggtaccctgaagagggaaagttcagagtgagggttgacatttcacattcaacgtgctgtttaacaacttttcatgagctgaccctgactttcaggaaatgaaatgaaaatggcagaatttatctgaagatccacaatctagaaacagagcacgtgtctttcaagggttctcgctggaaagtccagattgccagcctgactggtaaccagttattgggggccagaccccaacaggtatctgggtttgagggagttaagtgtatactgaaggcagagagggagagggggaaataaagaggaatttgtttctccacaccacaaggcctttgtgcgaaggtgactgtgtgtgtcaacgtcagacagtccctctttctgggagccaagaagatgtctttaaaactagaagggaaaggtgttttctccacatcagtccagcttcatagacattctttttcttttttttctttcctgagacgaagtcttgctcttgttgcccaggttggagtgcagtggcacgatcttggctcactgcagcctccgcctcccggcttcaagtgattctcttgcctcagcctcctgagtagctgggattacaggaacccatcatcacgcctggctagtttttgtacttttagtagagacggggtttcgccatgttggtcgggctggtctcaaactcctgacctcaggtgatccgcctgcttcggcctcccaaagtgctgggattacaggcatgagccacggtgcctggcctcagagacattctattagtgacatataccccttctccataaaacaacaatgacgtgttccgtgtgctaacaacatggcttaaaataaaggcataaaaacaattctgcatttttataaaacttaataaaaaaataatacttcaaactgcacagtcaccagaaatacacagttatcaaaaatgcacacacttcccttggcatccccagcgccttcaactttctgtgcctgctctgttttggcctctgcattttctgcagagttattcccctccttgccagcatgggctttttcctttttcccctttaccttctctcccttctttgcaggggcctctttaggcttgggcttcggaggagcaggtttggcagacaaccttgcagatcttctctgtggtttgtccttactttggttttatctcctttagcgtccccttcagcctttctcttgggcatggtggaggcgactgcagtggaatgtaggtgctggatctggggatgcagcagtgcgtgggctttggttggcctgggggatagttcttacctcttcttcttcacactgctcatagagtatttctttattagaaatttaacatttaaaaaattcagtgtttttaatgatgttgattgtttttgttggtgctcaagttaaaatctttgttttcaaccctgtttttccgataagccttgttacttttagagtttgttgttgcgaagcattagttttttagcaatacatatgttcaattacagaagaaattcccatgattccttttcctaaggttgaacaatctgggaaggagggatgggaaggttaatagcagcatctatgggaggtttttcccaaggatcagcagacttaagcattcttggctgcaacttggcctaaatcagttttcccttggtgactatcttcctaagtgctctttattgtatatttaggtgattgtggttttgcatttctgtcctctctctgatctcttgctacagtctgaacaagtgtcggaggccgagttactcccacagctgagcagagccccatcccaggctgcagaaagtagtccagcaaagaaggtaaggtcagcctgaggatgctgtcagatggcgttgcgagtcccaccccgggcttcttatctctattagctgatctattgttttaaggtttctgtgtcctgaaatgaatgtcaatgatccagatttcctagaatgtgggttctttgtgaagattggggtcctgaagattcctgggcttgacccttgatgcattttgtacatgacagtacatactcaacctccttagccccccagctaaacatggtggccttgtttatggcaagagctaaaagggctgtggggagggacagatgtctttagcaaaaccccatccacctgctaagcctctgtgaatacctcttggggtggggtagtctctcctttttggtctttgtaccatggtttcctcttgcatcgtggcattttcacctggcatctgcccagccatgccattgggtcacctgtaatttgctcagtaagtacccctcactcatcatgctctccattcatctcctcaccctcttcttgtccttctcccaggctcttctttcagagagagtgggccttgggctcaggagcacaggtgaggtagagtcctccaaagaagcagaccaactgtgtccttccagaatacactgtggctctttttcttgactttatgtaggaattggggataggagaatgatgagcatatgactaagacctttaaaaacttccaaagcttaggtttttttttgtttttgtttttgtttttttttcctgagacagagtctcgctttgttgcccaggctggagtgcagtggcgcgatctcggctcactgcaagctcccaggttcacgccattctcctgcctcagccttccgagtagctgggactacaggcatcttccagcaggccggctaattttttgtatttttagtagagacggggtttcaccgtgttagccaggatggtctcgatctcctgacctcgtgatccgaccgtctcggcctcccaaagtgctgggattacaggcatgagccactgcgcccggccaaaatttaggtttaaaaggcttcaaagtgaggcaggagcctatcttgtcttcagttaggaaaggccccatggtgtgagatgcacacagggtctgtgtgagtttcaggtgacaagaagtaatagacttcttgaaacatttaaaaagaaaaagaaaaaagggaagaccactggactctgatgcctgtgtccccccagttcttgctgagccatgggtcagtaaatagagtaccctcctgatcttggggttggggctaaaggcatgtgggacactggaaggaagagtggagggaacattgaaatgtttaactttttaatttttattttgttttaaatccacaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagtaagtagaccacataaacaagagtgaggtaggaatctcgctctgagatgtcgacggatatgtaaatgtgttgacatttacgtgcgcaccaacagaaggatttcatggttgtaagtttatcttgctcatctctgtgatgggattcaagtctcccagtcacatagaaggctttataagctataggacttaacctgacctaaaggggcaggcgagtcctaggctgtggtgtttggtttggtttgatttctttcccttcctctcaccttctgttgtttcctactcctcttccttgtgagggcccaaattttcctggcaagatgaaagtattgtaagtggcaattttgcctctctgcctgtgttatctccttttccttcagggcaaatggctagctccttcacccacagacacactttcagtaggtgtggtatgtgattcttttaaaatctccgtaaagagtttctgttgttggtcgcctcagcacagaatggatacatgcagaacttccattatatttatctaaccagctggaacaggtattggagggagggtgaagacacctgtggacatggccagggactgagacaatgatgctctggacaaactatccttctctgtaaaactttggctttgagaagagccatcacttgcttcaatttctttgtagtgaaattgagggaggtgttgaggacagaaacctgctcctgtcacttgactgcaagtgagcctgaccggtcactaacataaatgctcaagacccatcatgaccctgcttttggggtcttgcaggtctcagatgctgctgcagattttcttctgcttacacgttgtagaatgaaaagcagcaggttctgtgggagatgttagcaacttgtctttgaagccaaagtcccattctgaatctctgcagccctctccttcagaagattttctttttttcaaatggacaggtccctggtggtatcagtccataaaggaagtatattttgttcatcacattcaccgagaactttgaccatcttccagcccctgttaagcctggaaggtgaagaatccctatcagggacaaagatggctcaattttcttccatgttctaccccagcactccactttaatttcagctttatgttcattttagtcagcagtggcttaacagtctccagagtagatgtcagggcatctggtggagttcatacagagatcttttctttttctcttttttataacagctttattgcaatataattcacatagcatacagttcatgtttttaaatgtacaattcagtggttcttagtttattcacaaagtcatgcaaccatcaccacaatctaacttttgtcatgcctaaaataatatatatccacgcccattagcaatcactccccattctctccttccccctcagcccctggcaaccacgaatctcctttctgtctccatggctttgcatattcttgtcatttcacataaatggaataatgaaacgtggtcttttgtgactggcttctttcacttagcataatattttcaaggtttatccaagttgtagcataaatctgaacttatctttttatggctgaataatattccattgtatggatagaccacattttattcatccattcatcagtcaatggacattttggttatttctgcttttttggctcttaagagtaatgccactatactgtttgtgtacatgtttttgtgtggacttacattttcatttctcttgggtctgtacctaggagtggaattgctaggtcatgtggtaactctgtctttaatatttcgaagaactaccacacttttcatagtggctgcaccattttatgttcccgttggcaacgtatgagggttccaatttctccattttgtcaacacttatcttttttttttattatagccatcctagtgagtgtgaagtgtgatctcatggttttgatttgcatttcttttgtggctaacgacattgatcatcttttcatgtgcctattggccatttgtttatcttctttggagaaatgtgtattcacaccctttgcccacttttaattggattattaatctttttacttttgagttatgaattctttatatattctggatacaactcccttgttagatatatgagaaaattgagccctctttgtaaatattttctctcattctgtgggctgtcttttcactttctattttttatttttattttttagagacaaagtctcactctgtcacccaggctggggtgcagtagcatgatcatggctcattgtagcctcgaattcctgggctcaagtgatcctttccccctcagcctcctgagtagctggaactacaggcatgagccaccattcccagccaatttcattttattttttatagtgatggagtcttactatgttgcccagtctggtctcaaactcctggcctcaagtgatcatcctgcctcaacctctcaaagtgctgggattacaggcctgagccactgcacccagccaattatcaatattaatcagatctgtacagtggtcacagtccattctagttcagttgctcttttctagaacctatctcccagtaatggcacatatggctgtttttctaggagaacatcagttgctcttttgctctaagaattcggtgtttcttgctgtgggatgaaaggttgtagattatccctgtggtaactgcactgatttatcatcccaaccatggacggttttgaaaagtaaagagagtgctaatgtacttatgctggacagacagttttaaatggagactgtaatgggcgcagtaggatgcgtggtcactctggttatgcgtgttctgtgaatttgttgttaattgggaaatactggtattaaaacgttctgtatttttctcaagagccacagatatatgctggtccatgcacatacacgagtgcacatttatgcacacacacacatatacttaggcattcatgcctaataatacataaggtagaggtaggtagtctggctaagttaatgtagaatttttgctaaaaataatgttcttgtattattttccttcagacttgttcacaggggacacctgcaggtcttctaagtgctattaattcttacacaaaaagggcattccagttaatatggtttgtcaggaagaaatacttattaaaatgtcttggaataaatggaacacaaatgtttgaaaaggcccatttcacagcttttattcaagttataaaatgggaattacttcaggtgtaaataattcatcccaataaatttgtttcatttggtgtctatcttcctgaccgcctgtgaatatgagattttatttttggagccctgtgttgttaaccacttgttagtttaacacctctcatgaatcagagttctgaccctcaagggtccagacctctaagtcctttttcactgaagtgtttgtgcttttctataggcagtcttccaaacagaagaaggccattcaaactgctatccgcaaaaataaagaggcaaacgcagtgctggctcggctgaacagtgagctccagcagcagctcaaggtaaggaatgagtcccagatttggatgaccaggcttttccctggcttttaaaaagcttttttttaatttaataggcatataataattgtacatatttatagggtggggtacatagtgatgtctccatacctatcatgtacagtgatctgatgtgtccattggctgaccatttagttccatccctgttgataagacttgcctcttcgttctcaaaccctttttggaaggtggagaattactgtatttaagtttcatgggttggttcttgcatagtcagaggaagactagtgactttaatatgtaggcttcatattgtgtatgagttaaaaggaaagacaatctattacgaaggctgtttgaagcattctttattatccaaagcttctgggtaagcccttaattatttacatcctctctgaaagaggatgtaaatacttatttcagtagaaggaagtcaccttggtactatcaaagcccagcccctcctctggtgccttgcaaatggttccatttcaccttctcaatgacatcacccctgtttctcttcatcgttactctcccctgtgttagtttctcggggctgctataacaaaatactacaaatgtggtggcttaagataaccaaaaatgattctctcacagctctggaggctagaactctgaaatcaagatattggcagagctatgatctctttgaaggctctagaagatgatccttccttacctcttcccagcttctgatgttgctggcagccctgggcattccttggcttgtagctgcgtcactccaatctctgcctctgttgtcacatggccttcttcctgtatctctctgtgtctgtgtccaaatttctcttcttattgtatcctcttataaggacaccaatcattggattaggacccaccctaatctagcatgacctcatcttaacttgattacatctgcaaagaacctatttgcatataaggtcacatttacagatactgggggttaggacttaaacatatattttgagaggacatgattctacccactatatcccccagttctctactggatcattcgccatccacatgtaaatatgctccagtattgtccattacacttggccaattactgcctcatttctttggtccccttcacagcaaagtttcttaggagtggttttattcattatctttactttcaaaccagtaattttctcttccttccacttcagttggcttcgtcctcctccactcacacccgtcttgtggctaaatccaatagggctgttttaatattattatttttttttcagaagaattctacacaattgatcatttcctcctctgaaatggcttttataactggtttttgacataccatactctcctggttttccttctgcttcactggtgcttcccattttcattctctgctgtctcttccttccctgacttaacttttataccccaaccccatttgccccaatattttagtatgaaaattttcaaacatacaggaaagttgaaagaatcataagtgactgcttgtatagacatcacttcagttctacaataacattttactatacttatttttaatcacatatctacccatttatccttgtgtccatcagttcatcttatttttgacatattttcaaataaattgcagatatctgtatactttccctgaatattttagcatgcgtataattagctagagttcaatatatttttacagttttttcttatgatgtaaaatgtttatacaaaatgcatgcacaaatattattattattattattattattattattattattattattattattatttgagatggagtctcgctctgtcgcccacgctggagtgcggtggcgtgatctctgctcactgcaagctccgcctcctgggttcacaccattcttctggcttagcctcctgagtagctgggactacaggcgcctgccaccacgcccggccaactttttgtatttttagtagaggtggggtttcactgtgttagccaggttggtctcgatttcctgaccttgtgatctgcccgcctaggtctcccagagtgctgggattacaggcgtgagccaccgcgccagcgcacgcacaaaccttaagtgtacatttgctgagtttgtaacaagtacatgtacttacggaatccaaacccccaaaaagatagagaatattaccatcaccccaggaagctccctcatgctttttcctagtcaattcctgccctacccacacagaggcaatcactattctaatttttataccatagttttgcctgttctataactttatataagcggtgtcttacaacttatacttcttgtaaagcttctttcactaagtattatgtttttgagattcatttatattgttgtgtgtatcagtaattcattcatttttattgatgagtagtatcccattgggtgaatatgttacagtttggttatcaattctattgacagacacctgagcggtttccagtttttggcaatttggaataaaactgcattttttaataagtctctgtatggaaatatgttctcatttctcttggattgggattcgtaggtatcatggtaagtgtatgtgattagtttctgagaaactgctagatcattttccaaggtggttgtagcaatctgtactcctaccactaatgtatgagagttccaattgttccgcgtctttgccaacatttggtgttatgattcttattaattttagctagccctgtagtgatatagtttttatcatctccttgctgactaattatgttgtccacttttctttgtgattatttacctttcatatcttactttatgaaatatcttttcaaatgttatttttctccaaagtagtctatagatttattacaaaaccaataaaaatcccagcaggattttttgtgagtatagacaagctaatcccaaaacttatatgtaaaggccaaggagctggaattgcttaaacaaatttgaaaaggaagaacaaagttggaggaatcactttactgtcaagctccagtaatcaagatgctgatgcacaggtcagtggaataggatacagagtcctgaaatagaccacatgaaaacagccatttgatctttgacaaaggtgcaaaatcgattcaatgagaaataatagttttcaacaaattgttttataacaatttgtcatttgcatttaaaaaaataaccttgatctaagcctcacatctatacagagattaacttgaaatgagtcatagatgtaaatgtaaaacatagagctataaaatttttagaagaaaacagaaaaatcttcatgatctggagttagaaataacaccaaaagcacaatctataacagagaaaaactaaaaaaattggacttcatcaaaattaaaaccttttattttgccaagcacagttaagaaaattaagagacaagctgctgagtgggagaaagtatttgcaaaacacgtatttgataaaagacttatatctcaattatataaagaactcttaaaactcaataataagaactctcaaaaccaaagcatctcaatttaaaaatgggcaaaggatttgaacagacacttcactaaagaatatataaagatggcaaataagtacatgagaagatattcaacatcattagccatttgggaaatgcaaatttaaaccacaattacataccactatacacatactagaattgctaaaacaaaaaatgtgacatcaccaagtgctggcaattagaactctcatttattggtggtgggaatgcagaatggtaccaccactctgaaaaatcgttcagcagtttcctatgaagttatacatacactaaccatgtgacccagctgtctctctaccttagtgaaatgaaaatttatgttcgctcaaaaatctatatatgaacttacatagcagttttattcatgatagcccaaacctggaaacaacacaaatgtccttcaaaagatgaatgaataaattgggatacattcatacaatggaatagtactcaacagagaaaagaaatgatacacaacttggatgaaactcagacattatgcagagtgagacaagccagtatcaaaaggttgtgtactgtatgattccttttatttgacattcttgaaaaggtaaaactatagtgatgtgaaacaaatcagtggctatcaggggttatgcatgagatgagagtttgtatgagtagtcccagggaacttttggggttggttgaactgtaatgtgtcttctttgtggtggtggttacacaaatctgtacactaaaagaaaaaaattgttttaccctatgataattttaaaaagttattttttaaatttcaaagttcattctgttttctaaaactttgtatgtgaacttgttttgttttgcattttgtttggttttggttttctcctctctccctctgctttggggtaggccagtttcatccattgttctctacatttggtgggcccttttggaaactgatattccccagttctgaagggttttttattttcatttttgttgtcgttgattatttcctcccccctgccctcacccccatttttttctcattctcccttactgatattcagacattggacttcttagcttagttctctaattttctcatattttctcttctgttttctttcttttctcttcctacattttcttctttatttttgtctatttctggaaacttaattatatattctaaatcttctgttgtttaataaccaataattttttgttctctgtttatttttgacggtatcctattcttgtttcattgttgtgatcttttttttaattatactttaagttctgggaaacatgtgcagaactcgttgtgatctttttttatggtcatttttctttcttcttcctgaatagtttgtgtttgttgtgttgtgttgtatgtgctttatcttagatgctttcctttgatatctgatggcccttctttgctcatatttaaaaggaagatgaaaacactgattagaagttcattgtacgttgtaaggcttgtcaactctgagcttcactgtctggcaatttggctcggctgtatagttggggaacccccaaagggagtatgattagctctttcctcttggtctggttggagtgtccagagtggagactgttttggtcacctacatggagggatagagttggttcagtggagcaagagggctgtaggtctcagcattccaggatattcattcactctccctatttctggcccagtatcttgtcctcaactgtgcttgtttcttgctaatccagatgctctctgttgtaccttttcaagaaataaaccttcagcattctgccctggtggcaggaatgatctggggatctaattgcttctgaaacagattttcagccaacacttattttagccaactcccatctccccttatgtactcccactttaataggtatctggtgttgccaatttgagtctttcaggaattctcctacgtaaaatcaagttggttcttatttttcttcatgttagcctgggactcagctttctttacttgatctgtatgagtggaaaagttctaagtctagtgaacagaagtctgaagaatcattgaaacagaactatagtcatagcccctcaattaattcccaggctaagccagtttatagatccagaacctcttgaatgatgaaggggcatctatgtctccttaaggaaggaccccactgtgcagccaaaaatttacactgcaaatctttctcctagcctttcctaagggggaccctgctgccatttaccagggtgactgtgcattagaggaagggaaataattagacttttggggaattaccagacactggctctgaactcacactaattccaggagatgcaaagtgtcactgtggcccatcagagttggggcttagggagatcaggtgatcaatggagttttagcttatgttcgtctcacagtggacccagtggactcccaaactcaccctatggttatttccctagctctggaatggcatgcttggaatagacatactcagcagctggcagaattcccacatttattttcctggatttcctaagtcatttaccattcaccagtttgccactcagctttcaaattttattgctatcatcttgtcccttttgttttccctgtcttgtgggtccgtgactttgaaaagttgctgtattgttttagtggtgctccaggagggagagagtgtggtacccctggtcagtcttccatctttacctgaaacctctatctatactgttttgctagatgatgttatatggtctcatggctttgaagaccatccataaactaatgaaacctaatttatgtctcaagccctacttctcctttcctctgtgctctagacttgcatatataacttcttactcaatgttttctccttagatatccaatacacatctcagataattaattgccaaccctctccttgaaatactcatttcttatctaatcttctcattctcaatatcactaccagccagctactttcttcatacaaaaatcccaggagtcatcctcagatttttcttctctcctacatcaactttatcagcaagtcctaccagttctagattcaagatttatctagaattcatccacttctcttcatcttcatggcttctaccctgacggaagccattttcatttctcacctgggtccctgcagtaacctcccagttgctcccctgcttccactctcatcctgctataatctactgtctacacagtagccagagtgaaaattttgaattttaagttgggtcatgttccttccctgattagaaacactcaatgccaggccgggtgcagtggcccacgcctgtaatcccagcactttgggaggccgaggtgggcagatcacgaggtcaggagatcgagaccatcctggctaacgtggtgaaaccccgtttctactaaaaatacagaaaattagccgggcgtggtggcgggcgcctgtagtcccagctacttgggaggctgaggcaggagaatggcgtgaacctgggaggcggagcttgcagtgagccgagatcgcgccattgcactccagcctgggcgacagagtgagactctgtctcagaaaaaaaaaaaaaaagaaagaaagaaaccctcaatgccatccccgctacatttccatactatttcctctgcccacaaggccctgtacgatctggctccttgcttaaatctctgacttcatttcctgccaatgtcttccttgttccatctactctggtcacacaggctttttgttcatcaaattcaccaaactcactcgctcctcagggcctttgcagttgcccttttgtctctgtgaatatccttccccccatatcttcatatggctcactcctcatttcattcaagtctttgctcaagtattgctaactctgagaagccttcccagggcactctctctcctttctcccatatccccctctgttactctctattatgttatcttatttccttctggaagtatcttgttcattaactttattatctttctcaagtcatttgaatataagccctattgctctgatctggcatattctttgctgataccatcacagctacagcattacctcacctgtaggagatagaaaccaagagacttccggctgggtggctaggagagcatgtgaataaatacttgtgaagttgtatactgactattagtatgctgattcttctgaatctcacaattcagcctttctacaggattctttcccaccttgactgattctacttgaatacctttatgtgtcccctctcttcctgccaaaaaaatccgttttaggcccgaaagtttgaattcccaaagagcagattgctcagcctcttttctgcctttcacccagatgttgtaccttacaccatatgttgtgcagaaacttggatgagactttggtggaggggcaactagcgtacctttttggccctcagacctaactgagtatggtgcgggattacgagccagagattgcaactagaaatttaagtcctgttggctcactgctcagtattgggagtctgtttttgctttctgctttctcctagtcttttaatttttaatgactctgtctaccagctactgatcttgtcaaaacaggctaaaactagggcagggtggtagaggggagtaggtcagtttcatttcatcacgttcagaaaggagttgagagattacaaattgtgaagccccttttgtctggtcaccagcattaaatctgatacctcccagtcctcctgttcttgagttatacagcacttgtatttgtgggtccagttataagtttccttttaaatctgatgaagtagggatgaattcaagaaatgacccctttgcttttttgtttttcttgtgttttgtacaactcaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattatttatttaaagaatttatgttttctataaaaccttataaccaagaaccttcaggatgcttgtaaccaagtactttcaggatgctttttgtatgtatatcacatagagtaggttggtttcctgagtaattgggattccaactagatagtcattggtgtgaccataataaaaacaaaagctaaaataaaagcatcagatttagactggcgctgtgccctctaccactatatgccaaaaattgcttctctagtgccattttgatattatatctagctataaataatacatgactatcgttttctattgaatgtcaaagacttactgggtctttacacctctgtaaagtggaggttttggcaatgagctgtttaacttggccaagctaggctgtcaacccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccacccatcaaatatgaaaggctgatgagactgttaggattgataaacatttgttgtttgaacccagctatccaaactggggaagaaggggaaatggttgttaccaacaatctctagtagttattttaatctttattttaacctggattgcaaatgtatggggtatgaggagataatgaaagaaaagtggtcctcatgctggatatgtgactgttttgttctctgtaaagtgtattcttgggaagtgattggtttatatcagattcagaggagcccaattaactccagtgtaggtaatgtaaaacagtaagctcaaattgcagaagccagtatcctacagaaatttaagtagctactgcttctcctgaaagcccaagttgaaaatgggaccacaggggcacagggctactgaccctcacagggcatgccagcgttaacaccactttgagagaccaatggcaagaaatgctgtctcttgtgcattttactaatttccccattcttagggtagcagggtgggggtgtatagggtctttttgaagcagttttggataggtttgcaatatgtgggattcagcctttgatttcaatagagctgagagcttttagaacaagcaggcatttatttaatgtttccttagtccattggcaagctttatcaatagcttaatggcagaggataaaggctcaaacagatgatgttttttccacagaaaaacaaattgttgaatctattccgtgcatatttaaggattttgaattgattttgaaaatcatgaaacttgaactatttttctattccctttttttcttccccatttgctgccttttttgtttttgtgggggaagggttgggagtaagtttaaactcttccgaagattatgaatgggtcagcacaaatttttaggcaactgctttttccatgttctgagatctacgggctacaacaaattttatcagcagtgttttttgtttttttgagatggagacttgctctgtcgcccaggctggagcgcagtggcgcaatctcggctcactgcaacctccacctcctgggttcaagcaattcttgtgcctcagcctcccgagtagctgggattacaggcacccaccaccacgctcagctaatttttgtatttttagtagagatgggattttgtcatgttggctaggctagtctcgaattcctgacctcaagtgatccacccgccttggcctctcgaagtgctgggattacaggcgtgagccacccgcccggctatcagcactgttctgattgcagacgtttcacagcatgtttggcttttggtaaattcaatccaggaaagactagcatgtgcactttatctcataatcttccagtacatatgctctcagttgggatagcagttcatttccattaggcagacgtataaactaaggaatgttagtctgcagtattcattttaaaaatattgacatgcttttcccctcccctccatgaagtcagtgccagagtgagccagattgggaggttggggttttgtttggttggcttggttttcattaagggaaaaaacttgcattggacaatcaaattcccctgagtttcataatctcatcaatattttaagataggcgagcacacactaataatatctatgcctaccttcttgggtggactcaactgtaaccacagtttattagttgcttagaagtggatttttaaaaaacagttaaatgtgtgtgcataacacacaagtaatgacacactactattattattacctaagtagtgctcatcctctctttctgtgttttcttaggatgtgcactttaatttaggattgtaacgcctaataatatttctgtgagcctttaatgtgatttataagatggccgaattactgaaatcaccattatacctcttccataaaacgactccaaagttagacctgcctgttggggagaattctatagacagaaggtcaatgttgtccccatccataggggttgaattaccttgctgttaagtggtcttcccccattgggatcctacagtcccacagatgaaagcacagtagtagctgacagctggcttatttggtccctcggcatctctcgtatgtggcatattgcttttgccactttcctatccagcagacatcaaagcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaaccccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaagtctgtgaagaacatagttaaagatctccaactttggaaaatatacatgatgtgaaactggggtgctatgttaaaaataaatgtatgataactaa

SEQ ID NO: 3121 - DNA, 202322 bp, human
cgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcatagctaccaccttttggctgttctatacttggaaaagtactaggggatgatacataccagacgctgtttttgttttgtgctttccttggagcttggagaaagactacttgataagcctttgtctgtcatttcatgtcaccagcacttcatggtgataagactgttaatatcaggttcaaaacgtgaaatgaagcttttcctaaaagcaatagtatgaatgttattaacaccaatggaatatttagagtggcgagtggtattttaaaatctagtttcaaaggagaactgagggttttatggttcacttgcaatgtcattgtgttcatacgtatttttaaaaaaattgcttaagactgcgttttatactgctggagtgtttttactgctatatgtttgtgagcataactttagacactttgtaatctttcacccttttgaatttgggatttctgaaactgtaactagtattcacagaacttagcatggctgtttatccctaaagaagtccttgatatgtagacagttctgccattgctgatgagtagttgagctggatcaggtaaagagaaagtcagtgtcttaaaacacaaaccgtggctattacatgaggccctcagaatagtcccgagcataatacatttattcagtgctgtagctgcttcccagctgaaagaggaataattgactgaggctatgcagcaagtaagtgacagctgggtacctattaaggcttattttgttgtcagtaatgcatcggataagaggaggtgggcatagtaaatctgaatatgttggttgatgcctctttaggaattgggaagaaggatttcctgatgttagaacccatgctttcttgaggtacatatagttttaaaaggacccaaggcacagtggctgtgcgtgaatgagattatatttttgatgtccagttgaaatctgcttgcaaaagactgcttcagatactggcaaaaggggacatccctgcgagattgcttggagtaaatctctcagagctcgaagctcccttattcagcctagcaaagcaaaacacatcatccacctttaatccaacaaaattaccataactcaatattcttggtacaggtgaaaatgaacattgaaggcatcctggacatgtgatcctaagagagtcaaacaaagtcagcaaccagcagacacctaattttcacccatcactttggtggtggtggtggtggtggtggtggtggtggtgtgtgtatgctccatccactttaatttgcattaccccatcagtgtattagccattctttaaaacaaacgtagatgtttttaccctttctctgttaaacaggaacctgtaagttgagatttaagtgccccaacaggtataactgctcaaatcttggaggcactaaccagtcctgatattttctatggtaacaaccaggttttcctcttaataagcatacaattaagattaccataataatgttccaggaagagtgagaatcttgcattcttaccacaagtaaatggtctataaaaatacttattttttatttatttattttttgagatggagtctcgttctgttgcccaggctggagtgcggtggcgtgatcttggctcactgcaacctctgcctcccgggttcaagcgattcttccgcctcagcctcctgagtagctgggactacaggcgcacgccacctctcccggctaatttttgcatttttagtagagacggcgttttgccatgttggccaggctggtctcgaactcctgacttcaggtgatccacccgcctcagcctcccaaagtgctgggattacaggcgtgagccaccatgcctggccttaacatattttttaatagactatttttttttttcagagcagttttaggttcacagcaaaatttagcagagtacccatatatcccctgccccgacacacccgtagctttccttactctcaacgtcccacatcagaataatagagtttttacaattgatgaacctacattgacacctcattattccccaaagtctatatattagggctcactcttggtgttgtacattctgtgggtttggacaaatgtataatgacggttccaccattgtagtatcatacagaatagtttcactgctctaaaaatctgtgctctattgattcatccctccctctccactaacatgtggcaatcactgattttttttttttttttactgtccccatagttttgccttttttagaatgtcatatagttggagtcatacagtatataggcttttcactttggcttctttcatgtagtactatgcacttaaaattccttcatgtctttttatggtttggtggctcatttctttatagtgctgaataatattccattgtctgcatgtactacaatttatttattcacctactgaaggatatcttggttgcttccaagtttgggcaattatggataaagctgttataaacatctgtatgcagccttttttgttacatgcaggagataagcttttgactcatttgggtaaatagcaaggggcatgattgctagattgtatggtgagagtatatttagttttataagaaactgccaaactgctttccaaagtgattgtaccattttgcgttcccatcagcaatgcattggtttctttacagagtatttattttcctttgctgacttattttaacagcaggattctagcactaggtggaaaacgtatatgagtttctgatgtgtgtcaggtactgtcctaggtgctgaggttataatagtgaatccaacacaatctctgtcttcatggagcttatgttctcatgtgaatgtttttacacttcagagtttttatttggttgagaaaagacttgaaatataacatccaaaaataaaatgtcagcctggtgctgtggcgcacgcctgtagtcccagtgctttgggagaccaaggatgggaggattgcttgaggccaggactttgagatcagcctgggtaacatagtgagaccctgtctctacacaaaataaaatagccgggcatggtggcatgcgcttgtagtcctagctactctggaggctgaggcaggagaattgcttgagcccaggagttcaaggttatagtgaactatgatcgcaccattgctctccagcgtaggcaacagagcaaaaccctgtatcaaaataaagtaaaataagcctgtcaaacccaaaccaaatacatgtcaaacccagacctgattcttaccacacactatgccttctagtaaaattctggcctttgaataccaacaaaatacttcataacctgggaaaccaactactctaacgtttgttgctctgtcttgaaatactaaacaaaaccatttacctgttcgtagacatattttctttttctagtttaaaagtatcccattctgccattttccacctagtgctagaatcctgctcttaaaataagtcagcacagggaaataaatactctataaagagaccaaaagacctttcaaaataggctatggccaggcccagtggctcacgcctataaatcccagcactttgggagtctgaggtcggaggattacttgagcccaggagttctagactagcctgggcaagatggcaaaaccccatctacacacacacacacacacacacacacacacacacacacacacacacacacacacacacacccccgctacctacctctctctggggcatgcctgtagtcccagctattctggaggctgaggtgggaggatcccttgagcccaggagtttgaggctgcaatgagccattatgacaccactgcactccagcctgggtgaaagagccagaccctgtctcataaaataaataagtaaataaataaaatatctaccttaaagcagcaagttttgtatttgatgtaatgaattaacagaccgctttataatatctatcttttaggatagtgtcagtctcttggaatgctgtgcatgagtcatcattaaaattggttttcattaaaaaaatttttttaacatatacacatcttattggagttttcttttaaaattcaaaaatgggaacattattttttcaaagccaagtaacagaagagtatataaaaaagtcaattttgtgcatatctttttacattttctatgctcatgtaaaacatacatgacttatgtaattatacacatatgctccagatctcatctgtattaattttttaaattatactttagttctgggatacacttggagaacgtgcagttttgttacataggtatatatatgtgccatggtgatttgctgcacccatcaacccatcatctacattaggtatttctcctaatgctatctctcccctagccctgcacccctgaataggccccggtgtgtgatgtttccctccctgtgtccatgttttctcattgttcagctcccacttatgagtgagaacatgcggtgtttggttttctgttcctgtgttagtttgctgagaatgatggtttccggcttcatccatgttggttttcatttttgtgatagttaattcttggacattaaggggaataattataaaacactgttgcttccatatcaagggaaatcactgaatgattaaaaaaaacccaataagtgttgtctgattgtttaaacagctttcattgaggtaaataagtaaaacaaagctgtgagaagtagggaatatttaaacaatttgtgcgcatgccctcacctttggggagaagtcttttctgaaggctctcttctgattttttgaagcaactgtttaatcattaaagaaaattataggtaaaagacaaattcttgtgaactttcgctcattgctagattattaggcagaactattttttaaaaatttaaatgaaacaactttatatttttacatctttagatcatatcattttgtaactatactttagggaaatagaggccagcatattaaaacagtaactaggggctgggcagggtggctcattgcctgtaatcctagcactttgggaggccgaggcgggcagatcagctgaggtcaggagtttgaaaccagcctggccaacatagcgaaaccccatctctactaaaaatacaaaaattagcaggagaattgcttgaaccggagaggcgaaggttgcagtgagctgagatcaggccattgcactccagcctgggagacaagagtgaaactctgtctcaaaaacaaacaaaccaaaaaacaaacacacacacacacacacacacacacacacacacacacacacacaaacacacaaaccagtaactaggactaactatatgctgttttagattgacagtattctttttttctaaaagagaatgaatgccagcagatgtaggaagtaccagagctaaaccattgcctggttaaaaggagtacctctgcataatagttacttgttgactcttttgtaataaaatatttcaggcatgtaaaactagacagttacccaagaaataactgtgtatccaccactccgtataagtaaaacagcccagctagagtgaaagcctgctatgtccccttctctggtcccattcccctccctccctaccctggagttaccagagtcctgaatttggtgtgcatgatttgaagatttctttctacttttattgtatgtatatgtggatatatatatttgtgtatatataaatcactaaaaaagatattattttggatgtcttttcaacttaaggaatatcgtattctgtgtaaccttctgcaacttgcttttcctctcattgttttgtttttggaattcatcttgttgacacatgtaatttcagttcatttatgtttccttttaaaaaatctttactacttacgtttacaatgactcattgttacagtgcggtagagacccttatgccaaaaggaagtaggtggcatttttccttatttatatagaatgtcacatgactgggggactgttcgaaacgtgtatgaaaattaagaacaccttcatagatagcagaatgcacacttatattcttgagcgtgctaggggatgtttgagctaattaattgactttcatgggctttctttttttctcatcttttatttttttgagacagggtcttgctgtgtcacccagactggaatgcagcaatctgatcatgactcactgtaccctcaacctcctgggctcaagcaatcttcctgcctcaggctcccgagtagctgggaatacaggtgtgcagcaccaagcctggctaattttctttttaaaaatttgttgtggagatggtgtctcattatgttgcccagcctggtctcaaactcttgggctcaagtgatctcccgcctcagcctcccaaagtgttgggattacaggtgtgagccaccacaccctgccatttttcatctttttaaaaatggaacatctcaaataagcaagtagatagaataatgcattaaaccctgctgcacttgccactcaggcccaacaactgtcaatgcaaggttaattcaattccatctacatttctatctttgttccctctcacctttgttatcctgaagcaagtcgcaaacatcatatggttcatagggcttatctttaaggaaggaaccagggtgggcagaaggaaatggaaacatgcaggggtttaggttggccagaaaaggtacctgtggcctatggtcaaatggcaagactgatgatggttcaatactgtcaagcctttggctgtcatggagatagacgtgcttgagaactgatttagaatagttgggaaacctgtagggagattgaaaaagtaaccaactgaagaccaggaatacaagatggatttgaatattgttctagcttcacactcctaagtaggggctgtcctattttaagggtgtagacaattggttttgaggaaatcttgggttgtttttgctaattatttataactttttttttttttttttttttttgagacagagtcttgctctgtcgcccgggctgaagtgcagtggcgcaaggtcggctcactgcaacctccgcctcccaggttcaagcagttctccctgcctcagccttctgagtagctgggactacaggcgcccaccaccatgcctggctaatttttatattttttagtagagatggggtttcgccatgttgactaggctggtcttgaactcctgacctcaggtgatctgcccaccctggcctcccaaagtgctgggattacaggtgtgagccaccgcgcctggcctatttataactttaaaaagagggtttggttcctttccagggtttttcaaactttctgtttgtttcgtataggcaagtttctcatgttttgtattgatggcattctattattcatacctatctgttggtgggcaactaatcaacctgggttgcgcaggactgaaggatttcctgggggcatggaacttcagtcttcagacagtcctaggcaaactgggatggtcaccccctctcttggttgctgcattagttatctattgctctataatgaattaccacaaacttagcagcttaaagcagcacacagttattatctcccagtttctgtgggttcgggagtctggacatggctcagttgggtcctcagctcagagtttcataaagccacaatcaaggtgtctggagcttggagtcctctgtggaggtccaacacttggttgcagaattcagttccttgtgattttagaactgaggctctcaacttcgaggcttcctgcagttccctccacatggccttctccataggcaattcacaacatggctcttggcttcttcaaggccagcaggagagtgtctctctccagttagctcagacacctttgccatagtccattagttagaagcaagtcacaggttttgtctgctctcaaggggaggggattatacaaaacaacagagaccaggaggtgagaattttgcgggggacaccttaggatctttccaccacacttgctttccaggatttgtctgaagtagaaaattattctgttgagcctttttgtggccagaatatacatatgttttgctcagccactaatttagaattcctttatctttttaagaaacattttcatgcgtaattcatcctaagtagaactggcaaatatgtaacttcttaggtattttcaattttagtctttaggcaattgtttttcctcttaactagtaggaggcaggaaaaaaaagtggaaaagcagatgcaaatgccctgcctggctactcctgcacgcagtgctctaaagcaggccttctcagcctgggttagttcaggggtctgtgaatttagatgtggaaaagaactacatctttttttttttttttactaactgcccttcccccaactgaaattgagcacttccttctattatgcatgtaagcaaaaaaccacagcagtttttttttttttttttttttttttttttttttttgagacagggtcttgctctgtcacccaggctggagtgcaatctcacaattttggttcactgcaacctgtgcctcctgggcccaaatgatccttccatctcagcctcccaagtagctgggactacacgtgcatgccaccacacccagctaatttttgtattttttgtagaaacgggattttgccatgttgcctaggcaacagggttcactgctttcggtcaaatgacagcaatgctgctggcaagtccatggtcaggagtgagattccctcaggctgctgtggtccctcctcctccagtctgtcctgcaggaagctcagagtgaatggatgctcagctgtttcctctgagacctcaccagggacagttcctgcagtcccggctctgagctctgctcctgaccgttttatctggccctctcagctgtgcttcactgcaaaggaggaaggacaaggccctctggagccagtgccagctgcttgtggggcctgttttatttactactgctatctctacttcagagacttgggctaggacatagacttgaagaaaaaagccattttaacagacttgagaaactcagccatcctcataataccattcagaaccaggagaggccattattaacactaggctagtaggaaatgttcactttgactgaattcatttgtaacactttgccactggtttacaagaaaaatactttggttcagtctcctggaggtaggtaattaaatgtttcacctgtgctaattttccaaataattaaagtgaatcccataaatgccagcaattaagaattgttgtttttggccaagtgtggtggctcatgcctgtaattacagcactttgggaggttgaggcgggcggatcacttgaggccatgagtttgaggccaacctgggtaaaatagggagacgctgtctctacaaaaaatacaaaaatcagctgggcttggtggaatgtgcctgtagtcctggctacttggtaggctgaggcaggagaattgcttgaatccgggaggtagaggtttcagtgagccaagattgtgccactgtactccagcctaggcgacagaggcgagattctgtctcaaaaaaaaaaaaaagttgtttcttaagtgcagaccttctgagatgtgtagtgcttgccccatgccttcaaaagaacatatttaatacaataatctctttgtctctcctttacttcaaagtcagccttgtgaaaaacagatgatgatataccaacagttttttgctcttggaggtgtttggtgtgctctgctttttgagttttgttttttggacttctttaaaattattttaaaatgttttaactcctctcctttgcatactctctggtacccttatagtcccaatactgagtaaagcatgtaaaatttagcatgcagatgttttagcctcttttattttttgttcgagatccagattttttagtctcagcatgactgacactttggggctgtatcattctttgttgtggaggactgtcctgtgcattgtaggttgtcaagtaacatccctggtctctacccacaagataccagtagctattcttctcctgattgtgacaacaaaaaatgtttccagacattgtcagatgtctcctcggggcaaaatttagttctacatatatgatgataaaaaccatggtagcagccaacatttgttcactatcatccccattttgaagaaagcaaaaacggaggcactgagggtgaggttcacttacttgcccaaggtcacatagataaaagtcacttcttgaaatacttttcataatatatatgggttgaatctcagtcttaattgaggaggcagactaaaaaagaatgtaaaaacggggagtttcctgatgatgtctcaattgagaggctattgctttcatagtgattctgtgtaaatgctggaattcttgcttaaacggggtgattccatgggcatgtgtctgagtaaaggacttggatcatttctaagaagcttctgtggcatggtgaagcagaacataagacagtctaggatcaaggataactgatcaaactttgaaaccaaggaagccataggaaattggggtaaggctatgtatcacttagggtcccacaggaaatggcatgctcaaagggttttagtgaaaacaggaatgttgaggcacgaagggactagcagcaggaagctattgccattcctagacctggtggggcaaagggaggggagggaatgtcgttgctggagctgtgaaaggtactccctctacaggaacaatagtcatgaaagaatacagcctttgctagaactatggccagagaggggccagtgggatgaggggatgggagagaagtaaccaatttctgtttcctgccctctcatttgctgcagtgccttttgttgttctaacccaactagaagccacaggtaacagagcctgggtgttgaagcttattgaggttagcctcttgcgctgagtggatggaaagggctgagagtggttcaagggggcaaatagagcaacagccagcacaggctatgagcaggagtgggaaacactaccctggatcctaggaaggatggggcatggccagtgataggagcaatgaaagtctttttgtgtgaaaaagagcctggggatacagacctccatgaaggagaagagagggttggataggagtgactggttcatctgaggttcttcctatttctccaaggaagccttgaggaatgtggggttgtctgtttgcatttggatatggaagtatgtgtgtgtgtatacttttatttattttgagacagggtcttgttctgtcacccaggctggagcacagtggcaccatcacagctcactgcagcctctacttcctgggcttaagtggtcctcccacccaggcccccccaggtagctgggaccacaggcatgtaccactatgctcggctgatttttaatattttgtagagacagggtctcactatattcccctggttggcctcactcctgggctcaagtgatcctcccaccttggcctccagaagtgctaggaatacaggtgtaagccactacacccagtctgtttgtatactttttggtcagagtgaggctttccgtgagttggagtgtttgtccttattcatgacactgggaaacatacaacagtggagtgaccctcttgcagattctgctaggagtagctacatatggtgggaaaggttgctatgggaatggagataaattcaaggcagtagagagtgctttataatgtttgggggtatggccaagcattagttttgctttttccttcccagtaggatacgatttctgtagcaattcttccttacccaaaaatagctatatgtgctcccaaaaagaaaaagcccaggaccagatgacttcatggctgaattctaccaaacattcaaagaagagttaatactaatccttcttaaactcttccaaaaaacagaagtagagagagtacttccaaactcattttttgaggccagcatcaccctgatttcaaagccagacaaaagataccaagataccataagaggagaaaaccacaggttagtatctctgttgaacatatatgcaaaaatcctaaataaaatactagcagaccaaatttaacaacacctcaaaaagatgatacaccatgaccaaagtggcacttatccctgagatgcaagattggtttaacgtatataaaacaatcagtgtaatatgccacattaccaaaataagaggtaaaaaacaagccaggtgtggtggctcacacctataatcccaacactttgggaagctgaggtgggaggattgcttgaggccaggagttcaagaccagcctgggcaacatagtgagacactgtctctacaaaaaattaaaaaaaaatgagctgggcatagtggcatgtacctctagtccctgctacttgggaggctgaggcagcaggatcgctggagccgaggattttgaggctgcagtgagcactgattgtgccaccgcactccagttgggcagtacagcaagaccctgtcttcaaagaaaaaaaaagagagaaaaacccatgatcatttcaatacatgtagaaatagcatttgacaaagttcaacagcctttcgtgataaacattttcaacaaaataagtttaaaagggaatttcctcaacacattaaagaccatttatgtagagtccacagctaatatcataatcagtgggagaaaactgaaagctttttttctaagatctggtacaaagcaaggatgcccactcttgccacttttattgaacacagcactggaagtactaacatgagctatcagacaataaaaagagataaaaggcatctaaattgggaaagaagaagtaaaattatccctgtttgtaaatgtcatgatcctatatgtagaaaaccctggactccacaaaagccctcttaagactaataaatgagttcagtaaagttgcatgatacaaaatcagcgtacaaaaatcagttggaaatcaagaaaactgtcccatttatgataacataaaaataataaaatattcaggaatacatttaatgaaggaagtgaaagatctgtacattcaacattataaaatattgatgaaagaaattgaagacacaaataaatggaaagatatgccatgtttatgcattggaaaaattaatagtgttaaattgtccacactacccaaaacaatatacaggttcaatgcaatccctatcaaaataccaatggcatttttcacagaaatagaaaaaacaattctaaaattcatatggtgtgacaaaagacctagaatagccgaaacagtcttgagaaacaaaaacaaggttggaggcatcacacttccttagattataatacagtataaagcagtagaaattatgatagtatatcctggcataaaaacagacatatagatcaatagaatagaacagagatccgagaaatatacagtatatatacagaaatccaagtatatacagtcaactaatttttgacaaggccaccaaggagacacagtggggaaaggatagtctcttcaataaatgatattgggaaaactggatattcacaggcaaaagaatgaagctggatgcttatatacaaaaatcaactcaaaatgtgtctttaaaatatacaacaaaacctgaaaatggaaaagaagacctaaatgttaataactcaaaccattgaactcctagaagaaaacataggggaaaagctccttgatatcggccttggcaatgattttttagacatcacaccaaaagcacaggcaacaaaagcaaaaagaaacaggtggtactacatcagactaaaaagcttctgcatgacaaagggaacaatccgcaaataaaagggcagcctatgaattggaagaaaatatttgcgacccatatatatgataaggagttaatatcaaaaatatataaggaactcccagaactcaatggtaagaaaatgaataacccgattaaaaaataggcaaaggacttgattattcattttcccaaagaagccatacaaatggccagcaggttgtgaaaaggtactcagtatcactaatcataagggaaatggaaatcaaaaccactatgagatatcagctcacaccttttagaatggctattagaaagacaacagataacaaacgttagggtgtggagaaaagagaacccttttatacttttgatgggaatgtagattggtacagccattatggaaaatggtatagaagtgcctcaaaaaattaaaagtagaactaccatatgatccagcaattcctctgctggatatgtacctaaaggaaatgaagtcagtgtgtcaaagaggtatctacactcctgtgttcattgcagcattattcgcaatagccaagatatggaaacaatttaagtgactgttgatggatgagtggctaaaaatatcgtgggatacacacacacacacacacacacacacacacacacacacacacacacacagatgacagaatattattcagccttaaaaaaggagatcatgctatttgtgacaacatggatgaacttatgctaagtaaaataagtgagacacagaaggaaaaatacttcatgatcttatttatctggaacctgaaaaaaagagtcaaatatatagaaacagaatagaaccacggttaccaagggtgggaatggggaggaaataaggcaatgtaggtcaaagtgtacaaacttgcagtgatgtaggctcaataagtctagagatgtacagcaggaggactatagttaacaatattgtattgtatatggaaaatgtgctaagagtagattttaggtgctcttacctcttctccccacaaaggtaactatggaaggtgatgagtatgtcagattgcttactggtagtaatcatttcactatggatatgtatatcaaaacatcatgtcatacatgttaaagttatgccataaaaatagctatatgtgggccaggccaggcatggtggcttatgcctgtaataccagcattttgggaggctgaggcaggaggattgcttgaggccaggagtttaagaccagcctgggcaacgtagtgagaaacctgtctctccaaaaatgtttttaaaagttatctgcgtgtggtagtgcatgcctgtgatcccagctacttgggaggctgaggcaagaggattgcttgagcccgaaaggtagaggctgcagtgacctgcgattgcaccactgcactccagcctgcgtgacagagtgagaccctgtctcttaaaaaaaaaaaagattaaaaaatagttgtatgtgtatatgtatacgttcaggatttgttctatttgttttctttttcttttttttcataggcagtggtcaatggcctaaggatttctttatacattgctcatatccactaaggctctattgagcaaaccacgccttaaaaatcttacaatcctcttcatatattttaaaggcaaatgcaaagaaatagctttgttctgttttgcattcttcatgggttaacatatcttctggaaaacttgttgctatggcaatgggatattatctatcttggtaatgtactacataaaaatagccctttgtgtttgagaatgatgttagtgacaggtggttgggtgaatgtatagcaggctgctttgtcaagaatagtttcccaacattccattgtttaaagttgtgaaatcaaaatgagtataatttttttctctctcaaaatgtaattttatctggaaaaggcaggcagtggtgctctgtttaattatgaattacaagccttcctttgcaggtcaggtcaacatgatgattgaagccacctctcactgtaataagtaaacgacttctctattctttctgtcagggtgtgcagcacaaggttgcgctgggggggccagtagggataattttcccattcttgaacacatcgttcttcctaagcacctcgtacttataaaccaagaagtaggaagtggtcaggtggaagagatgagctctgagctgttaatcaaatccgaatttcttgtaggttcttaggtgaaacagttccttgggaaaggtcagatttccatgttgcttttagtattgaactcacacatatagccaaggatagaatctgacccaaatcttaatttttcctttgaaaaatcctttgggcaatttttttttaatttaatttaattttattattattattattattttttattgatcattcttgggtgtttctcgcagagggggatttggcagggtcacaggacagtagtggagggaaggtcagcagataaacaagtgaacaaaggtctctggttttcctaggcagaggaccctgccgccttccgcagtgtttgtgtccctgggtacttgagattagggagtggtgctgactcttaaggagcatgctgccttcaagcatctgtttaacaaagcacatcttgcaccgcccttaatccattcaaccctgagtggatacagcacatgtttcagagagcaccgggttgggggtaaggtcaccgatcaacaggatcccaaggcagaagaatttttcttagtacagaacaaaatgaaaagtctcccatgtctacctctttccacacagtcacggcaaccatccgatttctcaatcttttccccacctttcccccctttctattctacaaaaccgccattgtcatcatggcccgttctcaatgagctgttgggtacacctcccagacggggtggtggccgggcagaggggctcctcacttcccagtaggtgccgccgggcagaggcgcccctcacctcccggacggggcggctggccggacggggggctgaccccccccacctccctcctggacggggcggctggccgggcagaggggctcctcacttcccagtaggggcggccgggcagaggcgcccctcacctcccggacggggcggctggccgggcggggggctgacccccccacctccctcccggacggggcggctggccgggcagagtggctcctcacttcccagtaggggcagccgggcagaggcgcccctcacttcccggacggggcggctggccaggtggggggctgaccccgccacctccctcccggacggggcggctggccgggcagagtggctcctcacttcccagtaggggcgcccgggcagaggcgcccctcacctcccggacggggcggctggccgggcggggggctgacccccccacctccctcccagatggggcagctggccgggcggggggctgacccccccacctccctcccggacggggcggctggccgggtggggggctgacccccccacctccctcccggacagggcggctggcagggcagagtggctcctcacttcccagtaggggcggctgggcagaggcgcccctcacttcccggacggggcggctggccgggcggggggctgatccccccacctccctcccagacggggcggctggccgggcggggggctgacccccccacctccctcccggacggggcggctggccgggcggggggctgacccccccacctccctcccggacgaggtggctgccgggcggagacgctcctcacttcccagacggggtggctgctgggcggaggggctcctcacttctcagacggggcagctgccgggcggaggggctcctcacttctcagacggggcggttgccaggcagagggtctcctcacttctcagacggggcgtccgggcagagacgctcctcacatcccagacggggtggcagggcagaggtgctccccacatctcagacgatgggcggccgggcagagacgctcctcacttcccagatgtgatggcggccgggaagaggcgctcctcacttcctagatgggatggcggctgggcagaggctgcaatctctgcactttgggaggccaaggcaggctgctgggaggtggaggttgtagtgagctgagatcacgccactgcactccagcctgggcaccattgagcactgagtgaacgagactccgtctgcaatcccggcacctcgggaggccgaggctggcgggtcactcgcggttaggagctggagaccaacccggccaacacagcgaatccccatctccaccaaaaaaatacgaaaaccagtcaggcgtggcggcgcgcgcctgcaattgcaggcactcggcaagctgaggcaggagaatcaggcagggaggttgcagtgagccgagatggcagcagtactgtccagcttcggctcggcatcagagggagactgtggaaagagagggagagggagaccgtggggagagggagagggctgggcaatttcttagagcagtaactctcaaacattttgtcgtcatcatctcacttttcttctacttatcaaaatgagtattgatttaattgtaatgagtaaataacagctccctgctactgaaatgaaatttactctagctttgagaatttgagagaccctcttaagaaaataccacagctggaaatttgagacctaaaagtaatacaatttgagtatctcatatctgaaatgcttgggaccagaagtgttttggattttggattttttcagactttggaatatttgcgtttacataatgagatctcttggggatgggacccaagtctaaacacgaaattcattaatgttttatatacgccttatacacatagcctaaaggtaattttatacaatattttaaataagcttgtgcatgaaacaaaattttgactgtgttttgactgtgacctgtcacataaggtcaggtgtggattttttcatttgtgacttcatgtcaacactcagaaactttcacattttggagcattttggatttcagattagggatgcttaatctgcagctctaattctgatatgcacggtactactgcagagatggaaccattgcctttgtcttttctgttggagtcagtatagatatcttgctactaataatatcagaagagagtgttgagtggtttgctgggtgcccaatactacttttagaacattttatgtattaactaatttattcctgtaaacattcttgacagtttttgtgactatttcccaaatgaggcgtacttgttagcatgtctttctgtttgtggtgagtaagcattcttgtgtattggaagacttgcttactagcatgtcacagtgttcttcatattgaaagcattcttctatcaggagttgacgtaattcagcctgtgggccaaatccatcctgccacccattttttgtgtattttataagctaagaatggtttctgcatttttaaatggttgggaaaacataaaaagaataatttgtgacatgtgaaaattacatgaaatttaaatttcagtttccataaacagttttattggaacacagctttactcatttgtttacatattgctaaggctgcttttgaactagagtggcagagttgagtagttgtaatagagaccatatagctcccagaccctaagaaaaagtttgccaatcccttctctatattcttctgtatctagaatggcagatggtcctcaataataacagcagattggtcaggtgtcatagtttatgcctgtaatcccagcattttgagaggccaaggtgggaggatcacttgagctggagttcaagaccagcctgggcaacacagtgagacctagctctgcaaaaattagccaggtgtcatggtgcacgctggtggtcccagctacttgggaggctgaagtgggaggattgcttgagcctgggaggtcaaggctggagggagacgtgatcacaccattgtgctccagcctgggtgacagagcgagaccctgtctcaaaaatatataaacagattggatttatgtacaggttcatatatatattaattttcttttggtatgcaatatatttttctttcttccactaaacgtttctcttgtcataagcttgatgtcatgtactatggcatatctcaaatatacgtgatttcagctctttgcatacccatattggttttcttttttttttttttaattgatcattcttaggtgtttctcgcagagggggatttggcagggtcacaggacaatagtggagggaaggtcagcagataaacaagtgaacaaaggtctctggttttcctaggcagaggactctgcggccttccgcagtgtttgtgtccctgggtacttgagattagggagcggtgatgactcttaaggagcatgctgccttcaagcatctgtttaacaaagcacatcttgcaccgcccttaatccattcaaccctgagtggacacagcacatgtttcagagagcaccgggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcagtgagctgttgggtacacctcccagacggggtggtggccgggcagaggggctcctcacttcccagtaggggcggccgggcagaggcgcccctcacctcccggacggggcggctggccgggcggggggctgacacccccacctccctcccggacggggcggctggccgggcggggggctgacccccccacctccctccgggacggggtggctggctgggcagaggggctcctcacttcccagtaggggcggccaggcagaggcgcccctcacctcctggatggggcggctggccgggcggggggctgacccccccacctccctcccagacggggcggctggccgggcggggggctgaccccccccacctccctcccggacggggcggccggccgggcagaggggctcctcacttcccagtaggggcggccgggcagaggcgcccctcacctcccggatggggtggctggccgggcggggggctgacccccccacctccctcccggacggggtggctgctgggcggagacgttcctcacttcccagacgggatggctgccgggtggaggggctcctcacttctcagacggggcggctgccgggcggaggggcccctcacttctcagacggggcggctgctgggctgaggggctcctcacttttcagacggggcggttgccaggcagagggtctcctcacttctcagacggggcggctgggcagagacgctcctcacatcccggatggggcggcagggcagaggcactccccacatctcagacgatgggcggccgggcagagacgctcctcacttcctagatgggatggcggccgggaagaggcgctcctcacttcctagatgggatggcggccaggcagagacgctcctcactttccagactgggcagccaggcagaggggctcctcacatcccagacgatgggtggccaggcagagacactcctcactttccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatcccggcacctcgggaggccgaggctggcggatcactcccggttaggagctggagaccagcccggccaacacagcgaaaccccgtctccaccaaaaaaatacgaaaaccagtcaggcgtggcggcgcgcgcctgcaattgcaggcactcggcaggctgaggcaggagaatcaggcagggaggttgcagtgagccaagatggcagcagtacagtccagactcccacggcatcagagggagaccgtggaaagagagggagagggagaccgtggggagagggagaccgagagggagagggagagagggagagggagagagggagagggagagagggagagggagagatttggttttcataataatcataaccctttccaaatgagggagagtaatgaattttatcattttattagttagtgtgcttcctttgctagatcaggaattatatctcctagtaattataaccctctatttattatttttaactatattgctttctacttttgggctttcagccaacgtgtaaatattgacagtttaataatctgaaccaagccacctggactgattgtaatattttaatttaataaatcttgcatatggttaagattacatcttctacattcatcagattggatttaatgcactcaccataatcaactctggaacattcttgcaattattattgttatttttaaaggttttctcctttgtctgttgttttcccactttttttttttttttttaagacggaatctccctctgtcacccaggctggagtgcagtggcgtgatctcggctcactgcaacctccgccccctgggttcaagcgattctcctgtctcagcctcctgagtagctgggactacaggcgtgtgccaccacgcccagctaattttttgtatttttagtagagatggggtttcaccatgttggccaggctggtctcaaactcctgacctcaagcagtctgcctgcctcggcctcctgaagtgctgggattataggcgtgagccactgtgcctggcctgttttcccactttttaaagtaacagccttgttgagatgtaattcacataccatatagtcacctatttaaagtgtacaattcagtggttttagtatattcacagaattgtgcaaccatcacaactatttccggaatatttttgtcacccaaaaaagaaaccccatactcactagcaatcacccccagttccaccattcctaggcagccatggatctactttttgtctatggattcgtctattccagacatttcatagaaatgaaaccacatagtgtgtggtcatttgtgattgtcttctttctcttagcgtgttttaaatgtagcacgtatcagcacttcttattgccagttctgctgtatggctataccacattttatttatcaattcatgagttgacagacatttgggtcattttcactttttgcctcttatgtataatgctactctgaacacttgtgtataggtttttgtgtggacatatgtttttatttctgtcgaatatatacctagaggtggaattgttgtgtcgtatggtaactctatgtttaaccttttgaggaactgccaggctcttttgcaaagctgctgtactatttgacattcttgtgagcaatatatgagggttccagtttccccacatccttaccaacgtttgttattgtctatctttttgattatggctatcctagtgggtgtataatggtatctcattgtggttttagttggaatttccctgatgactaataatgttgcatgtcttttcacgtgcttattggccacttgtatatcttctttagagaaatgtgtatttagatcgtttgtccattttaaattgggttgtctttataaaatgttgaattgtaagagttctttatatattctggattcaatacatatgatacaatacatataatacatattttagtcatctatcagataaatgatttgcaaaaattttcttccattttgtgggttgtctttttactttcttgatggtgtcctttgaagcatgaaagcttttaattttgatggagtttatttattgttttctattgtcacttgtgtttttggtgtcatatttaagaaaccattgcctaatccaagatcacaaagatttcacttatgttttcttctaagagttttgtagttttagctcctatatgtcagtctttgattcattttgagttaatttttgtacgtggtgtgaagtaggggtacaacttcatacttttgtatatggatatccacttgtcttagcatcatgttttgaacaaactgttcttttcctaatgaattgttttggaacccttgtgcaaaaccaattgaccttatgtaaatgtaagggcttatgtctagactgtgtcagtatcacactgtcttgatttgtttaatctatttttgaggcagactttcgctccctgatctaaaattaaaatgtttcacaattgatgatgtcttatatgcatcaaaacttgcagactgggtgtaagtggcttgagaaaatatattggagactaaagtggggctgttggagactcataggaatcaaatagttagaaggtgggggagtgagagaggcagtaagttggatgcttcccaggtgtttagcagccatcccaaagtggcagtcaaaaataggctagctttacataatttcaaagttaggtactgatggttccagtttctttttatggattcttttaaaaagtgctgtatcaccaaatgctgttgatggcatagaagacaacactgtggaaaaatgtggacattgaccagtctgagtcaaaaagatggacagatattcagttctaaatgtgaggaatttttaggaaaaccttgagcagttaattttgcttatttccctttctatgtgtatatgaatgataaatgaaaagtctaaaagagctcctttaataagcctgagataaatgctaagtcgtagactactgcatcatatcttatttggcttttttttagtgccacctaaaatactggtgttttagctttgagatgctcttatcctcctgcttccagctctatctacacctcagaaggagctgggtcctttcccagagtctattgtataaattaaccttcttcctgtagtcactctatgtccatctgtttcccagccactttaattttgttctttttcctttctcttgtgcttgtagatttaagtcttaaaaacaagccaggtattattgtttatagtggaattttgagtaggagtggaggttaacctgtacatcaatctagtaggaatattcattcaatcactcaagggatgagcttatggaaaagttacaaaaatagtagcattcctttatattcctcaccctgctcccttaatgttaacattttatataaaggatcaagaataggaaattagtcttggtacagtattattaactaaactacagagcttatttgaattccatcagtttttccactggtggtctatttctgttctaggatcctgtccaggatcccatattgcatttagttattatttctccttagtctcatccagtttgtaataatttcttaatctttaatgacacctttgaagagtacagatcaatattttgtagaatgttcctcaatttgtatttgtttgatgctttcttatgaataaggttgttcatttttggcaagaatataatgatgcatatttttcagtgtatcatatcaaggagttcatgatgttgatgtgtcttgttactggtgacatttaccttgattccttgtttaaattgctgtctgcagggtttctctacagtaaaattattactttttctctttatggttaaaatatcttgggggagatgctttgagactaggcagatatcctatttatcctcaaatttttgtccattgatttttttcattctttggtggatcactctgtatcatagagtatttgtgacaaatatttgattagcagaaataaagctatgccctacaagaagcaaagatcaattacattgaaatcctattgtattggttaatataacgctagcagctgtgttcctcaactttcaggagcttaacacaacagatgcttttcttctcaatatgggcatttctggttgtgtaggcagttttctgccatgttaattcaagtatccagactaaactttttatactgaagtaacttcaaactgacagaaaatagggatgcaagaatagtaccaggaaatcctgtataccctttactagatttacttaacatttgctacatgtgccttatgattttctttgtctattcatatatgtatatgtattttatatatattttatatatctgtatttatatattgattgccatatactaaatcacttgagattaaatcacatacatcatgttcttctatgccttaatagtttaaacttaatatatttatttgtttaaatctagtatacagtttcagaattgctaacccatatctgtttgagaaacactttcactaactggattacagcatttatacaattcttttattctttagttttgcaatatctagtcaagatacgattttccagtttcccactgaagtattaagtttgaaaactgtacataagcacactgttattcaaatttaggaaatttaatatcagtactttagtatgcagtctgtattccagtttcattaattatccccaaaatgttcttcagtggaatattttttttctcctgatacagtatcaagtccaggatcatgtattgaatttatttgtcatgactttttagtttcctttgatctggaacagatcttataagcctttctttgtctttcatgacatcgacattttgaacaatgacaaatttatgacattgttttgtagaatgtaccaaatttgggctgggtgctgtggctcatgcctacaatcctagcactttgggaggctgaggcaggtggattgtctgagttcaggaactcgagaccagcttggccaacatggtgaaaccccatctctactaaaaatacaaaaaacaaaaaaaattagccatggcacctataatcccagctactcaggaggctgaggcaagagaatcgcttgaacccgggaggcagaggttgcagtgagccgagattgcaccactgcactccagcctgggcgacagagctagatgctccatttcaaaaaaaaaaggaacgtaccaaatttgggtttggttgatggctcctcttgtttagattgagattatgcatttttaaaaaaacttttaggttcaggggtacatgtgctgatttgttgtataggtaaattcttgtcacgggggtttgttgtacagattatttcattacccaggtactaaacctagtatgcagtagttttttttttctcttctccctcctgccaccctccatcctccaataggcctcagtgtctgttgttcttctctgtgtgtccatgtgttctcatcacttagctcccacttacaagtgagaacatgcagtatttggttttccgttcctgcattagtttgcttaggataatggcccccagctccatccatgttcctgcaaaggacatgagctcattcttttttatggttgtgtagtattccatggtgtatatgtaccacattttctttatccagtctatcattgatgggcatttaggttgattttatgtttttgctattgtgaatagtgctgcaatgaacatacgcttgcatgtgtctttatggtagaatgatttatattcctttgggtctatacccagtaatggggttgctgggtcgaatggtatttccgtttttaggtctttgaggaatcgccactctgttttccacaatagttgaattaatttacactcctaccagcagtatgtaagcattcctttttctctgcaacctcactggcacctgtttctttttgactttttagtaatagccattcttactgatgtgagatgttatctcattgtggttttgatttgcatttctctaatgatcagtgatgttgtggtttttttttcatctgctcgttagccacgtgtatgtcttcttttgaaaagtgtctgagattatgcatttttgtctggaatactgcataagtgacatgtccttctcaggcaatgcatcaggaggcacatgatgtctcaacccctcattggtgattgtaattttgatcatttggttaaattactgtttgcttaagtgttaactatttttagatatgacgtatcagagtgatcaatactgtgaagcctcttacaacagtgtttagattgaaaaattatgagtgaaaagcctttcacagtcattcggattgaatatgcctaacatgaaatccaaactgtttcaacatttctttcaagtcattttctactatggaaataataatgcatgatttagccatgcctgagttttatttcctcacgcaggcatttatttctttaaaaaatttaatttaaagttcactataaaacttaccattttaaccatttgaagtgtacacttcagtggcattaagtacattcacaatgttgtgcaaccatcactaccatccatctccaggacttctttatcatcccaaacataaaccatatctactaaacagtaactccccaattccttctccagcccctggtaacctcattttatatgccatcacaatattttagaataaacgccaacttcctggggtaagatcatttgacttttgctcccagatcagaactatgataaaaatattatttgctatatactaacagggaaatttctggattttggcatgagttactgtattataactctaaatcctggtaagggaagcatttttattctgaaagtaaacaaaaataaccattagtatgataatctttacctctgggggtggggtattttggagggggtgagtacaaagagaggtgaaattattcctctagggtggcagaccagagtttaaattgtttcttatgtttttcatcttggttgtctaccaattggatatagtcactcagatcatccatgtttttgtacctggtttgataggtataaatacctataaattggaataaattctagcaattagaggtccatgttccttggtctgtaaagtgaatataacaaaactgacttctctccaaagggtgctttgagacaaaactataaaacactttggagagtagaaggggggtccttatttttagtaacattcctcagtgttcttcaagaactcacctactgccaatcattcctctgagttaagaatatatattagaactagttttaatagcactataaactatagatagcatggccatatgtccctgtttgcctggagctgaataaattacaggttcaaaaatactcaaataataaaattgcctaggtggtgacccacctagtttgttgctgtatggtgttgggtatctcttttttttccttgacaaatttgaaaaggccttgaaaccatgagcagattccttggttcagatggtctgtaataggagacaccaggacaagcctgagtctcctgctcttgaaagattagcatattgatagattgcgtacccattatcagttaggtatctgccaaaccatttgcagcgtttctctggagttcatacagttgggaagacttcctagaggcaagaggtcttttacctgaagattcagcagttactataggggccttcttttggcttcttgctcttgggacacctttacttgaatgaggtagtcttttgccattagtgcctgtggggccttaatgattcctattgggatgagttggccagaagtgaggctctccacttcatgttgaaactaacttctgcctgagtattaaggatgggtgattctgaggtcctgagccagctggaaggactttcattcactttctactcttgtctgaagaatgcttaggctaccttactgttacttctctggtggtaccaaaggccatgtaatgacatggctggatgcgatcactcacgtctgtaatcccagcactttgggaggccaaggcaggaggatcacttgagcccaggagttcaaccagcctgggcgacataggaagacccccatctctaaaaaatttttaaaaaatctagctgggcatgttggtatactcctgtagtcccagctactcggcaggctgagatgggaggattgcttgagcttaggcgattgaggctgcggtgaaccatgatcacaccactgcactccagcttgggcaacagagcaagaccctgtctctaaaaaaaaaaaaaaaaaacaaacaaaagatgtgatgattgcctctttcggttatatcctgctgcctaagagcccaccccagaatttagtggcttaggataaccattttcatagttttgtcagtgagggattagggaagatgtcagctgagctcttcatttctgctccagatggcattggttgggcaatgggactggaggttctaattctaagatagcttcttcactcttatgaatagctcctcagtgtctgtggccagtctctctccatgtggtatctcatccaccctggcctttccacatgccttaggcttcccacatcatggtggttcctgggtagttactcttcttacagagtagggatgaaatgaaagcctctattctaaattcagttaaatactggtacaaatatttagtactgggattgtgggatcattttcttatatcataattataacccaatcagggtagaaaagtgaaagaaagaaggacacttcattttctttgctctttgtgtggatgatgggttgtacaaatagcaggaggttcaacttttggcttgttttggattactgagtactatccttcagaaatgatttcctaatactttcccggccatctggcatgagcacagaagaccttttactcaataaaagtaagctaataataataagttgaaacatcttgataataaatatatttgtacagcttttcaaatcccaggttattgaaattctgtcagccttggctggtttccatgctccttctgtgcccttgtgtttcctttttttctttttttttttgttgagccactcctgctgacttccaaaggatgctctgagctctaaaaggaggagcagttttgctggcatgcagaagtggtgaaggtaaggcttggattcaattacagtaatctcagaagttcttggtagaagaggggcacagaatcccagcctccattttgcaggtaaggaagaagaattataaaaagataaaatggcttttcttaatgtcagcatctgattctttaccttctttcaccctagcaaagattgttaacataaaacagatgttccttggacaagagaaaagtaatagagctggatcttttcatgatcctgcatttattatttgtagcactggatctctaaactaggaaaagcaatgtcgattctaactagaaattatggggcatttaataacacgtgaggcaaaattatgaggaaaggcaagaaaccaagtggctcctagcttctaacaccttattttctatggtgtaagttaatgaatgatccatttttaatgccataaaaaaggaaatttccgataggctttaccttaacttcacgttgctgtttatattacagacaaaatgctaaagttaacaagtgtaaaatgccctaggtcagggtttcgagtgcccataagcaattctctagaattattttgagtgctcagattatagatttgcccccataccatatactgtattacctatcactgcaagattctttatagggtgtcaagtatgtgggaggatttaaactaattgtcttaaatgcttcatgggataggagatgatccaatgggaactgaatgttttcaattaggatgtttccatggatactattaagcatgccaagattcatagccacaggagatttttacttacttcaatattgattaagaaatctgagaacaatctcaagaagtgtaggatgtaggcggaggataaattttgaggatagtctaaaatttgctttctcttccatagttaaggcctagtccagaaaaagtctaggcagtcagccaagtctaacagcaggatttatgtcaagagaatgtccagaataaaagtgaacatgggttgtttcatttaccccaggtgtatttattaacatttatttaatgttacttattatttgtttattaccattagctttcttatgtactcggtacaaagcattagaattacaaccctttgtatctttgttgtttatgaggaaaacatcctaaatagtgtctacagacatcttaaaattcacattcctctgagaaaggtttatcccttaggttattacttttttttttttttccacacatgggttttttacctgggttctcagatctccaagaaatcggtggatagaattcaaggtgacttcttggatggagaaaaagtacgtctttattttgaccaaccatggatatttagcattttcatcaattaatgaatgcaggtgacaaatcacagtactattggccccatctttgagtttgtcctcaatagctcacagatattttcatattgtatcacagttgttgcagatatcttgaaatattgtttattctaatcactccttcaaaatttgggtggttattggcattatcaccagttttttttttttttttgaggcagtctttctctgttacccccaggctggagtgcagtggtgtgatcttggctcactgtgacctctgcctcccaggttcaagtgattctcccgcctcagcttcctgagtagctgggattacaggcacatgccaccacggcccggctaatttatttatttatttattctttattttttatttttaaattttttttagatggagtctcactctgtcgccaggctggagtgcagtggtgtgatcttggctcactgcaacctccgcctcccaggttcaagcgattctcctgcctcagcctcccgagtagttgggactacgggagcgtgccaccacgcccagctaatttttctattttaagtagagatggagttttaccatgttggccaggatggtcgcgatctcttgacctcgtgatccacctgcctcggccaaaatgctgggattacaggcgtgagccaccgtgcctggccacattaccaccagttcttgatacttaatgccataacaaaaggcacatgtatcactatatcacaaattagcattttataatattttaataacgttttcaatataagtggcttcccttgtaatcatatattttatttttgcacttaaaaatataattcctaaaagggatccataaagcttcaccagactgccaaagcgtccatggcacaggacgttaagaaccctgttccaaatggaatgaagattagaagcactatcatatgttcattttctgatcgcagtttaagaaagagtttcctacttaagtgcttttcacagaaaatctaaacttaaaggttaaaagggaattcttttgtgctggctcatgtgtgggccctacaaagtactttgcagtcatatctgactttcgtttgagagtttgtcttcagaaatggaagaagaaaaggcattcaggtatatgacaggttgcattctgtagaacattgttaaatctatgggaggggagaaaagttccattcagtgtcttgtggattgtggtaggagtcagttgtgttcttgcagaaatttccctagacagtgcctcttgcctcctcctttcttgtcccacagtactccatggagcagatgtgggaacttggatgcctgatgggaattgtaaccccatgctttgccttatcctggtggggactgatctgaggtttatccattaaactgtatcagttcatggctgggagtaggaatgcagaaaacacaagcaaaatgactgcaggaaggtttaaataaaatctcatatgtggcttttccttaacacattattttgcaaaaagtggcagagtgaatttgctgtgatatgataggatcattctggacttttacttaatttacgtgttctctagcagaatgctgaaggagcacacataaggagtggggagttggtatttggttctgtgacaagtgctatcttataacagaaaaatacatatttttgtgaaacttcaaatgcatttttattccccagcacatctgtgattctggatccactaccttcttccaagtgtgatcaagcactgtacctgacagtatcgattatccttacccgtaggcaaaaattgtattacatttattttacagtgatctggaaaaaaaaggatgacaacaaaaaccagacacacttcatttctattccggtaacattttttggtaataatttattactgtacaagtcacacaccatataagtcacacatttaaagtgtcaaattaaatggtttttagtatattcacaggatcgtgccatcatcacagtcaaatttagaacacttattacccccaacaagaaacctcatacgctttagcagtcaccctccattgccccccagttttctaaccccaggccctaacaaccactaacctactttctgtctctatgaatttgcctcttctggccatttcatataaatggaattacacattttgtaaccttttgtgactggcttttttcacttagcataatgttttttaaggtctacctatattagagtatgtatcagtactttattcctttttatggccaaataatattccattttctggatataccagattttgtttatccattcatctgttgatggacatttgagttgtttccactttgtgctattattatgaataatgctgctatgaacattcatgtttacatcatgtatacattttaatgtggacatatgtttttagttatcttgagtatatacctaggagtggaatcatatatatatgtttttaaaccaaaatcaaattttaatgttgcagaatccctgaagcacttttaggaactgttcacttccatagaacagtttgcaaatcagtgttaaagtggagagagtgttgatttttttgtgcatgtatttggtagacatcgtttgaatcttgattttataggctgtgtgaattttgtcaagttacctgtgaacatctttcttctagtatagaatgttagtacctctggatgtttcacgagttgatagactgtattattgcttgaaaaattcactgtccatttattaccatcaactttggccacggatttgctttggctagtggcctgtgaggggaagtgatgtgtgccttcttccaggcagaagctggtggtttgcctcatctcttttcctttctgccatgatgaccattgatgttccagttggacacaggctccatcagcttgtgtatcagaatgaaaatgatgtggggcagagccctcatagattttgttgcatgagtatggaaaaagtgtcattttaagccgtcaagatttggtgactatttgatactttagcacagtggtcctcaagcaatggcagttttgcatttctcacactgagatatctggcaatgtctggagacattttttggttatcacacatggggaagtgctcttggcatttagtgggcagatgctgctaagcatccaacactgcacaggacagctcccacaacaaagaattatctgatccaaaatgtcaatagtgctgaagtttagaaaccctgctttagtataacctagtttatcctggttaagatagggtgttgagaagattaaatggaaaaaaaatatataaaatacagcacacagggtggtctttttttggtaattatgtgacagagcttggcaatggctctgaggtcttcccttgcatttgtgggtcttttccaacttccctagggttcagtattcagtttaattgtagttgtgtttataaatcaaggctcgtttttagcagaatcatataccctttaaaaaagggggagaactaacattagatgcctgtttggcaccaggctctttgtatgtgttttgaatttttacagatattctctgaaactgatattccttacctccattttgttttgttttgttttgttttgttttgagacaggatctcactgtgttgcccagactggagtgcagtggtgcgatcttgtctcactgcaacctccacctcctgaattcaagcaattctcctgcctcagcctcctgagtagctgggattacaggcatgcgccaccatgcccagttaatgttttgtattttcagtagagatgggatttcgctatgttggccaggctggtctcttaacttttggcctcctgtgatcccccagccttggcctcccaaagtgctgggattacaggcatgagccaccatgcccggccctccattttgtttttgatgaagacattgaggcactgaagttaagtaatttgaccaagatcacatggcttataagtggtgggcctagaattcgaagcacatctgtttgcctccagaaccctcttctttccacactgctatactacctctttagcagtgactttaacatagagaaatgaaggtaatacctgatttctaacaattatgtgttgtattagttatctattgctgtataacaggttacctcaaaacttagcactttaacacaacaaacagttattgtctgacatagttttgagaatcagtaatttaggggaagctaagctgggtggttctggctcaggatctctatggagattgcaaacaagttgtcttccagggctgcagcgatctgaagacctgattggagcaggaagatccacttccattgtggtgcactcacagggctgttggtgggaggcctcagttcctcaccatgtgggtctctctttagggttgcttgattgtcatcatgacatggcagctggcctccttcagagtgagggatctcagagagacagcaaggcagaagccacaatatcttttgtgacctagccttagaagtcacagatgatcacttctgctcttttctattggtcacatacacaaccctgatataatgtgggagaggatgatacaagggcatcaagaatactatgagatggaaatcactgggggccatcatggaggctggttactacatgttaatgatcctcatttgccatagttacaaaattatgaattatatttccttttcatattctaatattccaaacacctgttttgtactttaagatacttaaatcatttagaatgtgagtgaaaatacaaattggcttttgtaaacacttactgaatgggtaaaataaaggccgtggtacagatacttcattggggaattttttttttaaataggtttgactagctgaggcttcttgaatcctgaaaagtttggtctgatgtacttttttttttttcctggaaaatctccttgtaccaaacactgaattcttcatttgccaaagtccacccaactttctgatgtttttattgctggtttgatgtgcttgaatgccagccagagtataaggtgaatggtagatgcaaggactgtgcagtttccacggagacttctttcaggagcccttcattttttcattcagctattgctgggaggcatccccttccagttaatgtgtggtacacatcaatttgagtggctcttagaaaggggctcagtttatacaaattaagaattgaggttttttttttctctgtatatcttcaacgttaaattagatttctatgaaacttgaagatgttaacaggaaatcttcctgaaacagtttaactatacttttgtttattacacttgattttgagcttttgggaataaaagtagggtcctggctaggtacagaggtatatggatttactgtgtctaatcgtgcaaccatgaaataaacgtttgcacttcaggaatcaacccatcactttttaaccactgttgtttgcattggcttagagctttgtgcttccttcaactattttccttttttctttcaaaactgtgttcagttggttgtgaccaattttacacagagactggctcactcacttatgttcttgactcctgctgtcccaatatcatgcttcatttacacagggatagcttttcctggctttatctgttgacttgacatcctgtgcatcatatttcttttcttagatatagagaagactgaaaaaaatccacgatttgaagaaaatttgcaaaagtgcagagcaatgtgaaagagatagctttaattttaattttcactgtagtcagaataggtggcctcctgatgggcagacttgctttctcattttactctgtccagtgtagatacccagatcaatcaaggtcaagctggtctggtcattaatacaacttttggttttaaacacagctgtgtacgggggttcttagcattattaatagaggttataatgaaaacaaggtatagtcatacagttgtctgtgtgggtagtggcatggaggtggagttgttgcttaagatctgaaagtcaggaagctggaggtttttgtaattttattcattatcaatcttaagaatttattttgatcattataaatgcatgactggtgctattttccaatcctgaggttttttgggaaatttttttgaaaagaggccaggatgaggataaaaattaattttgaaaatccatttcaaagactcattatgctatgctccatcactgcaattttaatgcaacttatatattgtgcttttacctttgggactagcattcttaaaagctgacttttaatttggactttctaatatgtgtcggctctgtcagctcacgagtgtgtttttatctgtgcatcatgttatattgggacctgggtggaatgtaaatcttttactggcctaaatctgagtctaatcctctgcatggctttggtagaaaatcaatttcctctgctctgtcaagatttttcaggtcagtgctctttggaagtttcccagttctcttagattaaaatagattttgtttctgtgctacatactggtattagttagtaggacactgggatctaaaagcaagagaacagaggcagacaagatatccatgagttcttctatttcagttaacttgttgacacactgcacctttgaggaaccaaggagtttgtgtgctttcaggcatcatttgggggagcaattgtaaatgactcctgtaggtgaggctgtgcacttaattttaatgagttcaggttcattaagtgacctgctcactgggtcattagaagtgacctcactagaagtgaatggtaaagagaagaactacctaagttccactcagcttgtttcactactgtggggtattggaagtagagtgacaacttggactttctcagttttagcactgaaaagtcccacatcccaggaacttactcagtccccagcaaactagggggagcgggggatggttggtccccctagcagtgaaaagtaaggggatggatgatttggaactggttagtacccttatagatttttttttttttttctgagacaggttcttgctgtgtcacccaggctagaatatagtggcatgatcatggctcactgcagccacgatctcctgggtccaaatgatactcccacttcagcctccccagtagctggaactacggggacaagccaccacacccagctaatttttatttatttatattaattaattaatttatttttttgtagggacagggtctcgctttgttgcccaggctggtcttgaactcctgggctcaagtgatcctcctgccttagcctctcaaagcactgggattacaggtgtaaaccaccatgcctggctgtcttataaatactttaaggagggatttattagagacatgtagcaccttgctgcccagtgatgctagtaaatgagtgactctactttgatttgacagaagaaacaatggaaagaggagagatggaagtttttctacctaaacttcctaagaggatgtgtttaggggatgtgttggtaaaaagttattagcattaatgtttacctgtatctttctcatagataatgcaaagacctttaactccacttatccctccttttaacttatgttgttattgccttgtattttaatactatatattaaactctacaagacatcattattttatgcaggcattgtttatttaatcagagttcagtaaactttttctgtaaatgccagatggtaaatattttaacccctgcaggccttatagtctctgtcacaactactcaactccactcttaatagtgccaaaatggctatagacaatatggaaatgattgtgtgtacccatgttccaataaaatttatttacagaaacagacagtgggccagatttggcctgcaggccttactttgacaactcctaatttagatttatctacatatttatttattttccctttatttcttgctatatctttgaggttctacctgggatcattttcaaggcaaggatgtctattctcatcactgtttttcagcgttgtgctagaaattccaaccagtgcaataaggcaagaaaaggaaataaaaggcatacagagcagaaaggaaaaaaaaaatgaaactggccaggtacagctgctcatactttgagaggcgagctaggaggattgcttgagcccaggagttccagaccagcttgggcaatgtagggcgacccccatctctacaaaagtaaaaataaaaaaaaaattagcagggtgttatggtgcatgtctgtggtctcagctacttgggaggctgaggtgggaggatcacttgggccttggaggtgaagtgagccatggtgactgtatcactgcattctagcctgggcaacagagtgacaccgcctgtctcagaaaacaaaacaaaaacctgtctctatttgcagatgacatgattgtctacatagaagaccctgagaaatctacagtctacagaataactcctagacctaattaagtgagttcagcaaggtttcaggatataagataaacatacaaaaatgagttgtatttctacatactagccataaacaaatggacactgaaattaaaaatacaataccatttacattcactcaaaaaatacttgggtataaatctaacaaagcatgcacaggacttgtatgctgaaaactatacaatgctgatgaaagaaatcaaagtctaaatagatggggaaacataccatgttccgggtttcaggatataagataaacttacaaaaatgagttgtatttcacatactagctagaaacaaatggacactgaaattaaaaatacaataccatttacattcactcaagaaatacttgggtataaatctaacaaagcatgcacaggacttgtatgctgaaaactacaaaatgctgatgaaagaaatcaaagtctaaatagatggggaacataccatgttccaggattggaagactcaacatagtaaagatatcatttctcccccaaattgatatacaggtttaatgtaattcctgtcaaaatcttagtaagatttttttgtagatataattataaaatttatatggaaagggaaaagaactagactagctgaaacaattttgaaaaagaataataaagcaggaggaatcagtctgtaagattttaagacatataactacagtaatcaagactgtgtgatattggtggagggatacatgtatagatcaacggaacagaacaaagaacctagaaatagaccaacagaaatgtgcccaattgatctttgacaaaattgcaacagcaattgaacggagaaggaaagatagcctttttgacaaatggtgctaggtcaattaaacatcaatatgtcaaaaaaaaaaaaaaactcttgctgtaaatagtacacgttatatgaaaaataactccaaatgtatcacaaacttcaatgtaaaacataaaactataaaaataattagagaaaatcttcaggatctaaggctaggcagagttcttagacctgacaccaaaggtatgatccataaaagaattgataaattggatttcatcaaaataaaaaatacttactctgagaaagacctcataagaggatgaaaagacagactacagagtggggggaaatatttgcaaactacgtatccgacaaaggactggcatctagaatatataaataactttcaaaacttaacagtagaaaacaacccagttagaaagtggaaaaaatacaagaagggacatttcactgaagagcatatacagatgacagataagcatgtgaaaagatgttcaacataattagccactagggaaatgtaaattcagaccaaagtgagctatcactacatacctataagaatggctaaaattaaaaatagtgacagcatcaaatgatggcaaggctgtagagaaatggaatcattcatactttgctgatgggatgtaaaatgatacagcccctctgaaaaacagtttggcagtttcttaaagacactaaacatgcaactaccatatgacccagcaattgcactcctgggcatttatcccagagaagtgaagatttatgttcatataaatgccagtatgtgaatgttttataggagttttattcataatagcccataactggaaacaatacagatgttctttagtggatgaatggttagacaaactggtatatccatagcatggaatactacccagcagtaaaaaggagtgaagtactgatacatgcaatgatctggatggatctccagagaattatgccgagtgagaaaagccaatcctgagtggtttaaataccatatgattccatttatgtaacattcttgaagtgacaaaattatggagatggagaacagattagtccatgccaggggttgagggggcaagggttgggagtaaaatggatagctataaaaggcatgatgaggccaggcgtggtggctcacgcctgtaattccagcactttaagaggccgaggcgggtgaattgcttgaggtcaggagtttgagatcagcctgaccaacatggtgaaaccctgtttttactaaaaatacaaaaagtagctgggtgtagtggcaggtgcctgtaatcccagctactccagaggctgaggcaggagaatcgcttgaacctgggaggcagaggttgtagtgagctgagattgtgccactgaactccagcctgggcaacagagcaagactctgtcttaggaaaaaaaaaaaaaggcatcatgggtccttgtgagcatgaaaatgttctctattgactgtgtcaatagagacacacaattatgttgtgtgtcacaaccataatcacaacattatggttgtgatattgtactgtagttttacaagatgttaccattgggaggaagtgggcaaagggtacataggatctctgggtatcatttcttacctctgcatataaaactacagttgtctcaaaaggtttaattaagaaagtatttaagaaaaagaaccccaggatctaaaaagatcagagtcagagaatcacaaatgctaaataagaagcacttttgtatttggtgatgttctgaaattctggctcagttttgttatgaaatggagccacgtgggtccatgtgagtgagtccctgtgcacaggtgtatgattgactttttccctcaagtgcttctaatttgggatgttcttcactgtgtgccctttgagtgtctcttgcctctggttttttgttagacaaaaaaaccagtttttaaatgtcagttccaaggtcttttctgggtacggttaacttttatgatttcatttatgcagtgggttttcacctaagggccatggtttctagacactagactcgtttttcccaagcgattcatctctttgcctgtgggatggagagattcattctcttcttctcttttgcagtagaaactccagttttgagctgggcacctggatgcccagagtaaaggttgtactgcccacatttcattgtagctaggtgtgcctgcgtgaccaagtatgaaccttctatttagattaagccacaagataagtggagctatcaattggctttaacaaatatttagtgaataggtaaaataaaatactttatataagagctgtgtgttctgggttgaattgtgtcccccacaaaaagatatattaaagtcgtaacccttagtacctcagaatgtgaccttatttggaaagagggtctttgcagatataattaatttcaggtgaggttataccggagtagggtgggctcctaatccaatatgatgagtgtcctcagaagaaggcagtcaggcacatgtaccctaaaacttaaagtagaataaaaaataaataaataaataaataaataaaaaagaaggcagtcaggtgaagacacagacacacagtgggaaccccctatgaagatgaagatagaagcaatgtatctacaagccagggaccgcctgcggctgcaagaagccaggtgagacacatggagctgattctccctcacagcccttagaaggaacgtgccctgctgacaccttggttttggacttccagtctccagaaccatgggataataaatacatttctgttgtttgaagccacccaatttgtggtactttattatagcagccctaggaaaccaatatactatgcttttgatattatttttaggatgttgtggtttgaatatttgtgtctcccccaaattcctatgttgaaacctagtctctgatgcgatagtattaagaggtggggcctttaggaggtgcatgagggcagagcccttatgatgggattagtgttcctagaaaagagacttgagggagcttgtttgccccttccagtatgtgaggatacagcaagaaagtgccatctatgaggcagagagtgagccctcactatacactgaatctgctggcaccttgatcttagacttcccagcctccagaatggaaagaaatttctgttgtttataaattactgagtctaaggtattttgttgtagcagccccaacaaactaagacatggagtattttaaaaaatgggttgaacattcagaggcttcttaatctgagtccttagatatttggactgactctgccttctttttccagtgaaaagatctcgctgtatgaaacatagacattcttcattgccccaaagcccttccaccttccttatgtttttattgctggtttgatgtgcttgaatgctagccaaagtataaggtgaatggtagatgcaaggactgggcggtttccatggagacttcttgcaggagcctttcctttctcagttcaacagttgtcaaggaaacatctagtttcaattaaataaatgtttgtggggtctgccaatttgagtgtctcttggaaggggatttggttaaacttcttaaacatcgtaataaacaaattcagagcagaggctttttaggttcccttccagttatattaggtttttctgtaacttagggatgttaactagtcctctgtctgaagtgatcagactatttattcatatccagaaaatattatttttgagtcttgtggggaggaaaactgaggcttaaagaaagagaggccaaagccagggagctggtgttacatggcaccagctatatatacatgactatagtccatgctctttagtacgtcctgcaggataagagatccaaggggcctgacctttacaaactgtttacaggctatggagtttgctggctcagcactgtgtgtttattgcttctagttagctattgttgtatcagtggctggagttggtgatggttcacggaaatagtggtgagagtacagattctaggtatatgcaattctaataaatgagacttccctagtgttatctgtattgtgacagcctccccattgtgctctttatcaaacagtaaggtatggtatattgcaaaatgctcacaatactttgcaactcttcccatcaagaggtagagtcagtttctctattcttaggatcttggctgtcctgttgatttggtctgaccctggaatacagtagaaaagaccctgtgtgggttttgatcctaggcgtgaggtagagcttcagtttcttgctgctttgggaactctgccaccttgtaaaaaaagccctggctggcctcctggaggaagagagactatgtggaggaaaatgaaggtacccagacaacccaatagtcaactgcagaagcataagtgaccctcatctgagatcaatggtgcctggctcggatcagtataattgtccagctgaactcagcccaaattactgacccccagagttatgaattaaataaatgctgttgctttaaggcacttaagttttggggtggtgtgttatacagtagtagataattgatacagccaagtttggaagctctggaatgatcagggctcacctttgacctgtcctctataaaacccaggattcttagtaacacagtcctgttaataacagaacttgcctatggcaaatctaagcggaaaagcagtttattggcaggatattgtgtagctacatctttctttaggaagaccagggacaaggcttgaaaactgcacaactagggggcagtactgccagaactacagccagataacctcacagaattggtagctactgaatattggatgcctccacctacaccaccaacattgcctgcattggacattgggtatggggctgctcctggaactggatgttgttcctgtcactagaaaacaatcatctactgttcttgctgtttcacagcactcattactgattcagatgcccgtgtgccacgtgtttatagcagtgcaatttgtaattgcaaaaatagggaaccagcccaaatgcccatcaatcgagtggataaagaaaatatatcaaaaatatattttatatgtgtgtgtgtatgtatatgtgtgtatatatgtgtgtatgtatatgtgtgtatatatacacacacgtacatatatatacatatatatacacacacgtacatatatatacacacacgtacatatatatgcacacacacatatatatacacacacgtaacatttataatacgccatggaatactactcagccataaaaaggaatgaaataatagcatttgcaacaacgtggatggagttggagaccattattctaagtgaagtgactcaggaatggaaaaccgaacgttgtattttctcacttataagtgggagctaagctatgaggatgcaaaggcataagaatgaaacagtggactttggggcctcagagggaagggtgggaggtgagggataaaagactacacattgggtacagtgtacactgctcggctgatgagtacctcaaaatctcagaaatcagcactgaagaacttaactcatgtaaccaaataccatctgttcccccaaagctatttaaataataataaaaacaaaaacaaatgcctgtgtgggtggtgtctggcagagcgtaggtcttgtgcccataccctgattgaaaagaaatcaggaaagtgagaatctgacacttttagcttatttagctgaaagcaggtggaaaatttcataaacactggcaaagggttcggataacaggcagccaaaagaaaaatggcaaatgttcattagtttctgttgtatactctggttagctcagttggttacagcacagttatgatgaagccagcattgtggtttgttcttaagttttattgaaagaaaatagttctgagattgtcccccttacacctgctccctctctcacagatgtgtgctgatagccatttgtaaggccaggcaatagtggggcctaacttgcatctgtctctggctgctaaggtacaaagattatgtgtctttcagttggtgggcccagagactccattcactggcatagtgtgccacataagagaactgaatgaatggtatctgtgtgaatctaaggggttggctaattgcgcagtgaatttggttcatgtaacatttataatacaaattgttgggcagcaagatctttcaatccagacggtttctagtttttcagaatttctctgataacttctctgaactctgaaattcttatttgcaaaaccatctatatagggttcatttaaatattagaaatagtactcataaagagaaaagcataatgcctagaggatgtgtaatagatgttcaataaatgttgatcatttccctcaaacttcttagattcacacaccccaaccagattagaaactctgacacggcttgccctttttgtgttcaattctctctcagttgttaagtgaagacccaatccagttgttaaaataataaatgcacctcttgcctccctgacattctggcaaccttactctgaggaggctggcccggttcgaagctggctgctccagggcactaaagctggagaagggcccttccaccctgttcataactgtggacagtaaactgtatttgggatagaggatcttgggaacaataaggacctagatccaagctcatgcattgtggtgggactgtcaatttagggggatgggtagattttatcagatctgtcagtggaaagtttggggagatggaatagtatctacaggtagttccaggtaggaggaagagatctacctggctcctagggatgtccatcctggcaagcattgctcagtggcaggagttgtaagagtagggaaggtttaggaatttggatatcagggaagtgtcagcaggtagctggggatgaggtgcaggacaaagacagacgagaggaagaccaagccttaaagtgatgagtatctagatagggaagaggatggatgggtatagcttggacacagaaaggggattcagtcatggaaagaggtcagtctgcaatgtaatgtggctatcaggtcacaggagggccaagagcaggacaggtttggggcttggttctggttagtcgaggcagagccccttagaggtgtttggatttgccatggtgatgcaggggacctgagtgtgctggttgtcatgagatcttgttgctgggagaacagtcaagaacagggtagaaaggcccttccccagctttagtgtgccttggagcaggcagctttgaatagggccagcttcttcagagagagctgccagaatgtcagagaggcgagaggtgcatttgttattttaacaattggattgggtcttcactgggagctctacaaagaaaccaaattagtgaagttagattgcctatcccaccaacaatggatgtttatggtatgagtttagctctgtgctagagaatctcaatatatttagatttgggcttgagagagagaacttcagtgtgatctgagactgaacttccattcacattcattcctcgaggaagcatgttgaggatctatgtgtaatatactggtgttccatttacttgaaatatcctggcttgctctattcctctcacttaggcactcactcctctaaaaaataaatgtgtatatgtgtatgtgcatgtgtgtgtacatgtaggtgtaagtgtgcataaaatatggaatagactgaaatcaacaaacttataaaaataccaaataacctcaatctgtaattttatttttgagaagcactaaaaatgtcaataaatgaattgtctgaaaaactaatcctttggctggtgagataagtctgagttgccagaaccagttaaagctttatataatttggcagtacatttgcgttcacctgagatttctctgcctccagctgtacaaaaattctgtgatatgcagagcctcgaaacctgggccagaatgctaaaactaattttctttcgtaatctgagccgtaattgcattttaactcagttctagtgtgaagactgcttttgtatgtgtgtgtgtttacttcatgtcattaatttctggcatttaagttagtgcctggcacatagtctaccctcagtaaatgttagttcttactgccgagtctactgttctttccttctaaaccagtggggtagatgcttcctttgtgcctcagtggttcattcccttgccctcttcccctctcctcacccttgagttgttagatcctggttttgccccaggcaggtgccaaccccgaggaactcctgaccctgtggtgatgcatgcctgcatgtgtgcagccagctgggcagcttggaaagccatagtattgacttgccaaataaggactagtttacaaaagtcataagagatcactgtcatcaactgctatcactatctattatcctttctctttccaaaacacaatttaggtgcataataaaaacatctgtagaattactctgtcaagcctatgtatgcccatcagttgtgcaagagcctcagttcctacttctaatgaattttatactgattatcccagacctttctgccagctccctaatagcagaggagagaatacactgttggagtcaggggcaaccaaagcagctagtctgagtatagaatttctttgaattctcatctttaagaaccatgctcagctgggcacagtggttcatgactgtaatcctagcacttcgggaggccaaggtgggaggatagtaatggcctggtgtggtggctcatttccataatcccagcactttgggaggccaaggtaagcagattgctggagtccaggagttcaagaccagcctgggcaacacagggagaccccccatctctacaaaaaaacaaaaaagtagccaggtgtgatggcacttgcctgtagtcccagctatttgcagagggctgaggcgggaggatcacttgagcctgggaggttgaggctgcaatgagctgtgattgtgccactgctctgtagcctcgaggacagcgtgaccctgtctaaaaaaaaatggatgatatatccacatgattcagaattgaagaggtacaaaacaataaccaataaactctttctccccactgtgtcctagccaccttgttttcttccctggaggcatccagaagccaattttgttagtttcaacttctggagatggcttatgaaaatataagtaaatgcatctatattcaaccccattttagaagaaatgatacctactatatcagctgctttctgtgcaccttgctttttttctttttcacactttagcatgatgatttttctgtattggcacataaagagcttcttctttgttagttggtggttcttatggcagacaactgaatccaccctagatggttaagccaaaaagggattcggattttaggtaactcatggaatcctttggagggctggaggaacaggctagcatccgggtgcccagaaacaaagccccaagacacacgtagtactagcattaagtggaagccacctgtgctgctgcctccactgaacagcagatgctaggtatttgacttgactgcaactgcctctacctccactcctgcaccgggaaggcaacctagcagtgacacctgcaaaagtagaagctctgagcagagcctctttccttacatttctcacttctaaagcaaaatctggtgtggatgtatctgattagtggtgactaggtgacacatttgcatcttagcttcaatagagtctaggaattttattctcaacttttaaacttggaggtgggacttgtaataggtgaaatttttgcaaatagagaaataattttcaaagtatgatggacagtcacagatatggcaaatgtccactagagctgcttagaattccattgtatggatcaaccacaattgattaaactaatatcttagatggtagacctctaagtgttttctagttttctagtctgtgacttaggcaatactgtattaatgaccatatacatgtgtcattttgctaatgtaaaatggaatataaatttctagcagtggaattgctagatcaaaaggtaaattgtaattcttgtggatattgccaaatggtttctggatgctatactgattttttgcttccactagtgatgttcctgattttttttttttttttttttttttgcacagagtcttttccttttttagattccttctgagccagagtggcaggctgagtgttccctgctactggggtgagttttgggccttgggccaagaatgctgacaaatcagatctgggccataacctatgccaatatagactgtatttagcatctggactggatttggcttatagtttattgtagtccttctagccctaaattaaatggcatcttggggtatctaaaagataatgttgcttccaaaattgatttgcaatgtgggagtagcttacatcttggattgttatgtgttcacaaatgcataaagatgttttcaaagaatggttctaaagaattataataccttttctttttaaaaaagcaaaatcttggccgggcacggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaaatcttatttctagtgtgtgaactattgcatagattttgccaatatctgaactatggcatccaattgctctggttggttgccatgaaagtttatagtaacataggaagctcctgtttgaaagctcctgaaaaatttaaacaaatgtatataaatgggtgaaaaatgggggctgaggaagaaggtgaatacatgtgttttcttctcatggaagtgttcactattttttattaaattttttttagagacagggtctcactatgtttctcaggctggtctcggactcctgggcccaagtgatcctcttgtctcagccttccaagtagctgggactacaggcacgggcctccacatctggctgtgtttgcagtctttaagttggcatttacctagtgcagttgattatttcaagaaaatacactttctacatggctactgagggtatctgaaaggatataaagtatagcccagggaagtagcatgttgttaggcaggggttagtaactctttctggaaagggtcagttggtattttaggctttgcaggccaagaaacagaatcaaagatattacataggtaattctataacaagagaaaaaataaacttctacaagctttttattgacaaaattcaaaacataataactgaggacttttttttttggtaatacaggtctactcataagaagaacagcattcttactttggggataacattttgcttaatgggattcaaagaatagtgttccctttcatcaaatcgattgcaaatgttcatctgtaaataccatttattttctccttgtgggccatagaaaaccaagcagtgggctggatttgacccatgagcggtagttttccaaccactgatgtaatggaaagaccatgagctttggacctggatgcatgtaggtttgagtactggctctgaatttgtgaccttgaacatatcacttaactttctgaattgggaaggtttatttgtgtataaactgagtgtaatgacacctatctcatggaaaaaatattacccccatctttgtgattttgcattagtattctagttctgtagatgctgatatgatttagctagacttacctagaaaattagtatttaactgattttaaagctgacttttcaagggatagaacactcacatggtcttaaagtacaatgtaaaaacatagctttgcaatgaagagatctggcagtcaccacattaatcaaatgaccaagctttgcaatcagtaccaatggtgggatgttctgacattgtgtgcccctcactgctgtgtacctctcactatatctcagtatcacctgtgtggtgttcttgccagaaacttttgactttaatgtaatcacaataaaacagacaaatccaaaacatgggatgttctgaggacaactggcctggattcttaaatgattcagtgtcattaagaaccaagggggattgttctagattagggggagactaagggaaaatgagataaaaatgcagtgcatgaacattgactaaatcctggatgaggaaaagaaaattcagctctgtaggcattttctggataatcaagggaatgtgaatgtggaccatatgttgtatgttagtccattttcacgctgctgataaaggcatatccgagactgggaagaaaaagaggtttaattggacttacagttccacatgcctggggaagcctcagaatcatggcaggaggcaaaaggcacttcttacatggtggtggcaggagaaaaatgaggaagaagcaaaggcagaaacgcctgataaacccaccagatctcatgagacttgttcaccatcacaagaatagcatgggaaagaccgatccccgtgattcaattacctccccctaattgttcaagtccctcccacacacgtgggaattctgggagatacaattcaagttgagatttgggtgaggacacagccaaaccatatcatgttgtatgataatattgtgttaaagttgatttccttgggtgtggtgatgatggtgcggtggtgtacgaaaatatccctgttcttagaaggtgaatagtaaagtacttaggggtggtgtgtcatgaggtgtgtctgtaacccacttttcagatggtttggcaaaatgggagggaaggagggagggagagagagaatgtgtgtgagtttgtgtgtatgtagaataggtgattctgtgcattgctgctcagttcttagcatagcactcagcacattgcttttgatagggaggtgcccaaccaaaacttgttaaactaacaagtactttaaggttttagtaggattctctgaaatcacacctcagcactgcctgtctgccctctctttagcagtgtcatttggcttaggcatatactataatgcctaatgttgggtaatcagatatgggggttcatgttttcttgagtagctcacccatgtccctctggactgaaagtctctcttgaatgttacagtataaatgaatgggaaaggaaaacccagcatagaggttgacctgcgtgttcagctgttccctgagaggctgaggtacaatttgtaagcatgtacttcagattctcttctgtatttctgttgctgagtttgcccacttggggagggttgacacctcctggggctgtgctgagtaggaggtgcatctctggagttctgactggctggagcatcactgaggtattctcctgggctatgagggctagggccaggataaagaatggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatatagcaggcatagtaaagtatgagtcctgggggatacaaataataagaatataccctcgctttctgctgggcacttagggcatagggaaaggagatgggctacagtggagataattatcaaaataccaattgtgctgtgttgcaaggctagggatgtgttagaaagctagtaaaaagtgttatgggaatgcagagaacatgccatgtggaattgactacagtttcaaagataaggttggtcttgaggtgacttgaagaatgagcctggcaggcaaagaaatgggcatctggtgtgactaaagtcttaattagctgtagggtggggaggagagagacatgacgatgttggaaaggtagtttgggccagacaggagggcctcagaagccatgcttggtttcacaggaagggcgtgaagagtcccagaagccctttgaagttggagggtgatgtggttttgataagaggtcacggagggaatgtagaagctggtgtgtgaaggtgtgtgagtctggagacaggacttgaaacagtcgaggcgagagcaaagaatctggattttgctagctgcagcagagggagagtagaaaatggggtgctcttggagaattcttccagcccctcctactaggagtttttacattttcaaatctttctaaggaaacctttaataatacttgagagaagcttatttaaacctttgaacagttctgaaaatgtattacatttcagccaggaaagaaagtattatttcaggcaaactggaacatggttactcagcacagtcgcctaatcttatagaattaggtaggagggaagctatgttagtggccttcaaccttcttccagaactttgttcagatttctcccaaatggtcggtgaatttttctgatttgtatccagcatcccagccatttagtgtacatccgtaagctgtaaggaagttgatttaatctatttctttttttcatctcttgccttccacctgagaaaacactactccataggttcttattctgtattaggaatttgcacaatgtgtaacctaagatggatccagctgggagttggatccagctgggagtgttacaggtttggagtttagactaaagaagaggagtggaatcttttcatttttttcccctttattttgaggaaagcccagtgatttggattgtttgaaggatcaattatatcaaatatctccactaattgagtatctgggataaactttttttttcaccttattttctttagataccattaagcatttcgacccacaacttacagcttttccatggagattttaaacttagaaaactttgaaccttgatgaatgaaaaaaacctttcagaactaacctttttttttttttttttgattcagaagtccatgtgtaagttccaaaggcttataattcttttctcttccttgaggcttgactatttcagaacgttcttggtatgtctcttggaggtttggtgtacaaagagcaaggaaagtaacctatgggcttaactcacttatgtgtatatattctactttggctccaaagcaatgattctagtggtgatatgggaccaagggacagatttcaaggtaaataaggctgtttactaatgtcagattaaggtattagtcttcaagtaccataaatgttttactagcaatttcagttacctgtagtaaagagctttccagttccatgtggtagttatggtaaaggagcaactgaaagttaacttgatagtagattaacactcactgaaaatatagttgttattttttcacataccaaggattacaatgtctttttttttttctatttttaaaatagagacagggtcttgctatgttgcccatagtcttgaactcttggcctcaagcgatcttccttgaggcctcccaaagtgctgaggttataggcatgagccattgtgcccggcctacaatttcttaatattaggagttattttgcaagacaactatctcaatgttggaactacactaatgttggtgtgtttttttccttgtgtgggatagtctgtatcttaagatgtgtaatgtatatattcacaataagggctacattataaaattcagagacattttatttttgaggtaggtttcattcacttaattgagaatttgttgactgtatcttgggtgcctatccttatgctaggagatgaatggaagttgccccctgccattgaagagaagacattttaatgggaggcagagataaacagataattaattataatgtgatacatttggaaatagtcacaaaaaacttgaatatggagattttcaaaagtacaaagaataggatattgaaccctcatgaacccactaccaaacttcaacaattactaactcttggttatgcttgtttcacccatgtgccccacctcctcccttcccccttttattttgaagcaagtctaagacactgtatcatgtgatggacattaatagatacttggatagagtactctgagaatacactgggaaaacatactgtatcgggacagggaaaggagctacagaaaagtaacatttgagttcaatctaggtggggaggaggatgttgttccaggtgatgggatggaaactgacaattattacaatgtcttgaaaaatgtgtatatacaacttttttgttcctctgaactgagcacccaagatgtaatttccaagattaggaaattgttttgcctgaggactttataaaaataattaattcacttttaatttagataaactagaataatccatgagtagtggtaatgactaatctgttctcttttcaccccagtgactttctagactttgaacattagaatccactccctgaaaaagtcactctcctttgtaactagagcaacagctatcctttgtcacctttatttttctctttggaagaggaggaataatcagtggctcacttctgaaacatcatgaataggtagaatttagtaatctgaattaaaaacctccctgtaaactgaaggaagaggaaattgaccagtgggcacacagaggttctcaagggacttttttggttagccactaggtgaaatccttgatatttcatcatgtaccttgtctcattttcctgttgtgaaattgggtgttcagcattgtttttcttgtctgttctcagatcacagaactgtgtggtgcaaagcgggttggttattttggtccaacacagttttacattgccctgaaattaattgctgcagcacaatctggcctcccggtacggatagagagtattaaatgtggtgagtatctcacatttgtatgttttattgtccatggcgagtcgctcatttatgagaaccatttttaatgagtttaaacttttgtggaatttctccttgcttcctccaactcttctgcaaaataaaataagaaaacttggcaggtaggtagcttagtttctttcttttttaaatggggaaaattctgagagtaacctgagattagttcattttaactgatttgcagttaaaatagattttattctttagcaggaagagattgggccaggaattctagagcctgtggcaaataatcacattgactttaattttccacttgaggtatctataatgttattgaaggctctgttagaggagtaacaagggagtttgagtggaactatgccttttctctttcccatacctgccagtgctcagcctttaattcttagtttccaaagcactgttctgatgctagtaagtacttgggtgctaccaaaattttggcagaatgaatttatcttcttaaggttctgatttaatattttctcatcttgccatccctgccctcaacccactgtatgcttgagcactttctacaatttaaacaaaaagcaaaacccccaactattagcagtatttctgctgcctcaggattggttttaaaaatctgtatgaaaaaggtgattattcaaggggtgtgccaaggtcctctgataattcagtttgatacagattactttcatatgtccatacaggtatgtaggaactttttttctttttctcattctgagactaaaaacctcttaactgctcatgcctgtcctgtgaagtctctgatagacatacaagtggattcaggatttatggtgagcccatggaaacctcgtaggacaatccaaatggccgagaagattgccatagatggctggctgtggaagaccaagcccttcacactaaccgttagcaggtggcagtcatcatgctaatctttatcagggggctagcttgtgccagacactttcatttaatcctcatgacaccctactaaattaggtacttgtgtcagtttgattgcttaggataagctgcgataacaaatgtcacaatctcagtgcctcaaccagacagaggttcgttttccactttgcagtgggtcagggtgaccctccagggcagctgccctctatgtggtgaccatgtgatcctggctgctttatcttgtggcacctcccaacacaacacctgttcccataatcgccacaccagggaaagagtatctcaccctagcggttaaatgctttggcccagacatgactgaagttattgctgcccacactgcattggccagaacttgtcacattaatctgcttcagtgcagagcaggtgggagaacacaattctctcctgtgcctgcaaggagaggacaactgcgagtctctactatggctgcacactgcaagtctctactatggttatggctgcacactgcaggtctctactatggtgctgccgttgttcgtatcttacaagtatggaaatttgaactttagggaggttgagtaacttacctaagaatataaggttagtagaatttggagccaggatctacttccagtccccatgctcttaatttctatgcaaaatagccttgtctcaattttttctatttagtaagatgctgacagtaatctgttatacaatattttctgaatgggaaaaatattggacttgaaaggcatctcttggtatgacagaattttgttctttgaaataggtttcttgatggagtgtcatttgacaggcaggcttagtattcattgctgcaagacacagcggccatttgctttgattagttgaaagttgcatcacactgaatttggatttgtggtaggcactgatagtttttattccattgtaaatgatcattaagctttattatagtatcttccaattttatcttctggaaaagttagagctgctttattgtatacagaataaacttttgacacttttgttacttattttaagttagacctaagtcttttacctgatttgtgcccagattgacagtttaatttcctgagggcagggagcaggattgttgaagttatcacttgtgtaaaggattaacagtttatcacaaatataaggctttctcagttttattttataaacccagttgctgccttttacctctgagagtttatatatgtccagagttaattctgaattatcttccttcaccactctctactaatccatttaaagattgattaaataaaattatttgcagttagcatatgttgaataagaattagggcaagattgggccaaactttgagctgccacttagaattttccagtttgttgcttgaaatctattagcttaatgcttgatgacacaaatcttgaaggccaaagggatcactctgtgagaacctaatctgaaaggctgtgctagccctgtcacacccagggcatcatacccagggagttgtggatggatacccttatgtcatgaataacatgcacctgtgtgtatgtgcgtgaccctctaatccctagtccttcccatttcggtaaatgccaccaccatcctcagctgcacaagccagaaactcagcagccatcctggattcctccttttccctcactccttaatagaatccatcaaaagtcctagcaatgtggctccaatctcactccctgttgcctctatctctttgtccctgctagaccagacaaccttcatctacttacctggacaccacaatggattgacatcctagcccctcctctcttctctactgtgatctctcttttcccactggttttttgtttgtttgttttttgacagagactcgctctgtcacccaggctggagtgcagtggcacgatcacagctcactgcagccttgacttcctgggtgcaagggatcctccaacctcagcgccccgagtagctgggactacaggcatgcgccaccactccctactaatcctactaatttttgtattttttgtagagatggggttttgccatgttgcccaggctggtcttgaactactgagctcaagtgattggcctgcctcagcagcctcccaactttttttttttgagacagggcctcactctgtcacccaggctggagtgcagtggtgtgatcacggcttgttacagcctctgcttcccaggctcaaatgatcttcctgcgtagctgagactacaggcatacatcaccatgcctggctagtatatatgtctttttgtagagatgggggtcttgttatgtttcccaggctggtctcaaactgctgagctcaagtgactctcctgtgtcagcctcccaaagtgctgggattataggaatgagccaccatacccagcctcttttcctacttttgaaagtgtgatcttttcaaaatacacagcagattattccatcctcatcctttaaaccctccagtagtctgcttgttgtactttgtaaaacattcaaagtccctacactgatctgtaacaccctacacaatctagttcttgcctacttttccatcctcatctcaaatcttaaacccttgctcactacctgttccccagtctcagtggccttctagccatttctgggtgacttttcctgctgcaggccatatgtccattttatcttgcagtcttgggttcctagggatctgtttttcctttctgcttcccctggttggctccttcccaaccttcaggattcagagtctgtccctactatcctacctaaagtagttctgtcagattcattaattcatgaaggaaccagcatatggtaaaactggctcaagaaagtatagagagtcagatttatttatagtcatagaaagaaaggatgctggaatagaattgctaaattaggtataaagctaattaacgccctacggggtaatacaagtgcagcctggctattgtacttttttctaagatgaaagtatttgcattgccgtcagacaagaattacttgttagctaacagttttttccaagttaatatctaccctttcaggattatcaaatgcccaaccaagagtaaacagtaactcagagcagaagtccatatccctaggaagtgaggtgatccttgggtgggcctgctgggtaatgcttctgcagggcaatctcctccccactttgttctttcccagcatctgtttcctgatagcacttagcagagtttgcaaatattccttacaggtttcactattttttttgtctgtcttcctcacttgtccagtttgtgtaagggggagggaagaggatctgacaccccttgcattgtggggcattataggcactctgtgtgtattggttgaatgaatgaatgaagaggtgcatgtctacgcatgaggagggtgtcttaatcatctgccactctttaatctaaaacgattggaattcagattctcctggaactccagaggagtttttacagaagtcatctcagtctgcatatcatctttcttaggcactgattttcaaccttgtcggcacttgagaaccacctggagagctttaaatataaaataaaaaaatacagatgcctgggtccatctccagaaattctaatttcatatatctgcagtccggtctgagcatcagaatttttaacagctctccaggtgatttttgtatggagacatgtttaagaataaaagctgcatcaagcatttttaagagctttgcttaaactgtgtgtgtgtgtgtgtgtgtgtgtgtgtgtgtgtgtgtgtgtagttacagtagctgcatctgaactagggtgctgtacgacacagggcacatgatttaagggggcacttactctcagggcaagtgccgactctacatttacaccaccctgagagtgcgtgcctccttaaatgttggcactaggtatctctctagccccaccctcgtctgagttggggttaaacagatggcaaaacagctagggcagaaggaaagaaggtgaaaattaaggactggtagagaatttctgatgaggaaatcatgtggtgaacatttgccctgggacctgctgttacctttctttccagggtctgaagttgagcacgtgtgaggactgagggaaggttaggcagaacctagagtagggtttctcatcatttttgtgccaggagcccctttggcagtctgaagcctgtgggccctttctcagaattatgttttaaatgcaacaaagacataagattataatggaaaccaattatactgaaataatcactaaaatagttaaattgttatataacaacatacatgcttctaggcctggcacagtttctcatgcctgtaatcccagcactttgggaggccgaggtgggcggatcacttgaggccaggagttcgggaccagcccggcaaatgtggtgaaaccttgtctctactaagttcgagaccagcctggccagcatggtgaaaccttgtctctactaaaaatacaaaaattagccgggtgtagtggcacatgcctgtaatccctgctactcaggaggctgaggcaggagactagcttaaacccaggaggtggaggttgcagtgagtcgagattgtgccactgcactccagcctgggcaacagagtgagactatatctcaaaaaaaaaaaaaaaaaccaacccccaaaacatatatgcttctttattaatgcattaaataaagcatctaacagtgtttgaaataaccactactttttcaaattagtaatatgcataaacagtacttcaagatgttggcccggcatggtggctcatgcctgtaatcctagcactttgggaggccgaggagggtggatcacgaggtcaagagattgagaccatcctggccaacatggtgaaaccccgtctctactaaaatagaaaaaaattagctgggcgtggtgacacacacctgtagtcccagctactcaggaggctgaggcaggagaatcacttgaacccgggaggcggaggttgcagtgagccaagatcacgccattgcactctagcctgggcgacagagcgagatgccatctcaaaacaacaacaacaacaacaacaacaacaacaacaaacaaaaccctaatgtgataggtgacaaagttaccggtattgctagtgataatacagtggcttgttgcctacattcataatggaaagaaatgctaaatttcagttatagtagggaaaatgaagttgtaatttttttttttttcctaatcaaggtgacagaccccgtgatttcttttcactagtccctttgggagcctgtgaactctgatggtgcaatgacatgattcatgtagtctttggggctgtgttccccaaactggtttatggtctggttgcagtctggcacagtttagaattaggacaaaaggatgagttatttataaagctaaatgtattcaaatctaagattgggttttttttggttcctcttgttaagtgtcctttgtgaaactgctaatgggtaatagtttggggtaaaattcttgacgagataaaacattggcaactttatgttggctttcttcatttctttttttgttgttgttgggggagagatttttcctattttgtgaaatccccaaatttgtgagccactgttgtggtcacgattctactgccaagaagatactgaggcaaatcattgaattccctttgactcctcccttatctgcaaaacagttgttctccacctaggtgatttcgtccctttagggactttcggcaaggtgaggagacatttttggttgtcccagctgcggaaggggactgcctggcatctagccggtagaggccagggatgctgctcaacaccctacactgcagaggacaggaccccctcttccaacaacaacaaacttatctaatctaaaatgccagtaatgttgagactgagaaagccttctgtaaaataaggatcaagacttaggaactctaatcctgctgccttgcttcctgtgctctagttagtttttttgtttttttaatcatacaagaaaggtagaaggattttgcagcattgagtcctatttctgtggcttttgttttcaaagaagaattattttattcaaggaaaaataaaagcagttattctctggttgaattgagggtggggttccctgtgctttgcctatttgacaaaccctccctatctcttagggctaggagagaaatcttttgagtgtgacaaccagtttggtaattcatagaaaagacaggataggaagcccaagggtaaagaaagaagcccaggaggtaaggttgtagctggctctgtgtgtgtgtgtgtgtgtgtgtgtgtgtgtgtgtgtgtgtccacacagtgtctctgtattttgaacactaaatactatgttgggatgtctcattaagctaaggtcaactcatcctttctgactgacgtccaacccaatccccctttccttttttttcctcagtgttcctttgtcaatttcctttaccccctctcccagccctgctacagggacacagagctgctttggacaaagttcgcctatgcaggttcactgactgtacggctggacatttgtgttttctaggggtctgtccctctaccccatagcgctgtcattagctctattgttgctcctccccaaaggttctccccaaccttttgagctgtggattttcaccttatttgtaaaaatctttgttgtgggattctttgacaatctagtaaaagctctggatcttagcaggaaaatacacattgacattatgtaaaaaatgttgccttcaatgtcaggggtttctggacccctagagctggttcatggagcccagtgaagagcccttcttccagagaaatgcagtgtatgggatggatatagaggaggtaagttggaagatgcatagtggggaaattgaaggccaaagaggtaaaataaaagggatgctgcttgctagcagcagagcccagtggattgtggacctcctaactcactcctggggttctacccgtggtatggccaggaaattgaacttatccaccatcctcctctgccaaacatttacaagatcacccttcccattgtaacctccaccccgccatctagcgattacctacccatttcctaattgacaagaggtatttcagatcaatgggcagataggaggataataggagactagatagctttgattactcaggcctgggttgataagactggcctgatttttttttttgttttgttttttgttttcccccaaagtaacttcaggaaaatgtgtagggatggtttcactttggaattatagaacattattgtcataattctttgttaacgtataagtagctggtataagtgaataggtaacaaaaagcagtgggagagaagggagccagcagtcaggagtcaagaatttttgttacggtcttagctctgccactgtattgctgcatgactaaggcaagtcttgctctctctttcctgggcttatttcctcacctgcaaaatgcagacatttgagcaggttttctctagattattttctgaaatgccacagtttcatgctaaatgttcaaatctgtactagaaagaattttaatgttcaggatggtagtatagccttgtggctgggaatgtaggtcctagcaataggctacctcattatgaatctttccttcattaccttttatttgtgtggcctccggccagtttcttaatttctctgtttcaaatgactccctggaggaaaaggtataccaataacacctgccttatagacttgttgtaagcacaaaatcagggaatcccttatcaaacattgtagaaaagcatctacaactttgttatttaatatcgtagccacttgccatgtgtggctattgagcacttgaagtgtggcagtgtggctagtgtgactgagaaactgaatttttcattaaatgatttaaataaaaggttttaaacagtgtaaaatattttctgttaaatgcaaccttattgatttagtaggaccacttttcacttcaaccatcaaattctgtaagacaagggtcaacaacctttttctttttttttcttcttttttaaattttattttattattattatactttaagttttagggtacatgtgcacaacgtgcaggtttgttacatatgtatacatgtgccatgttggtgtgctgcacccattaactcgtcatttaacattaggtatttctcctaacactatccctccccccttcccccaccccacaacagtccccggtgtgtgatgttccccttcctgtgtccatgtgttctcattgttcaattcccacctatgagtgagaacatgcggtgtttggttttttgtccttgcaatagtttgcggagaatgatggtttccagcttcatccatgtccctacaaaggacatgaactcatcattttttatggctgcatagtattccatggtgtatatgtgccacattttcttaatccagtctatcattgtgggacatttgggttggttccaagtctttgctattgtgaatagtgccgcaataaacacacatgtgcatgtgtctttatagcagcatgatttataatcctttgggtatatacccagtaatgggatggctgggtcaaatggtatttctagttctagatccctgaggaatcgccacactgacttccacaatgattgaactagtttacagtcccaccaacagtgtaaaagtgttcctgtttctccacatcctctccagcatctgttgtttcctgactttttgatgatcgccattctaactggtgtgagatggtgtctctctgtggttttgatttgcatttctctgatggccagtgatgatgagcattttttcatgtgttttttgactgcgtaaatgtcttcttttgagaagtgtctgttcatatccttcgcccactttaaagggtcagatagactttgtgggcagtatgattttggtcacaactactcaaccctgttgtagtatgaaagtagccatggacagcatgtaatcagaggatcatggctgtgtgctaataaaactttatttatgaacactgaaatttgaatttttaattttttttattttttatttttgagacagagtctcactcttgtcacccaggctggagtgctgcagaggcacgatctcagctcactgccacctccaccttctgtgttcaagctattctcctgcttcagcctcctgagtagctgggactacaggcctgtgccaccacgcctggctaatttttgtattttagtagagatggggtttcaccatgttggtcaggctagtctcaaactcctgacctcgaatgatccacccatcttggtctcccaaagtgctgggattacaggtgtgagccactatgcctggcctgacatttgaatttaatataattttcacatcatgaaatatttttcttttttctttttttttttttttttttttgcaaatattcaaacattgtgcttgcgggatgtacagaaataggcagcagactggatttggttcttaggtatacacccaagataaataaattcatgtccatcaaaaaacatttataagaatttcacagcagctttatttacaatgggcccacactggaaacaacccaaatgtttatcacaggataatggattaaaattttcaatatattcttttagggtcttgctctgtcacctagactggagtgtaatggtgctgtttcagttcactgtaacctccaccttccaagctcaagccatcctcccacctcagcctcctgagtagctgggactataggtgtacaccaccatgcctggctaatttttgtattttttgtagagatggggttttgccatgttgcccacactggtctcgaacttctgagctcaagaaatctacctacctcggcctcccaaagtgctgggatcacaggtgtgagctactgctcctggctcaatatattcttaaaagtggattgctccatagcaatgaaaaagaatgaactatgtgtacaatacattgggtgattatcacagacaaaaaggtcgtaaaaaaagcttgtcacaagaacaaatactgtatgattcaatgtatgaagttccataatggcaaagataatctgcaagtatagaaattagtacagaggttgctcggtggaacaaagggaggggattactggaaatgaacatgaaggaaaattctgtatcttaatttgggaatttgggtgttggttacagggatatatatatatatatatgtatttgtcaaaattcttcaagtggaacacttacaattccctataaatcatcccaccatacagaatactctttacataatttaaaaagaaatcaattagttgcttacatttaacattgtaataataataaaatacagtaaaatacagatttctggccacaatggctcacattcccatgtagcaactatcaactagagctgtgctgtttcagtatggtagccagtagctgcatgtggctgttgagcacataaaatgtgacaagcacaaattgaggtatgcaaggagggtaaaatatacatgggagtttgaaggcttaatatgaaaaaaaatgtaaaatatttcattaatagtttttaatgttgattacatgttgaaatgataatattgggttaaattagattattaaaattttgccattaaaaatgttttgaaatggaaaatttttaattgtgataaaatacaaataacatttcccatcttaaccattttaaatgtataattcagtaatgtgtaaatatagtcacattgttgggtaactagtttctagaaccttttcacctcaccttacaaaatggaaactctgtattcattaaacaccttcccattttctttttcctacccagatcctggcaactgcctttttttttttttttttttttttgagtgcagtgacgtgatcatggcttactgctacctctgcctcccaggctcaagagattcttgtgcctcagcctcccgagtagctgggattacaggcgcatgcaccactacacccagctaatttttgtatttttagtagagatggggttttgtcatgttggccaggctagtcttgaactcctggcctcaagtgatctgcccacctcagcctcccaaagtgctgggattacaagtgtgagccactgcacctggcctgcccatctactttctggttctatgagtttggctactcttgatgcctcatataagtgaaaccacacagtacctgtctttttgtgaccagcttgtttcacttctttctttctttctttttttttttttttaatgtggctcacattcttttttggcagataacattgaaagactgtgaacagctgctgccattttgatggaacatgagttctctgcccagcaccctccactccatattgtctagctaatgaggctcaatgtcacttgccatttattattgcatttatgctgtttacattttttctaatggattgaggaaattgaggtatttttttttcttttttgagtgacagggtttcactgtcacccaggctggagtgcagtggcatgatgcagccttgaactctcagactcaagcgatcttcctgcctcagcctcctgagtagctgggactacaggcatatgccaccatgcccagctgattttttatttttatttttttaagagaaggggtcttactgtgttgtccaggctggtctcaaactgctgggctcaagtgatcctcccacctcggcctcccaaagtgctgggattacaggcatgagccaccactcccagcctaaagtattcctaatatatctgtatctctatcaaatatggaaaaacaaaggatttttctctcttgtagagggtcaagtgtttaaaaaggagcaggcataattttctttgtggaagggaaaaatagtcatttatgtttaatatacaaagcatttctgtgttcaaagaatgtaacctaagatgaaacaacaatgaagcaaattgtcatcttggatggccactctcattgtctcctcagaccctctaaacatttagtgtgaactcttactttgtttgctgtgtgtaattcaattcagtttgggagacaagattctaaccaatgactacaaatagaccttcttcttgacagacatcattgtatagcaggtactttattgattaattttttcaaagtttcactattaaattttgtgtatgtgtgactaggaaaaacattcagttgagtatggtgactcatgcctgtaatcccagcactttaggaggccaagacgggaggatcgcttgagctcaggaatttgagacctgtctgggcaatatagcaagaccccatctttacgaaaaataaaaaaagaaattagccagcatggtggcaagcacctggagtcccagctacttgggaggctgaggcaggaggatcagttgagtctgggagttcaaggctgcaatgagctatgttagtgccactgcacttcagtctgagagacagaccttgtctcaaaaaaacaaaaaccaaaaaaaacattcagactgaaaatttacaaactacttttacctttcactttttaaaagcttgcatcagtttaagggaaatggcaccttcatgaaagttttccatgataagaatattattatgtatggttatacttctgttaagtgagagttgcttggaaccacctgaccaaagaaagtatgagagaacttcagctgtattttgtcttttgctgtttggtggctgtctgggggagagaggtggttttctaggcacatagctctaaagaaatgccatagacagggtggaagaatgtgtgaagtgacaatgtcctagacaatatctgggagccctacttaagtcctaatataataattgatattcataattcagttagtgtattccattgttccttggaggtatctgttgaatgccagtaaggcactggtcagggagcttataaatactgagcatttatttcttttctccctcaagaagtacttggaagtagagtcatcctcttatgggtagatcagggtgcaaattattttatgtgatcttgtttcatctttttagatcctttttcctgactgagctggagcacatacctgagaccaaaaccatagagttagcttatatttgatttactaagaatctagagtttcttttctcttgcttttttgcttttgaagcccattcctgctttgagtgctggagagctgcccgagattgggaaacattaagattggttactctatttatgtctcttgggcccttggctgattgatcacacagggatttgtcatattgcctgcttcttttttttttttctggtacagaattttgctcttgttgcccaggctggagtgcaatggcatgatcttggctcactgcaacctccgcctcctgggtttaagcaattctcctgcctcagcctcctgagtagctgggattacaggcgcctgacgccacgcctggctaatttttggtatttttgtgtagagacggggttttaccatgttggccaggttagtttcgaactcctgacctcaggaggtccacccgcctccgcctcccaaagtgctggaattataggcgtaagtgagccactgcgcccggccgcctgctgctttgaatcaaatgtgaacatagcaactaaaagtaaacatcatgtggatgttagagaaccaggggccttctttgcctggggaactctaggatacttgcttgctgttgctaagatgttttctggccttagcacagcatcagtcattgaaagtgcagctgtgtttttggaatagagagctgatggaagtgcaaaggcacactgatgagtattatcctgaacaatggatacagatgcaaatcattatgcataatccataatgtccccatttttgtagggttttgtgctacgtgattgtgtgtgatttgatgtgctgagaactagaagtgtgccaaagtatcatttccgctttcagaatagttttgttagaattttgaaagatgagtaaatataccagaccgttgcttttcaactctttgtagcattttgagtggctaatggttttgacagaagaatgtggctgaatgatagattgattgctctgacttgatattgttttccttattccattatgaaaagacaaccagagattggatgtgaaaattccttaaagaattacataggatgagaaactgttctacccactaagtttgccataggaacaagggaccattctgtagagcactggtaaagtaccagcttgcctgcattcaaaccgtggctctgccacagatgagttgtgtgatcctggggacattacttagctcctttatgactgtttctacttttgcaatgagggggtggtaatgatagttttatcatacagagttgttgtgaggattaaatgagttaatatttgcaaatctttaatactgtgcctggcatatttaagcattatatgaattttacctgccaccatttgtcacttattattgtattatacagtgtcatatcctttttcttggttattgaaggatgaaatgggagatcagtcccaaatctgaatttattctgcgatttggcaacattgaaaaatgttaagccagaatactttggttaaaccatagcattttaaaaatcaggacgttattataggagtactcattgtatctaaatctaaatttatatttagtgctctggaatttttcctcaaaaatgattcatcgtttggccattgagttccccttttttgcagtttttaaattaagtctgactagagcttctctgatttctggtcccaaagaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggtaaacagtttgttcagatgtgttcatttgattctgaccatgaaaccgcatgtagcagggcctcgtatctactgttcagcttccagcaaatctcaccatctggaacccaattacagacttggaagtgagccagtaaagttttctcctagcaagaaagagagaccgacacatatgaatcaccaccacccacttaagggccctttagagcctactttaaagtagaattgtgtctaaaataaggctaccgatttaatacatttattgatttcactagctcagtggttttctaaatggattcttggaaatgtaacttccaggagtttttaataggttctcttctccaaaaagaagtctgtagaaaaggtttctcctattataataaatgtgtttggagaatgctgcttcatattcccttgttgagggaaggactaaatcctcagtcttggaaattcgtagtgcacattagcacggtaaaagccctgagaagttctgcagtgaagagacctggaaatgtgtgtttactaaacttctttcaccaggaaattctttcttggggaacatatttggaatactatcttgggaaatgctgccattacccatttagcaggtttggaaccagaacagggaggataggcttttaaaattagaccactaattgcaatggtcagatgatgattggtggagacaacagtataaaatctcagaagagtgggcagatccagaagaagtaaatagtctacacattggtgtaccctgcaggcatcaaggtatagctcatacttccagcaaagatactgaatcatgcagagaagtcaaattatgttcaacatagtgtcttctataaggtaaagaaatttattataggaacacttgaggctgggcacggtggctcacgcctgtaatcccagcactttgggaggccaaggcgggtggatcacaagaggtcaggagttcaagagcagcctggccaacatggcaaaaccctgtctctactagaaatacaaaaattagccgggcgtggtggcatgtgcctgtagtcccagctacttggaaggctgaggcaggagaatggcttgaatccgggaggcggagattgcagtgagccgagatcacatcactgcactccagcctgggccacagagcaagactgtgtctcaaaaaaaaaaaaaaaggaacactcgaatgaaaatgtttttaaaatgcaatgaatattaaatgattatgttggaaaactaacttctgtgacttaccctgtgatgttgtgtagatgaggtgttgctacagaagttttatatggatagttaggggaggtgtagcacatcctgttaaacaattccatgtactgtcactttcataattctgacacattttaaatcagttcttcagggatatatttaaaaaggaagaggtataggaattttcagtcaatattctttggcatattttcccaccagcatttggagaggaatgagggtccactgtcccacggtggttgatgccctgggaaatttccaggcccagtccctgattgtgtgaatgagaatacatcctttcacttcaggctgagtttatgcatgccccacccaatctatgggtgtgagctcatgctttagagcaaacatattttgctttttcttgaagaagagtatttgatcagtatttcagattacatatttctctttagactaagggagcctatatatatagtctgtgtgttgatagaaagcattgttttggctgggtgtagtggctcatgcctgtaatcccagcagttggggaggccgaagcaggaggattgcttgagcccaagaattcaagaccagcctgggcaacatagcaagacctcatttcaaaaaaaaaaaaaaaaaattagctgtgtgtggtggcgcatgcctgtagtagctactgggggtgctgaggtgggaggattgcttgagcccaggaagtcaaggctgcagtgagctatgatcacgccactgtgccccagcctgggtgacagagcgagaccctgtctcaaacaaacaaacaaacaaaaaaaagcactgttttcttggtacttgaatactccaaagttaccagtctactagtaaagttttttttttttttttttttttttaaagaggaaactcagcagcagataaggttgcttactttgcctagggttctacatcaggttcatatttgaattgagattcaaattgtagcttgttaagatttcatcttagtgtttgggagtaagctggttggaatggtttacctataatgaattgttttgcagtctctcattgttaaaaaaaaaaagctagcattttactttgacatggtaagctccaagaatattaagtattaagcatttagaaatatatattttaatattcacatttgctggaagacttgataagtataaatccaggaaataaatttattaatgaatgaaaatgaaatctatccacagagagatcacaattgggagcgggtatgaatgttatttcatgtgatcagtgtctttcattttccaaaggaaaatattattggaataaccaaaagtgtttcaggctggttttagtaatttaggtaactcagcactgatgagattttattctctgggagactttttgaatcctcagacactgctgtttaaccatgctgcatttttgagaaaacatttccccccatttgttaaaccagctgggtcaccagcagtagagttgcgttatgcttcctgactgcagctcagaacgccaggcttgagtgagcgcctctgaactctgatctggttctttgaagcaggaaacacagtctcccacgatgtcacccctcgcctcccctccttcttccccgcctcattaccagagggtgcccttgagccatggctacagcaaactgcggagcagcgcagaacagatgcatccaggtaagaggcgacctgggggccagctgtcccaggcagtgtcttagagactccttaatttaccaggcggtaacgcttcaagctgcttaatttcctgatttaattacccctgtctttggaaacatggctcaatttaattttatattctcaagcaaggtttttttttaaaaattgatttaaacatatttgagtaatgtttcatctcctgtcctagaaactagttcgtctttagacttgtaaacagctagatgatttaatctttcatatacagattttattgaatagaacataccatattaagggcttgtattttttttggaattgttattcctttctgtaagcacaccaaagatatttatatagtaactgctttaatgaaatttcttaagaaatataactgcaaaagcaaaagagttgatccaacctttgaagactgagcacgtaaatgaaaatatataggtcctgtgctttggaataaggataaaggaaatgctaggggtagcattttgctgaggggtatgtagcatgcacagttgtggggttgccttcttgctcacatttatgctctgctggcctcgttaggtggtaaaatacgttagttctgaggatgacttgcagagttggctgtttaggctgcagtgcctaaagcactggaaattcactgcagcatcttgtgcctcctggggttcagactcctagtttaagatatgaccaattaaaggtattctagaactggatatctgtaaacccccacccccccagttttgttttgtgggctgtggccccaaatgacccagtttctgcaggtttttactgcattaaaaatagtggtgacttttagagggacacagaaataaaactgcgcgctaggctgaataaagagaggctgtaatcttgcagagagaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatgtgagtataaaatctgtttggaaattaagtcctatgcacatgcaagatgatgttgctaatggatagtaacaaaaaaatcactgtcctgtaacttgaatatctcagtggggttagaaactaaatggagttgagaattcttcattttcctcttatagtttccctgatctgatttccctattttcaggagtgggttttttttttttttttcctatttctaatcttacttgggtttggaagttggtttttaattcacaggtgaaactttttgttctactgagtcagcctgtcagcaagttctacctttggtattccttagaaaacttttctgttcctcctccttaatgccccattccctcctcattccatacaaattgggcttccatttccccagtggtaaggaagcagcttgcttctctccatctttcttgactctcagcagcctgtgccaaagctgtccatgccttcatttcttttcatacttttttaaaagtgaggtaaaatatacatatgataaaatgtacccgttttatttgttcatttttgagacaggttctcactttgtcactcaggctggagtgcactggcgcgatcatggctcactgtagccttgatctcctaggtttaggtgatcctcccacctcagcctcctgagttggtgggattacagacatgtgccaccacaccgggctaattttctttttgtatttttttgtagagatgggatttcgccatgttgcccaggctggtctcgaacccctggactcaagcgatccgctctccttgtcctcccaaagtactgggattacaggtgtgagccacaatgcctggccatgcacatgttttaaatcttcaatttgagttttagcaaatggataggcccttgtagctaccactttgatcagtaattgaacatatccattatgccagagatgaccctctccggtcactccctgccccctaacgcaatcactgttctgattttcatcaccatcattagttttgcttcttctagaacttcatatgaatgaaaacacacagaatgactgactgtactcatatgtgtttgccatctttccttcagcataatggttgaaatttatctgtattgttgtatcagtagttcattcctttttattatttagtagtgggatatattgtgtgaatgcatcacagttcgacgatctgttctcctggtgctggacatttgagttgtttccagtgtttggctattatgaataaggatactatgaacattcatgtatgagtccttctgtgacatatgctgtcatttccctggctcctaggaatagagtcactcagttttagggtagttgtatatgaaactgccaaagagttctggtttgacactgaacttcagagtgatgaaatctttaggtttttttttttttttttttttttgtacacctccccttggagaaagatggtacttccagttcttattaaacctcttgtaaggggatcaaagaattatttgttttgcactgtattgcatgtttggggtttcatttgggaagaaagagagttgagtaatagctactttttaaccttctgaattcagatccaattaaggaaggagccagaagtcagacaattgatggcctgaatatcagctttattactgatatagctgatcagagcacatgtcttagatttgtgaccagatgggctttagacactcacctttccagtcacaggcaggcttggccatcccagatttcccacacaagtaggaagagaaaatctgcctctccaaaaaaggccccccatgcagctgagtcttcatccaagccctactgatgagataggtctgtctcttccaagggaaggcccttgtaggtgagggatagaagccaagggccagatggtggcctgttcccccatgtgtctcccctggaagtagaagtagaagctcttatgggaagcagaggcacgtgggattcacttcctaaggaaagctcatgactgctagcaccccaaccatgccacagttcactgtgtttcaaaccttttggcagagcgcaattggtattagtgatttaattcagtgctccatcaacacagaatgattttaaaaatcctacttctcagaagacaatggtggcctaccagctgagacttactttttaaaatttggattatgtgctctctatgtatgtatgttttgcagtttttatatctgtattcattcttagcaggttctgaaaatctacttgatgggttgccaggcaattgttttgctattttaatgtgtgttaatgtattgtaacattgtgttccagttactaggaagaaatacaaaaagcagatgtgagcccaagagtgatttatcattcttgatgtgctattgttgtaccttctttattttaaaaagagcaaactatgttaaacatgaggtcataacaggctgctctgctctctacctaattttatttgtaagtaagctacagaaataaaacattttacttatttatatattttcaaaaacttgaactattaacctatagagatgagaaagaatttcaacttgggtgataatttctgctttctgttggagctgcatactacctggttatgtttaactgtctccctgccatattggtaaggtcattattaagtcttctggaaataaaaggagtgaaaacatacattcatttttgtggcttaaaaagttattttaaaggcagcaaaattgttttttaaaagtttggttattgaatagtagaataataaatataaaatatatttattcattttcgtagtcttctctacatgattttacattctgtttgatttatttttcaaaaataatgttggttcttagtgttcaaaatgcacattagttttcttcttggggaagtggatgatcaatggaagacatttacttaggggggatatatagaatttacctcatatttagaatttgaacacttatgacacttttctagctattgttgctttctatcccaattgaagttctcactgttccaccttcacaatttattcctaatcataacccagtgtaaatatttttctgcttatcatgaattggttgaatgtctttagattgtttagtgaaattgtgccaaagagaatcaggggttgtcagtcctagatggccctatgagtattctgttgccagttctttcctgaaaagcagatgctgtatcagtttgaatgtgaagtcataatttttgaatggaatctttgcataccatactgactttcctttctgctgtttcagcaccttatgaagctaggcagccccttgtccagcccgagggatcctcatcagggggcccaggaaccaagccccttcggcatcaggcttcccttatccgggtaagtgatgatgcagggttatgccaatgggacagtagagtcaagctttgggcttcggggacatggctttttgatggaccctttttcattgcaaggaagatataaaactgatccttcatgcaaatattgcatgtcttgtttggttgcttgtataaattactaaatcttttctactgtgtatgtctctacgccttctcagtgtctctagaataaactaggctgcttcttgatctttagtatatctaaaatgtccctctgccttcacctatctaatcattagccaccactttcaggagagcttcactttttctaaagcagcccatcttgtctctgccttattctttattattactcatttaatgcatagttaactgttttccatttgttttgtgcctctaattacatggtaaacttttggaaggcagaagtagttctgtattctctctcagtgcctagaccaagagaacagttattgtacaatggcagcagctgctgtttccttatgtaataaatacaaaagaaatattatggcaaaagcttctggctataccacagcttagacaatttcagcttccctttctgcagtgttttcctttggataaagagctcttattttgttctctgtctgcagctgttgccttgtgtagtgtctctgggtcctgtgctggggaagttatattctcaaagaagggtgtgtgtgtgtgtgtgtgtgtgtgtgtgcacgcgcgggtgtgcaggtttactatttgacactaaagaggaagtggggcagtttgtataacatttcagtcatctaactcgggaataaggaacatttttgcacaggcacttctactcagaatagaagggtggtgtcagacactcccataaagatgtgggctgctaggttggaataggataaacaaagtctaaagaaggtcctggggttcatggaataccttctggggatggggcactgtgttagatgtggtgcagaacttgattttctaaggtgggactctgtgtacaaataatttcttaaagataataatttagccataggctattttttatatttaatgcttcctacaaccataagatctagttactgctgcttctaatagtataagtgagttgactgtggttgagagaggtcaaatagctggtttaaggtttcattcataactagtcagtgacagagccagaatttgaatccaggcctgtccaatgtcaaaacctgctcctttcattactttgtcctacattagagtcccatattacaagaaggctaggttctagagttgctacataaagaaacgttgggtgtagtaaaaaatactcttgaaaaatcccttattgataccacactggagaaccaatatgccatttgctcccagggccagtacagctcagttttatccccaagttggaaaacacatttgtttcttcagctgagctccagatgtagtagttggctgtgtttagagatcctgtggtacaaaaatatgtgcctttaaacacgagaatcacacccactgtggagtgaggtttacgttagaaaaggtatcagtaggactgggatttatccctaagctctccaaaatgtggctgtgtaggttcctacagagtgtgtcctgggaatacagaggccagatcctgaatggttaggatgatagtcaaactaccagtgcatactgagctttacagcagtgtgactgggctcactagaccctttctacctagcccctggctggcatgggcatggatgctcatttggattggcaccctgtggcttctcttctaatctccatgttcccttttctgctgacaaacatgcttcatgagcccttcactcaactaatatttagtgaacacctattaagtgccaggcactgtgttgagaatacaaaaatgaggtataacactaacagtttctgccctcatggagctactggagagatggtcattaaccaaaccaccacaaagtaaatgtataattatgatatgggatatcagtaggaattacactgtactttaaggatgaaaatgggcatggggtatgacctagccttgaggggcaggggctgatcaaagaaggcttctggtgggggagcaacattcgagttggaataagggtacatgggtgttatccaggtgacagggtgggagtgcgggagcaaggtgacaagatggagggaaccgcatatacaaagacatttcctatgggtttgccattttatgaacattatctctttcagtgcccacagctatcttatgaaataattagtgttgttatcccattttcagatgtcagaacctgaggtttagagaccttatttaatttgcccaagttcacagctaggaagtggcagggctggagttcaaacactggtcaaggttcctcagtctctggctcaggaaccagatagatggtggtgtcacctgttgagctaggaagccctagatgaaatactggcactggggaaagatcacaggttcagtgtttgatgtcaggaactgaggttttgagatagtccagagaagctgttgaagaactggtagattacatgggtctggagcttgggagagagcttaggctggacataggtatttggcagcaattggctatcagaaggtctcatggtatagtgcagaaaaaaccagacaggtgctcgcccaagtccagcaaaactctgtgtgaccttgggcaagttccttctcttttctgtaatacaaatgacttcgaatggatttaacagcccattgtaacaatcagcaacagtccgattctcttaatgtgtctgtggttttcatggctggtgtgtttttctttcctctgttcttaggtttccttcttatgcctgttaacttggtttggctggactccgtgttccagaaagcaaaatgccaacctggattagtcatgtagatgaggggatttgaagtgaaggttcttggtgataagggattaatgtttactgggcatggtgctaggcctaggctggggtgactaatccccctcatgttgtcacgttgatgtgccgatggcaaccttctttctcttctaactagttctctggccttgtattcaagttcttcctgcctgattacaagggggcatgtcctctgggtcctgggggaagcctttagggactcccagccagtgctgttgcaacccatggtgttggcattttagaggtgcttatgccaatccagtgcctaaacattggaatgatttgtctttttgcttactattttaggaatttcacttttgttcgggtgttggatttttttccctttgaaatttcagacactaagcatatcctatgttggtagatgattgatagtgctttgtaaagaaattataagacttattttctgcttcatctgttatcatatgtttagatgttgttttgtggtttgtttttcacaaattaccctcaacatctagatgatgtagtcatttgtaattttgctggcaaaagatttagaattgcacgctttattcctactgttctcagctgcctctgtttttgccagggtcatgagaaactttatgttaagccgttgtctttattgtctccttggcagctgtggacactgaccatcttctcgaaatgctctcatcatttggtgtccattatgcctgctctcctggttttcctcatgcttctatggctgcccctgcctcatttgtttcaatcctccttcctctgccctccccttgttatgctggagactgctgggcctacttctcactctacttactctttagatgtgtggatgctcatgaccacatagcaccatctgccagacatcttcactctaatgttccactgtcactttcagctgacatgtctttctcataaaatcagctttcactcttccactcctagctccacccacccatcagcacaggccagaatgctggtcattgtctttgacttctctttctctccttatgcctgttcagtccccaagtcctgaccataccacttttcaaatagcttgtgtctgtccatgcctctgtacttcttcgttcaggccattatccttttcactgattgtattgtattagcctctctcttgtttcttcttgcttccacccttgccttcttccaattcattattctcattgcacacaaaaacaatcttaaaaacacaaatctaatcatcctgctgacttgattgaagcctgtccctctctgcccatggctcttaacatgtcatccatgttgctgtctggccctcgcctacctcctcggccacagcagctcactgccgctttccctccactctctggccatttcccggatggtcagtgttctctgcgtgggagccttactcttcaccctcacttttgccttctttgttttctcctttgtctcaattcatctatgcttttttccccattaagaacgtgaaacgtaagtgttttctgatattttcttgtatatgcgatgtttcctttttttttcattcttaaaaagaaaaagatctattgcttgtcagctcatttatgtgtgcaactcagccagagggatgggcgtctgatcattattggtttcccatctcagaggcaaccagggttgcctgtttcttttgtatcattctaggaacattttacgcatgtacatgcaaatataggtattcatatatattaatatgtgtgtgtatgcactatatgtatttatatatttatttatttttttagacggagttttgctcttgttgcccaggctggagtacaatggcaccatcttggctcactgcaacctccacctcctgggtccaagcgattctcctgcctcagcctcccgagtagctgggattacaggcattctccaccatgcccagctaattttgtatttttattagagacggggtttctccatgttggtcaggctggtcttgaactcctgacctcaggtgatctgcccgcctcggactcccaaagtggtgcaatatatttttacctgaatttagggagacatgtttggcaaatgaatatattcttccagctagattgcactagaaaaaattatcttttatttaaaaccaaaacacattcacttttcaaaccctcaggatactgttgtgatgttttctttgctttttggagggatgaaagtaacagttttctagaacatattctcaacactcactactcttcttcagagatgaaaaaatgacaaacagaatttagatacctctattactctaccattcctcagggggcttagctatatttttggtgtaagttttctaatgatcaggtaggggaggggatgttaggcattgttagccagcaccatattcatctcgaagtgcataacttgaaaaatgtttatttaacttagttatctcctttcctcctcatctcagtttcttgccgtacctcctcccctagatataactgcaggtacttacggccagaagcaggtgatctccactccttgggtcctcttggaacccaagagaaaaggcaagtatatgaaagatgattaaagaaatgaatattcctgaggctctgtcagagtggtgttggcctgagtcaaaagataattgatagtcaccacaaataaattgttcattctaagagctttgatgaaaacagcaggaaatagcctttgggggaggctgatattgcaccgagagatcttcttgtggcatgaaagatattttatgggtagactggaccaggatgcaagcaggataaggagagcggaggagtgagaatgactgatggtttgggatgggattgagtgaggtgggttagagttgagtcatgagagagttggtcatctgagtttggaagaagagtgaagcaggtaaacaagcggggcatactgggtactgtcttggctactctggttgtctaacctaatactcagcccagggaattgacccacagagcaggtcaggcccgcccggattcttttggggttcaagaattatttaccaaggcattacttggtaagtaagtgttcatacgaacgtgtgtgagctctcaaacacacttgttcttcagagcaaatacagattttaaaaatatgtcaaacattcaacagatacaaaagggcacagtgaaaactgtccctaccatttccccgcacagccactcatcccaggggcaactgatatgacccatttattttgtatagtactatacaaaacatttatataatattgtatatgaatatcttttttatatacaagtgaaaataggtattatatataattacatgtaatatatgcaaaacacagttatgcttttttacacatatggtggcatactatacatctaacatgcatttagcactaacaataagctttattaacgttctatagcagcacataaagtacttcctcatctttttgttttttacagatgcatagtatttccttgtctgcgtcttgtgtaaatcatttagccagccccttttgattgacatcttgtacttgcaatcactgcgttgtttgcagatatatgggagaccaattcctagaaattgaattattgggtgaaaatgcctatatatttgtaatttttgataacgactttcaaattggaggtatagcagcctatgtacttgccaacaatatatgaaaatgtctgttttctcgtacctttgtgaaaacaatgtgctaacaaatttatgggtctttgccaatctgataggtgaaaaatgatagctcactgtagtttaattagcatatctctttattagtgaagtgaaatatcttaagtttatgagtcacttgtatttccttttctgtgaactgttgattcatatcaagtgcccctttttcttttgagtattggtttgtcattcttaatggcatgaaaccagaagctggtctgtcttttcctttggaccagagatatactggagtgtgtgtggaagatttctccctgagtggtgagaggagatgctggcacctgaggctctcgaaggaggttatggaccccagctgcttcccagttctggagaaccccaggcctgcctgcagtgcagatttcttgtttataaggtcatgacagtaaagttgaattacttagtttatgggtagagattagggctaaaaaaaaatcctctgttgttagagatggtaaatgtcaacactgtgtgtgtgcgttgatctctcagcattgcttagacagctaaattatgttcctttcactgaaatgggtgggaggaggagatagaggtagagataaagatagatagagggagagagtataagtgtgtgtgtgtgtgtgtgttaggaagagtgagtttgatgccttttctaggtatgtatgtgccttattcttgagatcttctttcaccaaattcattcctcgtttcatttgagaccccagctggacgtttataccatctcctaaggggtcaaaggttaacatgtcctccaggtgtcctacttcactgagtctactatagaacccacatatacctgaacggacactattgccacaaggaggtcctattttttcatagcctccagtctcctgcttacttattttcttcacctgcttgtagttctctttctgattttctagcccttaacttttgaggaaggatttctagctcttaacttttggggaaggaaacatttaatctcaactgatactgaagtttattttctcagtgccaatcttttctacttgtttcttttttcttttttccttttcttttcattgattgattgattgattgattgagatggagtctcgctctgttgcccaggctggagtgcagtggcgcgatcttggctgactacaacctctgcctcccaggctccagcaattctcctgcctcagcttcctgagtagctgggactacaggcgtgcgccactgcgcctggctattttttgtatatatttcttttagtagagacggggtttcaccatgttggccagggtggtcttgaactcctgacctcaagtgattcacccgccttggcctcccaaagtactaggattacaggcgtgagccaccatgcccggcctctacctgtttcttagtgtattcctcaggtgctcactgtgtaccacacttcttgacaataaaagagatgtttagttaatttagcctcccagaggtagctgaaaacactggtttgaactgctggttccaggcagtactttgtaaatctggaaaggatagtagcttattccccaggaccttttggtctcagttatatgccaggctatggatatggaagacttctttacaactggcaccattttagcccctgggcccatcagtctttcccttgatctcaggcgagcagggagtgtcatgcccccccagttgcctatcccaacaatagtcactactgactgaggtgcttctttggtcccagtgctgtgctggcccttttcagtcctcccaacaatctcacaaggtaggtattattacatcttccatttgtccatttggaaatacttaagtggcttccatgagtcagccaccatgccaggggtacactgaggagtacacctatagcctcttgctctctaggtgcttgcagtcaaaaggaggagatagatttgaatcaaatgatcccacctatgcatgtggaattaaaaactgacaattgccctaaaggccttaaaacatggtaccatgtagcaaaggaatccagcctatagctagaaagtgagagaaggctcctttaacaaagtatgtgttgagctgagctgtgaaggatgaatagaagttaaccaggctaaggaaggatggtcctgggaggtgaggagaggagtggagtgtttcctgtagaggtaagagcctctccaaaaccgcacagcagagctgggctgctgagagagctttgcttctgtcacaatcagaaagctacagcattgggaaactgctgccctagtgtcagctccaaccagatccacactacaaactaccttggcagccaaatgaaagctttgttccctgcctgtaacttgggtctgcatccgtcttccgtgggtgtatttgttgagtggaacctaagtcctatttggaattctagcagcaaaggtgttttgacagtggagtttttagctagccagcttgtgcagtgctgggacttatgctgacgggtggaatggactcgtgacccagtctctaccatatttcacagggagagcagatacatttgaagaactgaaagaaggcagctgtggctagagcctggagtgggagggagatgaggtcggagagggaggcagggccctgtgggctatgtgactgccttgcaggtgggagctgatggctcagaagttaatttactggttagtaagtgaccatgccaaattggaacccaagtctgtctgcctctggaacctgtactctttttgcacctccagtcagtagcctcattctccaaagcattcttgaattctgtccaagttgtggatgcatctgtttcccatctgaactcagactgccttgagtgtgaaggggagaacgtagtgaagagacaggcagccttggcctgaccagcaaggacaggggtgggaacgtcatcgcttcgttaatggaagtctgcagccttgtcagagtctcctcttactgctgatttctcatttttcttggctttctcctctaagcagagcacaaaatcctgataatagtgaaggaaaagtgcccttctggaacagcaaatcttggcccctgaggggagaattggaggcagtggttactaatgagcatttcttatgttaatcaaaatactgttagcgccacatactgcaatcacagtaaaatgattacatacctggattgtatggctagctctaggattcttttgtgatgacgtgccagatgcttacctgcaaaaattatgtgagaaataaaatggtgctctgtcagtatgatttaatagttcgccagccaaaatctaaaactaaactagatgatggggaggaaggtgtaatacagcatagtcatagctcaagcacagatcctcaatctgcaaaattgcagcaatgatttaggcattgcagtgaggttctttttgtaataaatgctctatttttacaggatggatgaacagatagagataactatagagcttgatgatcaagtgtacgtactttggacccagtttgtattctggctctaccatgtgccataggtgtgtggtcttggtaaattacttcccttacctaatcctcagtttcctgttctgcaaaatgggaattaccggatttacctcgcagggttgtgaagatgaaaattgattgtgtgcattaggtacttacagtgcctggcacttagcaaagcaatgaatgcttgttacctgacattcttctgtgtctaagtgatcgtttcaaaaagtatagcttattgtaataagcagcaactgtgtgttgcacattaggctcagagagattcctacagtttggcagtcagccttctgaactattgaaattagatccctaagtaagttaggtaatatgtggttaaaggcatctttgtgggtttatttccctgaagaaacagataaggttaaatttctctgttgggacttaattttaactaacttctctacagaaaaaccaaattatttattgcaacttcctgtgaatctataattattttgaaataaagactagaaagaaggagttttttaaaaagttctctgacttcagaggtaagggagagggctcagcctttatagtgttggatgacattatgtgataaatgcatataaagttcagcttcagtcagcttaagagaactcaggttaacctttctctgtctctagactgggattgagaattttttcgaatgtttgtttgtttactcattcagcaaataacttattgagtgttttgtatgtgttagtgacttttccaggcatttgggatatagcagtgatcaggatagacaaaattttctgtcctcctgggttttatgggatagcatggggtagggtgagaggcagagcataaacaagattgatcaagcataatttggaatcgtttcatgttaaaacaaaattgctaagctctgtctccttttctaggtccttttcttcatttctcattgaacactttccccacaattttacttgagctgtcttttctttttaactgggaatctccttcaaatccatggaagatgaacctatattactcaaacacagaaagactactataaaaatgaatcagcatcctggtcctatagattgtctgcatagataatcaaattagaatgagaaagttgtttgggctcataatggtctaatgtcattggtcagattgcaaaaccacaatagcttcaggcttccatctccaggatgggctttgtggttgtgaagggcagatcttcctttcctttgggtcttgcttgaaggatacattcattgagggaacagctgctataacaaataggccccacattttaatgactttgcacagtaggtatatttctcactaatataatagtttggcaggccgctgtcctcagcatggtgattcatgcaccagagctccttctgtcctgtcactgtgccatcgtctgttcagtgggcacataggaaagagagtagaggagtgctacagggtactagtcctgcttggaagtagggtaggccactggtgctcacattgcaatggctacaactcagtcacatggctgcatgtaacttcaagggaggctggaaaatgtcatttctggttgggcagccacttagtgacacctctacaccaggcatagtagagcatgaattattggaggagtctgctgtaatcccacctatcagcactgccaccacttgcttctgtgacttttttttctcagccccatgactgaccaatttccttgatctttctttagacaaattgatattcacttgggctatagtgtagtctcaccagcccattagctatccttttctttacagtagtcaagtcttctcacatctttgctaatgagatcgttttgatcagcaattgccttgtggtagtcttatttccaaaatatttttggcggaggaggcatcctcagatattcactgtgggcttagtatgagcttttgctactccaaatagtttgtttactaaggcactaacaggacactgttaaaagatcattacccctcataggtgaaatggctggactctaaaacagcatttataggatgccttcggggtaggtttatattttaaacagaaatgttctatgattgaaacaatacacacacccttcttaagttctctccaacaatgcttccttgcaattcatattatttagctttgtttgatttttaagatagtttgatagtaggggtaaatgttaccttttgggattttattaatagtattactttttaatgagtcttttgaagtctttcattataaacagcctgctttccccagagataataacttgccatgccaaatatttgcatttcacttgaaacaaaaccaaggggttgaatgttttaaatataagcaaatctaattctcctgtgtctagagaaactgtataatgaaccatatgtatgtggcttaagcagacagatgtgaaagatttctccctctctccttttatttaaaaaacaaaacactggcagagctcaaaattggcaccaagtagcaaacatctctgctcagccaacaaaaccactggagctggagttgatggggggaggcctctttagggtgcatgcaaaagtggagcttttcctggtcctggcttctacttggaaagctaaggctccacagcttatttgccctcatttctcagtgccttcaggcttcaaaatgagccattctcaggtgactgacttttcagatctttgagaagattgttgtggttgattgttggactggttcagaagacatgggtccacgcatctgggtcctgcggtgacatggcctctagctgctgacagagtggtgctgagctaccaaacagactcataggcttcctttcacaaagaacatcatagggcagtgtttccacatctcttgcaatacaagacatacctctgaacttcctcaagcttgccaataagtagagctcacactaccttttagtatctgtgatgtacctgccagggactataggtgggataaagtatctgatatggctcctgtccttcacattgaaacctgggtgaagatgtttaggaacactttaaatgttcaaactgtggtacttaccatgactatcataaagattcatatatatttttttgagacagggtcttgctctatcacccaggctggggttcagtggtacgatcatggctcactgcagccttgacctcctgcgctcaggtgactctcgcacctcagcctcctgagtagctggaactacaagtgcatgccaccatgcttggcagtttttaaatattttttgtagagatggggatttgccatgttgcccaggctggtctcaaactcctagagtcaagtggtctgcctgccttggcctcccaaagtgctgagattatgggtatgagccaacatgcccagccaagattcatattttttaagacgctcaaatcacttggcttagtaaatcaatttcaagcatacagcgagaagcaaggggaaagagatgggggggtaggttagcacacttagtgcaaaccagtagaagggccactctatgggttacacagaactcatgtgccctctccctttgtcctaaggcctttctaggtttaggagtaggaactctccttgcccacttaagttttcttggaagaggggttgggttctcatgggaatctaagaaatgagagccaaggaatggcccactggtctgtaggggtgggagttcttggctgttcatgcttgttctactgttaacaggccttgccctggttgtgttaagtttgctccactgtccacttatctttaggcttctgcagcctttcttgcccccccccccggctttgtgtcctttctgtacctacctcccagcttgtgctgatgcttggttctggcgccctcataactttaagtcccacctaccctttctctatactacagccccactgagcatctgtttagggtctactttctcttctcattggccttgatatttctcatccacattcccaagaatgagcatctgacctaagcccttgtcagagcatctcaaaggccagtatactgtgtgcccatgaacccttactcccactcaggtgacgccaggtgtgaggtgggtcatggtgcccacacaaggctgccaggcccacctttgcagcagagcatgggaacgagcagtgccgtctgtcatggccgtgggtacggcaggtacattggaggatttgagcaggggaagagtgttctgggaagaagacaaacatcttacccctgaggagtgagcatgtgcagtcggaaagcctgctgagaggaggctggggtgcgaggcttctgaaggccaggtggaggaggtggacttttctgttaggcagcaggtcatctctgcaggcttttaagcagaggagttaatcacccccttctgttcattcctgatttctgttgttagagtagacctgagacctgcctgctaagaggccactaatgccacgctggagtgaggtgatgtcaagaggagctagaaagcagatggttatggcattgaggaaagagcacacatgggctgacagggacagctaagcagcagcttcatgagcaggagggaaagggcgtgttctaggggagcagcagcttccatgtcagactcaggaatgcagcagacccaacatccagcttggagatttcttctctttttcttttttttcaatggaactgtattttcgcaaaatgttacagatcacttatagcaaacagaatggtgatggtcaaggaaactgactctgggctcctttttgaccgcagcagctatgtggaagcagctgcagctgtgataagggccgcccagcatggatatttctgtgtcttcgttcactgggaagtggagggacagagcttccgacccacatcccaccttcttcacgaatcatctttgccaccaaatcgttggctcataggtgtctgttcttgtctttcctgcccatgcctggcttttaggttcctttgctccagctctttctgtcagggctgacctggagggcagtgctcctgtgagttctccacattatatcatggccggtaatctaatccaattcaagctgacattctccaccctatgttctaccaatggaacctggtcagacatctgggctcattcaggaagtgctgctagggcatggctctggaatttggtgggagtattttggaaggttgtgtggtctgtttggttgtttagtgctcggactggattttgattttttttgctttacttatttttactgagacggagtttcgctcttgttgcccaggctggagtgcaatggcgcgatctcggctcgctgcaacgtccacctcccaggttcaagtgattctcctgcctcagcctcccgagtagctgggattacaggcgcctgccaccacacctggctaattttttgtatttttttagtagagacggggtttcaccatgttggctaggttggtcttgaactcctgacctcaggtgatccacccacctcagcctcccaaagttctgggattacacgtgtgaaccactgctctgggcctgtttatttttataataataagaggtttttgaaaaaaattcagatagatgcaacccagttaaaaaaaatcccggtatacaaaatcctgcctttgaataagagattaaaaaaagatggtcattatttgctgcctgcaggggttcactaagggatatgggtaagttcccttagctcggaaaaaggataataattaatacccgcttacatctccaaagtcttgaggtgctcaaacaagtaggagtgtgtgaaatgctttgtacatatcaaaacactctgtgaaatttaaggtattaactaatggataatgacttcttgaacatttaagagtggtttgatttacgtttagtagaaactcatctagtatgaaaatgatacatttattacaaatgattaacaaccctacagctctcaacctctttatgtaaccttccttctgactaaaggacccagatgactttgaggaatagcctgtttgctgggtgcattctcactcagcacttctggaagtatccattctacagttagtatttcatctcattgtcctggccttccgaaagcacccttaacccaaggtgtgagatatcaaagtaatacatattttacttcagagatgacatctcaaggttttacagtagctcaacattttctagtctcctttctctgaacattgtcagaggggagacaggcgttcctgggaagaattaattcctggaatggtgtgtgtgtgtgggtgtggggaatgggaggagatggccggccttcttttctagggttagtgggtggaattgcccgcccaatgattaattccctccttgacagtgtgttcagaagcaggcaccttgatggctctttagcagcaataccctcctcttctttcctagcctccttttgtcataaagcctcatcttttttatttatttttatttatttttttttttttgagacagagtctcactctgttgcccaggctggagtgcagtggtgcgacctctgctcccaggttcaacttctgcctcccaggttcaacctctgcctcccaggttcaagtgattctcttgccttagcctcccgagtagctgggattacaggcacgcaccaccatgcctagctaatttttgtatttttagtagagatggggtttcatcatgtcggccaggctggtcttgaactcctgacctcgtgatccacctgcctcggcctcccaaagtgctgggattacttgcgtgagccactgcacccggccaagcctcatccttctggtgttcacctcttggtcctgttaaggtggcccttggcaagtacctctttagtcttagggttcatgggagggatagaacaaaggcccacgcctccccctagcatcgacatttcccttcgtctgccaatgcctaccatagctttgttttctcccgcactgcttccctggttttctaggctcttaaatcctcaaatttgacttgcatgccctctagtggcaggtctgatgcaccccttgttaccctgtttattgtggtaccataacagctgttctcaccacccagctctgttactaaatattgtctgtaattcacaaatgccaaatgagaggttcagtggtcctgacttgccactcaagtaggagctggaaatgtgggatttgaattggagcttttgattcctggatttatacagcatttcagtgtaacggcaacagtaaaaaagatgtggttatagttgttctagtttcttttttgtcatttaaaaagaatccagattattttactatccactcagctaatctgaaagaatgaaaatgtgaggaatagtggaaaataagaatgatcatctttttttaaaccctttattacaattagaaatttttttgtcacttactgagtattcagtatttcatgcctcagtcctgttaactttgaagaatacaaaaaatacataaagcatgatgtctgcccctaagtttctgttctagttagattctagttatgaggcagttaaatttcttcacctgaggaaaaaaattaagcataacacatgataacttttattggtgtttaatttttctacttctcactaaagacaggttctctgagcatttactttttaatttattcttacagtccttttcagtggagagggaactacaggataacagcagttaccccgacgaaccctggaggataacagaagaacagcgcgagtactatgtcaatcagttccgatcccttcagccagacccaagctctttcatttcaggtaagaatgtgggctccctaggcatcactctcaccagaacatagccaccatcttgagaaatcattcacgcaaaatgagtatggcagccttctgtgatttcagtttgtttttcatctaaagtcgaatttcttatcagatgtaaaccatgcagaagaaaagttgccaatgacgtttggaaaattatatttccatttcaaagggcttaagtgggaatttgggggcaacttggcccagaccctgcaccttatcagctgaggcagttcttgaaatgctagcgtgtcgccccaaggggccacctctcattgcttcctcgttatattagagctcgggcaaggacagaatgtggcctcctaaggagttggtgtcacaagtctttttatgttatatgtgccttcaaacttcaaactcaggctcgttttctttggctcaaatgtttgtcctccagtttttctgagagaaattaaaatgggggaggaaaattggccagtgctttcccacttgtcagttcttctgggttgtcttcagatatatagattcctgttgagttctcatgtaaaattcaagctcagaggaactggtttaatgccagtgtggctacattttaccaggctgaaagactaacagtgaaatagtagagtctagaagaaaaattcataaagctttctttttagactttaaaatttgaagaataacaatatgtccttaataattgtaacctgccatattgaagtgtgggcaaagattagttttatcttgtgaaatgaggcacataattgaaatatacttgtataagtaattgcaaacatcatttactgattggtggtaatggctttattgacggcagaatagtacagatacaacaaattaatgttgacgtcatgattaaggaaaataagcagaaacccatattgcacgatttgaccacttgctaaccttaccccgtgctcaggtgagtttctttacgacatgtgcagatatttagccaaatacaaacaggtacttgttagaaatgtttttgttttcttttaacttttgtatcttgcagaatttcagatatagacacaactagtctggctgatacaacaaacctctgtgtacctatcacatagccccaatgattttctcttacctacagttaacacataaggttgtttcagtcagtcaatgatggcggtaccataacagtatcacggagctgaaaaattccagctccattaatcacctagtgatgctgtagccatcatgatgttgtagcacaaggcagtgctcacataaatgtgatgatgctggtaaaaacaaatctgtgctaccagtcgtataaaagcctagcacatatgattatgtacagtatataatacttaataataaatggctattattagcttattatgtatttattatgctatactttttttctttcttttcttttttgagatggagtcttgctctgtcgcccaggctggagtgcaatggcacgatcttggctcactgcagcctccgcctcccgggttcaaatgattcttctgcctcagcctcccgagtagctgggactacaggtgcatgccccacaccaggctaatttttgtatttttagtagagacggggtttcaccatgttggccaggctgctctcaaacccctgacctcgtgatccacccacctcagcctcccaaagtgctgggattgcaggcatgagccaccgcacctggccttttattatgctatacttttattgttattttagagtatactcttacttatatataaaaaaaagttaactgtaaaacagcctcaggcaggaacttcaggaggtattccagaagaaggcattgttatcctaggaggcggcagctacctgcaggttattgtcctcttctagtcacctccacagtatagaggtggaagacagtgttattgatggtcctgaccttgtgaaggtctaggctgataagtgtttgtgtttcagtttttaaccaaaaagtttatacgtgtttgtgtttcagtatttaaccaaaaagtttaaatggtaaaaaaattaaaaattttaaaaatagaataatagaataaagatataaagaaagaaaatatttttgtacagctgtgcaatttttttaaatttttaaatttttgtgggtacataggtgtatatatttatggggtacatgagatgttttgatacaggcacacaatatgaaataagcacatcatgaagaatggggtatccatttcctcaagcatttatctattaagttgaaaacaatttgactacactcttaagttattttaaaattgtacagtgtgtttttgttttaagccaagtgttattacaatggagtcaagaaggttaaaataaattttaaagtttatgaagtaaaaacttacactctaaggttaatttattattgatgaaaggatttttttttttggtaaatttagtgtagcctgagtgtgcagtatttataaagtctacagtagtgtacagtaatgtcctaggccttcacagtcactcaccactcactctctgacttacctagagcaacttccagtcctgcaagctccattcatggtaagggacctacaaaggtgaaccatttttcatcttttataccatatttttactctgccttttctatgtttcttctttctttcttcctttcttcctttctttctttctttctttctttctttctttctttctttctttctttctttcttttttttttttttttgacagggtcttactctgtgcctaggctggagtgcagtgatgtgatctcggctcactgcagccttgacctcctgggctcaagtgatcctcccacctcagcctccctagtagctgggactgcaggtgcacatcactatgccttgcctggctaatttttttgtagagaggaggtctcactatgttgcccaggctgttttctatatttagttgtgtttagatacacaaatagttactattgtgtcccaactgcctatagtattcagtacaggaacatgccgtacaggtttgtagcctaggagcaataggttctaccatctagcctaggtgtatagtaggctataccatctaggtttgtgtaagtacaccctgtgctgttcgcacaatgaggaaatcacctcatgatgcatttctcagaacgtatccctttttctagaaatggaatctcataatatgtggtcttttgtgtctctttcatttagcataatgttttagttttttttttaattaaaacatttgtgtgggtacataggtgtatatatttatggggtatgtgacatgttttgatgcagacatgcaatacataataatcacatcatggtaaatggggtatccatcccctcaagcatttatcctttgagttacaaacaatccagttacattctttaagttatttaaaatatacaattaagttattgactatagtcaccctattgtgctatcaagtagtaggtcttagtcattctttctaactagttttttgtacccattagcaatccccgcctcgcccctactctctccctgccactacccctcacagcctctggtaaccttccttctactctctgtgtccatgagttcaatcattttgatttttagatcccacaaatgagaacatgcgatgtttgtctttctgtgactggcttatttcacttaacataatgatctccagttccatccatgttgttgcaaatgattggatctcattatttttttttaatggctgaatagtaccccactgtgtatacataccacattttctttattcatctgtcaatggacacataggttgcctccaaatctcagctattgtaaacagtgctgcagcaaacataggagtgcacatatttctttgatacactgatttcctttcttttaggtatatacccagtagtgggattgctgggtcatatggtagctctaattgtagttttctgaggaacttccaaactgttctccatagtggttgtactaattcccaccaacagttagcataatgttttaaaggctcattcatgttgtatgtaccagaatttcattcctttttatggctgaataattccattatatcagtacatcccattttatttatccattcatcagttgataggcatatggtgttcttccacttttggagtattaagaataatgctgatttgaatatttgtgtaccagtttttatgtgaacatatatttttatttcttttgaatacatacctaggagtggaattgctagatcaaactgtactgggagctgaaagcattcaaattcaatctcagtaaggtctaacatttcaagaacagctgggtcttgcagttatgtaacatgtaaagtggaatgattgcctgatttcagttgatacaggtaaatcaacaatgaaggaagaaagattcctggataagtttctcaaaatgccactaggaattcttaaatctcaccaaaagctttcccaagatgtctgtcttatctctgtgtggtgtgatcaatggtattaattttcttctttttggtcagttttctattacttttctatttgaaatttctatttgaaatctgccaaatttgttcaaagttttgaacttcgtcttctaaatttttggaaaaattttgcagattttggtaaaaatgaagcagaaattaatttatgtgatttgcatctttcatgagcattatgttattgcttcttttgccctattgtaatttacatatttttaaaaaagctattcatgtgttgcttttggtcccatgattcataattgctttgaggaataaatatgtttgtggttatacagaagagattgctgaatgaaaaaattgtgattcatttgtatataaatgtaaaagctactctagctgagtaattaatggtttatttaaacaatggcacttgacaggttctgtggccaagaacttcttcaccaaatcaaagctttccattccagaactctcctatatatggtaagtacaattaatgccatatgacattcataccatcatccataactcatcctttagttcctacctttgcattttttaaaggcttatgttttgaatgatgtttttaacagactacaggagtgaatacaactcagatttttgttgctgtgaaaattaaatgttatatgaaaagtacaatgaacaatgtctggcacgtattaagcactatgagtgttaactattattttaaagtaatttcctaattattatccccatctcaatcccttttcagtctaggcagttgtgggcacatgagacttaccatcctgtagatttcattttcagacttttctgctaggtgtgatacaagtaaccagaggagcttgacaaactattttttatattttataaggctgagtgaacagaaggttgaggaatattttggagttaggttagatttgactattctagctgcctctgagctttgcaaatttggctggtgtttatcagttgggccctaattcagacttgcagctgtggtatccactgcacctttatgcactctggttccaaaagggctatgctgggatggtccagatggctctatttgcattcatgaaaatgcttggtgctgctgtaaactctcggctgtgtgtgggctagttcttccccaaaactgggcaggagatcgcactgctataaatatataattaaaaacattataatgtttatataaagctttttgcatgaggatttacagaattatgataggatttaaaattgcttgtcatgttttgtgcatcttattggaaaactactccaataatactcatgcatgtcaatgtatctgggattctgagctggatttaggttcttcaacaatatatactctggcataatttttttgtttttacaagccttatattagttttgtttttgttttgttttttgtttgtttgtttgtttttttggagatgagggctcactctgtcacccaggctggagtgcagtgacatgattatagctcattgcagcctctgactcctaagctcaagcgatcctcctacctcagcctcccagctagcttttcatttttttctagagacagggtcttgctatgttgaccagtctggtcttgaactccttgcctcaggcaatcctcctgccttggtttctgaaaactctgggattacaggcatgagccaccatgcccggcccttatattagattttctggctagggaagaataaagaaattatcattttgaaaagaataccatttgttttggcagaattcccagtctaaacattgttggcatgagacctcctatctttttgttgagacacgcctatgaaagctgaatggtattctttcgatctggcgtatgaagcagtttcctgacccctcactctggggaacagctatttcagggccccagtgcattcgaaattggaggaggaggatgtaaatggtctaaaggaaagttatggagcttaccttagaaatatattttctttcaaatagtaatacctttctagaataattttgtatttgtcttatctctatgcttgtcctaacacaagtacacttgtccctgtctacctaagagatggttaagcttatggggtcttagatataatactttggcaaataagtttcttttgtgctgagtaaataggtctgtgccttttagtgggaaataatgactgaagttaagcctgtttgagactccccctttcttcctttttgtcttatctggttccagtcagctttagttactagttttatcctaaaacataattcattccattttttattgagcttacttgtgttttcccaggagggagttctcaagcaaagaacagtttggtacaaaaatttacgtgacttgaaaagttcacggttttcctttaaagctgaaaaacaaagagcttatttctgtgctccaggtaaactgcataatggctaggacaactataaaatggctggggccacccttcctctgactgttttgaacaccatgtccagggcttttcaccccatgcagcctgcatttactgaatgactgtggacttctgggtatcatttttatttctgtgccatagtttcttgtcctatgtcctcagtgttgtaagacacaccaactagggaacctgaagaatttaaatttttatttataaaatgctactgatgctgatcccatcaatcggcatttttcttcctcggagtggcccccagagatttcaaatggatttggctaggagggtttgggtatctggtagggccatcaccacagagtctgggagttttattggcacgtttgggccaagtaacttgttctgtaagccccatggtaggtactcatgacatttgtttcatttagggagcttagtgatgctgactgtgatggagccctgaccctgcctgagttctgtgctgcgtttcatctcattgtggctcggaagaacggctacccattgcctgagggcctccctccaactctgcagccagaatacctgcaggcaggtaaggcctcaccatcaactgtaaaccttaagtacttttcctccaggctgtgtaaaaaacttttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaataaaaaataaaaaaacaaacaaacaaaaaaaaaaaacaaaaaaacttttgtttcttaaaatgatgtccagatactttggggagtccttggtatttacagttattgttctttaactgctattagactttcacatctcataatgtgaggaatagggctgatctgggtaagtgtgtattacctgtttttctcattctataccctctggatggatttgaaccaaagtcacttaccctttcatgacagttgtgaaataggcaagtactgaacctcccagctggtataaaatgaagaggaagatcctgtagagccaagtgttaacttggcatttttaggcacacccgagtgtctccgggtggccctgggcaatggagtggaatggaactcttatacctaatttaaaagtcaaaaaattagccgggcgcagtggctcatgcctgtaatcccagcactttgggaggccgaggcgggcggatcatgaggtcaggagatcgagaccatcctggctaacacggtgaaaccccatctctactaaaaaatacaaagaaaaaaattagccgggtgtggtggcgggtgcctgtagtcccagctactttggaggctgaggcaggagaatggcatgaacccgggaggcggagcttgcagtgagccgagatcgcgccactgcactccagcctgggagaaagagtgagactctgtctaaaaaaaaaaagtcaaaaaattacatgcagtgaaatgtgcaaagtgttgtcaccttaaatgtatgcttgatgaatttttgtatatgtatacacccatgtaactacaatcagatgaagatatagaatattctagcatatcagaaggttagaatagaactgttatatttctccttaataaaacagtctcgctcaaattattgttttggaccctttagatgggaaagagtcatggtgagtataacatatgtattaattcctttgggagagtagaaaaattaatagtgtgtcttgcccttttcaaaggcaaatgggcactggtctgatttccattattcatggaagtatagtgctcattgagaggccccagaaacagctggtgctttcaacaacctttctcactttttagggaagggctgttaaagaaatgagagcttagtcatgggtgattattagcaagagagagcagtgtctaaagaaactttaattacttattagtagagtatgaattttgtgattagatctgcaaaaggccttagattatcttgtctagccccttcctcatgatgacaccagattcaaagtggcaaatgtcttatctaagtttgtctcggggcctctgactctcttaaataaaaagtctgtcattttctgtgttaaatagtgagaggagaggaactcaaccaaagggcagaggccaagtttgtggctgctgctaagtgacaggtaaacatgttgggggaagagtgacccattctgggatcttcttcaaatgtcctcataaaatatgtgaaggggagagttcagagagcaaaacctactaatttctggacttggattttgctaacaatacctgctttctgcctattgcaggctgtaactctagcctgctgcccttccttagatgcttggaagactctcatgggtcccaggaattagcttgcaattgaggagcatgggaaactcctcttttctctttggtgtctttctgtctccatttcattctctccctcgtcttgtcttgtcttgtctttttcttttcttttcttttctttctgtttcttctgaatcagggcaaagaagcactggcattctgggggctatcttgacgcctacatggctctcattgccaaggcagtgcggggtcatagaggagccccttttcttgggattggagacacatggggcttttgtctctctctaaagggaattaatagctggcaaagggccaagttctgttctagggttatatttaataccttcgccgtgtcctctttcaagccctggagagagtcctgggtaacctcatctcccatacccacactgagttttctgtttgggggtcatgactagtactgttttattgttttgatgccatatggccatggaacctgtgggacatgccatgactccttatttgataagtcacttttgtaggtgtccaagtgtttcacagactatttcaaaagtcactgacataacggctgggtgtggtggctcacacctgtaatctcagcactttgggagtccaaggcaggtggatcactggaggtcaggagtttgagaccagcctggccaacatggtgaaaccccatgcactaaaaatacaaaaattaaacagatgtggtggcgcacacctgtagtcctagctactagggaggccaaggcaggagaatcacttgaacctgggaggcagaggttgcagtgagccaagattgtgccactgcactccagcctgggtgacagagctagactccttctcaaaaaaaaaaaaaaaaaaagtcactgacataatttttagacatctgaaagccctgagctaaaagtatgttaacaggaaagaagtaatctcttgattcctttcctactgccaatggcttcttttgacctgcttattcagtagaggggaatctataaaaaagagtgccaatgagccccatgtttcttcctggacttttatggagactgtcagcatgcatttatacaggaacaagggaagaatccatcatatacacttcaattaaacaaaaattgcacatcatttctagggcttgtgggattaatcttaaataataattatatagttctaacagaaaacatgaaagaacccataaaactctatcaaactcagtgacggtatattttaaaatgctttatcacctatgtttatcattgtatgaagcttaagaaaatggccagaaccacctaggtctcctctgtgctttttttgcttttctttgcaaaatatgagtgatcctattcatttttttgttcattttaatggcatctcatttagtgtttttcttttttctttctttctttctttttttttttttttgagacggagtcttgctctgttgcccaggctggagtgcagtggtgcaatctcggctcactgcaagctccacctcctgggttcatgccattctcctgcctcagcttccaaagtagctgggactacaggcacatgccaccatgcccggctaattttttgtatttttagtagagatggggcttcaccatgttagccaagatggtcttgatctcctgacctcatgatccacccgcctcggcctccgaaagtgctggacaacacgcccggcctagtgtttttttttttttttttaaagcttaactcttacctttttccaacttttttctaattgatctatattcagtctttaaaaaatctaatccagtttttgataagattggtgaagagtataaatttggttgatatcttcatgcattcataactagacaagcttgttttctaaaataataattttttttttgagatggagtctcgctctgtcacccagacttgagtgcagtggcatgatcttggctcactgcaatctctgcctcccgggttcaagcaattctcctgcctcagcctctcgagtagctggaactacaggtgcctgctaccatgcctgacagatttttgtattttagtagagacggggtttcaccatgttgaccaggctggtcctgaatttctggcctcaagtgatccacccacctcggcctcccaaagtgctgggattacaggcatgaaccacccaccacacctggcctgttttctaaaataatggaacaggaattgtatctgatgccattttacttgcaattatggaaatagtcccttttccctaatagtaaaacttcaaggacagagttgtattagttggtggcttacccgctagccttttgatagtttcatcaaaagtctccttttgatagtttcatcaagagtctccttttgatagtttcatcaagagtctccttttgatagtttcatcaaaagtctccttttgatagtttcagctgggtggggtggctcacgcctgtaatcccagcactctgggaagctgaggcaggaggatcaattgaggtcaggattttgagaccagcctgggcagcatggtgaaaccctgtctccaccaaaaaatacaaaaattagccaggtgcggtggcgtgcacctgtggtccccagctactcgggtggctgaggcaggagaattgcttgaacctgggaggcagaggttgcagtgagccgagattgcgtcactgcactccagcctgggtgacagagtgagattccatttcaaaaataaaataaaataaaaataaaaaaataaaaaaagtcaccttttgataggtgattgggtgggttctggtagaaatttttgccatagagtttgttaaaaaatacctatggagtacttactgcgtgagaggtaccacattgttcactgtggtcagaatgctgtatgacagagctcctactcccatgaacttgtgggcagttgatacgtgccatgaaggggaagtacaggtgcagcaagagggtgcatgatcttagggaagatttccttaaacgtttgggctgagatgtgaaggctgagctaaggactacataggtgaagaagagagaagcttaggttctgggaagggggaacagcaggtatgctggggaggctctgagagggggcttggagcataggaggagtgggaatttcaggccacagtggctggcgtgcacagaaccggggtagagaggctgggttgaagctgaggaagaaggtggggaacatatgacgggcaataatgtcaccttattttaggcagataagtgacacaatcagatttgctatgtgaaatgatcatgcaggttactgtccagagaacaggttttgaggggcacgggtagaaaccagaagactaagttgtggtagctggccagtcaggagcagcggggtgcttgcaatggggaggtgacagtgatatggagagatgtggacaccttggagagagatttagcaggtaattgacaaaattatagttttggaaagtgttagctttcttcacaggaagatccgctcatgataaagcatcagtcatataataccagtcagagccttgattgatagactagaaagagaaatcggtgaaattcagaccagagtaagcaaatgaacaaattaaggtgcttgtactcaactccatgtggtgctgatactcagaccagtacttccttacttacttactgtatgtatgtatgcatgtatgtatttatttaaattagatagacacgtaggtaggtaggtaggtagatacaaagacagatgaaacagggtctcactatgttgcccaggctggtctcaaactcctgggctcgagcaatcctcctgccttggcctcccaaagtgctgtcattacaggtgtgagccaccatgcctggccaatggccagtactttactgcagaaggatattggcatttcagtccctgatgggagtgggagggtggggaaggattaaaaacaatgccaatccacttttcacatttgattcaaatttttttaaaccttgcattacaattttatttcctaatagcttgttgtgacaaatttgatttgtagcttctgtttattatctgccacagtctgcttttcctctttggaatattgacaaattttctagctgttgagatatttctttcctaattactttgtgacaaagtagtgaagcagaatccgcttctaagacatagcctggtgtgaagtaattagcttaccaagtagcctgatctttcctcgtgtgaattcactcaactaccgaaataacagccagtgtcactattgcatattgaaagaaacccttaatgtgattctttttttctttgttgtaaatcagcaagaatttatgctcttatttttatcattcctgccaaccaaggagataaatatttcgtaaaatcatgttgggtgcacatcattataagatcttgcctatttctaacaatagttaaatgatgtatttccttagttaatgtccctatacattagaaactacactagtaacatagttaagacttacatattgtgatagtgatggttattgtggaaaattactatgctataacatgaagtgttcagagcacatacccttcagccagactgctgagagttcaagtccctgctcttccatttatcagctgtatgaccttgagtaagttgccctgttctcagtttcatcacatgtgaaatggggataatagaagtactgggttgtccatataaagaactgaaagtactacctcagcatgatgaatgccatatgtggtctatcagagctagctgattttgttgttatatttaacaagcacagaaaagctgatgggaaacactgattactatggctataggaaatattctgatatattctttttgtttcttcttagcttttcctaagcccaaatgggactgtcaattatttgattcttattctgagtcactgccggcaaatcaacaacctcgtgacttgaatcggatggaggtaaaagatcttcatatgctaataaataaggatgtgtatggagctaaatccattggcctatgttctttacaaattctggaaaatgaactttttttttgtttgaaaatgagcttttataacatttccttttcatacttggtaattattaatactttgatgctcagcctttcagatctagacaccagatgtatctataatttttttcccttttctccctaaaactggatgtggtaaagtaagtaacataatctctagaccttctagatgtgaaatgtagatatagccaaactaagacagaaaattctagccaagttatttactttaaccaagctttaattccctagtaaacaattttgattctatttttatcagttgggcattaataagctatactgaatcagaactgttttgagaagaggtttgagaactttatatgagggccccaaatcacattcggaactccctcagggtttttagcttttgaaccaaatgaggactgatttggatgatccccagaaggaacttggagaattcccccagtgttgggccatggatggaagggcttagccaagtgcttaggaagccttagctatggatcaataaataggagttgttatagttattgttgtcatcaccattgtcattatcatcatcatcaccattatgattactgtgatgacaatttaggatacctgcttttcccttccttaaaagatctggaaatgtttaataaatggagctttattcacagactccataatagtcagagactattagagtcctctgaccctagttgaaaccactgcaagatgatagaagtcaaagtcagggaacagggacatttctttaatttcttgtgactgtgcatgatgatttattctctcacatgaggccctcatgcctgtagcatgtgttatggatggcaccgtctgctcccctgtgagccagtcaagcctgcctttccagtgcccctctgactaacatctctctgccattttgcttctctttctttgagttgtgtcctccatggtactttcctcagatttctactcatgggaaaaagacataaagaaaagtcacttcaggaggaatgacagatgtgcatttgaagaattttggttaaaattttttttttctgcagaatgcttatgacaaagagagagataaaatagtttgccacttttcatggccctcagtttactttggggcttctagcagtgtttaaagagctttgtttatcaagccaggatggatacatctatggctctctgactatgtgtgtgtgtgtgtgtgatgggccccctgcttgcataaaatgatgaagttattagttggtcttctttaaaacggccataaaatctgttacacatgcacacgtctgttttactgttacacacacacacacacacacacacacacagtctctctcgcttgctctttctctctctctaatgtcctggatggcgttacatatattcacctttgtggattttatatgcagctagttttatatacttttgcatactttaagtggcctccttggggaggggagattaaaaactacctagtcttttttttttttttgccctatccaaagaagaaagcaaaacaacaacaaaaaatcccctcttttccaaccaaattgttatttttgaggatgctatggttttagacaatgaatgcagtaaacagaattcaaggacaaagtaatagggtttattgatggtttgttcatttaagaagtacgggtcagattgcaataatgattcaatatttcatgttcttctaaactattactgattgttctttctactagtcttttaatctatcatgaatgcatggagtttaattagattttggaaccagccctgtgatcgatgactccagtataggtggttgtgttctgaacaaagctgcagctgatttaggtctcacgtcatgagaaattggcttagtgatacatctttttctaaagacagcagagctgttagccatgtacttatttccattaagaattacagatgataatttcaagtatatttctttttatgagtgtctcttacattactggatttctttctttttctaaacagctttattgatagagactttacataccatacccatttaaagtatacaattcagtaatttttattatattaacagttgttccaccatctctacagtttaattttagaagaacatcatcagcccaaagagaaacccaatactcatgagcagtcacttcctattccactgtctctgccagcctctgataatcactagtctattttctgtctctagatttgcctattctggacatttcatataaatggaagcatatagtatgtagtgttttgtgaccgtattctttcacttagtataatgttttcaaggttcactcagatcataacatgtatcagtgcttcattcctttttaatgctgaataatattgcattgtatggatatgctacattttgtttgtccattcatcagttgatggacatttgcattgcttccacttttggctattgtaaataatgctgctatgaacatagatgtacaagtttttgtgtgggtgtgtgttttcggttctctcgagtgtatacctaggagtggagttgttggattgtatcataacttaactttctgaggaaccaccaaactgctttccaaagcaactatactattttacattcttccactagcagtgtatgagggttccaattttcccacatccttgttaacacttattgtctgcctttttgattttagacaccctagtggaatgaagtggtatctcattgtggttttgatttgagtttcctaatgattaatgacgttgagcatctttttgtgtgcttattagccatttgtatatcttctttcgccaagtgtctcgtcctttgtccattttaaaattgcattacttgtctattgaattgtaagtgttcttgtgcttttggcatcatatctaagaaaccattgcctaatattaaatcacgaagatgtacttccatgttttcttctaagagttttgtttgtttgtttttttgttttgttttgttttttgagacggaatctcgctctgtcaccaggccagagtgcagtggcgtgatctcagctcattgcaacctctgcctcccgggttcaagcaattctcctgcctcagcctcctgagtagctgggactacaggtgcgtgccaccaagcccagataatttttctatttttagtggagacggggtttcaccatgttggccaggatggtcttgatctcttgacattgtgatccacccacctcggcctcccatagtgctgggattacaggcgtgaaccactgagcctggcctcttctgagagttttatagttttagacctttacatttaggtgtgtgattttgagttaatttttgtgtatgttctgaggaagaggtccaactttatttttttgtatgtggatttctagtcgtcccagcaccatttattgaaaagatgtttttttccccattgaattgtcttgcacccttgttggaaatcaactgaccatagatgtaagggtttatttctgggttttcagttctattctattgatctatatgtttatgattatgccagtaccacagtgtcttgataattttagatttgtagtaagttttgaaatcaagaagtgtgaatcctttaacttttttcttctttttcaagaatattttgctattctgacttccttgcatttccatatgaaatttaggacaagcttgccaaattctgacaaagattgcattgaatttgtagatcagtttggagagtatggccaccttaccaatattaagtcttctaactcatgaacatgagatgtctttccatttatttagatatttaatttctttcaacaattttttgagatttctttttatctacattgcctacttctaaattatgttattctccaaaggggcctgatttataatgcaggtgggaaaagacaatgaaagaaatgcactgttatgatacattgtctgttctattggagatagtagactttgaatagaaaattatatctggatacttcgttttaatgagtaaatcccagcactatgtgaggccgaggtgggcagatcacgaggtcaggagattgagaccatcctggctaacacggtgaaaccctgtctttgttaaaaatacaaaaaattagccgggcgtggtggcatatgcctgtagtcccagctactcaggaggctgaggcaggagaatcacttgaacctgggaggtggaggttgcagtgagccaagattgtgccactgcactccagcctgggcaacagagcaggactccatctcaaaaaaaagaattacctgagtgaagactgttaaatcttagaccagttttctactgagtaatacttcagtctctttcttcagaacagtttaaaaacaaaagtattgcttatctctctggggttgtttaggttctgagaggtaaaccaattaactttttggaacaccagatggctccaggcatttactctccttccttcaagataaatgttacaatttatctttatttaatttgtgactatgttttaaatataaacaatatcaaaagacatatgttgacaagtcttcctcccatctaccaactcacctttcaattcttacatatctttccagagtttgtgtatataaataaagcaaatgtgaatatatattattcttgaacttaatcttataggcattagagtgcatattcttttccagctttgaggtataattgacaaaaaatatatatttatgatgttttcatctatgtatatattgtgaaatgattactgcaatcaagctagttaacatacctgtcacctctcacatagttacctttttttggtgtggtgagaacatttaacatcaactcccttagcagttttcaagtataccatacattgttattaactatagttagaatgtgtgttaaattgagaatttacaagaagtaaatttacagtaagtagattttaaacggtttaaaactaattcatacttgatagatttgggtattcatattagtgtgaggacttcccccctgtttgcattaggagaaaattttaatctgctcatcagtaaaattcttttatcccacaacaagaaggctggtttaatcaggtttagacaccatctgcatgacagatcttggcaaacacccacattgtggggccacttgtcagaacttctttgtgtttgtgaaaaaatacataaagaacaggtttgttcttggccaaatggaccagagttgctatgcaattctgtggctgaatcccagtctgaattcagatttaatacatgtgccttaatctgaatcatttttttcctctgtgtatgtaaaatttcaatacaaattaacatatacctcactaggaacctaaaaaaaataaggtagtattaaatgcagggtttactgcagatggaaatggtggcaagaaataatagcttttaagacattttcggctgggcgcggtggctcacgcctataatcttagcactttgggaggctgaggcgggtggatcacgaggtcaggagatggagaccatcctggctaacacagtgaaagcccttctctactaaaaaatacaaaaaattagccaggcgtggtggcgggtgcctgtagtcccagctactcgggaggctgaggcaggagaatggtgtgaacccgggaggtggagcttgcagtgagccgagatcgcgccactgcactccagcctgggcgacagtgcgagactctgtctcaaaaaaaaaaaattttttttcatcatatgtgcgcatcacttaatttctgttccaaccagtttaattcatttacttttctttttcaaagaagacatctgttaaagacatggctgaccttcctgtccctaaccaggatgtaactagtgatgacaaacaaggtaggagaagaatgagttttcttctttaaccagcgttctacctgttaccttatctactcctcttggaatggtggcttctagagcatatgagggtggttctcagcatgtaaacacatttggatagactaagtagttcaaatcattgtcataaaacaatagttcacaaagtggtagcaagagcttgagtgtccagagtcttccaactcattggccccttagtcattgctgaccctcagcctactcttaacaccttacactggaatctgatcgtagcaattaggaaatgacaggaagctgaacgaattgagaacatgttgtgtttgcggatgtgatcccagacatcagtgtaaatgcacatttgcatacagctctaatccatgaggaagttctcttctggacacagcttctgtccttagtgtttatctgtttcttggctttgtgagtgtgggagtgtgacatggagcccagctacaattttcctatcttactgggcagctgagaagcagtgcagcacagcattccgtgttagagctactcccagggaagagttggcttgggaatatctagaagtgtgggagggaccctctcccccacctcctatactttgtatagtgctttataatctaccaggtccttgctcatatactgtcttattcagtcctcacaaaactgaatggaggctggtaagttttatcacctgaaatttagagatgagtaaactgaaattcagacactatgaatcatttgcctagttattaagaaaaagatttgggacaagaaccaagattttttctaagcctcaagccagtattctgcctgttatttgatattgatttactacccatgaatgagaggcttatttgaagggactaaaaatcagtgaagctatttcaggttttattgttaaggcctgccattgattaggcattgtatgggggcttaacatgaaaaataagttttccattaagtgacagtaattgcatgttctctatttaaatacttgcttgggagagacaggtagaactggacattgtctgcagtagcgtgtactctgaccattctcctaactgcacagtggaataactgggcaaactgtaaaaatattgaagcctggatttcactcccagggattctcatgtcatcagtctgggtgtcaggaatgaaagagggagaaactcccaatacttcctggtaatacttctcctatctgcttgaggtgctgtctctggaaagttgaaaatacatctttgctctttgtagaaggagaacctatttccatactccaggaggtctttattgttttagtaaatgctatagcaacttttagaggtttgtgagacctgtttttgtaagtgatgactagcgattctttgtttgaatccaatttgcctcagaaataacattttatagttttaattttttttcctcttttctctttctttttgcttaaaaaacaaaacacaactagctttgaaaagtactatcaatgaagccttaccaaaggacgtgtctgaggatccaggtaggagaaaaccatttttgtatactttatatataattattttaaaataaaaaaacagcaagtcagtgagtagaagattgatacctctgtgatagtgtgtctgtttctctctatttatttgtcttgtattttattacaaggaaaccttttggctttttaccctttctctcttttcaggtatgagaacggggtgatatcttttcaagtttttaagtttcactgaaaggatcacgaaggatcactccgtgtgaatatagggtcttgttactaagtgcaaaattgagaaggcttgaggttgagatgatttcaacaagccattttgggttttgtgtagagtaaggaacttatagggtagatcaattggaggcccagagttggtattttccatttccaaagcagaaatctcaaatatttttattatgcttcaccaccaggaaggcaactatatgtgcttatatatggagtggattccaaggagaaaaataaaagttgtccagttttttggagagtcagacctgtgtctgtggagtcatggagaatggctgcccctgtgtccgcagctctctgttgatggagccatcattgaaccaagttgaatctagttaaaaacaaagtggctacagaagacattactatttggagctctagttataaggacatgaaaaaagttgttgctttctcttttgctgttttatttcttgtatatttttaataagtcaatcatgtttgttgtgataagctagctatcatcctaggcttatttgttgaacattggaacagaggaatcaatataatgttgaggcttatgctgtggtacaatattttccaaatgtcaagttcattcagagtttcaaagagagatgggtggagggagaggaaggagttgggggagtgggagaaaaatatggtagggggaaggagagagagagagaacatgagaatgagaataaatatgaatgaatgtggatgatgaatttcaattatggaagcctgagaaggtgtatttttaggcagctccccagttggttctggtacatagcctattttgggaaccaccagctctggaaggtgatgctacaaaatagaaaattaaggttatagatcaaccatgactccaaaagtgatgggaattcccaagcttaattttgactcttgaaacagatttgaattcattccttattgggtgaaatgctctgttaatgtaggccaacgcctggggtcagttctttctagctcttatttctggagctaaagtggatgcattccagtttttgtaaacttcatgttgtagtattagtaaaagctgtttaaatttggagtgttaaattggtgcttctccaacagcctttgaggatcataacttttcctacttttttttttttttttaagggattttagcacaagatcaagtgtcctctggggcatgagctttagatctcatttttaacattccttcattgactaggacatggcatcaccaaataaaacttgtcaggtgtgccacagcatgagaagtatgtcggaattgatttctcgttgtgcctggcagcatgctatgtgttttctgatttgttcttcccactactgcccctctctgggtatgagggagttcctcatcttaaacatagttaatccctccttttctgggaaatgtttggattcccagtgggagacacaagcgtttcaaggtggtgatttagaattctggatggctgtccttgccatgtggacctcagttcagttgctgctttttggagggttaatctctaggcctgctcctctttccattcccatttcctggaaagatgacatgccttgagtgttctaggaaggtggcagtccttttccctctttccagctacacgagaagctatgatccacttgttgtaattgctgagagtgtctatgttagtggagccttaagagattttttaaaccaatatcccattccaacctaattcagcagagcaccatgcacaatggtggtctttttcttgatgtttctggcccatgttgaggtgttttcagctggttcaccctcacagtgctgtctttagactgttgttggtgattctagcagctgctccattgccaactatcaccccatgtttttattggagtagagcagttctgtccttccattacctgctcctacctgcacctcctttgctgtcctagaagaaactaaatttagaaaccagatttccaggcttaaaaaattaggagcctttatttatgcactctacaatagtaatattttgcaattctaaagtacgttcagtttttaaattactttcaccttatctgtccctgtgagaaagaaactgcatttttattgcctttgttttctaggtgaggagactgaggttcagggaagtaacagctagttagtgtcatggccaggaggagggccttagtctcaggactcctggcctggtctctagtcctgtctctccactactcatccacaccctcaccccatctgtctgtctgtctatctcttaccagcagggctcacccctccttccacacccatccctaccagcaaaaagacaaagataatggcacttgacaaaggaattaacagtcaccatggtctgatttggggaacagtattttatcatggcggggacctctcctacccatgtatttcttgaaagcagtggggcctgagggagaagagggccacggagccagctgcaggcagcctgcgtagagggcttccccagctctgtggtgagtctggtccactctgtccacccagccccaaggcagcctcctgagctgggagagaggcttcctgaggtcgctttctttgctgcctggggtttgtaggagggagggaggtctttttctgtctatatccaggtgtgggtgcacgataatgggcaaaaggggactcaaactccttgggctttccaggctttcctgcactctggcagcgtttcagctgtttgaagttggaagatctctgtgttctcactacaacaagccaaaatgcttgggttgggagaagtgtatctcttgtgcagctgaccagtagtttgctttgtgccttgttagcatttatgaggattttcacctcccctctctgtcctgttatctaacccaaggattttaatgatcatcataaattcaggctgcttcataccaaggagggtttttatctttggagcaatgtaaaagaggatgagataatgcagtgagacattttctttttggaagaattcatgcagacaaagaaattacattcttcttgttctgtgttactagcaccttttctatgattttttatgacattttatgatgaaaaatttgcaatgtttgtaacacctgagcatagctactggttcctaaagttgtcttccatagaggattgaaagcataaaaagaggatcagtgtttttgtaaatgtttctaattactcctcacaacttgtgatggggaagaaggctgtatgggcgttggtagtgagcaagttagtttatgatttaaatttgatgaggaaaagtcatatggctgggaaaagattcagcgatattgttcataattctctgtatgatttggtcacagacatgtgggacacaaggatattttcttacaggagaagctgtatagctcatttccacttacttgtgagagctttgtttttttgtggccatgctgctctggtagtgtatttttttttttttaaaacgtgtagttagatagacttcttcctatccttcagggtagactagttcaaaatctattactagactatcatgatagaacaagaaaccctgaagtgtgaatccatcattatataaaaagacaaccccctttcaagggggttgtctttttatactggaatgtcttcattaattaacttggatttgagaatggcctctcaaatagtgcttgaccaaaggaaaaatatgctggtttttctttccttttaatcgtttctttagattttgaaataaaacaaggaaatcatgaaaatgtgggagccgtccagttctccacatgggcacttttacctcacatttacctgttgatgtgttctgtactagcccaggtgctgcatataaacttgtttaactgcagaaatgaaacccaagcaatatctttgtttcagcaactcccaaggattccaacagtctcaaagcaagaccaagatccaggtagtgttcgtttaatttctgctttaatgccctttgtgccgtgcccctgcctagaaataagaaccacaaaccaaaacccaacccatgatttcctcttcctttagatgtaaagcttaggatatgagccatttcgctcgtgcatggcctgatgggaacatgcagtaatgctgggagccttggtttctgtggtcattagtgctagaaggtgaccatgaatgccctacggcccctcaacgtgaagtggattgtgtgagacaacccagttgttgcaagatgataacttatagggggaagtagctttggaaagaggaaaatatgggtaaggtaacagacacgaaaatttgctatcatgacaaggtgaacaccaaaaagtaaaaagtctgggtaataaaatctacagtagggaaagaaaatgcttctgataacttcagtgaagcttgcagtttcaggtaagcgatgtttatggtctgtttgagcctatcttagtgcccctgtaagcttcacattttttaagaggctagtacaagagagaaagccagtaaggcagagctgtggttgatgtgagactcagaagagaggtgcagaggggaaatacagagacactaatagaattaatccattaaggaagggaaatggtattggtactgtatttcactggtagaactgcagtgtaagataggataacgaggataccatgtgtgtgttttctgttttgctttggctgttagtgacatttttccctcctttgcctactagacacaatcctgaaaaagtaaatttaagtctgatcatattttatatgcttgaaatactgatatttaaggaacctcatctctttgtaagtcaaagagttatcctttagtttatatgtgcattttccaaattggggttttgtttccttgtttatgtaagatacagatatctatatttttatatttatgtgtatttaaaaacaatagagtaattcatttaggtaggaagaaaaggtgtaggcattctttctgtggtcaacacatttactcatcctttgtaaaaggatgaatggatcttttacaaactagtctgtactagttgtgggatatgctttcatagtaggaattgcctttgaattgcagaaatctgttatgtgtactatgttaaccataaatcgaacctcaaagttttagcttctgctgacttcctctctccctgaaagccagtgaaattataaaatctcatagccacacgttctgttattaatgtgtctggctaaattttacatattatcctttcagagattgcgcttttggtctaatttggaggattttattttcattacttctcactgggaagaagagaattgaattgtttttatcctcctttttgaaataataaagttttgtagaaatataagggaaagagggaaaatcaccattttaacaccactgcattcatcattttgttaactccctgcacatttatgttttaattggttgcagcagtcatggttatacaatctcacttattttatattcagtaactttccatatgaagatataaacatacaggttatatatgaaaataaaatgaaaatgaggaatgtgcgctgtgggattgtgtgcttaacagtgtgcacgcatacacattatttacacacacattatttcttttttgagtgaaagatgtcactaaagctatatgtggcatagaaagctcttttcatttctagctagggtctctaattgtcttttttaagtgaagtgttcccatttaagaaccttgtccttccgtatcagttccctttgattcttgttgaaagagccagagcattcttccctgctagtttctgcctgttgctgccttgcctgtcttgccagttatgttacagggaccaccccagaacacgtcacatgccattatggtggctttattaaagttacaaccttgtaagacagacagaaccctcaactaccacaaagaatccttgagaaatttattcaggaaaataaaaactcacaatgtcaaaaacagctctgtcaagaactgaaggggtttaatagtaactgatatattctaacttcataaatgccactctaatagctaagtacgaagaaggttttcagaggttaatttgtctctctaggatgtacctctgactcagaggtcgttttctgctttgacatgaagctagttgagaagctaaataaaacagatgtatacatctacatcttagggccttttcgtgatcatcgtattgggaacccgtccttaaacctattcctaagcagtgtatggagttgaattttatttggaaagtaagtaggtctccaataaatattctagttgctatcaccaaagtattcccccgccaactcataggcagtatgagaacattttaaaaatgggatatagaaacagagattggagtttgaatcgaactgtgtaactttctatctgaccttttgcaagttatttagttcctttttaaaaagatgatattaccagagttacaatctcagaagttgcctagttaattatgccttgctatagattgaggaagaaggttgaaaatgagacttttgctttctcagggaaagacaagctagacccctcaatctgattgatgtgtgttttcctttcccagcttcgtttgtggcatattcccctgaacattgaattcttaccctcagcttatctgtcccaattccacatgagcctgtcatcacatttgcaagtgaacaggagaaaagttctctgatcagtttataccatgaaataccatgaagcccttctgttagaacatggaaatgcctaagctgaggggctccatattattcttattaacaattccaatagaaatggatttgaatttacacaaagttttttttggggggttgattcagatctaaggtataataagaacaaagaggttgaaaagatcccaattcatagttggatttggacaattattgtacatagtggcattcaatgggtaatagaatttatggctgctttggtagctcatcggttctttgtagtcactttgacttcgtgggtattttccatttcaccccaacttcagagagtaaagctttgctatttcgcttctgaccttcccttattttgctacagatcttactctagcacctccatagaagaggccatgaaaaggggcgaggaccctcccaccccgccacctcggccacagaaaacccattccagagcctcctccttggatctgaataaagtcttccagcccagtgtgccaggtgaagtgccccttgccccctgagcccttccatttcctgttggagccagcggatgtgtgtctgccacagtggcctctgtgagtccggagaaagagcagacctggcagtttcgcattccgtgaaggtcttcacgtggctatggtattcttgggagagaaagcaattctagacacatatgtagcacatgtgtctggagccttgcccacacttgttatggatcaagaattaggaaattctctaccaagaggataaaaatgcttcactcccatgcagcctgctgagtgtgtggctggggtcttactctctgcatcattggtaatttgtgaacaagatagatcgctgtctgtcatttcctcagatgcctgtgtggtcttctatgaaagatcttggagattaaggcctagccagaaccttctcctgcattttacacttatggagaagatcctgtgtcctgtaggatttaatgctgaggggactctgaatctgactgatggttgggtggttggtggagggtcctagggcaagggctccttcaggtgggctgctctgggcttctggggatgggatgttcttgagcccgcagttgtgtagtggggctggaggtgggggaggcccagaggggccctgtctgctcccttggcttcctgtgaagtagaagataccctcctaaggaacctaaggaatagaagatgggaggcatgcctttgctttagtgaaggtgataggatacggtgctgtcccaagtgttattttgggagcagcaagggcctttccactgactcatgcaggcaagctataaatacaatgatttcctggaactttttctccatctatgtgcattttaaatcaggccagcctcagatgctagtgatttgcagattattatcttttctgctaaagcaagaaaagactttccttggctcacacattagcatgacctctgtgtctgggcagagctcagcatgttttatttgttctaataaagtattctcctcacagtaaagttatagattgttttttaatatactaaaatctggaactctctatcaaatttaattctgtgccatgagttcatcagacaaaaatttgccttgaatttcctctcatactttgatctgaattctggcataaatttcatagtgactggtatgtagggtgggagtaaccacaggtgatgatgctataaaaatttcacatggctggcggattatgacctggaagattttcctatggatgcgagaaaattaaaacaatctgggaagctatctcagtacctttaccttgcaagaagggaggctggaaatgctcacaggtctctctcaggttgtgtgacccagtaaggagatgccagctgtactggagaattcacatgctgtggtttttacgacactgcatcacatagtggaagagacaaaactgggtttggagctcagctcagctgcttattcactgtttgattttcagcaagtagcttaatgtttatgcatctcagattcctaatctgtacagtagagccaatactccatggagttgtaaggttttggtgagataataaacataatccaaatatgggttgaatattccttatccaaaatacttggggtcacaagtgtttcaggctttggatatttttggattttggaatatttgcattatatgcttaccaattgagcatataataaaaaaatctgaaatgcttcaatgaccatttcctttgagtgtcatgttggcactaaaaagtttagggttttatagcattttggattttggatttttgggattagggatactcaacctgtagtactgtatttggcccacaggccttagtaagcatgtaaggcccatattcccgtggcctgcaagtatcaagaatttaatgcctgaaatggcaagcctccaccgaggaggataacaccccgacttccttgacccctagcagacaattctgtgattcctcctacccagtttctcagaaggctcgcaaaaggactgaaccccagttgcctgccgtagtacaccattcattgatgtactttttcttgttttgcttccctcctgccctgtctcactttcccctcactcgaataatatacctgttctcaagttcatatgtcaggggcttctttagagaaaacctgaattaagacagctttctttgatatctctgtgtcaatgtgacttcaagatgaaaagtattttggtttgataatgccctgacgatctcccttgtggtagggcctgataaatctaagatttagacaaataatagctaggtgggtgatgtctctgttcatagcctaattccattgtcttttcagtacaaatttatacagatgaaattttaatgagcagtttaaatttatcacatgaagaatagaacatttctgcagtatgaaaagcaggtggtataattgcatctactttatttattttcatgttggttaattctcacagaaaagtataagggtctgtctaaattatataaaattttagtgtattgcatattgctagaaattatcgaaatgctgacaaactagaaatgcatgaaatagagcttaaacctaccagaagagtctactcactgagaatcatggtgtacatttaggcatccctttgctgcacttatctttatgtatcactttagataaatgggatcacactatgcttgctgttctgtatcctgatctttccaattaaccatctttctatttcatatagaggattgcaccgttccctttaaggtgtgcatgatatggatataccatggttgactgtgctttgatggagagatctctcccttcttctctctgccttttctcttccccatactttcctcttaagctcacccaccaccccacgaccccagcccccgttcctttctcacccttgcaaacaaacctctctctctctccaccccgacccccgtgtcctcttcatacccctctgtttctctttttgtccttctcccccatcactccttcacaggtatgagcctcccctcactctccccttgccaagctcccccacaccaccaccttgttcttataatataaacgaggcagaggttattaataatttcatgtccgtatctttgtttcatcatctaattattttcttaggttaaatcctgctggttggagttgcagggtcaaaggctgtagatgtttaaagtgtagctatatgttgccaaagggtgaggtggaacacctgtcaacttgctccatcatcaacactgtctgaaagtgtttcctcacaatcttgccaacactgcttcatgttcatctttttaatcattacctgtgtaataggcagtttcatgtccctgattcctagtgaggctgagaatctttttgtattgttattggccataaatattccttctcttatgatttgcctgctcagaaggcttggccagcttctgttgctacatctctctttgcctaaccacggggaccacttctttcttcttcattttgcctacgttctggacctccctcctgtcaggcacttgggaatgtgagggtggccatggggaagcctacctcacctgctgctgtgctgttccttgtccctccagccccgccccccatatcccctccttctgccaactttatcacttaagacagactgcctgggtcaccctgtttatgacaatagaagaataaggaaaggtaaagaaaagaggggaaaataatgtgagatgaagcaagatgtggacttgagttgaaagggaaagataaaatgaagcccttgtttaataaaatgagactcaggattgtgaaaagcagtgattgaagctaaggtgctgatacagagtggcttaaagtggagtgatagtgtggaaaggaaataggatggagagaagatgcaaagaaaaatgaaaggaaaatgaagggaaagatgggatggttgttacataggagtgatgatgtttatccaaaggaataagcaggaaatagaataaaaaattgtagaaccaatggaaggagagtccacagactcttggtgtaggattcaagcagcatttaaaggaatagcttagaagtaggtggcattaatgcctttacatttatgaaaataggtaacatgatatggggaaaaagaacaaagggctgatttagaatgtaaatctataaaaatgaataaggccaactttggaaatatagaacagttggcttcaactttggtgtctgtaaagagagtgtgaatgtgtgatttatagtagcctagatgattccagggctctctaggtactggcatcagacccgaggcatgtgttttcataaggagaagcggatacactatgatcgctgtgtgtaacagggagatcaccatttgtaatagctgacccagttcttggagccattgcctcacagtcccacacagctgctgtgtttgagagatagcaaaaatgtgcaagaaagtctaagtcagtgacaatgcaagtatgcaaaacctagaggcagtcagacctggaatttgctcagtgatgtttggattttatgtctctatatttatagctatgaaacatcttttattactgagattcctgtaagaaaaatcacactaagctggtacctaacctccttttcctcaatgaaacagttattttcatgaggtaatttttttttcataaaaaggggtttcttctgtccacggagtcagtaagaactacccctctcttctactcttgattcagacctgcctcttctcaaagccatgcctgaggtttgtagcctgaggtttccatggtgacagtaaaaagccttagctctgccttgttccagtcattgagcatctgcctggcagaaggggcagagatggtgtggaggagacatagccattcctttaaagtttcagaccgggcattttcatcatttccactcaaatctagctgggggacctaggcccatggatagacctagttgccaggcagctgggaaatgtagtccttggcagggcagccatttcccagaaatacgtttcttactgcaaaaaaggagaaggggatgttgatggtcagttgtttttttttaaaaccacatcccatatggccaaatacattgagattcacacattaaaaccattgtgatggctgaacagaacacatccagggctagtgtctgtccatgggtagctaatttcctatctctgctttagatatactgataataacaactcattccatggttaagagactatggtacatccatcctatggaattgtatgaagctgttaaaaagaacaggcacgtatactacatggagagctatctcggataaattaagtgacaaaagtatgatgcagaatgtgtatgtttataaatgtgtagacaatttcaggatgatgctaaagaaactggtaatgatagttgcttctgggcaaggggaacagtatgactgaggacaggactgggaaacaagcttactttctgttgaatgcctatttgtatctttttaattttggctcatgtacagatgtcacctattataaaaaatttgcttttcactctttagctgcaatgatggtatctgaaagtaccagagatgtctttcctgcctgaggttacctatctcaatcttccctacgattctgtattcagggtatctttatgaccatctgctaccacctcctggaatgcagctgaaatgacagaaatgttccgagcactttttttttttttttttttttttgagatgaagtctcgttctgtcacccaggctggagtgcagtggcgtgatctcagctcactgcaagctccgtctcccgggttcatgcccattctcctgcctcggcctcccaaatagctggggactacaggcacctgccaccacgccctgctaattttttgtatttttagtagagacggggtttcaccgtgttagccaggatggtctcaatctcctgacctcatgatccacccgcctcagcctcccaaagtgctgggattacaggcatgagccactgcgcccagccccgagcactcttttaagctctgatgcgttcttcagattccatttcagtgcctttccaacactgaggagtagttctggaggacctcccaaagattacattgtgagatgtatagttgggtaaaacgtcatggtaagggctctgtcttaacttggaagtggctgtgtttattgagtggcgaattgagaagtctttcctcggttttctataaatgaatatttgtttctgtaacttaagaagtaggtaaactccttgggagtaagagatgttcctaataccaaacttacctttcaggttctctaaaagatgaatttggccacaaaagcagctctgaccttatatatttccttactgtatttttcctgtgagtgctacttgtttcttttaaaatctggtaggactatgggattcctgacccaccccaaacctttgggcccacagtgcacagctatccaagggttcaatttggcagtctgggcagtttttttgttttgttttgtttttttgttttttttaaatgaaagcgttattgagatgtaacccatatactataaaattcacctttttaaagtgcacaattcagtgatatttagtatattcatagtgttatatataactatcagcactatgtaatttcagaatattttcatccccctcaaaagaaaccccatacctattagcaatcattcccattccccccttttcttcctctatcccttggcaaccactaacttactttctgtttctatggatttgcccattccggaattctgtattaatagaatcatataatatgtggtcttttgtgactggcttcattcacttagtataatgttctcaaggttcatccatgttgtagcatgaatcaatacttcattccttttatggctgaataatctttcattgtatggataaaccacattttggatatttgggttgtttccactttttgactattgtgaataactctgctatagacattcatgtccaagtttttgtgtaaacatattttttctttctcttgagtatataggtagggctggaatttctggttcatatggtaactaactctatgttgaacattttgaggagctattgaagtattttccagagcagccaaaccaatttatttcattagcaatttatgaggattccaattgtgtttcttcacgtcctcaaaacacttgttattgcctttttaattttagccatcctagtgggcatgaagtggtattgtgattttgatttgcattttctaatggctaatgatgttatacatcttttcatgtacttattggtcatatttatgttgtctttggagaatgttcagaatctttgctcatttaaaaattgggttgtctttttattgttgatttgtaaatgttctttatatattttgcataaaagttcctttacagatatttgatttacaaatattttccttcgttctgtgggttgtcctttcatctttttgatggtgtcctttgaatcataaaagattttaattttgatgaggtctaatttatgtattttgttgcttgtgcttttgctgtcatatctaaaaaaccattgcttaactcaaggtcacaaacactcctcttttcttctaaaagtcttatagttttaggtcttacatttacgtcttcgttctgttttgagttaatttttttatatggcatgagttaggagtccaaattcatttttctgcatgtggatatacagttgtcccagtaccatttgttgaaaagactattaattatccatttaattttcttggcacctttgttgaaaatcaattaaccataaacataaggatttatttctggactctcagttctgttctgttggtctataggtctatccttatgccagtaccacagtgtcttgataattgtagatttatagtaagttttgaaattgcgaagcgtgagtcctcctgctttattctttttcaggattgttttggttattctgagtcccttgcatttccacatgaaatttatgatcagcttgtcaatttctgtaaaaacaaaaaagccagctgggattttggtatggcttgcattgaatttgtatatcagtttggttagtattgcggttttaataacattaagttgtccaatgcatgaacacaggatgtttttccatttatttagatctttaagtgtctttcaacaatgtttcagtatacaagtcttgcatttcttttgttaaatgtattcctaaaagttttattctttttgatatacattatacattatttcttggagatatccatgtcagtactgataattttgtatttcttttatatatcatctatatgctggctgctctgttaaaaaccgtattatgaaaaatttcaaatttatgcaaaagttgagaacctccacccccatattattttgaagcaaatcccaaatatcatataattgtatatataaactctttgtatatctctctaagagataaggtcttaaaatacttgagcacaatacctttgtcatacataacaaaattaacaataattctttaatatcatttaatatttggccagtgttcctatttcctgaattgtctcaagtttgtctttttatactagtttgttccattcagaattcaatcgagggctacatgcacattgcacttgttttggcatattttaagtctcttaactgataggttcttctctcagtcttttttttcctctttgcttttcatttattcataaaaagtcatctaccttgtagactttttcacattctgtattttgctgattgtttgttcttccatcccatgtatttcctataaactaataggtaggtctaggcttgattagagttagtttagatttttgacaagaatactacctaaagatgctgtgtacttcttactgcaccacattaagagatctctagtgtctaatgcctttatttttgtggtgtttgattgattaatgggtttacgtagtattggcctgatccatgtgttatgataaagatcccagcgacctttcaaataatggttttatcagctattgatcatcattgcctacatccagtggtgtgtcagtgaatgtttaacaaccggccacttgccaatttttatggtgtaaacactcctgccatggctaatttcattcctactgatgtgttactgaatgtggagtttggaacagatgcacacagttggctctcacaagctggcatgagctttttccagcaaaccactgcttagatccattatttcattggtagttgcaaaatggcgatactctattttttctacctttattaattgggactatggtttatttaagcattttcctattgttggacatttaatttgtgactattatgaagcttgtgagctgaaggagatcataaaacataattctcagtacatcagtaaattctttatatacatctgaatttatagaattgtatgaaaactgaaatagacttcagtaatggtgaccagaaaagtgtcttattcaaccagtatttaatgagcatttactgggtacttggcactttggaggatcccaagagggatatggatatgcccccaaactctgctaatcaatgtcacagttgtgtgtgattgttagaagggtttagagtttgggtggttgctaactagaatgatcagtggatttgtgggcagggggtgcacagggctggtgagctaaactttgaaggatatgacttttcagtcaaatcctattcttttttgacatctgtcttgatttacttcttatgactagtttcctgggtgtctactatagtagcctcaaatctggcttgcttgctttgttctttccttcataaagcaacaggattaattttctgcagcacacctatgatcacttccctactcaaaactcttcaggacctactatgtaatcaccaaatttctggtggaactgaacccgaagccatgtgattatattagctcagtaagggacacagtactgtggcctggagtgcctggggaggagtgtattacaggaaggaagtagagactagaagattcaagttggctggctggccaagaaaaatggagactggtggagaaggagtttgtagacggtgtctttgggaagtcttaggagaacatcccattagggtggtagggttaagccagattgcaaaagattgtggcataagcaaggaactttggtgtggagaagttgtcatcacaaagtcattttgaaatgtcgaaggtttagcagttgttctgactgtatgtcacattttaaaaaataatggtagtggccaggtgcagtggctcatgcctgtaatctcagcaccctgggaggccgaggtgggtggatcacctgaggtcaggggttcaaaaccagcctggccaacatggagaaaccccatctctactaaaaatacaaaaattagccaggcgtggtgatgtgtgcctctaatcccagctattcgggaggcttaggcttgagcctgggaggtggaggtttcagtgagccgagatcgtgccactgcactgcagcctgggcaaggacagagtgagactctgtcgatagatagatagatagatagatagatagatagatagatagatagatagatagataaagatacataagatagatagatagaggtagaagagagccagttccaagatgatagactgtttttatagattgccttcctcctaacacacatttgtattctctctctctcccccaccgcattattcagcgctaatgaaagtgtgatggaaacagctgctagtgaatgaatactaactaatcctgaaaaaaagatgtgtacttcttgaaattttagtttgatttacctgaaaacatatacagaaacacaactagtgatttcaaccaaccctagagttttaatagtaaaatgcttaggaggaatgcatttgtgtaaatgtaatatgagagaggaaaccagacacccatctttgaccaagattgaatctcatgcatttttgtcacttaagtctgcccatgtctccatccaggacctagttaacccttattgcgtatcctatggtacaggaaaaatgagttattagtaaacatggataaattttagaatcatgaagtgtcaatgctaaaagagaacttgaatgtcatcttggccaactctcacatattaccaacaaggagactaagatccaggcaatataatggctttgttctccatcagaatctttctttccttttttttttttttttttaagatggagtctctctctgttgcccaggctggagtgcagtggcgtggtctcggctcactgcaagctctgcaggttcacgctgttctcctgcctcagcctcccgagtagctgggactacaggtgcccaccaccacgcctggctaattttttgtatttttagtagagacggggtttcaccatgttagctaggatggtctcaatctcctgacctcgtgatccacctgcctcggcctcccaaaatgcttggattacaggtgtgagccaccacatcctgcccagaatctttcgaagttgggaaatctttgtttagatctttgttgcagcagatttggtatcaaagaaagctatctacattaaattaatttggagggcacaccctactacttttctacgggcaataacactaattaatatctaaagttaaaggatgtattaaagaatgaatatggtaacctttgcaaggcactcttcaatgtgtttttttctgtgtttccttctatgtgatttaaaatgttagtagatttctctgaggtacttcagggagataggaaaggagcttttgccctcatagatacttggaaataatatatctattttctttttttaatttcaaaaatgaaattattattaaaagctctaaatatagcaagaatataagacaaatagtatactgaacatccagcttcaacaattaatcaactgtgtcccatcttgtttcatatctgtcttcccccacattattaattatacttttttctacccttagcttaaaaaaaactttattgaggtatatagatcataaagtttatccattttaagtgtaaaatttaatgatttctagtaaatttatcaaatagtgcaactttcaccataatccagttttaggtcattttcagcactccaataatactgcacatacctgtttacagttaatccccatgcccagccccaggcaaccactaacctattttgtgtttctgcagattttccttttctgaatatttcatataaccgaatatacaatatgaggtcttttctgtctgactttgtttacttagcatgatgtttttgaggttcattcatgttgtatcatgtatcagtacttaattcctttttattgctgaatagtattccattatatagctatatcacattttgtttatccagtcttcagtttgacagacatttgagttgtttctgctttttgtctgttatgaataatgctgccattaatatttgaatacaagtctttgtgtgaacatatgtttcatttctcttagctagatatataggggtggaattgctgggtatgtggtaaatttatgtttaactttttaagaaatggacaaattgttttctaaagtatctgcaccattttacattcacatcagaaatgtatgagggttactatttctttatatcctcacccacacttattattatctttttgattatcctacatcctagtgtgtgtgaagtgatatctcactgtggttttgatttgtattcccctgatgattaatgatgttgagcatcttttcatgtgcttattagttattcctgtattttatttgatgagatattgtgttagtctgttttcacgctgctgataaagacatacccaaaactgggcaatttacaaaagaaaggtttagttggacttacagttccacgtggccggggaagcctcacaatcatggcagaaggctaaaggcatgtctcacatggtggcagacaggagaagagagcttgtacagggaaattcccatttttaaaaccatcagatcttgtgagacccattcactatcacgagaacaccatgggaaagacctgcccccatggttcaatcatctcccactgggtccttcccacaacacatgggaattatgggagatacaagatgagatttgggtggggacacagagccaaaccatgtcagatgtctactcaaatcatgctcattaaaaaattgggtgtttgtcttattgttgagttgtatattctgtaattctttatatattctggatacaaatcctttatcggatagatgatttgcaaatattttccacagtctgtgacttgtctttttgttttcttaatgatatgttttgaagtacagaagttttgagttttgacaaagtgtaatgttaaattttttccttttggattgtgcttttgatgtcatatctgagaagtctgcctaacccaaggtcttgaagattttttcttgttgtaaaatttttatagttttagctcttacgttaagatcttgaatccattttgatttaatttttgtataaggtgtgaggtaaggatctaagttaatctcttcgtatatgaatatccagttatcccagcactatttgtcaaaaaatactctccttttcctgttgccttggcacctttgttgagaatcacttgtctgttaaatataagggcttatttttggacactgcattctgttctgttgatttatatgtttatttttatgctagcactatactgaatgttttttaacacaggggagtcatacataatcttgcaaagaggtaatcccacgactcagaagtctttaagtatttgctacaatggcatattttttagatagtatatagtagcttatttacttcatttgtggtttgtagcatgttcagaaggatcctttgagctccttgaggttgcagtacttctttgctttgaagccttctgtcatgtttattccctgaatgtagaataccctctgtctagctgtttatcctccatctctgcatttttctgctctacctgccctgtaggttcaaaatgtggtactgattactgctcgatagtagccttgtgtccttggcaaggtcattttatttctccaggtcttaattttctcatctgtaaagtgaaagaatcagattttatctcactacttttctaaactctgtcgttaatattttccttgttgaacagttacaaggatgtgtaagttaatctcttttaactggtgaaaaagtatattctgttccatagagaattaaatgagcttgtatttcggggggtggtgtgtggtcatcaggggatagaggcaggtatttctggaaaggtgttcttggcaaacattttgttacatacactggtgtatatgacatacatgtccatcactgtatgctgggtgatcaagagatatgtataaggtcatacatgcttttatgattagaaaggagagaaagaatgaacaatttctgttacaaagaaatagccatttttatgaacttgccaagaagaggaatggtccttactgatgaaatccttaaagctttgcatgtggctctttacttgattgatatttaaaagtataggtcccactgggaggctcctttcaacattttccattccttgagtgtttttcccccctttggtattcgaatgcttttattttcttcacataaaatattcctagttaggggggatgggagcccctttccacagctgaagttattccaagttttgttccccctgaagaatcggctctctgttcctgaagctttcaatggccacatctgctgctttatttccactcaataagttggaatatattttcatttagttattgattaggggctatgtaaaaatctgaaggaaattagtaaatagtaatgtttatgaataacattttacctagaaatttctaagcgtaatgaaataagaggataaaaattgttagaggttggagttttggatgaaggtaccaggaagcagagatccaataaatcagtatcagaatctgcatgtctttcaataaacttaagaaattgttttaaacactaggaattattagtctgtcttctgaatttaggattaaatgacagtttcttttcctgaagtttttaatgtggttttcaggattggggtatttattattttcctttggattacacttataaaaatttttggctggacaaagccttgctgatacctagtatcccactttattaactataacacttgacgaataaacctgcaattgcttgacgaatatggtcactttttaaagtatgtgggaacaacattcttctctcgtcttcttgccttcttttccctcccaggaaagcagttgttactattaacaagtatattgtcatcttttgcaactgcacactagattattcagctattttttttcttttttttttcctttgccttccaccatgcgatcaaagtattttttaaatttcactttgcatgaaggtgtactttttcttttgactgattagggcatactggataaaatatttggatccaattttaagtcaagagcagactgaaaatattgtaagagaagatttttaaaattaaatttaattccaattttcaaccactgtgtgagtacctactaaacataaggcagtgtgtttaggtgctgtgggagacaaaaagatgaattagacagaattgatagaatgtagctagattaatatctcccaccattaaaggaaaggaacacagaattataaatgcaaggaagagatttttcagcagcaaccgaacaaggaaaaatgcatgagttaatgctatatatatatatatatatatatatatatatataattttttttttggaaagagtggcaactgagggaaacctgaggctttgggtgcacttctgactctgcctgcttccttgcagaagctgtgtgtgtgagtaggcaaatcttgagagttctcatcgagaccctaggtctagagcaaagtgaaatgaatgagtactcgtaattttcctttttcttgactaagtggaaatgacttcaggaaagagagttggaaaagtaaataatcatagctgatatcctgatattgtagaggggaaggcccagagcttcatgctgaactggggacaaactgaagtctgagaagttcctccaaggccattgatagaactccaagacttaggagaatgcactctgctgcagggttttaaaatgttgattattttggtatttccttcgtaattctaaatagcatatttgtgtaacttcttgtagacttcaatttttgccatcatcttccctcccccattatctttctcctccacccttccaatatagttatattataattttggttagattaatatttagtgtttatattattattgttatagccatgtaagacatatagtaaattactttttttttttacttgcacaggtttttgtttgccttggagtgaataatcaacttgtttcttttcaaagtacttgcccttgattcaaccacagacgtcttcaattttccagagttcctcttatgaaattctcacacctcaggtgttctgtcagtttcagctttttgaagcaatagaaactgattgtcttcaatgcctggtacatagttttcatcatgggatctctctacactgtcatccaaggattcccttcctctttttcccatgttggatttcttttattactgtatcctgtgtctttctctttctttgtttactttcttgttttggtgaagcacatccttcagcagcttccttagaaagggtgcatggagctcaatttgagaccctgaatgtctaaaaatgtatttaattatatcatcatgcaggctgctagtcttggatatacaatcatcagttggaaataagttttctttagaattttgatggaattgtgccaatggattctagcttctaatgatatatgaagaagtctaaaaccatttggacatctgatcctttgtatatgacttgctctcttctcctatgccctgctgaaaacttgtaaattattttgactctagtactttgaaatatcatgatataccttgtcatgagtctgttttcttccattgtcctggatattcagtgagtcctttaaatttagaaattcatattcttcatttctgggaaattttattgaaccatttaattgattatttttcctgctgttttctctgtttctctttgtggatcttttatttggctactaccctattttctggaagatttcctcagattatttttgacctttctattctctttctgctatcttttaatttccaagtattctttttgttttgttttgttttctgaatgttctttgtaaatagcatcccattatttcatcttagcaaatagcatttcttatgtcttactgagactttctctggtgactctagttaaaatttcatctgtcactctctaccccattgtctcttttctcagtagaatatgagcttcataagggtatagctttttttttccctgtttttcccatggatattttcccaataccttgaacaatacctcccacatagttagtgtttaaatgtttctggaataaacttaatgatcattctgatgatattaataatatatattttaacgttttctcctagtaaaggtctagtctgtttctttgaggtcatttcttcctgtttttattgatccctaccttaggttagaacattttctgcagatatctggtaatacttagtcatccacttatatttaataatgaaggataaaaagttgcttggaatatatgagcaaattgatggaagttgccagctattggcttcatggtagaatggtctggccaggccatcctgttggagatcccttgatatcaactctttagatgtctcttcctggctgatctgattctctggaacacattctcctaatctctagaaggaagcagcagtctgggagcagaagggaagaaggctggaagaatctcagcatccaaagtgcatatttttactgaatctgtctgttttcagcatggccctcatgccttcatctgggcctggtgccttccctgaaaagaaaactatatctagcattttgctggagtgagaaacatgctgaaactgtgcagaatgtgggagaaaaaactgctcctaaactgcttcaatcagtctttttttttttttttaatgaggatggaacataatcctatagattttaagatagtttaaagaactatttgttgatcacttactgtattttgagttatcaggtgagacagatataaggcatagctactacagcagaggggactgtaagagtagggcccctgaagccaaaaacagcatgaagaatagctagaaccagatcctgaagggtcttgtcaaagtatgcccttttcctgaagggtaggaaataaatccactattagttcattgctttaggtttttattgctttcctcattttacccctacattcagaggtgtttgatgccaccaattcctgagaactggggggcttctgtggtacaaatttgttactccctgctttctcagatctgtctagtcagctattagttgctcatctgttttcccagttccaaatttaaacaagagcatttaaacagttctcttcatttttgtgttaatgagttaagagtgagattagttacatgtatttgaactgctgtctatactcaaaagtctttggataggacatttaataaaacgttgggtcatacacaagaaacaaggaattttacacagtatcaagccaagattttagtttaaagtggtcccaggttgatagtaccctcagatttctggcagaagcgatagagggaagaggaattcactttccacatgcctcaaagttttcctgtcggtaaagttccaaggaatttgagtttagagtcacaggttgctaagcacactaggaaatgaagcacaatgagcaagaacaaacaggaaatacaaagccctcagatactgaaattatataaatatgttgaaagaaaagaggaagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtcgtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaagaggaagaaaatgaatggccaagaaattataaaaatgaaaaaaacattttcaaaaaagaccaaatagaacttctagaaaagaacaattctgtaacataaactcgaagactggattttgttagacattaagaacgactaaagagggaattggttacttggacagtagatcgtagaaaattgtctagaacacagtacagttagaaagctcttgaaggagaggggagagaaaaatggtagaaatacaacatttaaagaatcactgagaattgaccaaaattaatgggttgctacatggttcagaaattccagtgaagctcaagcaagtgataaaatgatggtagagaaatacatgtgcagacataggataaagtttgatatttcagagtacccaaaacaaagaggagatcttaaaagcaaccagagagaagatgggccatctaacaaaagagtgatttgactgagagctggcttcttaatagcaatagtagaaaccagaaggcagtggaatgttaccgtcaatgtgctgggagaaaatagctgtcaatttagaattctatacccaattaaatcctctttcaagaggggaaaaatgacttttcaatcaaataaactaagtttgctactaatagacttctcaattaaggaaattctaaaagacatactttagacatcataaaataaactgtaatggaaattaggaagcttttagcactgagtgataatatcacaaataaaaacctatgatattctactaaagaggtacttggaaaaaatttataaccctaaatgcttacattagaaaataaaagctacaaattagtgaactaagcaaccaatttaagatagaaaaagaacaagatatgcccaaagaaagtaaatggaagaagataagcagcattaataaaacagaaagcaaacatacaatacagaggctcaaaaaagttaaaagttggttttttgaaaagagtaacaaaactgacaaatgccagctgagattagtgaaggaaaactggagtatgaggaatgggaaaagacaattacacatgcagagattaaaataataataagaggggggtatggacaccattatgctaataaatttgaaattttaggcaatgaataaatgcctagaaaaatatcatttatcagaatcgacttaagaattagaaagtctgaaaagtcctataacaattcaagaagcagaatcatagtttaaaatcttgtttaaagaaaactccgggctcaggtggctctcctgggaaaatttttatttgatattcaagaaaaaatttccaatcttatacaacctatttaagagtataaacagggcatggtaggggtttgggggtggtgctctccacctgaatgaagcataatagaggaccatatgagaaaggaaatcacttgcaggtctcactcatgaagatagttgcaaaaatcctaaacaaaatatcagctaaccaaatctagcagatataaaaaacttaccaagttgagattatcccaggtctgcaagggtgttttaatattagacaatccagaatgtaatttaccacattaacaaattataaggaaaaaataataccataatctcaatggctagagttacagctctgattaaaatccaacaacaaattatcctgaaaagaagtctcaaaataaggataggaattttcataataatctatttttttcagggattatatatctatagttttattaagacaaaaactgagagtgtggtgtgaagtttacattcaaacaaagttttcaaagaaatctaacacatgcctaaaaagattttacaatgtagctctagatccaagtctagataatatcaagaactgatggatctcatgactcaagacagagcattttgggtatcagttacttcttaggatttgttaaaaaatggttttgtgtgtgtgtgtgtgtgtgtgttttaaagtgaaccactgcccagtatgaaagtttaatctcctgagaccaaggcttttgaaatcactcaactcttgagtcaattcagtgaaacttgtgctgtcagtgactgaactctgccaccaatggtttcagagttcaaagctcaaaagagaatggctccaaaagttgtcccaactaagagcatgggccctttacttccctcctgtcttatctcctctaccaccctctttcccttccccaacacctcagccagtggctaggatgaacaagctgatatttataactttattattggaaaagaaagggtcttctaatttcaggaattagcacctctgaggcagaatgatctgcttgtactgtatactctccaataaaagaccttccttcctcagtcaatttccatctccaaaatggcaactctggtaacttattaactggcttagtcctttgtgagactaagtacattaagtttaggcagggaacaccatggcttatagatttcagacattcacagcttttaaagtctctcacagtccgtatttatggtgccagtgacatttttttcaaaggtaaaatattctggacatagaagcaaatcattagttttctgttctttgcattgcttcaccatgtcccctatcaggccccaaattttaatcaaaatgatgctacccatctccctttccaccctccccattcctccctctcccacataatacaccagtaatagccaaaaactacacatttgctacgctgtaaaaatgtagagttaacactattgggaagaaagttgtgcgttgcggagatgctctttgattatctacagtatttttttgctctcccacacacccagttctgcaagttttgtccttcataaagggccctttgctttttctcagcaaagtgcagaaaaggttgccttgaagcacttatcccccttcccctccactgggacgggtgtgcaaactatacagcttggaatggctttaaaacacttgggctgctgcagggcacagaaacgatactggctcttcaaagggcatcttctcaagctacctctatggtgtcaagacaagtagaacttctttccttcccacctgaaacccacagtcagatgtgatagaggctggtactcaggagagttaattcttgtcatcatcctctttggggtaggaatgccacgtcagcctttcctcatagaaggatatgacaacccgtgggcatttgacattgacttccttggcagggacgaggtcagcctcatcagaatttttccctttcatcaggaacatgagctctccactggagtctgtagctccaataatctgctccggctccaaaccctgagcaaagcctcgtggcttttctgactcttctttcttcttctttggtttgctctcctctcccttatcttcagaatcagaatcagctttgtgcttgcctccctctgatttgtctatctcatgtgctgttttctgtgacggcagaaactcatgaggtcagggcaatccaagttctcttctgactcccatgtgttgtcctcatctgagaatcccttccactttaggaggtactccactttgccctttaccaatcgacggtagagaactttttccaccacatattcctgttcctcctcttctagcacctcctccactttcttcttgttttgttttttctccatagcgtgtgtgtaaagggtgatgctgctcagagcagtgcccaggagccggaaaggaatcggtgctgcgctattggcgcattgggtcggccagggcagtggcgctcagaaaagcagcaagggtagctgcaaaggagccccttgctgaaatggtgtaccgcaggcctcggctaatggccctcctctcagccgaacaaaagagccctgcactctgtgctgcccactgcccactgcctgcaccgccttcataatctattaaagggtatctacaacatacctacagcaaacaccaacaccataccttatggtgagctagtaaatgctcccctttgagatcaagagaagacaagaatgcccattatcaccatttaaattcaacttttacagtagataattctaactaggtaagactggaaaaataaaaaacgtggcaaaggtactgaaaagaggaaacaaagctgctcttagtatttgtttaatatggttgggcacagtggctcatacctgtaatcccaacactttaggaggccgaggtgggaggattgcttgagcccaggagtttgagactgcagtgttaatgatcatgccactgcactccagcctgggcaacagagtgatatcctgtcaagtataatatttttgatataaatgtgggggcttccccccaaaaaatgctctcagaatttaatgaggaaaataacctatgccaactcttgtttttttttctttttctttttctttctttttttttttttttgagatggagtctggctctgtcacccaggctggagtgcagtggtgtgatctcggctcactgaaagctccacctctcgggttcacgccattctcctgcctcagcctcccaaatagctgggactacaggcgcccgccaccatgcctggctaatttttttttgtttttgtatttttagtagagatggggtttcactgtgttagccaggatggtctcgatctcctgacctcatgatctgcccgccttggcctcccaaagtgctgggattacaagcgtgagccatcgcgccaggcctctatgccaactcttacaatgagagattcagaatgaacaacggacacatacctgtgatactgttttgttgcttgaagctcaattgtgagaaattaaaacaattccatattaaatggcctcagtcttttaccctatttcttcttcatatttggggcaatttctgataaaccacaataaatgatgttgtaggtgacatgcttttatctaaaagtgtattcagaaatagacccacacatcatcttttacaagagcagggcatttgtctttaaaaaaaattaaatcatacaaaagaacttaatgagatccgaatcaggatctaaatactgtttctaataactctcaaggcagtgagtagggacagtcagccacagggctcacctggttggttcctctctctcaggggtcactgtcttttgttgcctgattttctagtgccttgaaaactgttgtttcatatttttttttctatgtgtttttggttgttttaaatgggtgggtaaatctctctgttacttcatcttggctggaagcacaagtcaatttaattaaatggctcatcatttcttgtatagtcctcttttttgttaataaggagttgttttaacacacgttaatacaattgcttggcctttcccttaaagtttgcgtagatttattttattttattttatgttatgttatgttatgttatgttatgttatgttatgttatgttatgttattttattttatttatgaatgagacagggtctcactctgttgcctaggctggagtgcagtggcacaatcatggctcacggaagcctcaactcctgggttcaagtgatccttccgtctcagcctcccaagtagctgggactacaggtgtgcactaccacgcctggctagtttttgtattttttgtagataaggggtttatccatgttgcctatgccagtctcaaactcctgagctcaagggatccgcctaccttggcctcccaaagtgctaggactacagcatgaggcaccatgcctggcttgtttcatttgttttgaaagtaactgttaattttaaaggtccaatctgtgaggatctaaagagtaggagccctgagatgaataattcctgaaggctttcagcattctctcctgctgtgtgctttgttattgacagctgttcaaggtctcaccacctctggagttttaacccaccgatgtgtttcataaattttaatgaaagacagatagagagaaatcatagataggccaacatgattgtaccatatccatgcactggctcaaaatgaaaatctctgtgatattaccctgagttacatttgtggaacacaccaaactccgtcttctagcttgtctgatccagctagctaagggaaatcaaaagtaatttgcaaaatcttttatgttcttttatgttcttggtacattgctctgatttattttttaaggcacagaaaattgtccaaatgcatagtacaaatttgcaaataaactacatatagttatttggacgatggtgtttttctaaggagttttgtaaagaatgtggtttaacttgccagtgtgtaatgctaaacttatttcttgtgtgttattatgaactttatttataatttcatagcagctgtttattttcattgctaaggtacaattcagatgttcttggcttaactcagtattctctatctcacaaaatttaaaattagactgatactttgtaaagattcttcagatgtggccagattattttaggaacagctttagttatccctgataataaatattagggagagaaaaagaaattgaggtctttgaagaatccctaaatatcatttcagtctatcactgtcagcctccctcactgctttcagatccattcccaggagcatttacagggtggccaagcttcctcatttgggttccagctctcttagtttctgtagcctactcattgagctaatgagcagtgtagtggctgagagctagggagaaatatgagagaaatcaaagaagaccctttctgacttttgccctagattgtttgaaacgaaataacattagaataatgaggaattgaccacctttcccttgctgcgttttaggtgtcttttctgtaccattttattatgtcgtcttaatcataacagcctacataaatacttgagtttgggttaggatgacaatgaaaaagggattagaaataacgtgtactcttttttcttaagccttcagaaggactgtaaaaacttaaagatgttaaatgcaaatgccattgccattccaagttaacaagcataagagttttttgttgtttatttttggggggtgatccttaatagtatgtgtttttcttttcagctaccaagtcaggattgttacccccaccacctgcgctccctccaagaccttgtccatcacaggtaggagacatatttgatttatgtaaactgttcggtggtagggaagttgtcctatcgctgtgcttctttgcaagggttgatcgccacagatctggtccatgagattcccaagctgataccctgtgaagagagcagagagtggtttaatttattctcatccagccagctccccagcctcatgtggaagagagaaagtttcctcaataagccaccaagcatacatatactagttcactcttggctgtccaggggtgcgtctgttttcatccccagagaagggtagaagaaggggcctctctctaattggaggtggagacatggtttttctgtatagtatgtgcaatctgggtgcctatattttcgtcagtactttaggagctatgttaattctacataaatgaaaaataaatggttatcaacatggggttagtgccgtggttttggcctatggtgctttctgtaggatggtatttttcctcagaacaaaaagctgagatagcaggagggggagaacatgtcaccaagatctgtttcacccctaaattaattctgccttatttacatgtgccactatggccttattcatcaacactttgcagagctgaaaatgagaagcaaacagtggagtgtggtatatggtgctacagatctttccttttgttaattgctgctgaagaaactttctatctttaaagaccctttctgatttttggcagaaaattttgggaaatttctctgtacacagtccctgtttctacttcattgttctgggtggttcagagctatccttccatacggggacatctcaggactcatgagtcactgaaaccacttttaacacatgcttgtccttctttcagtgaatgaaatggtttttagcatccactcaaccttgagatgcaaatactatgagatattggcttcctgctttagtgcgaagggtaataaaaagcccatttcttcctgacctgcatataaaccagcgagaactcctttccaggatgtaacattggccttaagagatattggttgaaccgtcaacaagtatttattgagtccctgctgtatatctaatgccaaaccttagttttgccctaagcctttcattggctgtaatttcttctcattcaaattattagctgtgtctgttgagcatctccaataaatcaggcattgtgctaagtgctttcagtgcattatttaatcctcacaaaacccctctgaggtagatacaggtactaatattatcccttttttttttttaacagataaggaagttgaagtatatgggggctaagcaagttacccaaggtggcatagctagtaaatagtagagccagctcccaaattgcaatctgtctcctaaaggctcctcctgtcaccatcactggagtctgagtgtctatgtgtacagccagacagcagatccattacacttgcaatggaggctttcatcacaggcccctaaggaggaccttgatgagatgaggctcctgctccacaccaacagcaaacctggacttggtcacaacaaaatgagcaggcatttgctagctgctagttcaagcctggggcttgagagccacctggttgaatgcatggaagacctgtctgaattgacttttgtaaccaaccttctagctttctcttcctgcacaaatgccagtagttactacccggtcccaaaatatgctgctgctatcagcagtcttcatctgagctgcttgaggtgggcttcttgcctgcttttggagcttagtcaccaaagatctgactgggggatctgggaattctctagtcactgttaatgaatgagtctgcttctttgtctaccagatttcccatcacaatataaacagtgagcccagtactcagcctatcagctgcctaactatggagatttcagatttcaggaacaggtgtgtaagaaatggaggcagaagatccacattccatttctctcccctattccctcctttcacccactgtaagtgggacacacatattcagatatatgaagtcctgggcaataaacacatggttatatttagtttttgtgccatgtcaagttggtattgaccctatgagcgtcttactaaccactttgtatgggacacctatatattctagtctttcccaaactgcttgtgataaaacagtctctgggagatattaatagggctctgtggtacagatttgcagactgctgcccctctacccctctgggagagtcgctgtgcaagtgagctcactaaaggctttggaggcctacagtaagtaaagctagtaaattttgttaaagccagcaatttcctagcttctgtgaccattgatatctttatttataaaatacctgttaggatacaaaatcagtgtgcaaaaagcacaagcattcctttacaccaagaataggcaagcagagagccaaatcatgaatgaactcccattcacaatcactacaaagagaataaaatacttagaatacagctaacaagggatgtgaaggacctcttcagggagaactacaaaccactgctaaaggaaattagagaggacacaaacaaatggaaaaacattccatccttatggataggaagaatcaatatcgtgaaaatggccatactgcctgaagtaacttttttttttttttttgagacggagtgtcgcactatcgcccaggctggagtgcagtggggtgatctcagctcactgcaagctctgcctcccgggtgcacgccattctcctgtctcagcctcccgagtagctgggactacaggtgcctgccaccacgcccggttaattttctgtattttttagtagagacgggatttaactgtgttagccgggatgatctcgatctcctgacctcgtgatccacctgcctcggccttccaaagtgctgggattacaggcatgagccaccatgcccggctgcccaaagtaatttatagattcaatgatattcccatcaaactaccattgacattcttcacagaattagaaaaaactgttttcaatttcatatggaatcaaagaagaccccatataaccaagacaatcctaagccaaaagaacaaagctggaggcatcatgctacctgacttcaaactatactacaaggctacagtaaccaaaagagcatggtactggtatcaaaatagacatatagactagtggagcataacagagacctcagaaataacaccacacatctacaaccatctgatctttgacaaacctgacaaaaacaagcaatggggaaaggatcaaaggtcaaaataaagggctctattttaaagtgaaatcaggttctgataaatttatcatttgccctagataacattgttttaagtttatcaaggttgaatattcaagtggaatgcttgttttgtgtaatgtatttttcctttgttaactttggcagtaccttttactgtatgttccctagttatagaatcggttcatagattgctcagagctactcatatctctggattcatgtattatgaagaaacaattctgtttcagaccagcttgtgttgattgaatctcaagttttggaagttctcttgtgaggatttcttaaatttgaaaactactattctcaagtagttagggaccataggcacacactaccaaacctggctttccaggttttaagtatgtaagaaaaatgagtttgtacatttgcaatatgcatacagagatatataaagattgtttctacatacaccaaaagcatatattcttttatcaaatgagagagatgaagtataggttttcagcataacatgcagtttagctggctcatacttattcaagcaccactgtgatatgaacatctggattaagttatacaaatggggccctggagttaggaaaaggaataagttaaaagaaacatctttttatttttcatactataggtaagatcaagaagaacctagtgactatatacaaaattaagtagtttgtgtttcacattttcctgtggcaagactagagactagggcatggtcttttggctcagctcagaagaggtgacttttttttgaaaaaagacttatttatagcataaataaccaaaaagcaattaaagtaaactatttcatatagagcagtgcattcttttgtttgtttttgttttgttttcttaagacggtctcgctgtgtcacccagactggagtgcagtggcatgttcagggcttactgcagccttgacctcccaggctcaagtgatcttcccacctcagcctaaagtgttggggattacaggcgtgtgctactgtgcccggcctagagcagtgttaaagtgagagttaaatgtattagcccactgtttgtatcattttaataaatccagtaaattgccatctgtagagtttgtgtttattcttttttttttttttgagatggagtttcgctcttgttgcccaggctggagtgcaatggcgcgatcttggctcaccgcaacctccacctccccggttcaagcgattctcctgcctcagccttccgagtagctgggataacaggcatgcaccaccacgcccggctaattctgtatttttagtagagatgggggtttcaccatgttggccaggctggtctcgaactcctgacctcgtgatctgcccacttcagcctcccaaagtgctgggattacaggcatgagccaccgtgcccggcgagtttgtgtttattctgtaggtcagttctctgccaagggactgtttggtacttcagtagctaagtccttttaatagtgttgatctcatgacagttttcttatggcaattgtgatagagccacagcttcagtgtaactataataaagaaaagattttgggggtgcaagacattatcttttaagttttctattagcaccacatttgataaattggggttccctgcagactaatgtgctcagaattttcctatttctgccactaatttctcaccttatatgtaacaaagttttcctcactagcaatgtaatgagtactaaaaatagcactggaaggtgaaagcactgtgggagaagcatttgatgaatacctttaagcttagagagaccaagaagactcatggaaggggtgagatgaccaatgaaattagttttaaagaaacaacagaactttttttttttttttagctggctaaaagatacagagctttactgcagatttaaaaaaaaaaaaaaaacccaaatgcagagaaacaggcttgcaagaggtcctggtatgtttgaggagctgcctgagatttggaaagccagattgtagggaaaatggctgtagtgttctggaagtggccatggggagcaagcctcctgctcacttccagttccagttctggtagggatgtgggagagaaacagcccctaccaaaggagttctgtctggggagcagaaactgacgggaggacagggttttagcctagtggttctcacccttggctgcacagtggaatcatctgggggagctttgaacgtgctgaggcctggagcccctcccagagattttggcatggggtgctgaggtccggccactgggaggtttaaaaacctctccaggtgattctgaagtgcagccagagttgagaagcactgaattagggcaagaggaaggaatgctcagagaagaggttgagaatatagggaattttattgatgagttcttatagggcacaatgaaaggggttctggagttggggaggcatgaggtcagcttaggggatgtactcagaccctatggggacaagaactcagatcacaaggggcctgggagtcaagggattcttgtggtgactgatgtgaacagggctagaggatgtgacaggaaggtcctgctggaagaactagtcactgtgtgcctcaggtcctgtgtgtactactgtgagaggctagccatgaacacagatggcctcaagaggaaaccagaacaactgtggtccattgagttaattcttcatctaacttcataatctggctagaatcaggtcctgaaagtgatattgaacccaataggaatatggcagtcatgctactctttttcaaagactaattttttagacacaactttttataaaatactacatttgttttatttggaagtaaaaactgcagctcacttaaacttaaatggcagttcgtaggccctgaatttgtgaaatattcaacaccattttaaatactctatccttttaattaatatcctgtcatttaaattattctttccacaagttaatacacagttggtgattcaaaatagtaaattcttctgggagaaattaagagttttagaccacacatacttttttggggcaggggaaggaattcctggtgattatgtaagtctcttacagggctatctaatccatttttaagtgttaattttattaaagcataacatacatactgaatctatttttaatacatactaaatcaatttttaagatagtaaaatgaagtataggttgagtaccctttgtctgaagtgcttgggaccagaagtggtttagatttcacttttttttttttttttttgggaatatctacgttacacttacctagttgaccatctcaaatctgaaaatccaaaatcctaaatgctccagtgagcatttcctttgagtgtcatgttggtactcaaaaagttttgggaggccgaggtgggtggatcacctgaggtcagaagttcgagaccagcctggccaacatggtgaaacctcatctctactcaaaaaaaaaaaaacaaaaattagccgggcggggtggcaggcgcctgtagtcccagctactcaggaggctgaggcaggagaatctcttgaacctgcaaggcggaggttgcagtgagccaagaccacgacattgcactccagcctgggcaacaagagtgaaactctgtctcaaacaaacaaacaaacaaacaaacaataaaaaaagaagaggccaggcttagtggctcacgcctgtaatcccaacactttgggaggctgaagtgggcagatcacctaaggtcaggagttcgagaccagcctgaccaacatggtgaaaccccatctctactaaaaatacaaaaattagcctggcgtgatggtacgtgcctgtaatcccagctactcgggaggctgaggcaggagaattgcttgaacccaggaggttgaggttgcagggagccgagattgagccactgcactccagcgtgggtgacagagcaagactctgtctcaacaacaacaacagaagttttgggttttggagcattttggattttgtattttcggattttggatacttaacctgtattatattgttgtcagctttcaaatatctataagaaaatagcaagaaacattatttaatgtgaacaatagagaaatgtcactgcttttaaaattgcatgttttttttatcaaattaaaactccgtgaataaacaccaaacatcatgaaatctcttgctgtaatatattcaaatgacctcatgtaatatataagtcattgaatcaccttaagatactgcctgttaaagcatatttatgaactttcaaaggtatatacaacatcctaatttttactcatcaaaatacgaatttaatatgtatcaagatagtttctattcatgcatgtattagaaaatcagaaattattccaaagtgaatttataaacgtatatcacttaagatgccaccttcattttcttccaaagtgttactttgttctgtcctacagtgtatgctgtagattagctgaaaatcacaacatgttaatgagtatttcagtgattaaggaaagaagatataaaccaaggctgtaccttcatttgtgatgatgaaagaacatactgaaagctgtaccacactgtgctgaatgtagtaatatgaatgtgtctgtctgtggtcttatccttagtcctgctactgtgtagctctctggctttgtgggaattaagtaagttagtctcatggacctatcgccccttctataaagtaagaagattggactagagggatcctactagtgctaagatgtctgattctattttgtattctctgttcaagaattttttttgtaatatagataaaacttcatgaaacacagttgagggacaagataggttggactaattttctctgctcctccctgctaagtacaactaaaacccccagaaatactataatggaaagaggattttttttttttgagacagggtctcgctctgttgtccaggctggagtgcagtggtgtgatcatggcttactgcaccctcaacctcctgggctgaagggactcagcctcctgggtagctgggactataggtccttgctgccacaccgagctaatgtttttattttttgtagagacagggtcttcctatattgcccaggctggtctcaaattcctgagctcaagtaatcctcccacctcagcctcccaaagccttgggattacaggtgtgagccatcatgcctggccagaacagactttgaaaggtttaaagaggaaagaggactggcatgacagtgaactagagacttcaagtagacagaagaccaataaggaaatagaaagcttgaacaataccatggttcaacttgatataacataactatagaacacccagcatcagcacaatagacatttttctcaagtgcacttggaatattcttcaggatagaccatatgttaggccacaaaacaagtctcaataaatttcaaaagattgaaattatattaaacatcttctctgatgtcaatggaatgaaactagaaatcaataacagaagtaaaatggaagattcactaatatgtagaaattaacatactcttaaaaacacaaagaagaaattataagtgaaattagaaaataccttgagatgagcgaaaacaaaatcatatcaaaacctatgggatgcagtgatagcagtactcggcgggaaagttttagctataaacacttaacattaaaaaagaagagatccaaaatcaacagttagctttacaccttaagaaactggaagaaggctgggcacagtggctcacgcctgtaatcccagcactttgggaaaccaagacgggtggatcacgaggtcaggagatcaagaccatcctggctaacacgggaaactccgtctctactaaaaatacaaaaaaaatgttattctgggcatggtggcgggcgcctgtagtcccagttactcgggaggctgaggcaggagaatggtgtgaacccaggaggcggagcttgcagtgagccaagattgcaccactgcactccagcccgggcgacagagcaagactctgtctcaaaaaaaaaaaaaaaaaaaaaaaaagaaactggaagaaaaagagcacactagatccaaagctagcaggacagaaataataaagagtagagtggagataaacaaaatagagaacagaaaaacaacagagaaaatagttgaaaagttgattttttgcaaagatcaacgaaattgacaaaactttagctagactgaccaagagtataattaagcatgtgttaacctctggtcaaaataaagggctctattttaaagtgaaatcaggttctgataaatttatcatttgccctagataacattgttttaaatttatcgaggttgaatattcaagtggaatgcttgttttgtgtaatgtatttttcctttgttaactttggcagtaccttttactgtatgttccctagttgtagaatcggttcatagattgctcagagctactcatatctctagattcatgtatcatgaagaaacaattctgtttcggaccaacctgtgttgattgaatctcaagagttttggaagttctcttatgaggatttcttaaatttgaaaactattctcaaatagttcgcactgaatgacaaattcaaaaggcaaaggaaatggccatagtgataagtgcaaggagaagagagggtgagaattagtaatgaaataccagcattggaatggaggagaaaagtgtaagcctgtcccccttccttctttttgaaagaagtactcagcattttgctctttatcaataagtgtctttagaattaatcctagtaactaattcaaaagaaaggaaaagttctatgatgacatttattttagtattataaaaataagaacaatacagaccaccttaatatctaggaagaaggcactggtcaagggtaatgtatatctgcctgattagaatattaggcatctattaaaatgattacatgacaaaacagtagaaaagaggggtaacagctgaatacagaggtgtttcctgattgtaccacataagtatatggtagacctttgatggtaaggttttctcatctctgaggatgaccttgaaggtccatggtgcatggtaattggcccctttccagtggtcggatttcgaattacttttacattagccactgttccctccccagtagggttttgagattcttagctgcttagtgaatttctactaactctttttaggggtctaaagggatcgcttaggtgactcatttataatttacctatcttgtcttataacttgtttttataagtttttatattttgggagatgatgtatgtgtagtatttatgtgaattgggatatctgtgaaggtctccagatggttcagtcctaaatgtcaagtgcctactgttaaatacttggagaagactgctaagtaattggtagaagtttaaatggctgttttggtggggaagttatgcagtttttcttttaaaaattttgtcttaaaattaaggattggggaaaagaaaaaaaagtcctctgatatgacaactagaataaaaagtcatttgaagatttaccagaataaaatgacctttggaaactacttttagagaccagctctcagaaatagtgataagacatatattgcataattacattgttacgatgactctagcaattgtgaggttcaaagaaatagtgtactgaagtattatcatctagtcattttttaaatctatgttctttggatagtaaactcttattgccctcactcttaaatagtaattctgctgtgtacagaattttagactgaaagtaatttttcctcagtattttgaatgcattacctcctcttctagcatttattgctgccactgctccggattgtactgtcaatctattttttattcctttggtgcagctttgtctttcctctgggattgcttttaaaagtttatttttactttctgaaggggtgggttgcccctccacacctgtgggtgtttctcgttaggtggaacgtgagacttggaaaagaaaaagacacagagacaaagtatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaagtgctgtgctttagatatgcatacacataaacatctcaatgcgttagagagcagtattgttgcccgcatgtcccacctccagccctaaggcggttttcccctatctcagtagatggaacatacaatcgggttttataccgagacattccattgcccagggacgggcaggagacagatgccttcctcttgtctcaattgcaagaggcatgccttcctcttatactaatcctcctcagcacagaccctttacgggtgtcgagctgggggacggtcaggtctttctcttcccacgaggccatatttcagactatcacatggggagaaaccttggacaatacctggctttcctaggcagaggtccctgcggccttccgcagtgtttgtgtccctgggtacttgagattagggagtggtgatgactcttaactagcatgctgccttcaagcatctgtttaacaaagcacatcttgcaccgcccttaatccgtttaaccctgagttgacacagcacgtgtttcagagagcacggggttgggggtaaggttatagattaacagcatctcaaggcagaagaatttttctcagtacagaacaaaatggagtctcctatgtctacttctttcgacacagacacagtaacaatctgatctctcttgcttttccccacactttcagtgttctgttttgatggcgctgcgatgggtttaagcgtagatttaaatttgtttatgccaggtgacacttggcatgcattttccttctggaaaatcatctttaattttaggacatttagtgatatctctgtgggttttgcttctctacttatttcttctgttttcttctggaactaactatatttctgtcaacacatttaaaaaaaactctagtaatgtgtctttcatcttttttttttcttttttgagacagggtcttgctctgtcacccaggctgtgcaatgggatgatccatggctcactgcagcctcaacctcctgggctgaagctgtcctcccacttcagcctcctgagtagctgggactacaggcgcatgccaccacacctggctaattttttgtattttttgtagagatggggttttttcatgttacccaagctggtcttgaactcctgggcccaagcagtcctcccatctcaacctcccaaagtgctgggatgtacagatgtgagcaccgcaccttgtcactttcatctatttatgttgtgatctttctgggcttgctctggatgaaatcttcatcttccaaattaaaaatcctctgcataactatatagcctagaatttttcctattctgttattaagcctctatcactattctttgattctaggttttataatccattcttttttataacaacctgttcttgttttacttttccctatttttgttttatacccatctattcttttttaggatctattctccacttttaactttgaggattctaaaatacttactttaaagttatttttaacttgttctatttttgtttttgtcaggagcgaatttgccttttttatttggctgttctaccatgctttttggaattttgttttgtaggcttattttgagttggagttcaatctcattctcagttctctgagctcctcactttctgccagttcagtggctgtctctaccaactattcctggcatccatggcctccagtcaagagctgattcttatacttgaaatacagtacttccatctggtgcaggtgtcaggggtcttgtagatggcacccaatggtgcttagcccagaaccaggcttcagtgttatatctgcttcagttcctttcctaagtaggcaacccagagcttctccacaggcttcatcttggttttgcagcttcacaggtagcaaagtgataccttagcctctggcatcagggaatgagcttggtaccagtcccctgcctcatgcgggacatttatttatttttattttttattattattatactttaagttttagggtacatgtgcacaacgtgcaggtttgttacatatgtatacatgtgccatgttggtgtgctgcacccattaactcgtcatttagcattaggtatatctcctaatgctatccctcccctcttcccccaccccacaacagtccccagtgtgtgatgttccccttcctgtgtccatgtgttctcattgttcaattcccacctatgagtgagaacatgcagtgtttggttttttgtccttgcgatagtttgctgagaatgatagttaacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctctgggtatatacccagtaatgggatgactgggtcaactggtatttctagttctagatccctgaggaatcgccacaatgacttccacaatggttgaactagtttacagtcccaccaacagtgtaaaagtgttcctatttctccacatcctctccagcacctgttgtttcctgactttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccgtttcctgactttttaatgattcatgtgggacatttaaatccctgttattaggaactctcagctgcctctgtctgcttctgcaccctctgcctgcttctgcaccctctgcctgacctaccactttgtgatttggccccacagagacctttatcttgcttctgagtgggactgagtcttttaaattttaacagttcatgctaacactctcacatctgtcattgcatatcattttatgtaaggggaagttgagattcagagagcagaagttaactacttgggcctcgcagttggtaagtaagccagcctgctgtagaagaaaagggctggaaaaggtttctggggaagtgctagaaatttaataagcatgtagagagagaaaaatcattcattatacatcacaaaaattaactgtagatctgctaagtaaaagttgattaaatttctacactctgtgcccaccaataattttctaaatgtgaactctttcctacattaatctcaaatgcttatttttaaagtgccttccccagtgcagacttacattcatcttagccaaaatggccttcacatttggtctgtgggacatatttgatgtagcaaaaggccaagggtaacccttattctaccccctaaaagggaacagaaagagaacttttgcataataaataattatttatgcatttcaaaattgattttaagagtacacaaaccatagaggctttgcgattcttcatgtattttattaatttatcaagcacttcaacagagtgcccgatgctcttctagatgctttacaaatattaactcatttaagcctcacaacaaccacgtgcagtgggttctattgctatcctaacattgcagataagtaaacaaggcacagagaacctcagcaacttgcttgaggtcagtgacagaaagaaagagttaaggctatgattcctaccttggctatttagccccagtgtaccagctcctactatactactatgctgtgctgtgaaaccacgtctcacaattattttattaacaatcaaactgacacactatctttgtcagggacacattttatttcatggaactagttaaaaattagctttaactcacttctggtgacttgttttctttcttaggttcttcctcattatattatgcccatgctattgttatataaagctcactctgctggtatcattcttctggaagatgccataaattcatctaatcatttcatcagatgttaacggaatgtgctcactgtaggcccacagtttgctgagaactataggagcacaaagattgtgatgtgatccttatcctgtagttcctttatcctgcgtcaccctctcacagcagtcatgcccaacactatctattctatagtctctcatggttcttacaactgagtcattttctgtgtgtctcatttaaacccatttcttaatgctttattgacacaggttgtaagcaataaactggtcaccatgtttctaataactaccaatatagcccagttttcccctggggggctcagttatggtggttttctaggtttctgagcaatggaatcctcatttctcttctctgctgtcccctatcgcactgtgacttttttttttttttttttttttttttgagaaagagtcttgctccgttgcccaggctagagtgcagtggcgcgattctggctcgctgcaacctccgcctcccaggttcaagcaattctcctgccttagcctcccgagtagctgggattacaggcacatgccaccacgtccggctaatttttgtatttttagtagagatagggtttcaccatgttggccaggctggtctggaactcctgaccttgtgatccacctgccttggcctcccaaagtgttgggattacaggcgtgagccactgtgcacggcccacactgtgactttaaggaagcactcctgagggggtcaggggaggagcagatgtggattgggaggatgcccaaatgtgctactgtgctaatgggaaaggacaatggaggacaaccaggggttgggctcagggaggcagcttgacagaggatttaagagcatgggcttggggtttcaaatcctatctgcctcttactggctttgtgactttgggcaagttagtctctctgtgcctcaatttcatcatctgtaaaatggggatcatggtagtatccattttcatagggttatgatgattaaatgagtgaagatctctaaagcacttagaatgatgcctggtgccatagtcaaccctcaataacatttagctgttataattatcatcaccacaggcctagtgaaacagaggtggggtctagttggcaaacacagaacagactccagatagctagaaattagttgcaaccagcccagaatgagtgctgaagtggctcgctaaagcacttgcagtcaaagcacattgttaccctcatctgtgacctttcatgggctgtctctctgcctatgtcaggggttggcaaactatagcctacaggccaaatccagatggtcacctgtttctataaataatggaaatgtgaaggagaatcaattggcaagaggcacgcatagcgcatcttcaaccttttccatcggggaacatgagtcttgagaatcctgccatagatcaaaagaatggcaatgagaagaaccagtggacaggtggataggcctccccatcagcctttaaccctcctgctcttatctcaaggatcatatgcccgtgtctgtggtttctgatttttccttgaggacctttgaccgagatgatctgtctttcagactttactagcaaaattctgagcagtatcttttatacaactggcagcttcaaaggcttgcagtgggtaggcctccccaactctgtttcgcaagataattaaaagaagccagactccttcatccttgaaggagaggaagaagaaaacaagcctgtccagagaaaatggggtgaaggaatttttctccccaacttcctcctaaataccctgctctgcccatcaaattttgtaagtatcacccagtggtgtgttggtaaaccttctcccctgcggggtgggggaaagccccaatttgcagccgttgttgctgtctgtgttgtgaatgctcccaccatgctgactgcaagtggagctgggaagagatgtgtaccatcggctcactaacactagcatgctctgtggtagacagcttcccttgcctctgaatccttgtgtcaggattctacgtgccaggcaacaagagctttttttctttatgtatcatgccagtgattttagtctagggcactgttttagcccaatcccagaatgtgctattagaaatggggccatatttttgaagttgctaggggcaaaacttccctcttgtttatgtttaacttgtgccactaggtggcactttaaggacattacaggaaatcggctctactggatttttaaaacttttttttttttgagacggagtctcactctgtcgcccaggctggagtgcagtggcatgatctcagctcactgcaacctccgcttcccgggttcaagcaatttagctcactgcaacctccacttcccgggttcaagtaattttcctgcctcagccttccgagtagctgggactacaggcatgtgccaccacacccagataatttttgtattttagtagagatggggttttgccatgttggccaggctggtctcaaactcctgacctgagttgatctgcccacctcggcctcccaaagtgctaggattacaggcgtgagccactgtgcctggcccaaaacactttttattgaagtataattgcatatagaaaagcaagctgcacatttaatgtgcaactcaattttcacaagcagaacacatgcatataatcagcacccaaatcaagaaacagaatattactagcaccccagaagccctccttgtgctgttttccagtcgctatctcttattcttagggttaccactattctgacttctaacagcataaattagtttgacttgtgttctactttatataagtggaattatgcggtatatactctgtgtctggctttttattaaatgatgtttgtgtgatttattcatactgttgtgtgtaattgagatcattgctgtatagtattccattgtatgtgcaaatataacactgttttctactattgatggacatttttgtacttttcagatttgggcaattatgaatagtgctgctgtgaacactcgtatccaagttgttgagtggatgagtgttttcatttctcttggatatatacctaagagtagaatttctaggtcatggtgtaggcatatgttcagctttagtaggtactgccaaacagttttacgaagtgtttgtactgatttacactccattaatggtgttcccactccagttccatgtcctcatcaatgctgaatttattttatggatggttcctaactcttaacataatttttatagctccctttctggccagctatttctaattgaaaaattttaaagccacattattctgatggacatggctcatgcaggaagggctatgtcaacccaaaaggggacatttatcacagtctaagtgtgaactatcagtaagtcggaaaggatgttactctaatactccatcacactgatacacagagcaaagaaaccaggaaaggaattcagattgtaagtgtgataaaatatcggttcataggccagggctctgaggcattttgaaatttgtatatacatttgttattattgccaggcctatatatgtcagagattggggcccaacagaaagaatttctaaaggcctcataatgaagtgcctttcaattgtgctgctggtgggtgcctgttttactaagggtctctttggtttggcaagaggcatgcatggggcatctttcttcaacctcatccctggggagcgtgagtctctagagaatcctgctttagatcaccttacctgtgaggctcatgttgttgactctgcagatggtgttataatatggctttaggtatgtgatatagagagtacagttcagacttgactcagatttctgttccattactagaaattggacatagaagaacaaaacccaggtcatggtcaaaatatttgtcttttagaccaaaataaagtgctcatagtcctttagttgtaacagtaagtctgtctcatggatgttgtccataatctaatgggttccaagaatccccaaggcattctgccatgtgactcttgaatccagcaactagttgcccattatagtcactggtacccactttcaccaaagttgttcctgagcccctctgtcagtgttttcctgagtgtctccagtgttggattggtctaccgaggggggtgcccaccagagatgttcactgcacactgcctgagatatccatgttaaagcagccgtgaaacatgaaagtctgaccgggcttttatttttaaaattttctccccccaatattagtagcggtaatatccagtggcacagatttagactgtggatagcctgctttgtgggatctgcttatattctaaattggagccagcattttctcagcctaggttttcatctgtttggcaaggaggaaaatgcccttatgttggattggctgctgcttgcagtaggaggaactatgcctgggaaaccaatcataattttaatcctaatgataatagtagctgctgttgtcaaacagttactgtgtaattgtgcttagcacactagacagatattttgcttaatcttcacaatattgtgagttaggtgaattatcccactttgcagatgaagaaattgcagctcagagagactaagcatgtgaccagctcacacaatgagcaactgcaaagcctgggtttgactccagagcctatatcctgtaactgttctgtgctctgtgggtgcagttaccaaggaatgaattactgacctcttctccagtggaacatgaaacagtattgggttcattgctggcttattccacacattgattagaggacctgttgtttgctggcatgcagcttaggtatcaagaaaatgatagggaagcaagacagatcctgccctccaggtgcttaccattcgtttatcatgttctgtctctcacaggtgacttgagtcatggattttggtaatcattcttgctgagaattcagtctcttggaccttcttgaggctctatttacccctctctctgagcctggttggggaatgatggggtggaacagtggtgtgctgggccattggttctacatcttctgtgactgggtttagcaaatggctttctgttgtgttcttgcctagcggagatgggggacaggtgaaaactaggcaccaaatgacatttagaatactgacagaatgctggaaaggccctggaggcagcagcaggattgtcttcttgtctgcctagaatttagctgctgcctttgtgatccccattcttggaatccacctggatccttggatgataaagcctgagttcgtttttctgacctgccaatattgcaaacctaaaaaaaaaaaagttacctattatccacaccttggcaaagttctacagatggacttcttttttttttttttttttgagacagagtcttgctctgtcacccaggctggaatgtggagtgcagtagcgagatttcagctcactgcaacctccgcctcccgggttcaagtgattttcgtgcctcagcctcctgaatagctgggattacaggagcgtgtcactacgcccagctaatttttgtatttttagtagagacggggtttcatcatgttggtaggctggtctcaaactcctggtgtcaagtgatccacctcccaaagtgctgggattactagcgtgagccaccatgcccggccagactattttttaagtgggatttgactttttttttggttgcaaatttgacttttaaacaaaatcttactgctgaagattttgcccagctgcaaatatttatctatagaaccatgtggcatatacccccattccctctatgatgaatggatgagaaaacaattaagaagcctagttagttttgcaagagcacctgtggccttgcccagactagggccttggagacttggttttctcatctcttaaatgaagagtttggaccatcagtggttcccagttgatctgggctggctacataaaaatcacttagggtgcttgttaaaatataagtttctaatgccccatccctaagggattctgatgagggaagtctggaatagcatctacaaatctgaatttataaaaagttccccagataattatcctgctctggttatatttgggagccactgggctagagggtctagaacaaacataattaagttagggagaaacttctgatgtgcttgaagatttggggaatacctatatgcctggagcaggttccatatgggcgaactaacccagttatgttgcagaggtaaattggagccagaggatggaagacctttaactggctgagggattgtgttgtgtgccataggctttggggagccagtgaagggctttgagaaaaagcattttgattagatggtgctttaccagattaatttctcagtggtgtgcagggtggatcagagtgcactagaactgaaggctggaaaaagacccagtgaagtctttgcagtggcccaggtgataagtgtgacgagtacctggactcagatgggaccagtgggacctttgtaaagctaacctgcctcagtggaactggaatctgagacatactgttttaaactccttaaaaaatgcataatttattaatgtcatgttcatctgcctaaactattataattaactatttttattgtgtttttgtccaagaggttttaaaggagccctgtaaataaattcatgcaaagaagtagttggcagcagcaacagctgctaccgcagggagaagggacccccttctggccaggcagcaacctcattctcaccctgtctccatactctaagccaaagcgagaggggaggggagtgcaacaggggcccctggagttggatctgccaaccacagtggagaatgcacctccccaagggttaggtgtggaatatggcgtttggcattaagtcaaatagaatattcttcctttgttcctctaaaatccagtctatagtcaatgtttctcaaagtatgttccacagaacattagttcttcaggatgttaatagaagttacatgagaataaggagatgaaaccaaataaatttgggaactgatgggctacgcaaaggcaagtgacttcctttcagaatttcagagtgtgtaatgttctgtgtgctcagtgaatctccaagagggagatagaccaggcagtgtttcctaagcttatctgtagattcttcttccccctaggccaggggctgacaaattatggctcataggcctcatctatcccaccactttttttttgtaaataaagtttattggaacacagttgtgcccattcatcgtattgtctgtagctgctttagcacaacaggagagttgcagagtggctacagaggtagtctggccctcaaagcctaagatatttactatctgcccattacagaaaggtttgctaatccctgctctagacaattcatggaactggtgcttcctggtaccccctttcagagatgctactagaagaagatatacatgggttgttctagcactgctttatgataaatctgcctcattttattctgtttccatactgccatcattcctgcctcttgctttaaactactttatctctcaaccatttacccattatccaggatccaaacctgggttccatgtgtccttatcttttcttgcactcacaacattccaaaaatggccaagggtgtcttcaatttccagtctgggtagctcttaagtcagcccgaacccattcctaccaacctggcctacatgaccgtcatcttttctttttcagcattcgaattaggttccttttccccagatatgagttacctctagtcctttttactcactgaatctagaataacctttgtaaaatacaaatctagtcagattgattccttacttaaaatccttcagtggtccctgtggccctcaggataagctcagatcctcaggatggatgtgtgtcagtctggttgggcaaacagaaactactcctggtatttcgtactggaagagatttaatttaaggaattagttacttaagaaaaggagtagatatttccaggcttctgcctgctgtggcatagagaagggcatggaaatgggggatggtgttgagtgtttagcaaatgacccagaacaaaccaggtctgggaaaccatgtgttatcccctgctgcccttctccagcttcagctctcccatttttctcctgactcctcacccttcctccaccctgcaagtccccaaattctagatatatcaggatgcctttttgtccccccagaaacttaaaacaactgacatttacgaactcacagtctctttgggtcaggaacttgggagtgacttagctgggtggttcggggttacatcctctcatgaggcttctgtcaagatgtcttccagggctgcagtcatctgaaggcttaactggagctgatgatccacctctaagatggctcactcacagggctgttggcaggaggcctcacttctttgctgtatggaccccttgttaggactgcttgggtgtcctcacaatgtggcagctgactgtctccagaacaagtgatatgagagtgagagatagagatagaaacagagacaacaaggaggagcatactagagtgctttcagtcccctctcctgggagtacgttgcatagtgtctcaggtcagcttccctagaagcagaaccctgagatgaggattcttcaaaagtgatttgttgaaggagtgctctttaggaaaaaacctagaaggaggagagggaagaaaagtagggaaggggaaggagccaagcaatgatatagtctcagataaaatctgaccttggcctgatccacacaggcaggattctggtacataattgcataatagagttaaccctgtttgagacaggggactggccttttatatccttctctaagtcagtcattataggctgctggaggtgggggtgggaggtaggctcccattagttgagaataagtctctagagaagagggtggctgtgagtcctcagtagctaacactcagagcagctgggggatggtgtgccagccagggaaaggtgacccaggtggggccaacacagcacctactacagtgggcctccccgtacccatgtcccaagcacctaccatggtccctgacataccagaggtacgaaaaaaatatctgtgtaattgaataaatgaatgcatagaaatgcttagcctctctggacctgtgtccatttctgggaagtcagctcagcagggatcatattgtcccatcaaccatgggaatggtcgaagacccaggacagtttgccacatcatgagtggcagcactgtctaagtccaggattttcattgcaaaattagagtgaaagtatatttgccatttgtgaataaggaagtattaatattacaatattatatatttttaaaaggaactttagctcacatttcagtgagctctttgctaaaagtacattttcctggtttgtcacatcctgactgggtacatgttgttacacatggaaccgtgagggcagaactgccatttgttatattaattgtaatccatatatctgtttttttcccacaagaatcagtcactggatttcagttcagaaaaccaaaactgtcggacaaagccatattatcgtgttggcagagttgttccccatgaccccaaatacacagaggaggaagagaaccactgaggccccttgttttcttggattatcattcttccaaagttggtaactaagaaaagtctcaagaaatagcaaagaaacctccccaccttattctgctttccacatcccaagcctaacataagcctcaaactatttttatgaaggaaagcttattgtgaagagggtcttttacatgcctaaatctcatctttagtttttcttatcacacagccggttatctttgcccatctcttttcctgggataatgtctggctctgtcaaggctgtgccttattctgggaccttcctaatgcctgtgttccaggtccctcctgagattcgctcctccgaatgcttgatagatggatcaatttaggggattgatggtcagatttagcctgacataacaccatgcagtggtctgttaccagacatagagctggaaaacccaggcccttgcatacaagttcaggaaggtaaatttgcaaatgaaaaacattttaagacacatctcacagctgcttcctcatcccccaccctattgtttgtgtttttagagatgtttaagagaaaaggaggcaataacaaagacgctctgctgtgctttggaatcctcatttatgttgaaaaagggtccatttatcatctccttggatatttccacaaggagactttgctcatctcaccagggaatggagtggtagagcaaacacttctctgtccacctgatgatggaggagaaccaactaactgaaaggcagagagcctgaaattattatcctctctctgcctgcctgctgcaagatattgctgcatacctgtggtccctgcaggaggctgcatgcgtagacttgggccagaacatatattaccttccaagcaatagatttctaggtaaaaggcaagaaggggcctcaggttcaagttgcattcttcagtggggttcacaggaggccctgcattcagggggttactgggccctccttcagctgttaataaaactgacttttggctcatagagcttggagtatgcgtccatttgtatgaacctccagggaaagcagggtgagggcttgtgttccctagactcctggcagtgaatggctcctggacagctttgcttggttgtttcccaggtacttcaaactcaatctgcctaaagatgagttccccctcactcctgcttctcctgtgtttcccatcttggggattgaccttagtgttcttgtggtagccctggctgaaattatggatgttggagcatgggaggccctttgtgaacttacttttgggtctttctcaccattcccacacattgctcttttagcccaggcctcagctgagacatcacctgctcctgagtctttgccgacccatgagactgggtgcttctgtattccccatacttgccctccacagtccactgaagcaagttggctttgtcacttccctgttgctcccactagacttcaagcttctcttaagcaggatctgtatcttgttcatccttgagtgccagtgctagcacagggcctgcctgtagtagctgcttaataaatatgtcttgaatgagtaacactcaggcctgagaatacctgagactgtatggcatagtggttataagcttagctttggaaatcaaggcctgtgttcagactctgctatttgtgtgattttgggtgagttccttaacttcttgatcttcaatttcttcaccaataagatggggataataactacttcctagggctgtgatgatgaattgcaatgatccatgcaaagccctttgatcaatgtatgacacatagtaagtgttgtgtgcatcatagtacctattagtaacaacaacaacaatatagttatcgttaatggaagggagaaagctataagaactagttggaactagaagtcaggaatattgagtgcttgcatagtggatttagaggagatggggaattgcttgggataaaatgtaggaacagatgggattaccctgggagagaatgaacagggagggaaaaatgggtggagcaactaaagacagaaccttgagaaatcctacatttgagggataagaggagtcaaaacaggaaaaagagtgaatgactacagttaggagattgcagcttctcagatgccaggggcaggagtttaaaaaagatagtcaaaggtgctatactgggcagaagatcaatgaggagaagacgagaagaggtagccataacgtgttaaatgggggtatgttagcgcccttgggaactagccatttcagtggagtcagaggaagaagccatgctctgaaggaggttagagaaggccacgttagggatgaagtgggcatactaagtcagtttgttgtgctacaatgtgtgtttctgtaatgaggattatctgtgggtcagtagatgactggtgtcagtatgatgtagaagtcacattggttcatatgtagggttcattctcagcacatgaatgttttggcatcactggctactagtggctgaaagcagactaacacacctgaaggcagaagactgggggaaatgggggacatagagagctgctcatgaggcgcagtcaccctgtgttcttccacttgactgattggcacccactctgtcttgaagtgctttggggacattccttgccaatcttggtgagtttagtcactgattccattccactcagcacccttgacccttctgataactccttcgaccacagtcccccttccttttttaagaagggccatatttactagagtttttttttttttttttcccaaactgtgtccaggtttattaaagatactttttgtgaacagtcatggtatttcaggcaggacatgagcgacaatcattaacagtatacaactttcagactccctccttcaatggacttccaaaatcagaaagccatggtaaaacccaatgaagtcttcatttggtaccctgaagagggaaagttcagagtgagggttgacatttcacattcaacgtgctgtttaacaacttttcatgagctgaccctgactttcaggaaatgaaatgaaaatggcagaatttatctgaagatccacaatctagaaacagagcacgtgtctttcaagggttctcgctggaaagtccagattgccagcctgactggtaaccagttattgggggccagaccccaacaggtatctgggtttgagggagttaagtgtatactgaaggcagagagggagagggggaaataaagaggaatttgtttctccacaccacaaggcctttgtgcgaaggtgactgtgtgtgtcaacgtcagacagtccctctttctgggagccaagaagatgtctttaaaactagaagggaaaggtgttttctccacatcagtccagcttcatagacattctttttcttttttttctttcctgagacgaagtcttgctcttgttgcccaggttggagtgcagtggcacgatcttggctcactgcagcctccgcctcccggcttcaagtgattctcttgcctcagcctcctgagtagctgggattacaggaacccatcatcacgcctggctagtttttgtacttttagtagagacggggtttcgccatgttggtcgggctggtctcaaactcctgacctcaggtgatccgcctgcttcggcctcccaaagtgctgggattacaggcatgagccacggtgcctggcctcagagacattctattagtgacatataccccttctccataaaacaacaatgacgtgttccgtgtgctaacaacatggcttaaaataaaggcataaaaacaattctgcatttttataaaacttaataaaaaaataatacttcaaactgcacagtcaccagaaatacacagttatcaaaaatgcacacacttcccttggcatccccagcgccttcaactttctgtgcctgctctgttttggcctctgcattttctgcagagttattcccctccttgccagcatgggctttttcctttttcccctttaccttctctcccttctttgcaggggcctctttaggcttgggcttcggaggagcaggtttggcagacaaccttgcagatcttctctgtggtttgtccttactttggttttatctcctttagcgtccccttcagcctttctcttgggcatggtggaggcgactgcagtggaatgtaggtgctggatctggggatgcagcagtgcgtgggctttggttggcctgggggatagttcttacctcttcttcttcacactgctcatagagtatttctttattagaaatttaacatttaaaaaattcagtgtttttaatgatgttgattgtttttgttggtgctcaagttaaaatctttgttttcaaccctgtttttccgataagccttgttacttttagagtttgttgttgcgaagcattagttttttagcaatacatatgttcaattacagaagaaattcccatgattccttttcctaaggttgaacaatctgggaaggagggatgggaaggttaatagcagcatctatgggaggtttttcccaaggatcagcagacttaagcattcttggctgcaacttggcctaaatcagttttcccttggtgactatcttcctaagtgctctttattgtatatttaggtgattgtggttttgcatttctgtcctctctctgatctcttgctacagtctgaacaagtgtcggaggccgagttactcccacagctgagcagagccccatcccaggctgcagaaagtagtccagcaaagaaggtaaggtcagcctgaggatgctgtcagatggcgttgcgagtcccaccccgggcttcttatctctattagctgatctattgttttaaggtttctgtgtcctgaaatgaatgtcaatgatccagatttcctagaatgtgggttctttgtgaagattggggtcctgaagattcctgggcttgacccttgatgcattttgtacatgacagtacatactcaacctccttagccccccagctaaacatggtggccttgtttatggcaagagctaaaagggctgtggggagggacagatgtctttagcaaaaccccatccacctgctaagcctctgtgaatacctcttggggtggggtagtctctcctttttggtctttgtaccatggtttcctcttgcatcgtggcattttcacctggcatctgcccagccatgccattgggtcacctgtaatttgctcagtaagtacccctcactcatcatgctctccattcatctcctcaccctcttcttgtccttctcccaggctcttctttcagagagagtgggccttgggctcaggagcacaggtgaggtagagtcctccaaagaagcagaccaactgtgtccttccagaatacactgtggctctttttcttgactttatgtaggaattggggataggagaatgatgagcatatgactaagacctttaaaaacttccaaagcttaggtttttttttgtttttgtttttgtttttttttcctgagacagagtctcgctttgttgcccaggctggagtgcagtggcgcgatctcggctcactgcaagctcccaggttcacgccattctcctgcctcagccttccgagtagctgggactacaggcatcttccagcaggccggctaattttttgtatttttagtagagacggggtttcaccgtgttagccaggatggtctcgatctcctgacctcgtgatccgaccgtctcggcctcccaaagtgctgggattacaggcatgagccactgcgcccggccaaaatttaggtttaaaaggcttcaaagtgaggcaggagcctatcttgtcttcagttaggaaaggccccatggtgtgagatgcacacagggtctgtgtgagtttcaggtgacaagaagtaatagacttcttgaaacatttaaaaagaaaaagaaaaaagggaagaccactggactctgatgcctgtgtccccccagttcttgctgagccatgggtcagtaaatagagtaccctcctgatcttggggttggggctaaaggcatgtgggacactggaaggaagagtggagggaacattgaaatgtttaactttttaatttttattttgttttaaatccacaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagtaagtagaccacataaacaagagtgaggtaggaatctcgctctgagatgtcgacggatatgtaaatgtgttgacatttacgtgcgcaccaacagaaggatttcatggttgtaagtttatcttgctcatctctgtgatgggattcaagtctcccagtcacatagaaggctttataagctataggacttaacctgacctaaaggggcaggcgagtcctaggctgtggtgtttggtttggtttgatttctttcccttcctctcaccttctgttgtttcctactcctcttccttgtgagggcccaaattttcctggcaagatgaaagtattgtaagtggcaattttgcctctctgcctgtgttatctccttttccttcagggcaaatggctagctccttcacccacagacacactttcagtaggtgtggtatgtgattcttttaaaatctccgtaaagagtttctgttgttggtcgcctcagcacagaatggatacatgcagaacttccattatatttatctaaccagctggaacaggtattggagggagggtgaagacacctgtggacatggccagggactgagacaatgatgctctggacaaactatccttctctgtaaaactttggctttgagaagagccatcacttgcttcaatttctttgtagtgaaattgagggaggtgttgaggacagaaacctgctcctgtcacttgactgcaagtgagcctgaccggtcactaacataaatgctcaagacccatcatgaccctgcttttggggtcttgcaggtctcagatgctgctgcagattttcttctgcttacacgttgtagaatgaaaagcagcaggttctgtgggagatgttagcaacttgtctttgaagccaaagtcccattctgaatctctgcagccctctccttcagaagattttctttttttcaaatggacaggtccctggtggtatcagtccataaaggaagtatattttgttcatcacattcaccgagaactttgaccatcttccagcccctgttaagcctggaaggtgaagaatccctatcagggacaaagatggctcaattttcttccatgttctaccccagcactccactttaatttcagctttatgttcattttagtcagcagtggcttaacagtctccagagtagatgtcagggcatctggtggagttcatacagagatcttttctttttctcttttttataacagctttattgcaatataattcacatagcatacagttcatgtttttaaatgtacaattcagtggttcttagtttattcacaaagtcatgcaaccatcaccacaatctaacttttgtcatgcctaaaataatatatatccacgcccattagcaatcactccccattctctccttccccctcagcccctggcaaccacgaatctcctttctgtctccatggctttgcatattcttgtcatttcacataaatggaataatgaaacgtggtcttttgtgactggcttctttcacttagcataatattttcaaggtttatccaagttgtagcataaatctgaacttatctttttatggctgaataatattccattgtatggatagaccacattttattcatccattcatcagtcaatggacattttggttatttctgcttttttggctcttaagagtaatgccactatactgtttgtgtacatgtttttgtgtggacttacattttcatttctcttgggtctgtacctaggagtggaattgctaggtcatgtggtaactctgtctttaatatttcgaagaactaccacacttttcatagtggctgcaccattttatgttcccgttggcaacgtatgagggttccaatttctccattttgtcaacacttatcttttttttttattatagccatcctagtgagtgtgaagtgtgatctcatggttttgatttgcatttcttttgtggctaacgacattgatcatcttttcatgtgcctattggccatttgtttatcttctttggagaaatgtgtattcacaccctttgcccacttttaattggattattaatctttttacttttgagttatgaattctttatatattctggatacaactcccttgttagatatatgagaaaattgagccctctttgtaaatattttctctcattctgtgggctgtcttttcactttctattttttatttttattttttagagacaaagtctcactctgtcacccaggctggggtgcagtagcatgatcatggctcattgtagcctcgaattcctgggctcaagtgatcctttccccctcagcctcctgagtagctggaactacaggcatgagccaccattcccagccaatttcattttattttttatagtgatggagtcttactatgttgcccagtctggtctcaaactcctggcctcaagtgatcatcctgcctcaacctctcaaagtgctgggattacaggcctgagccactgcacccagccaattatcaatattaatcagatctgtacagtggtcacagtccattctagttcagttgctcttttctagaacctatctcccagtaatggcacatatggctgtttttctaggagaacatcagttgctcttttgctctaagaattcggtgtttcttgctgtgggatgaaaggttgtagattatccctgtggtaactgcactgatttatcatcccaaccatggacggttttgaaaagtaaagagagtgctaatgtacttatgctggacagacagttttaaatggagactgtaatgggcgcagtaggatgcgtggtcactctggttatgcgtgttctgtgaatttgttgttaattgggaaatactggtattaaaacgttctgtatttttctcaagagccacagatatatgctggtccatgcacatacacgagtgcacatttatgcacacacacacatatacttaggcattcatgcctaataatacataaggtagaggtaggtagtctggctaagttaatgtagaatttttgctaaaaataatgttcttgtattattttccttcagacttgttcacaggggacacctgcaggtcttctaagtgctattaattcttacacaaaaagggcattccagttaatatggtttgtcaggaagaaatacttattaaaatgtcttggaataaatggaacacaaatgtttgaaaaggcccatttcacagcttttattcaagttataaaatgggaattacttcaggtgtaaataattcatcccaataaatttgtttcatttggtgtctatcttcctgaccgcctgtgaatatgagattttatttttggagccctgtgttgttaaccacttgttagtttaacacctctcatgaatcagagttctgaccctcaagggtccagacctctaagtcctttttcactgaagtgtttgtgcttttctataggcagtcttccaaacagaagaaggccattcaaactgctatccgcaaaaataaagaggcaaacgcagtgctggctcggctgaacagtgagctccagcagcagctcaaggtaaggaatgagtcccagatttggatgaccaggcttttccctggcttttaaaaagcttttttttaatttaataggcatataataattgtacatatttatagggtggggtacatagtgatgtctccatacctatcatgtacagtgatctgatgtgtccattggctgaccatttagttccatccctgttgataagacttgcctcttcgttctcaaaccctttttggaaggtggagaattactgtatttaagtttcatgggttggttcttgcatagtcagaggaagactagtgactttaatatgtaggcttcatattgtgtatgagttaaaaggaaagacaatctattacgaaggctgtttgaagcattctttattatccaaagcttctgggtaagcccttaattatttacatcctctctgaaagaggatgtaaatacttatttcagtagaaggaagtcaccttggtactatcaaagcccagcccctcctctggtgccttgcaaatggttccatttcaccttctcaatgacatcacccctgtttctcttcatcgttactctcccctgtgttagtttctcggggctgctataacaaaatactacaaatgtggtggcttaagataaccaaaaatgattctctcacagctctggaggctagaactctgaaatcaagatattggcagagctatgatctctttgaaggctctagaagatgatccttccttacctcttcccagcttctgatgttgctggcagccctgggcattccttggcttgtagctgcgtcactccaatctctgcctctgttgtcacatggccttcttcctgtatctctctgtgtctgtgtccaaatttctcttcttattgtatcctcttataaggacaccaatcattggattaggacccaccctaatctagcatgacctcatcttaacttgattacatctgcaaagaacctatttgcatataaggtcacatttacagatactgggggttaggacttaaacatatattttgagaggacatgattctacccactatatcccccagttctctactggatcattcgccatccacatgtaaatatgctccagtattgtccattacacttggccaattactgcctcatttctttggtccccttcacagcaaagtttcttaggagtggttttattcattatctttactttcaaaccagtaattttctcttccttccacttcagttggcttcgtcctcctccactcacacccgtcttgtggctaaatccaatagggctgttttaatattattatttttttttcagaagaattctacacaattgatcatttcctcctctgaaatggcttttataactggtttttgacataccatactctcctggttttccttctgcttcactggtgcttcccattttcattctctgctgtctcttccttccctgacttaacttttataccccaaccccatttgccccaatattttagtatgaaaattttcaaacatacaggaaagttgaaagaatcataagtgactgcttgtatagacatcacttcagttctacaataacattttactatacttatttttaatcacatatctacccatttatccttgtgtccatcagttcatcttatttttgacatattttcaaataaattgcagatatctgtatactttccctgaatattttagcatgcgtataattagctagagttcaatatatttttacagttttttcttatgatgtaaaatgtttatacaaaatgcatgcacaaatattattattattattattattattattattattattattattattattatttgagatggagtctcgctctgtcgcccacgctggagtgcggtggcgtgatctctgctcactgcaagctccgcctcctgggttcacaccattcttctggcttagcctcctgagtagctgggactacaggcgcctgccaccacgcccggccaactttttgtatttttagtagaggtggggtttcactgtgttagccaggttggtctcgatttcctgaccttgtgatctgcccgcctaggtctcccagagtgctgggattacaggcgtgagccaccgcgccagcgcacgcacaaaccttaagtgtacatttgctgagtttgtaacaagtacatgtacttacggaatccaaacccccaaaaagatagagaatattaccatcaccccaggaagctccctcatgctttttcctagtcaattcctgccctacccacacagaggcaatcactattctaatttttataccatagttttgcctgttctataactttatataagcggtgtcttacaacttatacttcttgtaaagcttctttcactaagtattatgtttttgagattcatttatattgttgtgtgtatcagtaattcattcatttttattgatgagtagtatcccattgggtgaatatgttacagtttggttatcaattctattgacagacacctgagcggtttccagtttttggcaatttggaataaaactgcattttttaataagtctctgtatggaaatatgttctcatttctcttggattgggattcgtaggtatcatggtaagtgtatgtgattagtttctgagaaactgctagatcattttccaaggtggttgtagcaatctgtactcctaccactaatgtatgagagttccaattgttccgcgtctttgccaacatttggtgttatgattcttattaattttagctagccctgtagtgatatagtttttatcatctccttgctgactaattatgttgtccacttttctttgtgattatttacctttcatatcttactttatgaaatatcttttcaaatgttatttttctccaaagtagtctatagatttattacaaaaccaataaaaatcccagcaggattttttgtgagtatagacaagctaatcccaaaacttatatgtaaaggccaaggagctggaattgcttaaacaaatttgaaaaggaagaacaaagttggaggaatcactttactgtcaagctccagtaatcaagatgctgatgcacaggtcagtggaataggatacagagtcctgaaatagaccacatgaaaacagccatttgatctttgacaaaggtgcaaaatcgattcaatgagaaataatagttttcaacaaattgttttataacaatttgtcatttgcatttaaaaaaataaccttgatctaagcctcacatctatacagagattaacttgaaatgagtcatagatgtaaatgtaaaacatagagctataaaatttttagaagaaaacagaaaaatcttcatgatctggagttagaaataacaccaaaagcacaatctataacagagaaaaactaaaaaaattggacttcatcaaaattaaaaccttttattttgccaagcacagttaagaaaattaagagacaagctgctgagtgggagaaagtatttgcaaaacacgtatttgataaaagacttatatctcaattatataaagaactcttaaaactcaataataagaactctcaaaaccaaagcatctcaatttaaaaatgggcaaaggatttgaacagacacttcactaaagaatatataaagatggcaaataagtacatgagaagatattcaacatcattagccatttgggaaatgcaaatttaaaccacaattacataccactatacacatactagaattgctaaaacaaaaaatgtgacatcaccaagtgctggcaattagaactctcatttattggtggtgggaatgcagaatggtaccaccactctgaaaaatcgttcagcagtttcctatgaagttatacatacactaaccatgtgacccagctgtctctctaccttagtgaaatgaaaatttatgttcgctcaaaaatctatatatgaacttacatagcagttttattcatgatagcccaaacctggaaacaacacaaatgtccttcaaaagatgaatgaataaattgggatacattcatacaatggaatagtactcaacagagaaaagaaatgatacacaacttggatgaaactcagacattatgcagagtgagacaagccagtatcaaaaggttgtgtactgtatgattccttttatttgacattcttgaaaaggtaaaactatagtgatgtgaaacaaatcagtggctatcaggggttatgcatgagatgagagtttgtatgagtagtcccagggaacttttggggttggttgaactgtaatgtgtcttctttgtggtggtggttacacaaatctgtacactaaaagaaaaaaattgttttaccctatgataattttaaaaagttattttttaaatttcaaagttcattctgttttctaaaactttgtatgtgaacttgttttgttttgcattttgtttggttttggttttctcctctctccctctgctttggggtaggccagtttcatccattgttctctacatttggtgggcccttttggaaactgatattccccagttctgaagggttttttattttcatttttgttgtcgttgattatttcctcccccctgccctcacccccatttttttctcattctcccttactgatattcagacattggacttcttagcttagttctctaattttctcatattttctcttctgttttctttcttttctcttcctacattttcttctttatttttgtctatttctggaaacttaattatatattctaaatcttctgttgtttaataaccaataattttttgttctctgtttatttttgacggtatcctattcttgtttcattgttgtgatcttttttttaattatactttaagttctgggaaacatgtgcagaactcgttgtgatctttttttatggtcatttttctttcttcttcctgaatagtttgtgtttgttgtgttgtgttgtatgtgctttatcttagatgctttcctttgatatctgatggcccttctttgctcatatttaaaaggaagatgaaaacactgattagaagttcattgtacgttgtaaggcttgtcaactctgagcttcactgtctggcaatttggctcggctgtatagttggggaacccccaaagggagtatgattagctctttcctcttggtctggttggagtgtccagagtggagactgttttggtcacctacatggagggatagagttggttcagtggagcaagagggctgtaggtctcagcattccaggatattcattcactctccctatttctggcccagtatcttgtcctcaactgtgcttgtttcttgctaatccagatgctctctgttgtaccttttcaagaaataaaccttcagcattctgccctggtggcaggaatgatctggggatctaattgcttctgaaacagattttcagccaacacttattttagccaactcccatctccccttatgtactcccactttaataggtatctggtgttgccaatttgagtctttcaggaattctcctacgtaaaatcaagttggttcttatttttcttcatgttagcctgggactcagctttctttacttgatctgtatgagtggaaaagttctaagtctagtgaacagaagtctgaagaatcattgaaacagaactatagtcatagcccctcaattaattcccaggctaagccagtttatagatccagaacctcttgaatgatgaaggggcatctatgtctccttaaggaaggaccccactgtgcagccaaaaatttacactgcaaatctttctcctagcctttcctaagggggaccctgctgccatttaccagggtgactgtgcattagaggaagggaaataattagacttttggggaattaccagacactggctctgaactcacactaattccaggagatgcaaagtgtcactgtggcccatcagagttggggcttagggagatcaggtgatcaatggagttttagcttatgttcgtctcacagtggacccagtggactcccaaactcaccctatggttatttccctagctctggaatggcatgcttggaatagacatactcagcagctggcagaattcccacatttattttcctggatttcctaagtcatttaccattcaccagtttgccactcagctttcaaattttattgctatcatcttgtcccttttgttttccctgtcttgtgggtccgtgactttgaaaagttgctgtattgttttagtggtgctccaggagggagagagtgtggtacccctggtcagtcttccatctttacctgaaacctctatctatactgttttgctagatgatgttatatggtctcatggctttgaagaccatccataaactaatgaaacctaatttatgtctcaagccctacttctcctttcctctgtgctctagacttgcatatataacttcttactcaatgttttctccttagatatccaatacacatctcagataattaattgccaaccctctccttgaaatactcatttcttatctaatcttctcattctcaatatcactaccagccagctactttcttcatacaaaaatcccaggagtcatcctcagatttttcttctctcctacatcaactttatcagcaagtcctaccagttctagattcaagatttatctagaattcatccacttctcttcatcttcatggcttctaccctgacggaagccattttcatttctcacctgggtccctgcagtaacctcccagttgctcccctgcttccactctcatcctgctataatctactgtctacacagtagccagagtgaaaattttgaattttaagttgggtcatgttccttccctgattagaaacactcaatgccaggccgggtgcagtggcccacgcctgtaatcccagcactttgggaggccgaggtgggcagatcacgaggtcaggagatcgagaccatcctggctaacgtggtgaaaccccgtttctactaaaaatacagaaaattagccgggcgtggtggcgggcgcctgtagtcccagctacttgggaggctgaggcaggagaatggcgtgaacctgggaggcggagcttgcagtgagccgagatcgcgccattgcactccagcctgggcgacagagtgagactctgtctcagaaaaaaaaaaaaaaagaaagaaagaaaccctcaatgccatccccgctacatttccatactatttcctctgcccacaaggccctgtacgatctggctccttgcttaaatctctgacttcatttcctgccaatgtcttccttgttccatctactctggtcacacaggctttttgttcatcaaattcaccaaactcactcgctcctcagggcctttgcagttgcccttttgtctctgtgaatatccttccccccatatcttcatatggctcactcctcatttcattcaagtctttgctcaagtattgctaactctgagaagccttcccagggcactctctctcctttctcccatatccccctctgttactctctattatgttatcttatttccttctggaagtatcttgttcattaactttattatctttctcaagtcatttgaatataagccctattgctctgatctggcatattctttgctgataccatcacagctacagcattacctcacctgtaggagatagaaaccaagagacttccggctgggtggctaggagagcatgtgaataaatacttgtgaagttgtatactgactattagtatgctgattcttctgaatctcacaattcagcctttctacaggattctttcccaccttgactgattctacttgaatacctttatgtgtcccctctcttcctgccaaaaaaatccgttttaggcccgaaagtttgaattcccaaagagcagattgctcagcctcttttctgcctttcacccagatgttgtaccttacaccatatgttgtgcagaaacttggatgagactttggtggaggggcaactagcgtacctttttggccctcagacctaactgagtatggtgcgggattacgagccagagattgcaactagaaatttaagtcctgttggctcactgctcagtattgggagtctgtttttgctttctgctttctcctagtcttttaatttttaatgactctgtctaccagctactgatcttgtcaaaacaggctaaaactagggcagggtggtagaggggagtaggtcagtttcatttcatcacgttcagaaaggagttgagagattacaaattgtgaagccccttttgtctggtcaccagcattaaatctgatacctcccagtcctcctgttcttgagttatacagcacttgtatttgtgggtccagttataagtttccttttaaatctgatgaagtagggatgaattcaagaaatgacccctttgcttttttgtttttcttgtgttttgtacaactcaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattatttatttaaagaatttatgttttctataaaaccttataaccaagaaccttcaggatgcttgtaaccaagtactttcaggatgctttttgtatgtatatcacatagagtaggttggtttcctgagtaattgggattccaactagatagtcattggtgtgaccataataaaaacaaaagctaaaataaaagcatcagatttagactggcgctgtgccctctaccactatatgccaaaaattgcttctctagtgccattttgatattatatctagctataaataatacatgactatcgttttctattgaatgtcaaagacttactgggtctttacacctctgtaaagtggaggttttggcaatgagctgtttaacttggccaagctaggctgtcaacccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccacccatcaaatatgaaaggctgatgagactgttaggattgataaacatttgttgtttgaacccagctatccaaactggggaagaaggggaaatggttgttaccaacaatctctagtagttattttaatctttattttaacctggattgcaaatgtatggggtatgaggagataatgaaagaaaagtggtcctcatgctggatatgtgactgttttgttctctgtaaagtgtattcttgggaagtgattggtttatatcagattcagaggagcccaattaactccagtgtaggtaatgtaaaacagtaagctcaaattgcagaagccagtatcctacagaaatttaagtagctactgcttctcctgaaagcccaagttgaaaatgggaccacaggggcacagggctactgaccctcacagggcatgccagcgttaacaccactttgagagaccaatggcaagaaatgctgtctcttgtgcattttactaatttccccattcttagggtagcagggtgggggtgtatagggtctttttgaagcagttttggataggtttgcaatatgtgggattcagcctttgatttcaatagagctgagagcttttagaacaagcaggcatttatttaatgtttccttagtccattggcaagctttatcaatagcttaa

SEQ ID NO: 3122 - DNA, 75301 bp, human
ggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcatagctaccaccttttggctgttctatacttggaaaagtactaggggatgatacataccagacgctgtttttgttttgtgctttccttggagcttggagaaagactacttgataagcctttgtctgtcatttcatgtcaccagcacttcatggtgataagactgttaatatcaggttcaaaacgtgaaatgaagcttttcctaaaagcaatagtatgaatgttattaacaccaatggaatatttagagtggcgagtggtattttaaaatctagtttcaaaggagaactgagggttttatggttcacttgcaatgtcattgtgttcatacgtatttttaaaaaaattgcttaagactgcgttttatactgctggagtgtttttactgctatatgtttgtgagcataactttagacactttgtaatctttcacccttttgaatttgggatttctgaaactgtaactagtattcacagaacttagcatggctgtttatccctaaagaagtccttgatatgtagacagttctgccattgctgatgagtagttgagctggatcaggtaaagagaaagtcagtgtcttaaaacacaaaccgtggctattacatgaggccctcagaatagtcccgagcataatacatttattcagtgctgtagctgcttcccagctgaaagaggaataattgactgaggctatgcagcaagtaagtgacagctgggtacctattaaggcttattttgttgtcagtaatgcatcggataagaggaggtgggcatagtaaatctgaatatgttggttgatgcctctttaggaattgggaagaaggatttcctgatgttagaacccatgctttcttgaggtacatatagttttaaaaggacccaaggcacagtggctgtgcgtgaatgagattatatttttgatgtccagttgaaatctgcttgcaaaagactgcttcagatactggcaaaaggggacatccctgcgagattgcttggagtaaatctctcagagctcgaagctcccttattcagcctagcaaagcaaaacacatcatccacctttaatccaacaaaattaccataactcaatattcttggtacaggtgaaaatgaacattgaaggcatcctggacatgtgatcctaagagagtcaaacaaagtcagcaaccagcagacacctaattttcacccatcactttggtggtggtggtggtggtggtggtggtggtggtgtgtgtatgctccatccactttaatttgcattaccccatcagtgtattagccattctttaaaacaaacgtagatgtttttaccctttctctgttaaacaggaacctgtaagttgagatttaagtgccccaacaggtataactgctcaaatcttggaggcactaaccagtcctgatattttctatggtaacaaccaggttttcctcttaataagcatacaattaagattaccataataatgttccaggaagagtgagaatcttgcattcttaccacaagtaaatggtctataaaaatacttattttttatttatttattttttgagatggagtctcgttctgttgcccaggctggagtgcggtggcgtgatcttggctcactgcaacctctgcctcccgggttcaagcgattcttccgcctcagcctcctgagtagctgggactacaggcgcacgccacctctcccggctaatttttgcatttttagtagagacggcgttttgccatgttggccaggctggtctcgaactcctgacttcaggtgatccacccgcctcagcctcccaaagtgctgggattacaggcgtgagccaccatgcctggccttaacatattttttaatagactatttttttttttcagagcagttttaggttcacagcaaaatttagcagagtacccatatatcccctgccccgacacacccgtagctttccttactctcaacgtcccacatcagaataatagagtttttacaattgatgaacctacattgacacctcattattccccaaagtctatatattagggctcactcttggtgttgtacattctgtgggtttggacaaatgtataatgacggttccaccattgtagtatcatacagaatagtttcactgctctaaaaatctgtgctctattgattcatccctccctctccactaacatgtggcaatcactgattttttttttttttttactgtccccatagttttgccttttttagaatgtcatatagttggagtcatacagtatataggcttttcactttggcttctttcatgtagtactatgcacttaaaattccttcatgtctttttatggtttggtggctcatttctttatagtgctgaataatattccattgtctgcatgtactacaatttatttattcacctactgaaggatatcttggttgcttccaagtttgggcaattatggataaagctgttataaacatctgtatgcagccttttttgttacatgcaggagataagcttttgactcatttgggtaaatagcaaggggcatgattgctagattgtatggtgagagtatatttagttttataagaaactgccaaactgctttccaaagtgattgtaccattttgcgttcccatcagcaatgcattggtttctttacagagtatttattttcctttgctgacttattttaacagcaggattctagcactaggtggaaaacgtatatgagtttctgatgtgtgtcaggtactgtcctaggtgctgaggttataatagtgaatccaacacaatctctgtcttcatggagcttatgttctcatgtgaatgtttttacacttcagagtttttatttggttgagaaaagacttgaaatataacatccaaaaataaaatgtcagcctggtgctgtggcgcacgcctgtagtcccagtgctttgggagaccaaggatgggaggattgcttgaggccaggactttgagatcagcctgggtaacatagtgagaccctgtctctacacaaaataaaatagccgggcatggtggcatgcgcttgtagtcctagctactctggaggctgaggcaggagaattgcttgagcccaggagttcaaggttatagtgaactatgatcgcaccattgctctccagcgtaggcaacagagcaaaaccctgtatcaaaataaagtaaaataagcctgtcaaacccaaaccaaatacatgtcaaacccagacctgattcttaccacacactatgccttctagtaaaattctggcctttgaataccaacaaaatacttcataacctgggaaaccaactactctaacgtttgttgctctgtcttgaaatactaaacaaaaccatttacctgttcgtagacatattttctttttctagtttaaaagtatcccattctgccattttccacctagtgctagaatcctgctcttaaaataagtcagcacagggaaataaatactctataaagagaccaaaagacctttcaaaataggctatggccaggcccagtggctcacgcctataaatcccagcactttgggagtctgaggtcggaggattacttgagcccaggagttctagactagcctgggcaagatggcaaaaccccatctacacacacacacacacacacacacacacacacacacacacacacacacacacacacacacccccgctacctacctctctctggggcatgcctgtagtcccagctattctggaggctgaggtgggaggatcccttgagcccaggagtttgaggctgcaatgagccattatgacaccactgcactccagcctgggtgaaagagccagaccctgtctcataaaataaataagtaaataaataaaatatctaccttaaagcagcaagttttgtatttgatgtaatgaattaacagaccgctttataatatctatcttttaggatagtgtcagtctcttggaatgctgtgcatgagtcatcattaaaattggttttcattaaaaaaatttttttaacatatacacatcttattggagttttcttttaaaattcaaaaatgggaacattattttttcaaagccaagtaacagaagagtatataaaaaagtcaattttgtgcatatctttttacattttctatgctcatgtaaaacatacatgacttatgtaattatacacatatgctccagatctcatctgtattaattttttaaattatactttagttctgggatacacttggagaacgtgcagttttgttacataggtatatatatgtgccatggtgatttgctgcacccatcaacccatcatctacattaggtatttctcctaatgctatctctcccctagccctgcacccctgaataggccccggtgtgtgatgtttccctccctgtgtccatgttttctcattgttcagctcccacttatgagtgagaacatgcggtgtttggttttctgttcctgtgttagtttgctgagaatgatggtttccggcttcatccatgttggttttcatttttgtgatagttaattcttggacattaaggggaataattataaaacactgttgcttccatatcaagggaaatcactgaatgattaaaaaaaacccaataagtgttgtctgattgtttaaacagctttcattgaggtaaataagtaaaacaaagctgtgagaagtagggaatatttaaacaatttgtgcgcatgccctcacctttggggagaagtcttttctgaaggctctcttctgattttttgaagcaactgtttaatcattaaagaaaattataggtaaaagacaaattcttgtgaactttcgctcattgctagattattaggcagaactattttttaaaaatttaaatgaaacaactttatatttttacatctttagatcatatcattttgtaactatactttagggaaatagaggccagcatattaaaacagtaactaggggctgggcagggtggctcattgcctgtaatcctagcactttgggaggccgaggcgggcagatcagctgaggtcaggagtttgaaaccagcctggccaacatagcgaaaccccatctctactaaaaatacaaaaattagcaggagaattgcttgaaccggagaggcgaaggttgcagtgagctgagatcaggccattgcactccagcctgggagacaagagtgaaactctgtctcaaaaacaaacaaaccaaaaaacaaacacacacacacacacacacacacacacacacacacacacacacaaacacacaaaccagtaactaggactaactatatgctgttttagattgacagtattctttttttctaaaagagaatgaatgccagcagatgtaggaagtaccagagctaaaccattgcctggttaaaaggagtacctctgcataatagttacttgttgactcttttgtaataaaatatttcaggcatgtaaaactagacagttacccaagaaataactgtgtatccaccactccgtataagtaaaacagcccagctagagtgaaagcctgctatgtccccttctctggtcccattcccctccctccctaccctggagttaccagagtcctgaatttggtgtgcatgatttgaagatttctttctacttttattgtatgtatatgtggatatatatatttgtgtatatataaatcactaaaaaagatattattttggatgtcttttcaacttaaggaatatcgtattctgtgtaaccttctgcaacttgcttttcctctcattgttttgtttttggaattcatcttgttgacacatgtaatttcagttcatttatgtttccttttaaaaaatctttactacttacgtttacaatgactcattgttacagtgcggtagagacccttatgccaaaaggaagtaggtggcatttttccttatttatatagaatgtcacatgactgggggactgttcgaaacgtgtatgaaaattaagaacaccttcatagatagcagaatgcacacttatattcttgagcgtgctaggggatgtttgagctaattaattgactttcatgggctttctttttttctcatcttttatttttttgagacagggtcttgctgtgtcacccagactggaatgcagcaatctgatcatgactcactgtaccctcaacctcctgggctcaagcaatcttcctgcctcaggctcccgagtagctgggaatacaggtgtgcagcaccaagcctggctaattttctttttaaaaatttgttgtggagatggtgtctcattatgttgcccagcctggtctcaaactcttgggctcaagtgatctcccgcctcagcctcccaaagtgttgggattacaggtgtgagccaccacaccctgccatttttcatctttttaaaaatggaacatctcaaataagcaagtagatagaataatgcattaaaccctgctgcacttgccactcaggcccaacaactgtcaatgcaaggttaattcaattccatctacatttctatctttgttccctctcacctttgttatcctgaagcaagtcgcaaacatcatatggttcatagggcttatctttaaggaaggaaccagggtgggcagaaggaaatggaaacatgcaggggtttaggttggccagaaaaggtacctgtggcctatggtcaaatggcaagactgatgatggttcaatactgtcaagcctttggctgtcatggagatagacgtgcttgagaactgatttagaatagttgggaaacctgtagggagattgaaaaagtaaccaactgaagaccaggaatacaagatggatttgaatattgttctagcttcacactcctaagtaggggctgtcctattttaagggtgtagacaattggttttgaggaaatcttgggttgtttttgctaattatttataactttttttttttttttttttttttgagacagagtcttgctctgtcgcccgggctgaagtgcagtggcgcaaggtcggctcactgcaacctccgcctcccaggttcaagcagttctccctgcctcagccttctgagtagctgggactacaggcgcccaccaccatgcctggctaatttttatattttttagtagagatggggtttcgccatgttgactaggctggtcttgaactcctgacctcaggtgatctgcccaccctggcctcccaaagtgctgggattacaggtgtgagccaccgcgcctggcctatttataactttaaaaagagggtttggttcctttccagggtttttcaaactttctgtttgtttcgtataggcaagtttctcatgttttgtattgatggcattctattattcatacctatctgttggtgggcaactaatcaacctgggttgcgcaggactgaaggatttcctgggggcatggaacttcagtcttcagacagtcctaggcaaactgggatggtcaccccctctcttggttgctgcattagttatctattgctctataatgaattaccacaaacttagcagcttaaagcagcacacagttattatctcccagtttctgtgggttcgggagtctggacatggctcagttgggtcctcagctcagagtttcataaagccacaatcaaggtgtctggagcttggagtcctctgtggaggtccaacacttggttgcagaattcagttccttgtgattttagaactgaggctctcaacttcgaggcttcctgcagttccctccacatggccttctccataggcaattcacaacatggctcttggcttcttcaaggccagcaggagagtgtctctctccagttagctcagacacctttgccatagtccattagttagaagcaagtcacaggttttgtctgctctcaaggggaggggattatacaaaacaacagagaccaggaggtgagaattttgcgggggacaccttaggatctttccaccacacttgctttccaggatttgtctgaagtagaaaattattctgttgagcctttttgtggccagaatatacatatgttttgctcagccactaatttagaattcctttatctttttaagaaacattttcatgcgtaattcatcctaagtagaactggcaaatatgtaacttcttaggtattttcaattttagtctttaggcaattgtttttcctcttaactagtaggaggcaggaaaaaaaagtggaaaagcagatgcaaatgccctgcctggctactcctgcacgcagtgctctaaagcaggccttctcagcctgggttagttcaggggtctgtgaatttagatgtggaaaagaactacatctttttttttttttttactaactgcccttcccccaactgaaattgagcacttccttctattatgcatgtaagcaaaaaaccacagcagtttttttttttttttttttttttttttttttttttgagacagggtcttgctctgtcacccaggctggagtgcaatctcacaattttggttcactgcaacctgtgcctcctgggcccaaatgatccttccatctcagcctcccaagtagctgggactacacgtgcatgccaccacacccagctaatttttgtattttttgtagaaacgggattttgccatgttgcctaggcaacagggttcactgctttcggtcaaatgacagcaatgctgctggcaagtccatggtcaggagtgagattccctcaggctgctgtggtccctcctcctccagtctgtcctgcaggaagctcagagtgaatggatgctcagctgtttcctctgagacctcaccagggacagttcctgcagtcccggctctgagctctgctcctgaccgttttatctggccctctcagctgtgcttcactgcaaaggaggaaggacaaggccctctggagccagtgccagctgcttgtggggcctgttttatttactactgctatctctacttcagagacttgggctaggacatagacttgaagaaaaaagccattttaacagacttgagaaactcagccatcctcataataccattcagaaccaggagaggccattattaacactaggctagtaggaaatgttcactttgactgaattcatttgtaacactttgccactggtttacaagaaaaatactttggttcagtctcctggaggtaggtaattaaatgtttcacctgtgctaattttccaaataattaaagtgaatcccataaatgccagcaattaagaattgttgtttttggccaagtgtggtggctcatgcctgtaattacagcactttgggaggttgaggcgggcggatcacttgaggccatgagtttgaggccaacctgggtaaaatagggagacgctgtctctacaaaaaatacaaaaatcagctgggcttggtggaatgtgcctgtagtcctggctacttggtaggctgaggcaggagaattgcttgaatccgggaggtagaggtttcagtgagccaagattgtgccactgtactccagcctaggcgacagaggcgagattctgtctcaaaaaaaaaaaaaagttgtttcttaagtgcagaccttctgagatgtgtagtgcttgccccatgccttcaaaagaacatatttaatacaataatctctttgtctctcctttacttcaaagtcagccttgtgaaaaacagatgatgatataccaacagttttttgctcttggaggtgtttggtgtgctctgctttttgagttttgttttttggacttctttaaaattattttaaaatgttttaactcctctcctttgcatactctctggtacccttatagtcccaatactgagtaaagcatgtaaaatttagcatgcagatgttttagcctcttttattttttgttcgagatccagattttttagtctcagcatgactgacactttggggctgtatcattctttgttgtggaggactgtcctgtgcattgtaggttgtcaagtaacatccctggtctctacccacaagataccagtagctattcttctcctgattgtgacaacaaaaaatgtttccagacattgtcagatgtctcctcggggcaaaatttagttctacatatatgatgataaaaaccatggtagcagccaacatttgttcactatcatccccattttgaagaaagcaaaaacggaggcactgagggtgaggttcacttacttgcccaaggtcacatagataaaagtcacttcttgaaatacttttcataatatatatgggttgaatctcagtcttaattgaggaggcagactaaaaaagaatgtaaaaacggggagtttcctgatgatgtctcaattgagaggctattgctttcatagtgattctgtgtaaatgctggaattcttgcttaaacggggtgattccatgggcatgtgtctgagtaaaggacttggatcatttctaagaagcttctgtggcatggtgaagcagaacataagacagtctaggatcaaggataactgatcaaactttgaaaccaaggaagccataggaaattggggtaaggctatgtatcacttagggtcccacaggaaatggcatgctcaaagggttttagtgaaaacaggaatgttgaggcacgaagggactagcagcaggaagctattgccattcctagacctggtggggcaaagggaggggagggaatgtcgttgctggagctgtgaaaggtactccctctacaggaacaatagtcatgaaagaatacagcctttgctagaactatggccagagaggggccagtgggatgaggggatgggagagaagtaaccaatttctgtttcctgccctctcatttgctgcagtgccttttgttgttctaacccaactagaagccacaggtaacagagcctgggtgttgaagcttattgaggttagcctcttgcgctgagtggatggaaagggctgagagtggttcaagggggcaaatagagcaacagccagcacaggctatgagcaggagtgggaaacactaccctggatcctaggaaggatggggcatggccagtgataggagcaatgaaagtctttttgtgtgaaaaagagcctggggatacagacctccatgaaggagaagagagggttggataggagtgactggttcatctgaggttcttcctatttctccaaggaagccttgaggaatgtggggttgtctgtttgcatttggatatggaagtatgtgtgtgtgtatacttttatttattttgagacagggtcttgttctgtcacccaggctggagcacagtggcaccatcacagctcactgcagcctctacttcctgggcttaagtggtcctcccacccaggcccccccaggtagctgggaccacaggcatgtaccactatgctcggctgatttttaatattttgtagagacagggtctcactatattcccctggttggcctcactcctgggctcaagtgatcctcccaccttggcctccagaagtgctaggaatacaggtgtaagccactacacccagtctgtttgtatactttttggtcagagtgaggctttccgtgagttggagtgtttgtccttattcatgacactgggaaacatacaacagtggagtgaccctcttgcagattctgctaggagtagctacatatggtgggaaaggttgctatgggaatggagataaattcaaggcagtagagagtgctttataatgtttgggggtatggccaagcattagttttgctttttccttcccagtaggatacgatttctgtagcaattcttccttacccaaaaatagctatatgtgctcccaaaaagaaaaagcccaggaccagatgacttcatggctgaattctaccaaacattcaaagaagagttaatactaatccttcttaaactcttccaaaaaacagaagtagagagagtacttccaaactcattttttgaggccagcatcaccctgatttcaaagccagacaaaagataccaagataccataagaggagaaaaccacaggttagtatctctgttgaacatatatgcaaaaatcctaaataaaatactagcagaccaaatttaacaacacctcaaaaagatgatacaccatgaccaaagtggcacttatccctgagatgcaagattggtttaacgtatataaaacaatcagtgtaatatgccacattaccaaaataagaggtaaaaaacaagccaggtgtggtggctcacacctataatcccaacactttgggaagctgaggtgggaggattgcttgaggccaggagttcaagaccagcctgggcaacatagtgagacactgtctctacaaaaaattaaaaaaaaatgagctgggcatagtggcatgtacctctagtccctgctacttgggaggctgaggcagcaggatcgctggagccgaggattttgaggctgcagtgagcactgattgtgccaccgcactccagttgggcagtacagcaagaccctgtcttcaaagaaaaaaaaagagagaaaaacccatgatcatttcaatacatgtagaaatagcatttgacaaagttcaacagcctttcgtgataaacattttcaacaaaataagtttaaaagggaatttcctcaacacattaaagaccatttatgtagagtccacagctaatatcataatcagtgggagaaaactgaaagctttttttctaagatctggtacaaagcaaggatgcccactcttgccacttttattgaacacagcactggaagtactaacatgagctatcagacaataaaaagagataaaaggcatctaaattgggaaagaagaagtaaaattatccctgtttgtaaatgtcatgatcctatatgtagaaaaccctggactccacaaaagccctcttaagactaataaatgagttcagtaaagttgcatgatacaaaatcagcgtacaaaaatcagttggaaatcaagaaaactgtcccatttatgataacataaaaataataaaatattcaggaatacatttaatgaaggaagtgaaagatctgtacattcaacattataaaatattgatgaaagaaattgaagacacaaataaatggaaagatatgccatgtttatgcattggaaaaattaatagtgttaaattgtccacactacccaaaacaatatacaggttcaatgcaatccctatcaaaataccaatggcatttttcacagaaatagaaaaaacaattctaaaattcatatggtgtgacaaaagacctagaatagccgaaacagtcttgagaaacaaaaacaaggttggaggcatcacacttccttagattataatacagtataaagcagtagaaattatgatagtatatcctggcataaaaacagacatatagatcaatagaatagaacagagatccgagaaatatacagtatatatacagaaatccaagtatatacagtcaactaatttttgacaaggccaccaaggagacacagtggggaaaggatagtctcttcaataaatgatattgggaaaactggatattcacaggcaaaagaatgaagctggatgcttatatacaaaaatcaactcaaaatgtgtctttaaaatatacaacaaaacctgaaaatggaaaagaagacctaaatgttaataactcaaaccattgaactcctagaagaaaacataggggaaaagctccttgatatcggccttggcaatgattttttagacatcacaccaaaagcacaggcaacaaaagcaaaaagaaacaggtggtactacatcagactaaaaagcttctgcatgacaaagggaacaatccgcaaataaaagggcagcctatgaattggaagaaaatatttgcgacccatatatatgataaggagttaatatcaaaaatatataaggaactcccagaactcaatggtaagaaaatgaataacccgattaaaaaataggcaaaggacttgattattcattttcccaaagaagccatacaaatggccagcaggttgtgaaaaggtactcagtatcactaatcataagggaaatggaaatcaaaaccactatgagatatcagctcacaccttttagaatggctattagaaagacaacagataacaaacgttagggtgtggagaaaagagaacccttttatacttttgatgggaatgtagattggtacagccattatggaaaatggtatagaagtgcctcaaaaaattaaaagtagaactaccatatgatccagcaattcctctgctggatatgtacctaaaggaaatgaagtcagtgtgtcaaagaggtatctacactcctgtgttcattgcagcattattcgcaatagccaagatatggaaacaatttaagtgactgttgatggatgagtggctaaaaatatcgtgggatacacacacacacacacacacacacacacacacacacacacacacacacagatgacagaatattattcagccttaaaaaaggagatcatgctatttgtgacaacatggatgaacttatgctaagtaaaataagtgagacacagaaggaaaaatacttcatgatcttatttatctggaacctgaaaaaaagagtcaaatatatagaaacagaatagaaccacggttaccaagggtgggaatggggaggaaataaggcaatgtaggtcaaagtgtacaaacttgcagtgatgtaggctcaataagtctagagatgtacagcaggaggactatagttaacaatattgtattgtatatggaaaatgtgctaagagtagattttaggtgctcttacctcttctccccacaaaggtaactatggaaggtgatgagtatgtcagattgcttactggtagtaatcatttcactatggatatgtatatcaaaacatcatgtcatacatgttaaagttatgccataaaaatagctatatgtgggccaggccaggcatggtggcttatgcctgtaataccagcattttgggaggctgaggcaggaggattgcttgaggccaggagtttaagaccagcctgggcaacgtagtgagaaacctgtctctccaaaaatgtttttaaaagttatctgcgtgtggtagtgcatgcctgtgatcccagctacttgggaggctgaggcaagaggattgcttgagcccgaaaggtagaggctgcagtgacctgcgattgcaccactgcactccagcctgcgtgacagagtgagaccctgtctcttaaaaaaaaaaaagattaaaaaatagttgtatgtgtatatgtatacgttcaggatttgttctatttgttttctttttcttttttttcataggcagtggtcaatggcctaaggatttctttatacattgctcatatccactaaggctctattgagcaaaccacgccttaaaaatcttacaatcctcttcatatattttaaaggcaaatgcaaagaaatagctttgttctgttttgcattcttcatgggttaacatatcttctggaaaacttgttgctatggcaatgggatattatctatcttggtaatgtactacataaaaatagccctttgtgtttgagaatgatgttagtgacaggtggttgggtgaatgtatagcaggctgctttgtcaagaatagtttcccaacattccattgtttaaagttgtgaaatcaaaatgagtataatttttttctctctcaaaatgtaattttatctggaaaaggcaggcagtggtgctctgtttaattatgaattacaagccttcctttgcaggtcaggtcaacatgatgattgaagccacctctcactgtaataagtaaacgacttctctattctttctgtcagggtgtgcagcacaaggttgcgctgggggggccagtagggataattttcccattcttgaacacatcgttcttcctaagcacctcgtacttataaaccaagaagtaggaagtggtcaggtggaagagatgagctctgagctgttaatcaaatccgaatttcttgtaggttcttaggtgaaacagttccttgggaaaggtcagatttccatgttgcttttagtattgaactcacacatatagccaaggatagaatctgacccaaatcttaatttttcctttgaaaaatcctttgggcaatttttttttaatttaatttaattttattattattattattattttttattgatcattcttgggtgtttctcgcagagggggatttggcagggtcacaggacagtagtggagggaaggtcagcagataaacaagtgaacaaaggtctctggttttcctaggcagaggaccctgccgccttccgcagtgtttgtgtccctgggtacttgagattagggagtggtgctgactcttaaggagcatgctgccttcaagcatctgtttaacaaagcacatcttgcaccgcccttaatccattcaaccctgagtggatacagcacatgtttcagagagcaccgggttgggggtaaggtcaccgatcaacaggatcccaaggcagaagaatttttcttagtacagaacaaaatgaaaagtctcccatgtctacctctttccacacagtcacggcaaccatccgatttctcaatcttttccccacctttcccccctttctattctacaaaaccgccattgtcatcatggcccgttctcaatgagctgttgggtacacctcccagacggggtggtggccgggcagaggggctcctcacttcccagtaggtgccgccgggcagaggcgcccctcacctcccggacggggcggctggccggacggggggctgaccccccccacctccctcctggacggggcggctggccgggcagaggggctcctcacttcccagtaggggcggccgggcagaggcgcccctcacctcccggacggggcggctggccgggcggggggctgacccccccacctccctcccggacggggcggctggccgggcagagtggctcctcacttcccagtaggggcagccgggcagaggcgcccctcacttcccggacggggcggctggccaggtggggggctgaccccgccacctccctcccggacggggcggctggccgggcagagtggctcctcacttcccagtaggggcgcccgggcagaggcgcccctcacctcccggacggggcggctggccgggcggggggctgacccccccacctccctcccagatggggcagctggccgggcggggggctgacccccccacctccctcccggacggggcggctggccgggtggggggctgacccccccacctccctcccggacagggcggctggcagggcagagtggctcctcacttcccagtaggggcggctgggcagaggcgcccctcacttcccggacggggcggctggccgggcggggggctgatccccccacctccctcccagacggggcggctggccgggcggggggctgacccccccacctccctcccggacggggcggctggccgggcggggggctgacccccccacctccctcccggacgaggtggctgccgggcggagacgctcctcacttcccagacggggtggctgctgggcggaggggctcctcacttctcagacggggcagctgccgggcggaggggctcctcacttctcagacggggcggttgccaggcagagggtctcctcacttctcagacggggcgtccgggcagagacgctcctcacatcccagacggggtggcagggcagaggtgctccccacatctcagacgatgggcggccgggcagagacgctcctcacttcccagatgtgatggcggccgggaagaggcgctcctcacttcctagatgggatggcggctgggcagaggctgcaatctctgcactttgggaggccaaggcaggctgctgggaggtggaggttgtagtgagctgagatcacgccactgcactccagcctgggcaccattgagcactgagtgaacgagactccgtctgcaatcccggcacctcgggaggccgaggctggcgggtcactcgcggttaggagctggagaccaacccggccaacacagcgaatccccatctccaccaaaaaaatacgaaaaccagtcaggcgtggcggcgcgcgcctgcaattgcaggcactcggcaagctgaggcaggagaatcaggcagggaggttgcagtgagccgagatggcagcagtactgtccagcttcggctcggcatcagagggagactgtggaaagagagggagagggagaccgtggggagagggagagggctgggcaatttcttagagcagtaactctcaaacattttgtcgtcatcatctcacttttcttctacttatcaaaatgagtattgatttaattgtaatgagtaaataacagctccctgctactgaaatgaaatttactctagctttgagaatttgagagaccctcttaagaaaataccacagctggaaatttgagacctaaaagtaatacaatttgagtatctcatatctgaaatgcttgggaccagaagtgttttggattttggattttttcagactttggaatatttgcgtttacataatgagatctcttggggatgggacccaagtctaaacacgaaattcattaatgttttatatacgccttatacacatagcctaaaggtaattttatacaatattttaaataagcttgtgcatgaaacaaaattttgactgtgttttgactgtgacctgtcacataaggtcaggtgtggattttttcatttgtgacttcatgtcaacactcagaaactttcacattttggagcattttggatttcagattagggatgcttaatctgcagctctaattctgatatgcacggtactactgcagagatggaaccattgcctttgtcttttctgttggagtcagtatagatatcttgctactaataatatcagaagagagtgttgagtggtttgctgggtgcccaatactacttttagaacattttatgtattaactaatttattcctgtaaacattcttgacagtttttgtgactatttcccaaatgaggcgtacttgttagcatgtctttctgtttgtggtgagtaagcattcttgtgtattggaagacttgcttactagcatgtcacagtgttcttcatattgaaagcattcttctatcaggagttgacgtaattcagcctgtgggccaaatccatcctgccacccattttttgtgtattttataagctaagaatggtttctgcatttttaaatggttgggaaaacataaaaagaataatttgtgacatgtgaaaattacatgaaatttaaatttcagtttccataaacagttttattggaacacagctttactcatttgtttacatattgctaaggctgcttttgaactagagtggcagagttgagtagttgtaatagagaccatatagctcccagaccctaagaaaaagtttgccaatcccttctctatattcttctgtatctagaatggcagatggtcctcaataataacagcagattggtcaggtgtcatagtttatgcctgtaatcccagcattttgagaggccaaggtgggaggatcacttgagctggagttcaagaccagcctgggcaacacagtgagacctagctctgcaaaaattagccaggtgtcatggtgcacgctggtggtcccagctacttgggaggctgaagtgggaggattgcttgagcctgggaggtcaaggctggagggagacgtgatcacaccattgtgctccagcctgggtgacagagcgagaccctgtctcaaaaatatataaacagattggatttatgtacaggttcatatatatattaattttcttttggtatgcaatatatttttctttcttccactaaacgtttctcttgtcataagcttgatgtcatgtactatggcatatctcaaatatacgtgatttcagctctttgcatacccatattggttttcttttttttttttttaattgatcattcttaggtgtttctcgcagagggggatttggcagggtcacaggacaatagtggagggaaggtcagcagataaacaagtgaacaaaggtctctggttttcctaggcagaggactctgcggccttccgcagtgtttgtgtccctgggtacttgagattagggagcggtgatgactcttaaggagcatgctgccttcaagcatctgtttaacaaagcacatcttgcaccgcccttaatccattcaaccctgagtggacacagcacatgtttcagagagcaccgggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcagtgagctgttgggtacacctcccagacggggtggtggccgggcagaggggctcctcacttcccagtaggggcggccgggcagaggcgcccctcacctcccggacggggcggctggccgggcggggggctgacacccccacctccctcccggacggggcggctggccgggcggggggctgacccccccacctccctccgggacggggtggctggctgggcagaggggctcctcacttcccagtaggggcggccaggcagaggcgcccctcacctcctggatggggcggctggccgggcggggggctgacccccccacctccctcccagacggggcggctggccgggcggggggctgaccccccccacctccctcccggacggggcggccggccgggcagaggggctcctcacttcccagtaggggcggccgggcagaggcgcccctcacctcccggatggggtggctggccgggcggggggctgacccccccacctccctcccggacggggtggctgctgggcggagacgttcctcacttcccagacgggatggctgccgggtggaggggctcctcacttctcagacggggcggctgccgggcggaggggcccctcacttctcagacggggcggctgctgggctgaggggctcctcacttttcagacggggcggttgccaggcagagggtctcctcacttctcagacggggcggctgggcagagacgctcctcacatcccggatggggcggcagggcagaggcactccccacatctcagacgatgggcggccgggcagagacgctcctcacttcctagatgggatggcggccgggaagaggcgctcctcacttcctagatgggatggcggccaggcagagacgctcctcactttccagactgggcagccaggcagaggggctcctcacatcccagacgatgggtggccaggcagagacactcctcactttccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatcccggcacctcgggaggccgaggctggcggatcactcccggttaggagctggagaccagcccggccaacacagcgaaaccccgtctccaccaaaaaaatacgaaaaccagtcaggcgtggcggcgcgcgcctgcaattgcaggcactcggcaggctgaggcaggagaatcaggcagggaggttgcagtgagccaagatggcagcagtacagtccagactcccacggcatcagagggagaccgtggaaagagagggagagggagaccgtggggagagggagaccgagagggagagggagagagggagagggagagagggagagggagagagggagagggagagatttggttttcataataatcataaccctttccaaatgagggagagtaatgaattttatcattttattagttagtgtgcttcctttgctagatcaggaattatatctcctagtaattataaccctctatttattatttttaactatattgctttctacttttgggctttcagccaacgtgtaaatattgacagtttaataatctgaaccaagccacctggactgattgtaatattttaatttaataaatcttgcatatggttaagattacatcttctacattcatcagattggatttaatgcactcaccataatcaactctggaacattcttgcaattattattgttatttttaaaggttttctcctttgtctgttgttttcccactttttttttttttttttaagacggaatctccctctgtcacccaggctggagtgcagtggcgtgatctcggctcactgcaacctccgccccctgggttcaagcgattctcctgtctcagcctcctgagtagctgggactacaggcgtgtgccaccacgcccagctaattttttgtatttttagtagagatggggtttcaccatgttggccaggctggtctcaaactcctgacctcaagcagtctgcctgcctcggcctcctgaagtgctgggattataggcgtgagccactgtgcctggcctgttttcccactttttaaagtaacagccttgttgagatgtaattcacataccatatagtcacctatttaaagtgtacaattcagtggttttagtatattcacagaattgtgcaaccatcacaactatttccggaatatttttgtcacccaaaaaagaaaccccatactcactagcaatcacccccagttccaccattcctaggcagccatggatctactttttgtctatggattcgtctattccagacatttcatagaaatgaaaccacatagtgtgtggtcatttgtgattgtcttctttctcttagcgtgttttaaatgtagcacgtatcagcacttcttattgccagttctgctgtatggctataccacattttatttatcaattcatgagttgacagacatttgggtcattttcactttttgcctcttatgtataatgctactctgaacacttgtgtataggtttttgtgtggacatatgtttttatttctgtcgaatatatacctagaggtggaattgttgtgtcgtatggtaactctatgtttaaccttttgaggaactgccaggctcttttgcaaagctgctgtactatttgacattcttgtgagcaatatatgagggttccagtttccccacatccttaccaacgtttgttattgtctatctttttgattatggctatcctagtgggtgtataatggtatctcattgtggttttagttggaatttccctgatgactaataatgttgcatgtcttttcacgtgcttattggccacttgtatatcttctttagagaaatgtgtatttagatcgtttgtccattttaaattgggttgtctttataaaatgttgaattgtaagagttctttatatattctggattcaatacatatgatacaatacatataatacatattttagtcatctatcagataaatgatttgcaaaaattttcttccattttgtgggttgtctttttactttcttgatggtgtcctttgaagcatgaaagcttttaattttgatggagtttatttattgttttctattgtcacttgtgtttttggtgtcatatttaagaaaccattgcctaatccaagatcacaaagatttcacttatgttttcttctaagagttttgtagttttagctcctatatgtcagtctttgattcattttgagttaatttttgtacgtggtgtgaagtaggggtacaacttcatacttttgtatatggatatccacttgtcttagcatcatgttttgaacaaactgttcttttcctaatgaattgttttggaacccttgtgcaaaaccaattgaccttatgtaaatgtaagggcttatgtctagactgtgtcagtatcacactgtcttgatttgtttaatctatttttgaggcagactttcgctccctgatctaaaattaaaatgtttcacaattgatgatgtcttatatgcatcaaaacttgcagactgggtgtaagtggcttgagaaaatatattggagactaaagtggggctgttggagactcataggaatcaaatagttagaaggtgggggagtgagagaggcagtaagttggatgcttcccaggtgtttagcagccatcccaaagtggcagtcaaaaataggctagctttacataatttcaaagttaggtactgatggttccagtttctttttatggattcttttaaaaagtgctgtatcaccaaatgctgttgatggcatagaagacaacactgtggaaaaatgtggacattgaccagtctgagtcaaaaagatggacagatattcagttctaaatgtgaggaatttttaggaaaaccttgagcagttaattttgcttatttccctttctatgtgtatatgaatgataaatgaaaagtctaaaagagctcctttaataagcctgagataaatgctaagtcgtagactactgcatcatatcttatttggcttttttttagtgccacctaaaatactggtgttttagctttgagatgctcttatcctcctgcttccagctctatctacacctcagaaggagctgggtcctttcccagagtctattgtataaattaaccttcttcctgtagtcactctatgtccatctgtttcccagccactttaattttgttctttttcctttctcttgtgcttgtagatttaagtcttaaaaacaagccaggtattattgtttatagtggaattttgagtaggagtggaggttaacctgtacatcaatctagtaggaatattcattcaatcactcaagggatgagcttatggaaaagttacaaaaatagtagcattcctttatattcctcaccctgctcccttaatgttaacattttatataaaggatcaagaataggaaattagtcttggtacagtattattaactaaactacagagcttatttgaattccatcagtttttccactggtggtctatttctgttctaggatcctgtccaggatcccatattgcatttagttattatttctccttagtctcatccagtttgtaataatttcttaatctttaatgacacctttgaagagtacagatcaatattttgtagaatgttcctcaatttgtatttgtttgatgctttcttatgaataaggttgttcatttttggcaagaatataatgatgcatatttttcagtgtatcatatcaaggagttcatgatgttgatgtgtcttgttactggtgacatttaccttgattccttgtttaaattgctgtctgcagggtttctctacagtaaaattattactttttctctttatggttaaaatatcttgggggagatgctttgagactaggcagatatcctatttatcctcaaatttttgtccattgatttttttcattctttggtggatcactctgtatcatagagtatttgtgacaaatatttgattagcagaaataaagctatgccctacaagaagcaaagatcaattacattgaaatcctattgtattggttaatataacgctagcagctgtgttcctcaactttcaggagcttaacacaacagatgcttttcttctcaatatgggcatttctggttgtgtaggcagttttctgccatgttaattcaagtatccagactaaactttttatactgaagtaacttcaaactgacagaaaatagggatgcaagaatagtaccaggaaatcctgtataccctttactagatttacttaacatttgctacatgtgccttatgattttctttgtctattcatatatgtatatgtattttatatatattttatatatctgtatttatatattgattgccatatactaaatcacttgagattaaatcacatacatcatgttcttctatgccttaatagtttaaacttaatatatttatttgtttaaatctagtatacagtttcagaattgctaacccatatctgtttgagaaacactttcactaactggattacagcatttatacaattcttttattctttagttttgcaatatctagtcaagatacgattttccagtttcccactgaagtattaagtttgaaaactgtacataagcacactgttattcaaatttaggaaatttaatatcagtactttagtatgcagtctgtattccagtttcattaattatccccaaaatgttcttcagtggaatattttttttctcctgatacagtatcaagtccaggatcatgtattgaatttatttgtcatgactttttagtttcctttgatctggaacagatcttataagcctttctttgtctttcatgacatcgacattttgaacaatgacaaatttatgacattgttttgtagaatgtaccaaatttgggctgggtgctgtggctcatgcctacaatcctagcactttgggaggctgaggcaggtggattgtctgagttcaggaactcgagaccagcttggccaacatggtgaaaccccatctctactaaaaatacaaaaaacaaaaaaaattagccatggcacctataatcccagctactcaggaggctgaggcaagagaatcgcttgaacccgggaggcagaggttgcagtgagccgagattgcaccactgcactccagcctgggcgacagagctagatgctccatttcaaaaaaaaaaggaacgtaccaaatttgggtttggttgatggctcctcttgtttagattgagattatgcatttttaaaaaaacttttaggttcaggggtacatgtgctgatttgttgtataggtaaattcttgtcacgggggtttgttgtacagattatttcattacccaggtactaaacctagtatgcagtagttttttttttctcttctccctcctgccaccctccatcctccaataggcctcagtgtctgttgttcttctctgtgtgtccatgtgttctcatcacttagctcccacttacaagtgagaacatgcagtatttggttttccgttcctgcattagtttgcttaggataatggcccccagctccatccatgttcctgcaaaggacatgagctcattcttttttatggttgtgtagtattccatggtgtatatgtaccacattttctttatccagtctatcattgatgggcatttaggttgattttatgtttttgctattgtgaatagtgctgcaatgaacatacgcttgcatgtgtctttatggtagaatgatttatattcctttgggtctatacccagtaatggggttgctgggtcgaatggtatttccgtttttaggtctttgaggaatcgccactctgttttccacaatagttgaattaatttacactcctaccagcagtatgtaagcattcctttttctctgcaacctcactggcacctgtttctttttgactttttagtaatagccattcttactgatgtgagatgttatctcattgtggttttgatttgcatttctctaatgatcagtgatgttgtggtttttttttcatctgctcgttagccacgtgtatgtcttcttttgaaaagtgtctgagattatgcatttttgtctggaatactgcataagtgacatgtccttctcaggcaatgcatcaggaggcacatgatgtctcaacccctcattggtgattgtaattttgatcatttggttaaattactgtttgcttaagtgttaactatttttagatatgacgtatcagagtgatcaatactgtgaagcctcttacaacagtgtttagattgaaaaattatgagtgaaaagcctttcacagtcattcggattgaatatgcctaacatgaaatccaaactgtttcaacatttctttcaagtcattttctactatggaaataataatgcatgatttagccatgcctgagttttatttcctcacgcaggcatttatttctttaaaaaatttaatttaaagttcactataaaacttaccattttaaccatttgaagtgtacacttcagtggcattaagtacattcacaatgttgtgcaaccatcactaccatccatctccaggacttctttatcatcccaaacataaaccatatctactaaacagtaactccccaattccttctccagcccctggtaacctcattttatatgccatcacaatattttagaataaacgccaacttcctggggtaagatcatttgacttttgctcccagatcagaactatgataaaaatattatttgctatatactaacagggaaatttctggattttggcatgagttactgtattataactctaaatcctggtaagggaagcatttttattctgaaagtaaacaaaaataaccattagtatgataatctttacctctgggggtggggtattttggagggggtgagtacaaagagaggtgaaattattcctctagggtggcagaccagagtttaaattgtttcttatgtttttcatcttggttgtctaccaattggatatagtcactcagatcatccatgtttttgtacctggtttgataggtataaatacctataaattggaataaattctagcaattagaggtccatgttccttggtctgtaaagtgaatataacaaaactgacttctctccaaagggtgctttgagacaaaactataaaacactttggagagtagaaggggggtccttatttttagtaacattcctcagtgttcttcaagaactcacctactgccaatcattcctctgagttaagaatatatattagaactagttttaatagcactataaactatagatagcatggccatatgtccctgtttgcctggagctgaataaattacaggttcaaaaatactcaaataataaaattgcctaggtggtgacccacctagtttgttgctgtatggtgttgggtatctcttttttttccttgacaaatttgaaaaggccttgaaaccatgagcagattccttggttcagatggtctgtaataggagacaccaggacaagcctgagtctcctgctcttgaaagattagcatattgatagattgcgtacccattatcagttaggtatctgccaaaccatttgcagcgtttctctggagttcatacagttgggaagacttcctagaggcaagaggtcttttacctgaagattcagcagttactataggggccttcttttggcttcttgctcttgggacacctttacttgaatgaggtagtcttttgccattagtgcctgtggggccttaatgattcctattgggatgagttggccagaagtgaggctctccacttcatgttgaaactaacttctgcctgagtattaaggatgggtgattctgaggtcctgagccagctggaaggactttcattcactttctactcttgtctgaagaatgcttaggctaccttactgttacttctctggtggtaccaaaggccatgtaatgacatggctggatgcgatcactcacgtctgtaatcccagcactttgggaggccaaggcaggaggatcacttgagcccaggagttcaaccagcctgggcgacataggaagacccccatctctaaaaaatttttaaaaaatctagctgggcatgttggtatactcctgtagtcccagctactcggcaggctgagatgggaggattgcttgagcttaggcgattgaggctgcggtgaaccatgatcacaccactgcactccagcttgggcaacagagcaagaccctgtctctaaaaaaaaaaaaaaaaaacaaacaaaagatgtgatgattgcctctttcggttatatcctgctgcctaagagcccaccccagaatttagtggcttaggataaccattttcatagttttgtcagtgagggattagggaagatgtcagctgagctcttcatttctgctccagatggcattggttgggcaatgggactggaggttctaattctaagatagcttcttcactcttatgaatagctcctcagtgtctgtggccagtctctctccatgtggtatctcatccaccctggcctttccacatgccttaggcttcccacatcatggtggttcctgggtagttactcttcttacagagtagggatgaaatgaaagcctctattctaaattcagttaaatactggtacaaatatttagtactgggattgtgggatcattttcttatatcataattataacccaatcagggtagaaaagtgaaagaaagaaggacacttcattttctttgctctttgtgtggatgatgggttgtacaaatagcaggaggttcaacttttggcttgttttggattactgagtactatccttcagaaatgatttcctaatactttcccggccatctggcatgagcacagaagaccttttactcaataaaagtaagctaataataataagttgaaacatcttgataataaatatatttgtacagcttttcaaatcccaggttattgaaattctgtcagccttggctggtttccatgctccttctgtgcccttgtgtttcctttttttctttttttttttgttgagccactcctgctgacttccaaaggatgctctgagctctaaaaggaggagcagttttgctggcatgcagaagtggtgaaggtaaggcttggattcaattacagtaatctcagaagttcttggtagaagaggggcacagaatcccagcctccattttgcaggtaaggaagaagaattataaaaagataaaatggcttttcttaatgtcagcatctgattctttaccttctttcaccctagcaaagattgttaacataaaacagatgttccttggacaagagaaaagtaatagagctggatcttttcatgatcctgcatttattatttgtagcactggatctctaaactaggaaaagcaatgtcgattctaactagaaattatggggcatttaataacacgtgaggcaaaattatgaggaaaggcaagaaaccaagtggctcctagcttctaacaccttattttctatggtgtaagttaatgaatgatccatttttaatgccataaaaaaggaaatttccgataggctttaccttaacttcacgttgctgtttatattacagacaaaatgctaaagttaacaagtgtaaaatgccctaggtcagggtttcgagtgcccataagcaattctctagaattattttgagtgctcagattatagatttgcccccataccatatactgtattacctatcactgcaagattctttatagggtgtcaagtatgtgggaggatttaaactaattgtcttaaatgcttcatgggataggagatgatccaatgggaactgaatgttttcaattaggatgtttccatggatactattaagcatgccaagattcatagccacaggagatttttacttacttcaatattgattaagaaatctgagaacaatctcaagaagtgtaggatgtaggcggaggataaattttgaggatagtctaaaatttgctttctcttccatagttaaggcctagtccagaaaaagtctaggcagtcagccaagtctaacagcaggatttatgtcaagagaatgtccagaataaaagtgaacatgggttgtttcatttaccccaggtgtatttattaacatttatttaatgttacttattatttgtttattaccattagctttcttatgtactcggtacaaagcattagaattacaaccctttgtatctttgttgtttatgaggaaaacatcctaaatagtgtctacagacatcttaaaattcacattcctctgagaaaggtttatcccttaggttattacttttttttttttttccacacatgggttttttacctgggttctcagatctccaagaaatcggtggatagaattcaaggtgacttcttggatggagaaaaagtacgtctttattttgaccaaccatggatatttagcattttcatcaattaatgaatgcaggtgacaaatcacagtactattggccccatctttgagtttgtcctcaatagctcacagatattttcatattgtatcacagttgttgcagatatcttgaaatattgtttattctaatcactccttcaaaatttgggtggttattggcattatcaccagttttttttttttttttgaggcagtctttctctgttacccccaggctggagtgcagtggtgtgatcttggctcactgtgacctctgcctcccaggttcaagtgattctcccgcctcagcttcctgagtagctgggattacaggcacatgccaccacggcccggctaatttatttatttatttattctttattttttatttttaaattttttttagatggagtctcactctgtcgccaggctggagtgcagtggtgtgatcttggctcactgcaacctccgcctcccaggttcaagcgattctcctgcctcagcctcccgagtagttgggactacgggagcgtgccaccacgcccagctaatttttctattttaagtagagatggagttttaccatgttggccaggatggtcgcgatctcttgacctcgtgatccacctgcctcggccaaaatgctgggattacaggcgtgagccaccgtgcctggccacattaccaccagttcttgatacttaatgccataacaaaaggcacatgtatcactatatcacaaattagcattttataatattttaataacgttttcaatataagtggcttcccttgtaatcatatattttatttttgcacttaaaaatataattcctaaaagggatccataaagcttcaccagactgccaaagcgtccatggcacaggacgttaagaaccctgttccaaatggaatgaagattagaagcactatcatatgttcattttctgatcgcagtttaagaaagagtttcctacttaagtgcttttcacagaaaatctaaacttaaaggttaaaagggaattcttttgtgctggctcatgtgtgggccctacaaagtactttgcagtcatatctgactttcgtttgagagtttgtcttcagaaatggaagaagaaaaggcattcaggtatatgacaggttgcattctgtagaacattgttaaatctatgggaggggagaaaagttccattcagtgtcttgtggattgtggtaggagtcagttgtgttcttgcagaaatttccctagacagtgcctcttgcctcctcctttcttgtcccacagtactccatggagcagatgtgggaacttggatgcctgatgggaattgtaaccccatgctttgccttatcctggtggggactgatctgaggtttatccattaaactgtatcagttcatggctgggagtaggaatgcagaaaacacaagcaaaatgactgcaggaaggtttaaataaaatctcatatgtggcttttccttaacacattattttgcaaaaagtggcagagtgaatttgctgtgatatgataggatcattctggacttttacttaatttacgtgttctctagcagaatgctgaaggagcacacataaggagtggggagttggtatttggttctgtgacaagtgctatcttataacagaaaaatacatatttttgtgaaacttcaaatgcatttttattccccagcacatctgtgattctggatccactaccttcttccaagtgtgatcaagcactgtacctgacagtatcgattatccttacccgtaggcaaaaattgtattacatttattttacagtgatctggaaaaaaaaggatgacaacaaaaaccagacacacttcatttctattccggtaacattttttggtaataatttattactgtacaagtcacacaccatataagtcacacatttaaagtgtcaaattaaatggtttttagtatattcacaggatcgtgccatcatcacagtcaaatttagaacacttattacccccaacaagaaacctcatacgctttagcagtcaccctccattgccccccagttttctaaccccaggccctaacaaccactaacctactttctgtctctatgaatttgcctcttctggccatttcatataaatggaattacacattttgtaaccttttgtgactggcttttttcacttagcataatgttttttaaggtctacctatattagagtatgtatcagtactttattcctttttatggccaaataatattccattttctggatataccagattttgtttatccattcatctgttgatggacatttgagttgtttccactttgtgctattattatgaataatgctgctatgaacattcatgtttacatcatgtatacattttaatgtggacatatgtttttagttatcttgagtatatacctaggagtggaatcatatatatatgtttttaaaccaaaatcaaattttaatgttgcagaatccctgaagcacttttaggaactgttcacttccatagaacagtttgcaaatcagtgttaaagtggagagagtgttgatttttttgtgcatgtatttggtagacatcgtttgaatcttgattttataggctgtgtgaattttgtcaagttacctgtgaacatctttcttctagtatagaatgttagtacctctggatgtttcacgagttgatagactgtattattgcttgaaaaattcactgtccatttattaccatcaactttggccacggatttgctttggctagtggcctgtgaggggaagtgatgtgtgccttcttccaggcagaagctggtggtttgcctcatctcttttcctttctgccatgatgaccattgatgttccagttggacacaggctccatcagcttgtgtatcagaatgaaaatgatgtggggcagagccctcatagattttgttgcatgagtatggaaaaagtgtcattttaagccgtcaagatttggtgactatttgatactttagcacagtggtcctcaagcaatggcagttttgcatttctcacactgagatatctggcaatgtctggagacattttttggttatcacacatggggaagtgctcttggcatttagtgggcagatgctgctaagcatccaacactgcacaggacagctcccacaacaaagaattatctgatccaaaatgtcaatagtgctgaagtttagaaaccctgctttagtataacctagtttatcctggttaagatagggtgttgagaagattaaatggaaaaaaaatatataaaatacagcacacagggtggtctttttttggtaattatgtgacagagcttggcaatggctctgaggtcttcccttgcatttgtgggtcttttccaacttccctagggttcagtattcagtttaattgtagttgtgtttataaatcaaggctcgtttttagcagaatcatataccctttaaaaaagggggagaactaacattagatgcctgtttggcaccaggctctttgtatgtgttttgaatttttacagatattctctgaaactgatattccttacctccattttgttttgttttgttttgttttgttttgagacaggatctcactgtgttgcccagactggagtgcagtggtgcgatcttgtctcactgcaacctccacctcctgaattcaagcaattctcctgcctcagcctcctgagtagctgggattacaggcatgcgccaccatgcccagttaatgttttgtattttcagtagagatgggatttcgctatgttggccaggctggtctcttaacttttggcctcctgtgatcccccagccttggcctcccaaagtgctgggattacaggcatgagccaccatgcccggccctccattttgtttttgatgaagacattgaggcactgaagttaagtaatttgaccaagatcacatggcttataagtggtgggcctagaattcgaagcacatctgtttgcctccagaaccctcttctttccacactgctatactacctctttagcagtgactttaacatagagaaatgaaggtaatacctgatttctaacaattatgtgttgtattagttatctattgctgtataacaggttacctcaaaacttagcactttaacacaacaaacagttattgtctgacatagttttgagaatcagtaatttaggggaagctaagctgggtggttctggctcaggatctctatggagattgcaaacaagttgtcttccagggctgcagcgatctgaagacctgattggagcaggaagatccacttccattgtggtgcactcacagggctgttggtgggaggcctcagttcctcaccatgtgggtctctctttagggttgcttgattgtcatcatgacatggcagctggcctccttcagagtgagggatctcagagagacagcaaggcagaagccacaatatcttttgtgacctagccttagaagtcacagatgatcacttctgctcttttctattggtcacatacacaaccctgatataatgtgggagaggatgatacaagggcatcaagaatactatgagatggaaatcactgggggccatcatggaggctggttactacatgttaatgatcctcatttgccatagttacaaaattatgaattatatttccttttcatattctaatattccaaacacctgttttgtactttaagatacttaaatcatttagaatgtgagtgaaaatacaaattggcttttgtaaacacttactgaatgggtaaaataaaggccgtggtacagatacttcattggggaattttttttttaaataggtttgactagctgaggcttcttgaatcctgaaaagtttggtctgatgtacttttttttttttcctggaaaatctccttgtaccaaacactgaattcttcatttgccaaagtccacccaactttctgatgtttttattgctggtttgatgtgcttgaatgccagccagagtataaggtgaatggtagatgcaaggactgtgcagtttccacggagacttctttcaggagcccttcattttttcattcagctattgctgggaggcatccccttccagttaatgtgtggtacacatcaatttgagtggctcttagaaaggggctcagtttatacaaattaagaattgaggttttttttttctctgtatatcttcaacgttaaattagatttctatgaaacttgaagatgttaacaggaaatcttcctgaaacagtttaactatacttttgtttattacacttgattttgagcttttgggaataaaagtagggtcctggctaggtacagaggtatatggatttactgtgtctaatcgtgcaaccatgaaataaacgtttgcacttcaggaatcaacccatcactttttaaccactgttgtttgcattggcttagagctttgtgcttccttcaactattttccttttttctttcaaaactgtgttcagttggttgtgaccaattttacacagagactggctcactcacttatgttcttgactcctgctgtcccaatatcatgcttcatttacacagggatagcttttcctggctttatctgttgacttgacatcctgtgcatcatatttcttttcttagatatagagaagactgaaaaaaatccacgatttgaagaaaatttgcaaaagtgcagagcaatgtgaaagagatagctttaattttaattttcactgtagtcagaataggtggcctcctgatgggcagacttgctttctcattttactctgtccagtgtagatacccagatcaatcaaggtcaagctggtctggtcattaatacaacttttggttttaaacacagctgtgtacgggggttcttagcattattaatagaggttataatgaaaacaaggtatagtcatacagttgtctgtgtgggtagtggcatggaggtggagttgttgcttaagatctgaaagtcaggaagctggaggtttttgtaattttattcattatcaatcttaagaatttattttgatcattataaatgcatgactggtgctattttccaatcctgaggttttttgggaaatttttttgaaaagaggccaggatgaggataaaaattaattttgaaaatccatttcaaagactcattatgctatgctccatcactgcaattttaatgcaacttatatattgtgcttttacctttgggactagcattcttaaaagctgacttttaatttggactttctaatatgtgtcggctctgtcagctcacgagtgtgtttttatctgtgcatcatgttatattgggacctgggtggaatgtaaatcttttactggcctaaatctgagtctaatcctctgcatggctttggtagaaaatcaatttcctctgctctgtcaagatttttcaggtcagtgctctttggaagtttcccagttctcttagattaaaatagattttgtttctgtgctacatactggtattagttagtaggacactgggatctaaaagcaagagaacagaggcagacaagatatccatgagttcttctatttcagttaacttgttgacacactgcacctttgaggaaccaaggagtttgtgtgctttcaggcatcatttgggggagcaattgtaaatgactcctgtaggtgaggctgtgcacttaattttaatgagttcaggttcattaagtgacctgctcactgggtcattagaagtgacctcactagaagtgaatggtaaagagaagaactacctaagttccactcagcttgtttcactactgtggggtattggaagtagagtgacaacttggactttctcagttttagcactgaaaagtcccacatcccaggaacttactcagtccccagcaaactagggggagcgggggatggttggtccccctagcagtgaaaagtaaggggatggatgatttggaactggttagtacccttatagatttttttttttttttctgagacaggttcttgctgtgtcacccaggctagaatatagtggcatgatcatggctcactgcagccacgatctcctgggtccaaatgatactcccacttcagcctccccagtagctggaactacggggacaagccaccacacccagctaatttttatttatttatattaattaattaatttatttttttgtagggacagggtctcgctttgttgcccaggctggtcttgaactcctgggctcaagtgatcctcctgccttagcctctcaaagcactgggattacaggtgtaaaccaccatgcctggctgtcttataaatactttaaggagggatttattagagacatgtagcaccttgctgcccagtgatgctagtaaatgagtgactctactttgatttgacagaagaaacaatggaaagaggagagatggaagtttttctacctaaacttcctaagaggatgtgtttaggggatgtgttggtaaaaagttattagcattaatgtttacctgtatctttctcatagataatgcaaagacctttaactccacttatccctccttttaacttatgttgttattgccttgtattttaatactatatattaaactctacaagacatcattattttatgcaggcattgtttatttaatcagagttcagtaaactttttctgtaaatgccagatggtaaatattttaacccctgcaggccttatagtctctgtcacaactactcaactccactcttaatagtgccaaaatggctatagacaatatggaaatgattgtgtgtacccatgttccaataaaatttatttacagaaacagacagtgggccagatttggcctgcaggccttactttgacaactcctaatttagatttatctacatatttatttattttccctttatttcttgctatatctttgaggttctacctgggatcattttcaaggcaaggatgtctattctcatcactgtttttcagcgttgtgctagaaattccaaccagtgcaataaggcaagaaaaggaaataaaaggcatacagagcagaaaggaaaaaaaaaatgaaactggccaggtacagctgctcatactttgagaggcgagctaggaggattgcttgagcccaggagttccagaccagcttgggcaatgtagggcgacccccatctctacaaaagtaaaaataaaaaaaaaattagcagggtgttatggtgcatgtctgtggtctcagctacttgggaggctgaggtgggaggatcacttgggccttggaggtgaagtgagccatggtgactgtatcactgcattctagcctgggcaacagagtgacaccgcctgtctcagaaaacaaaacaaaaacctgtctctatttgcagatgacatgattgtctacatagaagaccctgagaaatctacagtctacagaataactcctagacctaattaagtgagttcagcaaggtttcaggatataagataaacatacaaaaatgagttgtatttctacatactagccataaacaaatggacactgaaattaaaaatacaataccatttacattcactcaaaaaatacttgggtataaatctaacaaagcatgcacaggacttgtatgctgaaaactatacaatgctgatgaaagaaatcaaagtctaaatagatggggaaacataccatgttccgggtttcaggatataagataaacttacaaaaatgagttgtatttcacatactagctagaaacaaatggacactgaaattaaaaatacaataccatttacattcactcaagaaatacttgggtataaatctaacaaagcatgcacaggacttgtatgctgaaaactacaaaatgctgatgaaagaaatcaaagtctaaatagatggggaacataccatgttccaggattggaagactcaacatagtaaagatatcatttctcccccaaattgatatacaggtttaatgtaattcctgtcaaaatcttagtaagatttttttgtagatataattataaaatttatatggaaagggaaaagaactagactagctgaaacaattttgaaaaagaataataaagcaggaggaatcagtctgtaagattttaagacatataactacagtaatcaagactgtgtgatattggtggagggatacatgtatagatcaacggaacagaacaaagaacctagaaatagaccaacagaaatgtgcccaattgatctttgacaaaattgcaacagcaattgaacggagaaggaaagatagcctttttgacaaatggtgctaggtcaattaaacatcaatatgtcaaaaaaaaaaaaaaactcttgctgtaaatagtacacgttatatgaaaaataactccaaatgtatcacaaacttcaatgtaaaacataaaactataaaaataattagagaaaatcttcaggatctaaggctaggcagagttcttagacctgacaccaaaggtatgatccataaaagaattgataaattggatttcatcaaaataaaaaatacttactctgagaaagacctcataagaggatgaaaagacagactacagagtggggggaaatatttgcaaactacgtatccgacaaaggactggcatctagaatatataaataactttcaaaacttaacagtagaaaacaacccagttagaaagtggaaaaaatacaagaagggacatttcactgaagagcatatacagatgacagataagcatgtgaaaagatgttcaacataattagccactagggaaatgtaaattcagaccaaagtgagctatcactacatacctataagaatggctaaaattaaaaatagtgacagcatcaaatgatggcaaggctgtagagaaatggaatcattcatactttgctgatgggatgtaaaatgatacagcccctctgaaaaacagtttggcagtttcttaaagacactaaacatgcaactaccatatgacccagcaattgcactcctgggcatttatcccagagaagtgaagatttatgttcatataaatgccagtatgtgaatgttttataggagttttattcataatagcccataactggaaacaatacagatgttctttagtggatgaatggttagacaaactggtatatccatagcatggaatactacccagcagtaaaaaggagtgaagtactgatacatgcaatgatctggatggatctccagagaattatgccgagtgagaaaagccaatcctgagtggtttaaataccatatgattccatttatgtaacattcttgaagtgacaaaattatggagatggagaacagattagtccatgccaggggttgagggggcaagggttgggagtaaaatggatagctataaaaggcatgatgaggccaggcgtggtggctcacgcctgtaattccagcactttaagaggccgaggcgggtgaattgcttgaggtcaggagtttgagatcagcctgaccaacatggtgaaaccctgtttttactaaaaatacaaaaagtagctgggtgtagtggcaggtgcctgtaatcccagctactccagaggctgaggcaggagaatcgcttgaacctgggaggcagaggttgtagtgagctgagattgtgccactgaactccagcctgggcaacagagcaagactctgtcttaggaaaaaaaaaaaaaggcatcatgggtccttgtgagcatgaaaatgttctctattgactgtgtcaatagagacacacaattatgttgtgtgtcacaaccataatcacaacattatggttgtgatattgtactgtagttttacaagatgttaccattgggaggaagtgggcaaagggtacataggatctctgggtatcatttcttacctctgcatataaaactacagttgtctcaaaaggtttaattaagaaagtatttaagaaaaagaaccccaggatctaaaaagatcagagtcagagaatcacaaatgctaaataagaagcacttttgtatttggtgatgttctgaaattctggctcagttttgttatgaaatggagccacgtgggtccatgtgagtgagtccctgtgcacaggtgtatgattgactttttccctcaagtgcttctaatttgggatgttcttcactgtgtgccctttgagtgtctcttgcctctggttttttgttagacaaaaaaaccagtttttaaatgtcagttccaaggtcttttctgggtacggttaacttttatgatttcatttatgcagtgggttttcacctaagggccatggtttctagacactagactcgtttttcccaagcgattcatctctttgcctgtgggatggagagattcattctcttcttctcttttgcagtagaaactccagttttgagctgggcacctggatgcccagagtaaaggttgtactgcccacatttcattgtagctaggtgtgcctgcgtgaccaagtatgaaccttctatttagattaagccacaagataagtggagctatcaattggctttaacaaatatttagtgaataggtaaaataaaatactttatataagagctgtgtgttctgggttgaattgtgtcccccacaaaaagatatattaaagtcgtaacccttagtacctcagaatgtgaccttatttggaaagagggtctttgcagatataattaatttcaggtgaggttataccggagtagggtgggctcctaatccaatatgatgagtgtcctcagaagaaggcagtcaggcacatgtaccctaaaacttaaagtagaataaaaaataaataaataaataaataaataaaaaagaaggcagtcaggtgaagacacagacacacagtgggaaccccctatgaagatgaagatagaagcaatgtatctacaagccagggaccgcctgcggctgcaagaagccaggtgagacacatggagctgattctccctcacagcccttagaaggaacgtgccctgctgacaccttggttttggacttccagtctccagaaccatgggataataaatacatttctgttgtttgaagccacccaatttgtggtactttattatagcagccctaggaaaccaatatactatgcttttgatattatttttaggatgttgtggtttgaatatttgtgtctcccccaaattcctatgttgaaacctagtctctgatgcgatagtattaagaggtggggcctttaggaggtgcatgagggcagagcccttatgatgggattagtgttcctagaaaagagacttgagggagcttgtttgccccttccagtatgtgaggatacagcaagaaagtgccatctatgaggcagagagtgagccctcactatacactgaatctgctggcaccttgatcttagacttcccagcctccagaatggaaagaaatttctgttgtttataaattactgagtctaaggtattttgttgtagcagccccaacaaactaagacatggagtattttaaaaaatgggttgaacattcagaggcttcttaatctgagtccttagatatttggactgactctgccttctttttccagtgaaaagatctcgctgtatgaaacatagacattcttcattgccccaaagcccttccaccttccttatgtttttattgctggtttgatgtgcttgaatgctagccaaagtataaggtgaatggtagatgcaaggactgggcggtttccatggagacttcttgcaggagcctttcctttctcagttcaacagttgtcaaggaaacatctagtttcaattaaataaatgtttgtggggtctgccaatttgagtgtctcttggaaggggatttggttaaacttcttaaacatcgtaataaacaaattcagagcagaggctttttaggttcccttccagttatattaggtttttctgtaacttagggatgttaactagtcctctgtctgaagtgatcagactatttattcatatccagaaaatattatttttgagtcttgtggggaggaaaactgaggcttaaagaaagagaggccaaagccagggagctggtgttacatggcaccagctatatatacatgactatagtccatgctctttagtacgtcctgcaggataagagatccaaggggcctgacctttacaaactgtttacaggctatggagtttgctggctcagcactgtgtgtttattgcttctagttagctattgttgtatcagtggctggagttggtgatggttcacggaaatagtggtgagagtacagattctaggtatatgcaattctaataaatgagacttccctagtgttatctgtattgtgacagcctccccattgtgctctttatcaaacagtaaggtatggtatattgcaaaatgctcacaatactttgcaactcttcccatcaagaggtagagtcagtttctctattcttaggatcttggctgtcctgttgatttggtctgaccctggaatacagtagaaaagaccctgtgtgggttttgatcctaggcgtgaggtagagcttcagtttcttgctgctttgggaactctgccaccttgtaaaaaaagccctggctggcctcctggaggaagagagactatgtggaggaaaatgaaggtacccagacaacccaatagtcaactgcagaagcataagtgaccctcatctgagatcaatggtgcctggctcggatcagtataattgtccagctgaactcagcccaaattactgacccccagagttatgaattaaataaatgctgttgctttaaggcacttaagttttggggtggtgtgttatacagtagtagataattgatacagccaagtttggaagctctggaatgatcagggctcacctttgacctgtcctctataaaacccaggattcttagtaacacagtcctgttaataacagaacttgcctatggcaaatctaagcggaaaagcagtttattggcaggatattgtgtagctacatctttctttaggaagaccagggacaaggcttgaaaactgcacaactagggggcagtactgccagaactacagccagataacctcacagaattggtagctactgaatattggatgcctccacctacaccaccaacattgcctgcattggacattgggtatggggctgctcctggaactggatgttgttcctgtcactagaaaacaatcatctactgttcttgctgtttcacagcactcattactgattcagatgcccgtgtgccacgtgtttatagcagtgcaatttgtaattgcaaaaatagggaaccagcccaaatgcccatcaatcgagtggataaagaaaatatatcaaaaatatattttatatgtgtgtgtgtatgtatatgtgtgtatatatgtgtgtatgtatatgtgtgtatatatacacacacgtacatatatatacatatatatacacacacgtacatatatatacacacacgtacatatatatgcacacacacatatatatacacacacgtaacatttataatacgccatggaatactactcagccataaaaaggaatgaaataatagcatttgcaacaacgtggatggagttggagaccattattctaagtgaagtgactcaggaatggaaaaccgaacgttgtattttctcacttataagtgggagctaagctatgaggatgcaaaggcataagaatgaaacagtggactttggggcctcagagggaagggtgggaggtgagggataaaagactacacattgggtacagtgtacactgctcggctgatgagtacctcaaaatctcagaaatcagcactgaagaacttaactcatgtaaccaaataccatctgttcccccaaagctatttaaataataataaaaacaaaaacaaatgcctgtgtgggtggtgtctggcagagcgtaggtcttgtgcccataccctgattgaaaagaaatcaggaaagtgagaatctgacacttttagcttatttagctgaaagcaggtggaaaatttcataaacactggcaaagggttcggataacaggcagccaaaagaaaaatggcaaatgttcattagtttctgttgtatactctggttagctcagttggttacagcacagttatgatgaagccagcattgtggtttgttcttaagttttattgaaagaaaatagttctgagattgtcccccttacacctgctccctctctcacagatgtgtgctgatagccatttgtaaggccaggcaatagtggggcctaacttgcatctgtctctggctgctaaggtacaaagattatgtgtctttcagttggtgggcccagagactccattcactggcatagtgtgccacataagagaactgaatgaatggtatctgtgtgaatctaaggggttggctaattgcgcagtgaatttggttcatgtaacatttataatacaaattgttgggcagcaagatctttcaatccagacggtttctagtttttcagaatttctctgataacttctctgaactctgaaattcttatttgcaaaaccatctatatagggttcatttaaatattagaaatagtactcataaagagaaaagcataatgcctagaggatgtgtaatagatgttcaataaatgttgatcatttccctcaaacttcttagattcacacaccccaaccagattagaaactctgacacggcttgccctttttgtgttcaattctctctcagttgttaagtgaagacccaatccagttgttaaaataataaatgcacctcttgcctccctgacattctggcaaccttactctgaggaggctggcccggttcgaagctggctgctccagggcactaaagctggagaagggcccttccaccctgttcataactgtggacagtaaactgtatttgggatagaggatcttgggaacaataaggacctagatccaagctcatgcattgtggtgggactgtcaatttagggggatgggtagattttatcagatctgtcagtggaaagtttggggagatggaatagtatctacaggtagttccaggtaggaggaagagatctacctggctcctagggatgtccatcctggcaagcattgctcagtggcaggagttgtaagagtagggaaggtttaggaatttggatatcagggaagtgtcagcaggtagctggggatgaggtgcaggacaaagacagacgagaggaagaccaagccttaaagtgatgagtatctagatagggaagaggatggatgggtatagcttggacacagaaaggggattcagtcatggaaagaggtcagtctgcaatgtaatgtggctatcaggtcacaggagggccaagagcaggacaggtttggggcttggttctggttagtcgaggcagagccccttagaggtgtttggatttgccatggtgatgcaggggacctgagtgtgctggttgtcatgagatcttgttgctgggagaacagtcaagaacagggtagaaaggcccttccccagctttagtgtgccttggagcaggcagctttgaatagggccagcttcttcagagagagctgccagaatgtcagagaggcgagaggtgcatttgttattttaacaattggattgggtcttcactgggagctctacaaagaaaccaaattagtgaagttagattgcctatcccaccaacaatggatgtttatggtatgagtttagctctgtgctagagaatctcaatatatttagatttgggcttgagagagagaacttcagtgtgatctgagactgaacttccattcacattcattcctcgaggaagcatgttgaggatctatgtgtaatatactggtgttccatttacttgaaatatcctggcttgctctattcctctcacttaggcactcactcctctaaaaaataaatgtgtatatgtgtatgtgcatgtgtgtgtacatgtaggtgtaagtgtgcataaaatatggaatagactgaaatcaacaaacttataaaaataccaaataacctcaatctgtaattttatttttgagaagcactaaaaatgtcaataaatgaattgtctgaaaaactaatcctttggctggtgagataagtctgagttgccagaaccagttaaagctttatataatttggcagtacatttgcgttcacctgagatttctctgcctccagctgtacaaaaattctgtgatatgcagagcctcgaaacctgggccagaatgctaaaactaattttctttcgtaatctgagccgtaattgcattttaactcagttctagtgtgaagactgcttttgtatgtgtgtgtgtttacttcatgtcattaatttctggcatttaagttagtgcctggcacatagtctaccctcagtaaatgttagttcttactgccgagtctactgttctttccttctaaaccagtggggtagatgcttcctttgtgcctcagtggttcattcccttgccctcttcccctctcctcacccttgagttgttagatcctggttttgccccaggcaggtgccaaccccgaggaactcctgaccctgtggtgatgcatgcctgcatgtgtgcagccagctgggcagcttggaaagccatagtattgacttgccaaataaggactagtttacaaaagtcataagagatcactgtcatcaactgctatcactatctattatcctttctctttccaaaacacaatttaggtgcataataaaaacatctgtagaattactctgtcaagcctatgtatgcccatcagttgtgcaagagcctcagttcctacttctaatgaattttatactgattatcccagacctttctgccagctccctaatagcagaggagagaatacactgttggagtcaggggcaaccaaagcagctagtctgagtatagaatttctttgaattctcatctttaagaaccatgctcagctgggcacagtggttcatgactgtaatcctagcacttcgggaggccaaggtgggaggatagtaatggcctggtgtggtggctcatttccataatcccagcactttgggaggccaaggtaagcagattgctggagtccaggagttcaagaccagcctgggcaacacagggagaccccccatctctacaaaaaaacaaaaaagtagccaggtgtgatggcacttgcctgtagtcccagctatttgcagagggctgaggcgggaggatcacttgagcctgggaggttgaggctgcaatgagctgtgattgtgccactgctctgtagcctcgaggacagcgtgaccctgtctaaaaaaaaatggatgatatatccacatgattcagaattgaagaggtacaaaacaataaccaataaactctttctccccactgtgtcctagccaccttgttttcttccctggaggcatccagaagccaattttgttagtttcaacttctggagatggcttatgaaaatataagtaaatgcatctatattcaaccccattttagaagaaatgatacctactatatcagctgctttctgtgcaccttgctttttttctttttcacactttagcatgatgatttttctgtattggcacataaagagcttcttctttgttagttggtggttcttatggcagacaactgaatccaccctagatggttaagccaaaaagggattcggattttaggtaactcatggaatcctttggagggctggaggaacaggctagcatccgggtgcccagaaacaaagccccaagacacacgtagtactagcattaagtggaagccacctgtgctgctgcctccactgaacagcagatgctaggtatttgacttgactgcaactgcctctacctccactcctgcaccgggaaggcaacctagcagtgacacctgcaaaagtagaagctctgagcagagcctctttccttacatttctcacttctaaagcaaaatctggtgtggatgtatctgattagtggtgactaggtgacacatttgcatcttagcttcaatagagtctaggaattttattctcaacttttaaacttggaggtgggacttgtaataggtgaaatttttgcaaatagagaaataattttcaaagtatgatggacagtcacagatatggcaaatgtccactagagctgcttagaattccattgtatggatcaaccacaattgattaaactaatatcttagatggtagacctctaagtgttttctagttttctagtctgtgacttaggcaatactgtattaatgaccatatacatgtgtcattttgctaatgtaaaatggaatataaatttctagcagtggaattgctagatcaaaaggtaaattgtaattcttgtggatattgccaaatggtttctggatgctatactgattttttgcttccactagtgatgttcctgattttttttttttttttttttttttgcacagagtcttttccttttttagattccttctgagccagagtggcaggctgagtgttccctgctactggggtgagttttgggccttgggccaagaatgctgacaaatcagatctgggccataacctatgccaatatagactgtatttagcatctggactggatttggcttatagtttattgtagtccttctagccctaaattaaatggcatcttggggtatctaaaagataatgttgcttccaaaattgatttgcaatgtgggagtagcttacatcttggattgttatgtgttcacaaatgcataaagatgttttcaaagaatggttctaaagaattataataccttttctttttaaaaaagcaaaatcttggccgggcacggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaaatcttatttctagtgtgtgaactattgcatagattttgccaatatctgaactatggcatccaattgctctggttggttgccatgaaagtttatagtaacataggaagctcctgtttgaaagctcctgaaaaatttaaacaaatgtatataaatgggtgaaaaatgggggctgaggaagaaggtgaatacatgtgttttcttctcatggaagtgttcactattttttattaaattttttttagagacagggtctcactatgtttctcaggctggtctcggactcctgggcccaagtgatcctcttgtctcagccttccaagtagctgggactacaggcacgggcctccacatctggctgtgtttgcagtctttaagttggcatttacctagtgcagttgattatttcaagaaaatacactttctacatggctactgagggtatctgaaaggatataaagtatagcccagggaagtagcatgttgttaggcaggggttagtaactctttctggaaagggtcagttggtattttaggctttgcaggccaagaaacagaatcaaagatattacataggtaattctataacaagagaaaaaataaacttctacaagctttttattgacaaaattcaaaacataataactgaggacttttttttttggtaatacaggtctactcataagaagaacagcattcttactttggggataacattttgcttaatgggattcaaagaatagtgttccctttcatcaaatcgattgcaaatgttcatctgtaaataccatttattttctccttgtgggccatagaaaaccaagcagtgggctggatttgacccatgagcggtagttttccaaccactgatgtaatggaaagaccatgagctttggacctggatgcatgtaggtttgagtactggctctgaatttgtgaccttgaacatatcacttaactttctgaattgggaaggtttatttgtgtataaactgagtgtaatgacacctatctcatggaaaaaatattacccccatctttgtgattttgcattagtattctagttctgtagatgctgatatgatttagctagacttacctagaaaattagtatttaactgattttaaagctgacttttcaagggatagaacactcacatggtcttaaagtacaatgtaaaaacatagctttgcaatgaagagatctggcagtcaccacattaatcaaatgaccaagctttgcaatcagtaccaatggtgggatgttctgacattgtgtgcccctcactgctgtgtacctctcactatatctcagtatcacctgtgtggtgttcttgccagaaacttttgactttaatgtaatcacaataaaacagacaaatccaaaacatgggatgttctgaggacaactggcctggattcttaaatgattcagtgtcattaagaaccaagggggattgttctagattagggggagactaagggaaaatgagataaaaatgcagtgcatgaacattgactaaatcctggatgaggaaaagaaaattcagctctgtaggcattttctggataatcaagggaatgtgaatgtggaccatatgttgtatgttagtccattttcacgctgctgataaaggcatatccgagactgggaagaaaaagaggtttaattggacttacagttccacatgcctggggaagcctcagaatcatggcaggaggcaaaaggcacttcttacatggtggtggcaggagaaaaatgaggaagaagcaaaggcagaaacgcctgataaacccaccagatctcatgagacttgttcaccatcacaagaatagcatgggaaagaccgatccccgtgattcaattacctccccctaattgttcaagtccctcccacacacgtgggaattctgggagatacaattcaagttgagatttgggtgaggacacagccaaaccatatcatgttgtatgataatattgtgttaaagttgatttccttgggtgtggtgatgatggtgcggtggtgtacgaaaatatccctgttcttagaaggtgaatagtaaagtacttaggggtggtgtgtcatgaggtgtgtctgtaacccacttttcagatggtttggcaaaatgggagggaaggagggagggagagagagaatgtgtgtgagtttgtgtgtatgtagaataggtgattctgtgcattgctgctcagttcttagcatagcactcagcacattgcttttgatagggaggtgcccaaccaaaacttgttaaactaacaagtactttaaggttttagtaggattctctgaaatcacacctcagcactgcctgtctgccctctctttagcagtgtcatttggcttaggcatatactataatgcctaatgttgggtaatcagatatgggggttcatgttttcttgagtagctcacccatgtccctctggactgaaagtctctcttgaatgttacagtataaatgaatgggaaaggaaaacccagcatagaggttgacctgcgtgttcagctgttccctgagaggctgaggtacaatttgtaagcatgtacttcagattctcttctgtatttctgttgctgagtttgcccacttggggagggttgacacctcctggggctgtgctgagtaggaggtgcatctctggagttctgactggctggagcatcactgaggtattctcctgggctatgagggctagggccaggataaagaatggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatatagcaggcatagtaaagtatgagtcctgggggatacaaataataagaatataccctcgctttctgctgggcacttagggcatagggaaaggagatgggctacagtggagataattatcaaaataccaattgtgctgtgttgcaaggctagggatgtgttagaaagctagtaaaaagtgttatgggaatgcagagaacatgccatgtggaattgactacagtttcaaagataaggttggtcttgaggtgacttgaagaatgagcctggcaggcaaagaaatgggcatctggtgtgactaaagtcttaattagctgtagggtggggaggagagagacatgacgatgttggaaaggtagtttgggccagacaggagggcctcagaagccatgcttggtttcacaggaagggcgtgaagagtcccagaagccctttgaagttggagggtgatgtggttttgataagaggtcacggagggaatgtagaagctggtgtgtgaaggtgtgtgagtctggagacaggacttgaaacagtcgaggcgagagcaaagaatctggattttgctagctgcagcagagggagagtagaaaatggggtgctcttggagaattcttccagcccctcctactaggagtttttacattttcaaatctttctaaggaaacctttaataatacttgagagaagcttatttaaacctttgaacagttctgaaaatgtattacatttcagccaggaaagaaagtattatttcaggcaaactggaacatggttactcagcacagtcgcctaatcttatagaattaggtaggagggaagctatgttagtggccttcaaccttcttccagaactttgttcagatttctcccaaatggtcggtgaatttttctgatttgtatccagcatcccagccatttagtgtacatccgtaagctgtaaggaagttgatttaatctatttctttttttcatctcttgccttccacctgagaaaacactactccataggttcttattctgtattaggaatttgcacaatgtgtaacctaagatggatccagctgggagttggatccagctgggagtgttacaggtttggagtttagactaaagaagaggagtggaatcttttcatttttttcccctttattttgaggaaagcccagtgatttggattgtttgaaggatcaattatatcaaatatctccactaattgagtatctgggataaactttttttttcaccttattttctttagataccattaagcatttcgacccacaacttacagcttttccatggagattttaaacttagaaaactttgaaccttgatgaatgaaaaaaacctttcagaactaacctttttttttttttttttgattcagaagtccatgtgtaagttccaaaggcttataattcttttctcttccttgaggcttgactatttcagaacgttcttggtatgtctcttggaggtttggtgtacaaagagcaaggaaagtaacctatgggcttaactcacttatgtgtatatattctactttggctccaaagcaatgattctagtggtgatatgggaccaagggacagatttcaaggtaaataaggctgtttactaatgtcagattaaggtattagtcttcaagtaccataaatgttttactagcaatttcagttacctgtagtaaagagctttccagttccatgtggtagttatggtaaaggagcaactgaaagttaacttgatagtagattaacactcactgaaaatatagttgttattttttcacataccaaggattacaatgtctttttttttttctatttttaaaatagagacagggtcttgctatgttgcccatagtcttgaactcttggcctcaagcgatcttccttgaggcctcccaaagtgctgaggttataggcatgagccattgtgcccggcctacaatttcttaatattaggagttattttgcaagacaactatctcaatgttggaactacactaatgttggtgtgtttttttccttgtgtgggatagtctgtatcttaagatgtgtaatgtatatattcacaataagggctacattataaaattcagagacattttatttttgaggtaggtttcattcacttaattgagaatttgttgactgtatcttgggtgcctatccttatgctaggagatgaatggaagttgccccctgccattgaagagaagacattttaatgggaggcagagataaacagataattaattataatgtgatacatttggaaatagtcacaaaaaacttgaatatggagattttcaaaagtacaaagaataggatattgaaccctcatgaacccactaccaaacttcaacaattactaactcttggttatgcttgtttcacccatgtgccccacctcctcccttcccccttttattttgaagcaagtctaagacactgtatcatgtgatggacattaatagatacttggatagagtactctgagaatacactgggaaaacatactgtatcgggacagggaaaggagctacagaaaagtaacatttgagttcaatctaggtggggaggaggatgttgttccaggtgatgggatggaaactgacaattattacaatgtcttgaaaaatgtgtatatacaacttttttgttcctctgaactgagcacccaagatgtaatttccaagattaggaaattgttttgcctgaggactttataaaaataattaattcacttttaatttagataaactagaataatccatgagtagtggtaatgactaatctgttctcttttcaccccagtgactttctagactttgaacattagaatccactccctgaaaaagtcactctcctttgtaactagagcaacagctatcctttgtcacctttatttttctctttggaagaggaggaataatcagtggctcacttctgaaacatcatgaataggtagaatttagtaatctgaattaaaaacctccctgtaaactgaaggaagaggaaattgaccagtgggcacacagaggttctcaagggacttttttggttagccactaggtgaaatccttgatatttcatcatgtaccttgtctcattttcctgttgtgaaattgggtgttcagcattgtttttcttgtctgttctcagatcacagaactgtgtggtgcaaagcgggttggttattttggtccaacacagttttacattgccctgaaattaattgctgcagcacaatctggcctcccggtacggatagagagtattaaatgtggtgagtatctcacatttgtatgttttattgtccatggcgagtcgctcatttatgagaaccatttttaatgagtttaaacttttgtggaatttctccttgcttcctccaactcttctgcaaaataaaataagaaaacttggcaggtaggtagcttagtttctttcttttttaaatggggaaaattctgagagtaacctgagattagttcattttaactgatttgcagttaaaatagattttattctttagcaggaagagattgggccaggaattctagagcctgtggcaaataatcacattgactttaattttccacttgaggtatctataatgttattgaaggctctgttagaggagtaacaagggagtttgagtggaactatgccttttctctttcccatacctgccagtgctcagcctttaattcttagtttccaaagcactgttctgatgctagtaagtacttgggtgctaccaaaattttggcagaatgaatttatcttcttaaggttctgatttaatattttctcatcttgccatccctgccctcaacccactgtatgcttgagcactttctacaatttaaacaaaaagcaaaacccccaactattagcagtatttctgctgcctcaggattggttttaaaaatctgtatgaaaaaggtgattattcaaggggtgtgccaaggtcctctgataattcagtttgatacagattactttcatatgtccatacaggtatgtaggaactttttttctttttctcattctgagactaaaaacctcttaactgctcatgcctgtcctgtgaagtctctgatagacatacaagtggattcaggatttatggtgagcccatggaaacctcgtaggacaatccaaatggccgagaagattgccatagatggctggctgtggaagaccaagcccttcacactaaccgttagcaggtggcagtcatcatgctaatctttatcagggggctagcttgtgccagacactttcatttaatcctcatgacaccctactaaattaggtacttgtgtcagtttgattgcttaggataagctgcgataacaaatgtcacaatctcagtgcctcaaccagacagaggttcgttttccactttgcagtgggtcagggtgaccctccagggcagctgccctctatgtggtgaccatgtgatcctggctgctttatcttgtggcacctcccaacacaacacctgttcccataatcgccacaccagggaaagagtatctcaccctagcggttaaatgctttggcccagacatgactgaagttattgctgcccacactgcattggccagaacttgtcacattaatctgcttcagtgcagagcaggtgggagaacacaattctctcctgtgcctgcaaggagaggacaactgcgagtctctactatggctgcacactgcaagtctctactatggttatggctgcacactgcaggtctctactatggtgctgccgttgttcgtatcttacaagtatggaaatttgaactttagggaggttgagtaacttacctaagaatataaggttagtagaatttggagccaggatctacttccagtccccatgctcttaatttctatgcaaaatagccttgtctcaattttttctatttagtaagatgctgacagtaatctgttatacaatattttctgaatgggaaaaatattggacttgaaaggcatctcttggtatgacagaattttgttctttgaaataggtttcttgatggagtgtcatttgacaggcaggcttagtattcattgctgcaagacacagcggccatttgctttgattagttgaaagttgcatcacactgaatttggatttgtggtaggcactgatagtttttattccattgtaaatgatcattaagctttattatagtatcttccaattttatcttctggaaaagttagagctgctttattgtatacagaataaacttttgacacttttgttacttattttaagttagacctaagtcttttacctgatttgtgcccagattgacagtttaatttcctgagggcagggagcaggattgttgaagttatcacttgtgtaaaggattaacagtttatcacaaatataaggctttctcagttttattttataaacccagttgctgccttttacctctgagagtttatatatgtccagagttaattctgaattatcttccttcaccactctctactaatccatttaaagattgattaaataaaattatttgcagttagcatatgttgaataagaattagggcaagattgggccaaactttgagctgccacttagaattttccagtttgttgcttgaaatctattagcttaatgcttgatgacacaaatcttgaaggccaaagggatcactctgtgagaacctaatctgaaaggctgtgctagccctgtcacacccagggcatcatacccagggagttgtggatggatacccttatgtcatgaataacatgcacctgtgtgtatgtgcgtgaccctctaatccctagtccttcccatttcggtaaatgccaccaccatcctcagctgcacaagccagaaactcagcagccatcctggattcctccttttccctcactccttaatagaatccatcaaaagtcctagcaatgtggctccaatctcactccctgttgcctctatctctttgtccctgctagaccagacaaccttcatctacttacctggacaccacaatggattgacatcctagcccctcctctcttctctactgtgatctctcttttcccactggttttttgtttgtttgttttttgacagagactcgctctgtcacccaggctggagtgcagtggcacgatcacagctcactgcagccttgacttcctgggtgcaagggatcctccaacctcagcgccccgagtagctgggactacaggcatgcgccaccactccctactaatcctactaatttttgtattttttgtagagatggggttttgccatgttgcccaggctggtcttgaactactgagctcaagtgattggcctgcctcagcagcctcccaactttttttttttgagacagggcctcactctgtcacccaggctggagtgcagtggtgtgatcacggcttgttacagcctctgcttcccaggctcaaatgatcttcctgcgtagctgagactacaggcatacatcaccatgcctggctagtatatatgtctttttgtagagatgggggtcttgttatgtttcccaggctggtctcaaactgctgagctcaagtgactctcctgtgtcagcctcccaaagtgctgggattataggaatgagccaccatacccagcctcttttcctacttttgaaagtgtgatcttttcaaaatacacagcagattattccatcctcatcctttaaaccctccagtagtctgcttgttgtactttgtaaaacattcaaagtccctacactgatctgtaacaccctacacaatctagttcttgcctacttttccatcctcatctcaaatcttaaacccttgctcactacctgttccccagtctcagtggccttctagccatttctgggtgacttttcctgctgcaggccatatgtccattttatcttgcagtcttgggttcctagggatctgtttttcctttctgcttcccctggttggctccttcccaaccttcaggattcagagtctgtccctactatcctacctaaagtagttctgtcagattcattaattcatgaaggaaccagcatatggtaaaactggctcaagaaagtatagagagtcagatttatttatagtcatagaaagaaaggatgctggaatagaattgctaaattaggtataaagctaattaacgccctacggggtaatacaagtgcagcctggctattgtacttttttctaagatgaaagtatttgcattgccgtcagacaagaattacttgttagctaacagttttttccaagttaatatctaccctttcaggattatcaaatgcccaaccaagagtaaacagtaactcagagcagaagtccatatccctaggaagtgaggtgatccttgggtgggcctgctgggtaatgcttctgcagggcaatctcctccccactttgttctttcccagcatctgtttcctgatagcacttagcagagtttgcaaatattccttacaggtttcactattttttttgtctgtcttcctcacttgtccagtttgtgtaagggggagggaagaggatctgacaccccttgcattgtggggcattataggcactctgtgtgtattggttgaatgaatgaatgaagaggtgcatgtctacgcatgaggagggtgtcttaatcatctgccactctttaatctaaaacgattggaattcagattctcctggaactccagaggagtttttacagaagtcatctcagtctgcatatcatctttcttaggcactgattttcaaccttgtcggcacttgagaaccacctggagagctttaaatataaaataaaaaaatacagatgcctgggtccatctccagaaattctaatttcatatatctgcagtccggtctgagcatcagaatttttaacagctctccaggtgatttttgtatggagacatgtttaagaataaaagctgcatcaagcatttttaagagctttgcttaaactgtgtgtgtgtgtgtgtgtgtgtgtgtgtgtgtgtgtgtgtgtagttacagtagctgcatctgaactagggtgctgtacgacacagggcacatgatttaagggggcacttactctcagggcaagtgccgactctacatttacaccaccctgagagtgcgtgcctccttaaatgttggcactaggtatctctctagccccaccctcgtctgagttggggttaaacagatggcaaaacagctagggcagaaggaaagaaggtgaaaattaaggactggtagagaatttctgatgaggaaatcatgtggtgaacatttgccctgggacctgctgttacctttctttccagggtctgaagttgagcacgtgtgaggactgagggaaggttaggcagaacctagagtagggtttctcatcatttttgtgccaggagcccctttggcagtctgaagcctgtgggccctttctcagaattatgttttaaatgcaacaaagacataagattataatggaaaccaattatactgaaataatcactaaaatagttaaattgttatataacaacatacatgcttctaggcctggcacagtttctcatgcctgtaatcccagcactttgggaggccgaggtgggcggatcacttgaggccaggagttcgggaccagcccggcaaatgtggtgaaaccttgtctctactaagttcgagaccagcctggccagcatggtgaaaccttgtctctactaaaaatacaaaaattagccgggtgtagtggcacatgcctgtaatccctgctactcaggaggctgaggcaggagactagcttaaacccaggaggtggaggttgcagtgagtcgagattgtgccactgcactccagcctgggcaacagagtgagactatatctcaaaaaaaaaaaaaaaaaccaacccccaaaacatatatgcttctttattaatgcattaaataaagcatctaacagtgtttgaaataaccactactttttcaaattagtaatatgcataaacagtacttcaagatgttggcccggcatggtggctcatgcctgtaatcctagcactttgggaggccgaggagggtggatcacgaggtcaagagattgagaccatcctggccaacatggtgaaaccccgtctctactaaaatagaaaaaaattagctgggcgtggtgacacacacctgtagtcccagctactcaggaggctgaggcaggagaatcacttgaacccgggaggcggaggttgcagtgagccaagatcacgccattgcactctagcctgggcgacagagcgagatgccatctcaaaacaacaacaacaacaacaacaacaacaacaacaaacaaaaccctaatgtgataggtgacaaagttaccggtattgctagtgataatacagtggcttgttgcctacattcataatggaaagaaatgctaaatttcagttatagtagggaaaatgaagttgtaatttttttttttttcctaatcaaggtgacagaccccgtgatttcttttcactagtccctttgggagcctgtgaactctgatggtgcaatgacatgattcatgtagtctttggggctgtgttccccaaactggtttatggtctggttgcagtctggcacagtttagaattaggacaaaaggatgagttatttataaagctaaatgtattcaaatctaagattgggttttttttggttcctcttgttaagtgtcctttgtgaaactgctaatgggtaatagtttggggtaaaattcttgacgagataaaacattggcaactttatgttggctttcttcatttctttttttgttgttgttgggggagagatttttcctattttgtgaaatccccaaatttgtgagccactgttgtggtcacgattctactgccaagaagatactgaggcaaatcattgaattccctttgactcctcccttatctgcaaaacagttgttctccacctaggtgatttcgtccctttagggactttcggcaaggtgaggagacatttttggttgtcccagctgcggaaggggactgcctggcatctagccggtagaggccagggatgctgctcaacaccctacactgcagaggacaggaccccctcttccaacaacaacaaacttatctaatctaaaatgccagtaatgttgagactgagaaagccttctgtaaaataaggatcaagacttaggaactctaatcctgctgccttgcttcctgtgctctagttagtttttttgtttttttaatcatacaagaaaggtagaaggattttgcagcattgagtcctatttctgtggcttttgttttcaaagaagaattattttattcaaggaaaaataaaagcagttattctctggttgaattgagggtggggttccctgtgctttgcctatttgacaaaccctccctatctcttagggctaggagagaaatcttttgagtgtgacaaccagtttggtaattcatagaaaagacaggataggaagcccaagggtaaagaaagaagcccaggaggtaaggttgtagctggctctgtgtgtgtgtgtgtgtgtgtgtgtgtgtgtgtgtgtgtgtccacacagtgtctctgtattttgaacactaaatactatgttgggatgtctcattaagctaaggtcaactcatcctttctgactgacgtccaacccaatccccctttccttttttttcctcagtgttcctttgtcaatttcctttaccccctctcccagccctgctacagggacacagagctgctttggacaaagttcgcctatgcaggttcactgactgtacggctggacatttgtgttttctaggggtctgtccctctaccccatagcgctgtcattagctctattgttgctcctccccaaaggttctccccaaccttttgagctgtggattttcaccttatttgtaaaaatctttgttgtgggattctttgacaatctagtaaaagctctggatcttagcaggaaaatacacattgacattatgtaaaaaatgttgccttcaatgtcaggggtttctggacccctagagctggttcatggagcccagtgaagagcccttcttccagagaaatgcagtgtatgggatggatatagaggaggtaagttggaagatgcatagtggggaaattgaaggccaaagaggtaaaataaaagggatgctgcttgctagcagcagagcccagtggattgtggacctcctaactcactcctggggttctacccgtggtatggccaggaaattgaacttatccaccatcctcctctgccaaacatttacaagatcacccttcccattgtaacctccaccccgccatctagcgattacctacccatttcctaattgacaagaggtatttcagatcaatgggcagataggaggataataggagactagatagctttgattactcaggcctgggttgataagactggcctgatttttttttttgttttgttttttgttttcccccaaagtaacttcaggaaaatgtgtagggatggtttcactttggaattatagaacattattgtcataattctttgttaacgtataagtagctggtataagtgaataggtaacaaaaagcagtgggagagaagggagccagcagtcaggagtcaagaatttttgttacggtcttagctctgccactgtattgctgcatgactaaggcaagtcttgctctctctttcctgggcttatttcctcacctgcaaaatgcagacatttgagcaggttttctctagattattttctgaaatgccacagtttcatgctaaatgttcaaatctgtactagaaagaattttaatgttcaggatggtagtatagccttgtggctgggaatgtaggtcctagcaataggctacctcattatgaatctttccttcattaccttttatttgtgtggcctccggccagtttcttaatttctctgtttcaaatgactccctggaggaaaaggtataccaataacacctgccttatagacttgttgtaagcacaaaatcagggaatcccttatcaaacattgtagaaaagcatctacaactttgttatttaatatcgtagccacttgccatgtgtggctattgagcacttgaagtgtggcagtgtggctagtgtgactgagaaactgaatttttcattaaatgatttaaataaaaggttttaaacagtgtaaaatattttctgttaaatgcaaccttattgatttagtaggaccacttttcacttcaaccatcaaattctgtaagacaagggtcaacaacctttttctttttttttcttcttttttaaattttattttattattattatactttaagttttagggtacatgtgcacaacgtgcaggtttgttacatatgtatacatgtgccatgttggtgtgctgcacccattaactcgtcatttaacattaggtatttctcctaacactatccctccccccttcccccaccccacaacagtccccggtgtgtgatgttccccttcctgtgtccatgtgttctcattgttcaattcccacctatgagtgagaacatgcggtgtttggttttttgtccttgcaatagtttgcggagaatgatggtttccagcttcatccatgtccctacaaaggacatgaactcatcattttttatggctgcatagtattccatggtgtatatgtgccacattttcttaatccagtctatcattgtgggacatttgggttggttccaagtctttgctattgtgaatagtgccgcaataaacacacatgtgcatgtgtctttatagcagcatgatttataatcctttgggtatatacccagtaatgggatggctgggtcaaatggtatttctagttctagatccctgaggaatcgccacactgacttccacaatgattgaactagtttacagtcccaccaacagtgtaaaagtgttcctgtttctccacatcctctccagcatctgttgtttcctgactttttgatgatcgccattctaactggtgtgagatggtgtctctctgtggttttgatttgcatttctctgatggccagtgatgatgagcattttttcatgtgttttttgactgcgtaaatgtcttcttttgagaagtgtctgttcatatccttcgcccactttaaagggtcagatagactttgtgggcagtatgattttggtcacaactactcaaccctgttgtagtatgaaagtagccatggacagcatgtaatcagaggatcatggctgtgtgctaataaaactttatttatgaacactgaaatttgaatttttaattttttttattttttatttttgagacagagtctcactcttgtcacccaggctggagtgctgcagaggcacgatctcagctcactgccacctccaccttctgtgttcaagctattctcctgcttcagcctcctgagtagctgggactacaggcctgtgccaccacgcctggctaatttttgtattttagtagagatggggtttcaccatgttggtcaggctagtctcaaactcctgacctcgaatgatccacccatcttggtctcccaaagtgctgggattacaggtgtgagccactatgcctggcctgacatttgaatttaatataattttcacatcatgaaatatttttcttttttctttttttttttttttttttttgcaaatattcaaacattgtgcttgcgggatgtacagaaataggcagcagactggatttggttcttaggtatacacccaagataaataaattcatgtccatcaaaaaacatttataagaatttcacagcagctttatttacaatgggcccacactggaaacaacccaaatgtttatcacaggataatggattaaaattttcaatatattcttttagggtcttgctctgtcacctagactggagtgtaatggtgctgtttcagttcactgtaacctccaccttccaagctcaagccatcctcccacctcagcctcctgagtagctgggactataggtgtacaccaccatgcctggctaatttttgtattttttgtagagatggggttttgccatgttgcccacactggtctcgaacttctgagctcaagaaatctacctacctcggcctcccaaagtgctgggatcacaggtgtgagctactgctcctggctcaatatattcttaaaagtggattgctccatagcaatgaaaaagaatgaactatgtgtacaatacattgggtgattatcacagacaaaaaggtcgtaaaaaaagcttgtcacaagaacaaatactgtatgattcaatgtatgaagttccataatggcaaagataatctgcaagtatagaaattagtacagaggttgctcggtggaacaaagggaggggattactggaaatgaacatgaaggaaaattctgtatcttaatttgggaatttgggtgttggttacagggatatatatatatatatatgtatttgtcaaaattcttcaagtggaacacttacaattccctataaatcatcccaccatacagaatactctttacataatttaaaaagaaatcaattagttgcttacatttaacattgtaataataataaaatacagtaaaatacagatttctggccacaatggctcacattcccatgtagcaactatcaactagagctgtgctgtttcagtatggtagccagtagctgcatgtggctgttgagcacataaaatgtgacaagcacaaattgaggtatgcaaggagggtaaaatatacatgggagtttgaaggcttaatatgaaaaaaaatgtaaaatatttcattaatagtttttaatgttgattacatgttgaaatgataatattgggttaaattagattattaaaattttgccattaaaaatgttttgaaatggaaaatttttaattgtgataaaatacaaataacatttcccatcttaaccattttaaatgtataattcagtaatgtgtaaatatagtcacattgttgggtaactagtttctagaaccttttcacctcaccttacaaaatggaaactctgtattcattaaacaccttcccattttctttttcctacccagatcctggcaactgcctttttttttttttttttttttttgagtgcagtgacgtgatcatggcttactgctacctctgcctcccaggctcaagagattcttgtgcctcagcctcccgagtagctgggattacaggcgcatgcaccactacacccagctaatttttgtatttttagtagagatggggttttgtcatgttggccaggctagtcttgaactcctggcctcaagtgatctgcccacctcagcctcccaaagtgctgggattacaagtgtgagccactgcacctggcctgcccatctactttctggttctatgagtttggctactcttgatgcctcatataagtgaaaccacacagtacctgtctttttgtgaccagcttgtttcacttctttctttctttctttttttttttttttaatgtggctcacattcttttttggcagataacattgaaagactgtgaacagctgctgccattttgatggaacatgagttctctgcccagcaccctccactccatattgtctagctaatgaggctcaatgtcacttgccatttattattgcatttatgctgtttacattttttctaatggattgaggaaattgaggtatttttttttcttttttgagtgacagggtttcactgtcacccaggctggagtgcagtggcatgatgcagccttgaactctcagactcaagcgatcttcctgcctcagcctcctgagtagctgggactacaggcatatgccaccatgcccagctgattttttatttttatttttttaagagaaggggtcttactgtgttgtccaggctggtctcaaactgctgggctcaagtgatcctcccacctcggcctcccaaagtgctgggattacaggcatgagccaccactcccagcctaaagtattcctaatatatctgtatctctatcaaatatggaaaaacaaaggatttttctctcttgtagagggtcaagtgtttaaaaaggagcaggcataattttctttgtggaagggaaaaatagtcatttatgtttaatatacaaagcatttctgtgttcaaagaatgtaacctaagatgaaacaacaatgaagcaaattgtcatcttggatggccactctcattgtctcctcagaccctctaaacatttagtgtgaactcttactttgtttgctgtgtgtaattcaattcagtttgggagacaagattctaaccaatgactacaaatagaccttcttcttgacagacatcattgtatagcaggtactttattgattaattttttcaaagtttcactattaaattttgtgtatgtgtgactaggaaaaacattcagttgagtatggtgactcatgcctgtaatcccagcactttaggaggccaagacgggaggatcgcttgagctcaggaatttgagacctgtctgggcaatatagcaagaccccatctttacgaaaaataaaaaaagaaattagccagcatggtggcaagcacctggagtcccagctacttgggaggctgaggcaggaggatcagttgagtctgggagttcaaggctgcaatgagctatgttagtgccactgcacttcagtctgagagacagaccttgtctcaaaaaaacaaaaaccaaaaaaaacattcagactgaaaatttacaaactacttttacctttcactttttaaaagcttgcatcagtttaagggaaatggcaccttcatgaaagttttccatgataagaatattattatgtatggttatacttctgttaagtgagagttgcttggaaccacctgaccaaagaaagtatgagagaacttcagctgtattttgtcttttgctgtttggtggctgtctgggggagagaggtggttttctaggcacatagctctaaagaaatgccatagacagggtggaagaatgtgtgaagtgacaatgtcctagacaatatctgggagccctacttaagtcctaatataataattgatattcataattcagttagtgtattccattgttccttggaggtatctgttgaatgccagtaaggcactggtcagggagcttataaatactgagcatttatttcttttctccctcaagaagtacttggaagtagagtcatcctcttatgggtagatcagggtgcaaattattttatgtgatcttgtttcatctttttagatcctttttcctgactgagctggagcacatacctgagaccaaaaccatagagttagcttatatttgatttactaagaatctagagtttcttttctcttgcttttttgcttttgaagcccattcctgctttgagtgctggagagctgcccgagattgggaaacattaagattggttactctatttatgtctcttgggcccttggctgattgatcacacagggatttgtcatattgcctgcttcttttttttttttctggtacagaattttgctcttgttgcccaggctggagtgcaatggcatgatcttggctcactgcaacctccgcctcctgggtttaagcaattctcctgcctcagcctcctgagtagctgggattacaggcgcctgacgccacgcctggctaatttttggtatttttgtgtagagacggggttttaccatgttggccaggttagtttcgaactcctgacctcaggaggtccacccgcctccgcctcccaaagtgctggaattataggcgtaagtgagccactgcgcccggccgcctgctgctttgaatcaaatgtgaacatagcaactaaaagtaaacatcatgtggatgttagagaaccaggggccttctttgcctggggaactctaggatacttgcttgctgttgctaagatgttttctggccttagcacagcatcagtcattgaaagtgcagctgtgtttttggaatagagagctgatggaagtgcaaaggcacactgatgagtattatcctgaacaatggatacagatgcaaatcattatgcataatccataatgtccccatttttgtagggttttgtgctacgtgattgtgtgtgatttgatgtgctgagaactagaagtgtgccaaagtatcatttccgctttcagaatagttttgttagaattttgaaagatgagtaaatataccagaccgttgcttttcaactctttgtagcattttgagtggctaatggttttgacagaagaatgtggctgaatgatagattgattgctctgacttgatattgttttccttattccattatgaaaagacaaccagagattggatgtgaaaattccttaaagaattacataggatgagaaactgttctacccactaagtttgccataggaacaagggaccattctgtagagcactggtaaagtaccagcttgcctgcattcaaaccgtggctctgccacagatgagttgtgtgatcctggggacattacttagctcctttatgactgtttctacttttgcaatgagggggtggtaatgatagttttatcatacagagttgttgtgaggattaaatgagttaatatttgcaaatctttaatactgtgcctggcatatttaagcattatatgaattttacctgccaccatttgtcacttattattgtattatacagtgtcatatcctttttcttggttattgaaggatgaaatgggagatcagtcccaaatctgaatttattctgcgatttggcaacattgaaaaatgttaagccagaatactttggttaaaccatagcattttaaaaatcaggacgttattataggagtactcattgtatctaaatctaaatttatatttagtgctctggaatttttcctcaaaaatgattcatcgtttggccattgagttccccttttttgcagtttttaaattaagtctgactagagcttctctgatttctggtcccaaagaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggtaaacagtttgttcagatgtgttcatttgattctgaccatgaaaccgcatgtagcagggcctcgtatctactgttcagcttccagcaaatctcaccatc

SEQ ID NO: 3123 - DNA, 206410 bp, human
tggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcatagctaccaccttttggctgttctatacttggaaaagtactaggggatgatacataccagacgctgtttttgttttgtgctttccttggagcttggagaaagactacttgataagcctttgtctgtcatttcatgtcaccagcacttcatggtgataagactgttaatatcaggttcaaaacgtgaaatgaagcttttcctaaaagcaatagtatgaatgttattaacaccaatggaatatttagagtggcgagtggtattttaaaatctagtttcaaaggagaactgagggttttatggttcacttgcaatgtcattgtgttcatacgtatttttaaaaaaattgcttaagactgcgttttatactgctggagtgtttttactgctatatgtttgtgagcataactttagacactttgtaatctttcacccttttgaatttgggatttctgaaactgtaactagtattcacagaacttagcatggctgtttatccctaaagaagtccttgatatgtagacagttctgccattgctgatgagtagttgagctggatcaggtaaagagaaagtcagtgtcttaaaacacaaaccgtggctattacatgaggccctcagaatagtcccgagcataatacatttattcagtgctgtagctgcttcccagctgaaagaggaataattgactgaggctatgcagcaagtaagtgacagctgggtacctattaaggcttattttgttgtcagtaatgcatcggataagaggaggtgggcatagtaaatctgaatatgttggttgatgcctctttaggaattgggaagaaggatttcctgatgttagaacccatgctttcttgaggtacatatagttttaaaaggacccaaggcacagtggctgtgcgtgaatgagattatatttttgatgtccagttgaaatctgcttgcaaaagactgcttcagatactggcaaaaggggacatccctgcgagattgcttggagtaaatctctcagagctcgaagctcccttattcagcctagcaaagcaaaacacatcatccacctttaatccaacaaaattaccataactcaatattcttggtacaggtgaaaatgaacattgaaggcatcctggacatgtgatcctaagagagtcaaacaaagtcagcaaccagcagacacctaattttcacccatcactttggtggtggtggtggtggtggtggtggtggtggtgtgtgtatgctccatccactttaatttgcattaccccatcagtgtattagccattctttaaaacaaacgtagatgtttttaccctttctctgttaaacaggaacctgtaagttgagatttaagtgccccaacaggtataactgctcaaatcttggaggcactaaccagtcctgatattttctatggtaacaaccaggttttcctcttaataagcatacaattaagattaccataataatgttccaggaagagtgagaatcttgcattcttaccacaagtaaatggtctataaaaatacttattttttatttatttattttttgagatggagtctcgttctgttgcccaggctggagtgcggtggcgtgatcttggctcactgcaacctctgcctcccgggttcaagcgattcttccgcctcagcctcctgagtagctgggactacaggcgcacgccacctctcccggctaatttttgcatttttagtagagacggcgttttgccatgttggccaggctggtctcgaactcctgacttcaggtgatccacccgcctcagcctcccaaagtgctgggattacaggcgtgagccaccatgcctggccttaacatattttttaatagactatttttttttttcagagcagttttaggttcacagcaaaatttagcagagtacccatatatcccctgccccgacacacccgtagctttccttactctcaacgtcccacatcagaataatagagtttttacaattgatgaacctacattgacacctcattattccccaaagtctatatattagggctcactcttggtgttgtacattctgtgggtttggacaaatgtataatgacggttccaccattgtagtatcatacagaatagtttcactgctctaaaaatctgtgctctattgattcatccctccctctccactaacatgtggcaatcactgattttttttttttttttactgtccccatagttttgccttttttagaatgtcatatagttggagtcatacagtatataggcttttcactttggcttctttcatgtagtactatgcacttaaaattccttcatgtctttttatggtttggtggctcatttctttatagtgctgaataatattccattgtctgcatgtactacaatttatttattcacctactgaaggatatcttggttgcttccaagtttgggcaattatggataaagctgttataaacatctgtatgcagccttttttgttacatgcaggagataagcttttgactcatttgggtaaatagcaaggggcatgattgctagattgtatggtgagagtatatttagttttataagaaactgccaaactgctttccaaagtgattgtaccattttgcgttcccatcagcaatgcattggtttctttacagagtatttattttcctttgctgacttattttaacagcaggattctagcactaggtggaaaacgtatatgagtttctgatgtgtgtcaggtactgtcctaggtgctgaggttataatagtgaatccaacacaatctctgtcttcatggagcttatgttctcatgtgaatgtttttacacttcagagtttttatttggttgagaaaagacttgaaatataacatccaaaaataaaatgtcagcctggtgctgtggcgcacgcctgtagtcccagtgctttgggagaccaaggatgggaggattgcttgaggccaggactttgagatcagcctgggtaacatagtgagaccctgtctctacacaaaataaaatagccgggcatggtggcatgcgcttgtagtcctagctactctggaggctgaggcaggagaattgcttgagcccaggagttcaaggttatagtgaactatgatcgcaccattgctctccagcgtaggcaacagagcaaaaccctgtatcaaaataaagtaaaataagcctgtcaaacccaaaccaaatacatgtcaaacccagacctgattcttaccacacactatgccttctagtaaaattctggcctttgaataccaacaaaatacttcataacctgggaaaccaactactctaacgtttgttgctctgtcttgaaatactaaacaaaaccatttacctgttcgtagacatattttctttttctagtttaaaagtatcccattctgccattttccacctagtgctagaatcctgctcttaaaataagtcagcacagggaaataaatactctataaagagaccaaaagacctttcaaaataggctatggccaggcccagtggctcacgcctataaatcccagcactttgggagtctgaggtcggaggattacttgagcccaggagttctagactagcctgggcaagatggcaaaaccccatctacacacacacacacacacacacacacacacacacacacacacacacacacacacacacacccccgctacctacctctctctggggcatgcctgtagtcccagctattctggaggctgaggtgggaggatcccttgagcccaggagtttgaggctgcaatgagccattatgacaccactgcactccagcctgggtgaaagagccagaccctgtctcataaaataaataagtaaataaataaaatatctaccttaaagcagcaagttttgtatttgatgtaatgaattaacagaccgctttataatatctatcttttaggatagtgtcagtctcttggaatgctgtgcatgagtcatcattaaaattggttttcattaaaaaaatttttttaacatatacacatcttattggagttttcttttaaaattcaaaaatgggaacattattttttcaaagccaagtaacagaagagtatataaaaaagtcaattttgtgcatatctttttacattttctatgctcatgtaaaacatacatgacttatgtaattatacacatatgctccagatctcatctgtattaattttttaaattatactttagttctgggatacacttggagaacgtgcagttttgttacataggtatatatatgtgccatggtgatttgctgcacccatcaacccatcatctacattaggtatttctcctaatgctatctctcccctagccctgcacccctgaataggccccggtgtgtgatgtttccctccctgtgtccatgttttctcattgttcagctcccacttatgagtgagaacatgcggtgtttggttttctgttcctgtgttagtttgctgagaatgatggtttccggcttcatccatgttggttttcatttttgtgatagttaattcttggacattaaggggaataattataaaacactgttgcttccatatcaagggaaatcactgaatgattaaaaaaaacccaataagtgttgtctgattgtttaaacagctttcattgaggtaaataagtaaaacaaagctgtgagaagtagggaatatttaaacaatttgtgcgcatgccctcacctttggggagaagtcttttctgaaggctctcttctgattttttgaagcaactgtttaatcattaaagaaaattataggtaaaagacaaattcttgtgaactttcgctcattgctagattattaggcagaactattttttaaaaatttaaatgaaacaactttatatttttacatctttagatcatatcattttgtaactatactttagggaaatagaggccagcatattaaaacagtaactaggggctgggcagggtggctcattgcctgtaatcctagcactttgggaggccgaggcgggcagatcagctgaggtcaggagtttgaaaccagcctggccaacatagcgaaaccccatctctactaaaaatacaaaaattagcaggagaattgcttgaaccggagaggcgaaggttgcagtgagctgagatcaggccattgcactccagcctgggagacaagagtgaaactctgtctcaaaaacaaacaaaccaaaaaacaaacacacacacacacacacacacacacacacacacacacacacacaaacacacaaaccagtaactaggactaactatatgctgttttagattgacagtattctttttttctaaaagagaatgaatgccagcagatgtaggaagtaccagagctaaaccattgcctggttaaaaggagtacctctgcataatagttacttgttgactcttttgtaataaaatatttcaggcatgtaaaactagacagttacccaagaaataactgtgtatccaccactccgtataagtaaaacagcccagctagagtgaaagcctgctatgtccccttctctggtcccattcccctccctccctaccctggagttaccagagtcctgaatttggtgtgcatgatttgaagatttctttctacttttattgtatgtatatgtggatatatatatttgtgtatatataaatcactaaaaaagatattattttggatgtcttttcaacttaaggaatatcgtattctgtgtaaccttctgcaacttgcttttcctctcattgttttgtttttggaattcatcttgttgacacatgtaatttcagttcatttatgtttccttttaaaaaatctttactacttacgtttacaatgactcattgttacagtgcggtagagacccttatgccaaaaggaagtaggtggcatttttccttatttatatagaatgtcacatgactgggggactgttcgaaacgtgtatgaaaattaagaacaccttcatagatagcagaatgcacacttatattcttgagcgtgctaggggatgtttgagctaattaattgactttcatgggctttctttttttctcatcttttatttttttgagacagggtcttgctgtgtcacccagactggaatgcagcaatctgatcatgactcactgtaccctcaacctcctgggctcaagcaatcttcctgcctcaggctcccgagtagctgggaatacaggtgtgcagcaccaagcctggctaattttctttttaaaaatttgttgtggagatggtgtctcattatgttgcccagcctggtctcaaactcttgggctcaagtgatctcccgcctcagcctcccaaagtgttgggattacaggtgtgagccaccacaccctgccatttttcatctttttaaaaatggaacatctcaaataagcaagtagatagaataatgcattaaaccctgctgcacttgccactcaggcccaacaactgtcaatgcaaggttaattcaattccatctacatttctatctttgttccctctcacctttgttatcctgaagcaagtcgcaaacatcatatggttcatagggcttatctttaaggaaggaaccagggtgggcagaaggaaatggaaacatgcaggggtttaggttggccagaaaaggtacctgtggcctatggtcaaatggcaagactgatgatggttcaatactgtcaagcctttggctgtcatggagatagacgtgcttgagaactgatttagaatagttgggaaacctgtagggagattgaaaaagtaaccaactgaagaccaggaatacaagatggatttgaatattgttctagcttcacactcctaagtaggggctgtcctattttaagggtgtagacaattggttttgaggaaatcttgggttgtttttgctaattatttataactttttttttttttttttttttttgagacagagtcttgctctgtcgcccgggctgaagtgcagtggcgcaaggtcggctcactgcaacctccgcctcccaggttcaagcagttctccctgcctcagccttctgagtagctgggactacaggcgcccaccaccatgcctggctaatttttatattttttagtagagatggggtttcgccatgttgactaggctggtcttgaactcctgacctcaggtgatctgcccaccctggcctcccaaagtgctgggattacaggtgtgagccaccgcgcctggcctatttataactttaaaaagagggtttggttcctttccagggtttttcaaactttctgtttgtttcgtataggcaagtttctcatgttttgtattgatggcattctattattcatacctatctgttggtgggcaactaatcaacctgggttgcgcaggactgaaggatttcctgggggcatggaacttcagtcttcagacagtcctaggcaaactgggatggtcaccccctctcttggttgctgcattagttatctattgctctataatgaattaccacaaacttagcagcttaaagcagcacacagttattatctcccagtttctgtgggttcgggagtctggacatggctcagttgggtcctcagctcagagtttcataaagccacaatcaaggtgtctggagcttggagtcctctgtggaggtccaacacttggttgcagaattcagttccttgtgattttagaactgaggctctcaacttcgaggcttcctgcagttccctccacatggccttctccataggcaattcacaacatggctcttggcttcttcaaggccagcaggagagtgtctctctccagttagctcagacacctttgccatagtccattagttagaagcaagtcacaggttttgtctgctctcaaggggaggggattatacaaaacaacagagaccaggaggtgagaattttgcgggggacaccttaggatctttccaccacacttgctttccaggatttgtctgaagtagaaaattattctgttgagcctttttgtggccagaatatacatatgttttgctcagccactaatttagaattcctttatctttttaagaaacattttcatgcgtaattcatcctaagtagaactggcaaatatgtaacttcttaggtattttcaattttagtctttaggcaattgtttttcctcttaactagtaggaggcaggaaaaaaaagtggaaaagcagatgcaaatgccctgcctggctactcctgcacgcagtgctctaaagcaggccttctcagcctgggttagttcaggggtctgtgaatttagatgtggaaaagaactacatctttttttttttttttactaactgcccttcccccaactgaaattgagcacttccttctattatgcatgtaagcaaaaaaccacagcagtttttttttttttttttttttttttttttttttttgagacagggtcttgctctgtcacccaggctggagtgcaatctcacaattttggttcactgcaacctgtgcctcctgggcccaaatgatccttccatctcagcctcccaagtagctgggactacacgtgcatgccaccacacccagctaatttttgtattttttgtagaaacgggattttgccatgttgcctaggcaacagggttcactgctttcggtcaaatgacagcaatgctgctggcaagtccatggtcaggagtgagattccctcaggctgctgtggtccctcctcctccagtctgtcctgcaggaagctcagagtgaatggatgctcagctgtttcctctgagacctcaccagggacagttcctgcagtcccggctctgagctctgctcctgaccgttttatctggccctctcagctgtgcttcactgcaaaggaggaaggacaaggccctctggagccagtgccagctgcttgtggggcctgttttatttactactgctatctctacttcagagacttgggctaggacatagacttgaagaaaaaagccattttaacagacttgagaaactcagccatcctcataataccattcagaaccaggagaggccattattaacactaggctagtaggaaatgttcactttgactgaattcatttgtaacactttgccactggtttacaagaaaaatactttggttcagtctcctggaggtaggtaattaaatgtttcacctgtgctaattttccaaataattaaagtgaatcccataaatgccagcaattaagaattgttgtttttggccaagtgtggtggctcatgcctgtaattacagcactttgggaggttgaggcgggcggatcacttgaggccatgagtttgaggccaacctgggtaaaatagggagacgctgtctctacaaaaaatacaaaaatcagctgggcttggtggaatgtgcctgtagtcctggctacttggtaggctgaggcaggagaattgcttgaatccgggaggtagaggtttcagtgagccaagattgtgccactgtactccagcctaggcgacagaggcgagattctgtctcaaaaaaaaaaaaaagttgtttcttaagtgcagaccttctgagatgtgtagtgcttgccccatgccttcaaaagaacatatttaatacaataatctctttgtctctcctttacttcaaagtcagccttgtgaaaaacagatgatgatataccaacagttttttgctcttggaggtgtttggtgtgctctgctttttgagttttgttttttggacttctttaaaattattttaaaatgttttaactcctctcctttgcatactctctggtacccttatagtcccaatactgagtaaagcatgtaaaatttagcatgcagatgttttagcctcttttattttttgttcgagatccagattttttagtctcagcatgactgacactttggggctgtatcattctttgttgtggaggactgtcctgtgcattgtaggttgtcaagtaacatccctggtctctacccacaagataccagtagctattcttctcctgattgtgacaacaaaaaatgtttccagacattgtcagatgtctcctcggggcaaaatttagttctacatatatgatgataaaaaccatggtagcagccaacatttgttcactatcatccccattttgaagaaagcaaaaacggaggcactgagggtgaggttcacttacttgcccaaggtcacatagataaaagtcacttcttgaaatacttttcataatatatatgggttgaatctcagtcttaattgaggaggcagactaaaaaagaatgtaaaaacggggagtttcctgatgatgtctcaattgagaggctattgctttcatagtgattctgtgtaaatgctggaattcttgcttaaacggggtgattccatgggcatgtgtctgagtaaaggacttggatcatttctaagaagcttctgtggcatggtgaagcagaacataagacagtctaggatcaaggataactgatcaaactttgaaaccaaggaagccataggaaattggggtaaggctatgtatcacttagggtcccacaggaaatggcatgctcaaagggttttagtgaaaacaggaatgttgaggcacgaagggactagcagcaggaagctattgccattcctagacctggtggggcaaagggaggggagggaatgtcgttgctggagctgtgaaaggtactccctctacaggaacaatagtcatgaaagaatacagcctttgctagaactatggccagagaggggccagtgggatgaggggatgggagagaagtaaccaatttctgtttcctgccctctcatttgctgcagtgccttttgttgttctaacccaactagaagccacaggtaacagagcctgggtgttgaagcttattgaggttagcctcttgcgctgagtggatggaaagggctgagagtggttcaagggggcaaatagagcaacagccagcacaggctatgagcaggagtgggaaacactaccctggatcctaggaaggatggggcatggccagtgataggagcaatgaaagtctttttgtgtgaaaaagagcctggggatacagacctccatgaaggagaagagagggttggataggagtgactggttcatctgaggttcttcctatttctccaaggaagccttgaggaatgtggggttgtctgtttgcatttggatatggaagtatgtgtgtgtgtatacttttatttattttgagacagggtcttgttctgtcacccaggctggagcacagtggcaccatcacagctcactgcagcctctacttcctgggcttaagtggtcctcccacccaggcccccccaggtagctgggaccacaggcatgtaccactatgctcggctgatttttaatattttgtagagacagggtctcactatattcccctggttggcctcactcctgggctcaagtgatcctcccaccttggcctccagaagtgctaggaatacaggtgtaagccactacacccagtctgtttgtatactttttggtcagagtgaggctttccgtgagttggagtgtttgtccttattcatgacactgggaaacatacaacagtggagtgaccctcttgcagattctgctaggagtagctacatatggtgggaaaggttgctatgggaatggagataaattcaaggcagtagagagtgctttataatgtttgggggtatggccaagcattagttttgctttttccttcccagtaggatacgatttctgtagcaattcttccttacccaaaaatagctatatgtgctcccaaaaagaaaaagcccaggaccagatgacttcatggctgaattctaccaaacattcaaagaagagttaatactaatccttcttaaactcttccaaaaaacagaagtagagagagtacttccaaactcattttttgaggccagcatcaccctgatttcaaagccagacaaaagataccaagataccataagaggagaaaaccacaggttagtatctctgttgaacatatatgcaaaaatcctaaataaaatactagcagaccaaatttaacaacacctcaaaaagatgatacaccatgaccaaagtggcacttatccctgagatgcaagattggtttaacgtatataaaacaatcagtgtaatatgccacattaccaaaataagaggtaaaaaacaagccaggtgtggtggctcacacctataatcccaacactttgggaagctgaggtgggaggattgcttgaggccaggagttcaagaccagcctgggcaacatagtgagacactgtctctacaaaaaattaaaaaaaaatgagctgggcatagtggcatgtacctctagtccctgctacttgggaggctgaggcagcaggatcgctggagccgaggattttgaggctgcagtgagcactgattgtgccaccgcactccagttgggcagtacagcaagaccctgtcttcaaagaaaaaaaaagagagaaaaacccatgatcatttcaatacatgtagaaatagcatttgacaaagttcaacagcctttcgtgataaacattttcaacaaaataagtttaaaagggaatttcctcaacacattaaagaccatttatgtagagtccacagctaatatcataatcagtgggagaaaactgaaagctttttttctaagatctggtacaaagcaaggatgcccactcttgccacttttattgaacacagcactggaagtactaacatgagctatcagacaataaaaagagataaaaggcatctaaattgggaaagaagaagtaaaattatccctgtttgtaaatgtcatgatcctatatgtagaaaaccctggactccacaaaagccctcttaagactaataaatgagttcagtaaagttgcatgatacaaaatcagcgtacaaaaatcagttggaaatcaagaaaactgtcccatttatgataacataaaaataataaaatattcaggaatacatttaatgaaggaagtgaaagatctgtacattcaacattataaaatattgatgaaagaaattgaagacacaaataaatggaaagatatgccatgtttatgcattggaaaaattaatagtgttaaattgtccacactacccaaaacaatatacaggttcaatgcaatccctatcaaaataccaatggcatttttcacagaaatagaaaaaacaattctaaaattcatatggtgtgacaaaagacctagaatagccgaaacagtcttgagaaacaaaaacaaggttggaggcatcacacttccttagattataatacagtataaagcagtagaaattatgatagtatatcctggcataaaaacagacatatagatcaatagaatagaacagagatccgagaaatatacagtatatatacagaaatccaagtatatacagtcaactaatttttgacaaggccaccaaggagacacagtggggaaaggatagtctcttcaataaatgatattgggaaaactggatattcacaggcaaaagaatgaagctggatgcttatatacaaaaatcaactcaaaatgtgtctttaaaatatacaacaaaacctgaaaatggaaaagaagacctaaatgttaataactcaaaccattgaactcctagaagaaaacataggggaaaagctccttgatatcggccttggcaatgattttttagacatcacaccaaaagcacaggcaacaaaagcaaaaagaaacaggtggtactacatcagactaaaaagcttctgcatgacaaagggaacaatccgcaaataaaagggcagcctatgaattggaagaaaatatttgcgacccatatatatgataaggagttaatatcaaaaatatataaggaactcccagaactcaatggtaagaaaatgaataacccgattaaaaaataggcaaaggacttgattattcattttcccaaagaagccatacaaatggccagcaggttgtgaaaaggtactcagtatcactaatcataagggaaatggaaatcaaaaccactatgagatatcagctcacaccttttagaatggctattagaaagacaacagataacaaacgttagggtgtggagaaaagagaacccttttatacttttgatgggaatgtagattggtacagccattatggaaaatggtatagaagtgcctcaaaaaattaaaagtagaactaccatatgatccagcaattcctctgctggatatgtacctaaaggaaatgaagtcagtgtgtcaaagaggtatctacactcctgtgttcattgcagcattattcgcaatagccaagatatggaaacaatttaagtgactgttgatggatgagtggctaaaaatatcgtgggatacacacacacacacacacacacacacacacacacacacacacacacacagatgacagaatattattcagccttaaaaaaggagatcatgctatttgtgacaacatggatgaacttatgctaagtaaaataagtgagacacagaaggaaaaatacttcatgatcttatttatctggaacctgaaaaaaagagtcaaatatatagaaacagaatagaaccacggttaccaagggtgggaatggggaggaaataaggcaatgtaggtcaaagtgtacaaacttgcagtgatgtaggctcaataagtctagagatgtacagcaggaggactatagttaacaatattgtattgtatatggaaaatgtgctaagagtagattttaggtgctcttacctcttctccccacaaaggtaactatggaaggtgatgagtatgtcagattgcttactggtagtaatcatttcactatggatatgtatatcaaaacatcatgtcatacatgttaaagttatgccataaaaatagctatatgtgggccaggccaggcatggtggcttatgcctgtaataccagcattttgggaggctgaggcaggaggattgcttgaggccaggagtttaagaccagcctgggcaacgtagtgagaaacctgtctctccaaaaatgtttttaaaagttatctgcgtgtggtagtgcatgcctgtgatcccagctacttgggaggctgaggcaagaggattgcttgagcccgaaaggtagaggctgcagtgacctgcgattgcaccactgcactccagcctgcgtgacagagtgagaccctgtctcttaaaaaaaaaaaagattaaaaaatagttgtatgtgtatatgtatacgttcaggatttgttctatttgttttctttttcttttttttcataggcagtggtcaatggcctaaggatttctttatacattgctcatatccactaaggctctattgagcaaaccacgccttaaaaatcttacaatcctcttcatatattttaaaggcaaatgcaaagaaatagctttgttctgttttgcattcttcatgggttaacatatcttctggaaaacttgttgctatggcaatgggatattatctatcttggtaatgtactacataaaaatagccctttgtgtttgagaatgatgttagtgacaggtggttgggtgaatgtatagcaggctgctttgtcaagaatagtttcccaacattccattgtttaaagttgtgaaatcaaaatgagtataatttttttctctctcaaaatgtaattttatctggaaaaggcaggcagtggtgctctgtttaattatgaattacaagccttcctttgcaggtcaggtcaacatgatgattgaagccacctctcactgtaataagtaaacgacttctctattctttctgtcagggtgtgcagcacaaggttgcgctgggggggccagtagggataattttcccattcttgaacacatcgttcttcctaagcacctcgtacttataaaccaagaagtaggaagtggtcaggtggaagagatgagctctgagctgttaatcaaatccgaatttcttgtaggttcttaggtgaaacagttccttgggaaaggtcagatttccatgttgcttttagtattgaactcacacatatagccaaggatagaatctgacccaaatcttaatttttcctttgaaaaatcctttgggcaatttttttttaatttaatttaattttattattattattattattttttattgatcattcttgggtgtttctcgcagagggggatttggcagggtcacaggacagtagtggagggaaggtcagcagataaacaagtgaacaaaggtctctggttttcctaggcagaggaccctgccgccttccgcagtgtttgtgtccctgggtacttgagattagggagtggtgctgactcttaaggagcatgctgccttcaagcatctgtttaacaaagcacatcttgcaccgcccttaatccattcaaccctgagtggatacagcacatgtttcagagagcaccgggttgggggtaaggtcaccgatcaacaggatcccaaggcagaagaatttttcttagtacagaacaaaatgaaaagtctcccatgtctacctctttccacacagtcacggcaaccatccgatttctcaatcttttccccacctttcccccctttctattctacaaaaccgccattgtcatcatggcccgttctcaatgagctgttgggtacacctcccagacggggtggtggccgggcagaggggctcctcacttcccagtaggtgccgccgggcagaggcgcccctcacctcccggacggggcggctggccggacggggggctgaccccccccacctccctcctggacggggcggctggccgggcagaggggctcctcacttcccagtaggggcggccgggcagaggcgcccctcacctcccggacggggcggctggccgggcggggggctgacccccccacctccctcccggacggggcggctggccgggcagagtggctcctcacttcccagtaggggcagccgggcagaggcgcccctcacttcccggacggggcggctggccaggtggggggctgaccccgccacctccctcccggacggggcggctggccgggcagagtggctcctcacttcccagtaggggcgcccgggcagaggcgcccctcacctcccggacggggcggctggccgggcggggggctgacccccccacctccctcccagatggggcagctggccgggcggggggctgacccccccacctccctcccggacggggcggctggccgggtggggggctgacccccccacctccctcccggacagggcggctggcagggcagagtggctcctcacttcccagtaggggcggctgggcagaggcgcccctcacttcccggacggggcggctggccgggcggggggctgatccccccacctccctcccagacggggcggctggccgggcggggggctgacccccccacctccctcccggacggggcggctggccgggcggggggctgacccccccacctccctcccggacgaggtggctgccgggcggagacgctcctcacttcccagacggggtggctgctgggcggaggggctcctcacttctcagacggggcagctgccgggcggaggggctcctcacttctcagacggggcggttgccaggcagagggtctcctcacttctcagacggggcgtccgggcagagacgctcctcacatcccagacggggtggcagggcagaggtgctccccacatctcagacgatgggcggccgggcagagacgctcctcacttcccagatgtgatggcggccgggaagaggcgctcctcacttcctagatgggatggcggctgggcagaggctgcaatctctgcactttgggaggccaaggcaggctgctgggaggtggaggttgtagtgagctgagatcacgccactgcactccagcctgggcaccattgagcactgagtgaacgagactccgtctgcaatcccggcacctcgggaggccgaggctggcgggtcactcgcggttaggagctggagaccaacccggccaacacagcgaatccccatctccaccaaaaaaatacgaaaaccagtcaggcgtggcggcgcgcgcctgcaattgcaggcactcggcaagctgaggcaggagaatcaggcagggaggttgcagtgagccgagatggcagcagtactgtccagcttcggctcggcatcagagggagactgtggaaagagagggagagggagaccgtggggagagggagagggctgggcaatttcttagagcagtaactctcaaacattttgtcgtcatcatctcacttttcttctacttatcaaaatgagtattgatttaattgtaatgagtaaataacagctccctgctactgaaatgaaatttactctagctttgagaatttgagagaccctcttaagaaaataccacagctggaaatttgagacctaaaagtaatacaatttgagtatctcatatctgaaatgcttgggaccagaagtgttttggattttggattttttcagactttggaatatttgcgtttacataatgagatctcttggggatgggacccaagtctaaacacgaaattcattaatgttttatatacgccttatacacatagcctaaaggtaattttatacaatattttaaataagcttgtgcatgaaacaaaattttgactgtgttttgactgtgacctgtcacataaggtcaggtgtggattttttcatttgtgacttcatgtcaacactcagaaactttcacattttggagcattttggatttcagattagggatgcttaatctgcagctctaattctgatatgcacggtactactgcagagatggaaccattgcctttgtcttttctgttggagtcagtatagatatcttgctactaataatatcagaagagagtgttgagtggtttgctgggtgcccaatactacttttagaacattttatgtattaactaatttattcctgtaaacattcttgacagtttttgtgactatttcccaaatgaggcgtacttgttagcatgtctttctgtttgtggtgagtaagcattcttgtgtattggaagacttgcttactagcatgtcacagtgttcttcatattgaaagcattcttctatcaggagttgacgtaattcagcctgtgggccaaatccatcctgccacccattttttgtgtattttataagctaagaatggtttctgcatttttaaatggttgggaaaacataaaaagaataatttgtgacatgtgaaaattacatgaaatttaaatttcagtttccataaacagttttattggaacacagctttactcatttgtttacatattgctaaggctgcttttgaactagagtggcagagttgagtagttgtaatagagaccatatagctcccagaccctaagaaaaagtttgccaatcccttctctatattcttctgtatctagaatggcagatggtcctcaataataacagcagattggtcaggtgtcatagtttatgcctgtaatcccagcattttgagaggccaaggtgggaggatcacttgagctggagttcaagaccagcctgggcaacacagtgagacctagctctgcaaaaattagccaggtgtcatggtgcacgctggtggtcccagctacttgggaggctgaagtgggaggattgcttgagcctgggaggtcaaggctggagggagacgtgatcacaccattgtgctccagcctgggtgacagagcgagaccctgtctcaaaaatatataaacagattggatttatgtacaggttcatatatatattaattttcttttggtatgcaatatatttttctttcttccactaaacgtttctcttgtcataagcttgatgtcatgtactatggcatatctcaaatatacgtgatttcagctctttgcatacccatattggttttcttttttttttttttaattgatcattcttaggtgtttctcgcagagggggatttggcagggtcacaggacaatagtggagggaaggtcagcagataaacaagtgaacaaaggtctctggttttcctaggcagaggactctgcggccttccgcagtgtttgtgtccctgggtacttgagattagggagcggtgatgactcttaaggagcatgctgccttcaagcatctgtttaacaaagcacatcttgcaccgcccttaatccattcaaccctgagtggacacagcacatgtttcagagagcaccgggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcagtgagctgttgggtacacctcccagacggggtggtggccgggcagaggggctcctcacttcccagtaggggcggccgggcagaggcgcccctcacctcccggacggggcggctggccgggcggggggctgacacccccacctccctcccggacggggcggctggccgggcggggggctgacccccccacctccctccgggacggggtggctggctgggcagaggggctcctcacttcccagtaggggcggccaggcagaggcgcccctcacctcctggatggggcggctggccgggcggggggctgacccccccacctccctcccagacggggcggctggccgggcggggggctgaccccccccacctccctcccggacggggcggccggccgggcagaggggctcctcacttcccagtaggggcggccgggcagaggcgcccctcacctcccggatggggtggctggccgggcggggggctgacccccccacctccctcccggacggggtggctgctgggcggagacgttcctcacttcccagacgggatggctgccgggtggaggggctcctcacttctcagacggggcggctgccgggcggaggggcccctcacttctcagacggggcggctgctgggctgaggggctcctcacttttcagacggggcggttgccaggcagagggtctcctcacttctcagacggggcggctgggcagagacgctcctcacatcccggatggggcggcagggcagaggcactccccacatctcagacgatgggcggccgggcagagacgctcctcacttcctagatgggatggcggccgggaagaggcgctcctcacttcctagatgggatggcggccaggcagagacgctcctcactttccagactgggcagccaggcagaggggctcctcacatcccagacgatgggtggccaggcagagacactcctcactttccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatcccggcacctcgggaggccgaggctggcggatcactcccggttaggagctggagaccagcccggccaacacagcgaaaccccgtctccaccaaaaaaatacgaaaaccagtcaggcgtggcggcgcgcgcctgcaattgcaggcactcggcaggctgaggcaggagaatcaggcagggaggttgcagtgagccaagatggcagcagtacagtccagactcccacggcatcagagggagaccgtggaaagagagggagagggagaccgtggggagagggagaccgagagggagagggagagagggagagggagagagggagagggagagagggagagggagagatttggttttcataataatcataaccctttccaaatgagggagagtaatgaattttatcattttattagttagtgtgcttcctttgctagatcaggaattatatctcctagtaattataaccctctatttattatttttaactatattgctttctacttttgggctttcagccaacgtgtaaatattgacagtttaataatctgaaccaagccacctggactgattgtaatattttaatttaataaatcttgcatatggttaagattacatcttctacattcatcagattggatttaatgcactcaccataatcaactctggaacattcttgcaattattattgttatttttaaaggttttctcctttgtctgttgttttcccactttttttttttttttttaagacggaatctccctctgtcacccaggctggagtgcagtggcgtgatctcggctcactgcaacctccgccccctgggttcaagcgattctcctgtctcagcctcctgagtagctgggactacaggcgtgtgccaccacgcccagctaattttttgtatttttagtagagatggggtttcaccatgttggccaggctggtctcaaactcctgacctcaagcagtctgcctgcctcggcctcctgaagtgctgggattataggcgtgagccactgtgcctggcctgttttcccactttttaaagtaacagccttgttgagatgtaattcacataccatatagtcacctatttaaagtgtacaattcagtggttttagtatattcacagaattgtgcaaccatcacaactatttccggaatatttttgtcacccaaaaaagaaaccccatactcactagcaatcacccccagttccaccattcctaggcagccatggatctactttttgtctatggattcgtctattccagacatttcatagaaatgaaaccacatagtgtgtggtcatttgtgattgtcttctttctcttagcgtgttttaaatgtagcacgtatcagcacttcttattgccagttctgctgtatggctataccacattttatttatcaattcatgagttgacagacatttgggtcattttcactttttgcctcttatgtataatgctactctgaacacttgtgtataggtttttgtgtggacatatgtttttatttctgtcgaatatatacctagaggtggaattgttgtgtcgtatggtaactctatgtttaaccttttgaggaactgccaggctcttttgcaaagctgctgtactatttgacattcttgtgagcaatatatgagggttccagtttccccacatccttaccaacgtttgttattgtctatctttttgattatggctatcctagtgggtgtataatggtatctcattgtggttttagttggaatttccctgatgactaataatgttgcatgtcttttcacgtgcttattggccacttgtatatcttctttagagaaatgtgtatttagatcgtttgtccattttaaattgggttgtctttataaaatgttgaattgtaagagttctttatatattctggattcaatacatatgatacaatacatataatacatattttagtcatctatcagataaatgatttgcaaaaattttcttccattttgtgggttgtctttttactttcttgatggtgtcctttgaagcatgaaagcttttaattttgatggagtttatttattgttttctattgtcacttgtgtttttggtgtcatatttaagaaaccattgcctaatccaagatcacaaagatttcacttatgttttcttctaagagttttgtagttttagctcctatatgtcagtctttgattcattttgagttaatttttgtacgtggtgtgaagtaggggtacaacttcatacttttgtatatggatatccacttgtcttagcatcatgttttgaacaaactgttcttttcctaatgaattgttttggaacccttgtgcaaaaccaattgaccttatgtaaatgtaagggcttatgtctagactgtgtcagtatcacactgtcttgatttgtttaatctatttttgaggcagactttcgctccctgatctaaaattaaaatgtttcacaattgatgatgtcttatatgcatcaaaacttgcagactgggtgtaagtggcttgagaaaatatattggagactaaagtggggctgttggagactcataggaatcaaatagttagaaggtgggggagtgagagaggcagtaagttggatgcttcccaggtgtttagcagccatcccaaagtggcagtcaaaaataggctagctttacataatttcaaagttaggtactgatggttccagtttctttttatggattcttttaaaaagtgctgtatcaccaaatgctgttgatggcatagaagacaacactgtggaaaaatgtggacattgaccagtctgagtcaaaaagatggacagatattcagttctaaatgtgaggaatttttaggaaaaccttgagcagttaattttgcttatttccctttctatgtgtatatgaatgataaatgaaaagtctaaaagagctcctttaataagcctgagataaatgctaagtcgtagactactgcatcatatcttatttggcttttttttagtgccacctaaaatactggtgttttagctttgagatgctcttatcctcctgcttccagctctatctacacctcagaaggagctgggtcctttcccagagtctattgtataaattaaccttcttcctgtagtcactctatgtccatctgtttcccagccactttaattttgttctttttcctttctcttgtgcttgtagatttaagtcttaaaaacaagccaggtattattgtttatagtggaattttgagtaggagtggaggttaacctgtacatcaatctagtaggaatattcattcaatcactcaagggatgagcttatggaaaagttacaaaaatagtagcattcctttatattcctcaccctgctcccttaatgttaacattttatataaaggatcaagaataggaaattagtcttggtacagtattattaactaaactacagagcttatttgaattccatcagtttttccactggtggtctatttctgttctaggatcctgtccaggatcccatattgcatttagttattatttctccttagtctcatccagtttgtaataatttcttaatctttaatgacacctttgaagagtacagatcaatattttgtagaatgttcctcaatttgtatttgtttgatgctttcttatgaataaggttgttcatttttggcaagaatataatgatgcatatttttcagtgtatcatatcaaggagttcatgatgttgatgtgtcttgttactggtgacatttaccttgattccttgtttaaattgctgtctgcagggtttctctacagtaaaattattactttttctctttatggttaaaatatcttgggggagatgctttgagactaggcagatatcctatttatcctcaaatttttgtccattgatttttttcattctttggtggatcactctgtatcatagagtatttgtgacaaatatttgattagcagaaataaagctatgccctacaagaagcaaagatcaattacattgaaatcctattgtattggttaatataacgctagcagctgtgttcctcaactttcaggagcttaacacaacagatgcttttcttctcaatatgggcatttctggttgtgtaggcagttttctgccatgttaattcaagtatccagactaaactttttatactgaagtaacttcaaactgacagaaaatagggatgcaagaatagtaccaggaaatcctgtataccctttactagatttacttaacatttgctacatgtgccttatgattttctttgtctattcatatatgtatatgtattttatatatattttatatatctgtatttatatattgattgccatatactaaatcacttgagattaaatcacatacatcatgttcttctatgccttaatagtttaaacttaatatatttatttgtttaaatctagtatacagtttcagaattgctaacccatatctgtttgagaaacactttcactaactggattacagcatttatacaattcttttattctttagttttgcaatatctagtcaagatacgattttccagtttcccactgaagtattaagtttgaaaactgtacataagcacactgttattcaaatttaggaaatttaatatcagtactttagtatgcagtctgtattccagtttcattaattatccccaaaatgttcttcagtggaatattttttttctcctgatacagtatcaagtccaggatcatgtattgaatttatttgtcatgactttttagtttcctttgatctggaacagatcttataagcctttctttgtctttcatgacatcgacattttgaacaatgacaaatttatgacattgttttgtagaatgtaccaaatttgggctgggtgctgtggctcatgcctacaatcctagcactttgggaggctgaggcaggtggattgtctgagttcaggaactcgagaccagcttggccaacatggtgaaaccccatctctactaaaaatacaaaaaacaaaaaaaattagccatggcacctataatcccagctactcaggaggctgaggcaagagaatcgcttgaacccgggaggcagaggttgcagtgagccgagattgcaccactgcactccagcctgggcgacagagctagatgctccatttcaaaaaaaaaaggaacgtaccaaatttgggtttggttgatggctcctcttgtttagattgagattatgcatttttaaaaaaacttttaggttcaggggtacatgtgctgatttgttgtataggtaaattcttgtcacgggggtttgttgtacagattatttcattacccaggtactaaacctagtatgcagtagttttttttttctcttctccctcctgccaccctccatcctccaataggcctcagtgtctgttgttcttctctgtgtgtccatgtgttctcatcacttagctcccacttacaagtgagaacatgcagtatttggttttccgttcctgcattagtttgcttaggataatggcccccagctccatccatgttcctgcaaaggacatgagctcattcttttttatggttgtgtagtattccatggtgtatatgtaccacattttctttatccagtctatcattgatgggcatttaggttgattttatgtttttgctattgtgaatagtgctgcaatgaacatacgcttgcatgtgtctttatggtagaatgatttatattcctttgggtctatacccagtaatggggttgctgggtcgaatggtatttccgtttttaggtctttgaggaatcgccactctgttttccacaatagttgaattaatttacactcctaccagcagtatgtaagcattcctttttctctgcaacctcactggcacctgtttctttttgactttttagtaatagccattcttactgatgtgagatgttatctcattgtggttttgatttgcatttctctaatgatcagtgatgttgtggtttttttttcatctgctcgttagccacgtgtatgtcttcttttgaaaagtgtctgagattatgcatttttgtctggaatactgcataagtgacatgtccttctcaggcaatgcatcaggaggcacatgatgtctcaacccctcattggtgattgtaattttgatcatttggttaaattactgtttgcttaagtgttaactatttttagatatgacgtatcagagtgatcaatactgtgaagcctcttacaacagtgtttagattgaaaaattatgagtgaaaagcctttcacagtcattcggattgaatatgcctaacatgaaatccaaactgtttcaacatttctttcaagtcattttctactatggaaataataatgcatgatttagccatgcctgagttttatttcctcacgcaggcatttatttctttaaaaaatttaatttaaagttcactataaaacttaccattttaaccatttgaagtgtacacttcagtggcattaagtacattcacaatgttgtgcaaccatcactaccatccatctccaggacttctttatcatcccaaacataaaccatatctactaaacagtaactccccaattccttctccagcccctggtaacctcattttatatgccatcacaatattttagaataaacgccaacttcctggggtaagatcatttgacttttgctcccagatcagaactatgataaaaatattatttgctatatactaacagggaaatttctggattttggcatgagttactgtattataactctaaatcctggtaagggaagcatttttattctgaaagtaaacaaaaataaccattagtatgataatctttacctctgggggtggggtattttggagggggtgagtacaaagagaggtgaaattattcctctagggtggcagaccagagtttaaattgtttcttatgtttttcatcttggttgtctaccaattggatatagtcactcagatcatccatgtttttgtacctggtttgataggtataaatacctataaattggaataaattctagcaattagaggtccatgttccttggtctgtaaagtgaatataacaaaactgacttctctccaaagggtgctttgagacaaaactataaaacactttggagagtagaaggggggtccttatttttagtaacattcctcagtgttcttcaagaactcacctactgccaatcattcctctgagttaagaatatatattagaactagttttaatagcactataaactatagatagcatggccatatgtccctgtttgcctggagctgaataaattacaggttcaaaaatactcaaataataaaattgcctaggtggtgacccacctagtttgttgctgtatggtgttgggtatctcttttttttccttgacaaatttgaaaaggccttgaaaccatgagcagattccttggttcagatggtctgtaataggagacaccaggacaagcctgagtctcctgctcttgaaagattagcatattgatagattgcgtacccattatcagttaggtatctgccaaaccatttgcagcgtttctctggagttcatacagttgggaagacttcctagaggcaagaggtcttttacctgaagattcagcagttactataggggccttcttttggcttcttgctcttgggacacctttacttgaatgaggtagtcttttgccattagtgcctgtggggccttaatgattcctattgggatgagttggccagaagtgaggctctccacttcatgttgaaactaacttctgcctgagtattaaggatgggtgattctgaggtcctgagccagctggaaggactttcattcactttctactcttgtctgaagaatgcttaggctaccttactgttacttctctggtggtaccaaaggccatgtaatgacatggctggatgcgatcactcacgtctgtaatcccagcactttgggaggccaaggcaggaggatcacttgagcccaggagttcaaccagcctgggcgacataggaagacccccatctctaaaaaatttttaaaaaatctagctgggcatgttggtatactcctgtagtcccagctactcggcaggctgagatgggaggattgcttgagcttaggcgattgaggctgcggtgaaccatgatcacaccactgcactccagcttgggcaacagagcaagaccctgtctctaaaaaaaaaaaaaaaaaacaaacaaaagatgtgatgattgcctctttcggttatatcctgctgcctaagagcccaccccagaatttagtggcttaggataaccattttcatagttttgtcagtgagggattagggaagatgtcagctgagctcttcatttctgctccagatggcattggttgggcaatgggactggaggttctaattctaagatagcttcttcactcttatgaatagctcctcagtgtctgtggccagtctctctccatgtggtatctcatccaccctggcctttccacatgccttaggcttcccacatcatggtggttcctgggtagttactcttcttacagagtagggatgaaatgaaagcctctattctaaattcagttaaatactggtacaaatatttagtactgggattgtgggatcattttcttatatcataattataacccaatcagggtagaaaagtgaaagaaagaaggacacttcattttctttgctctttgtgtggatgatgggttgtacaaatagcaggaggttcaacttttggcttgttttggattactgagtactatccttcagaaatgatttcctaatactttcccggccatctggcatgagcacagaagaccttttactcaataaaagtaagctaataataataagttgaaacatcttgataataaatatatttgtacagcttttcaaatcccaggttattgaaattctgtcagccttggctggtttccatgctccttctgtgcccttgtgtttcctttttttctttttttttttgttgagccactcctgctgacttccaaaggatgctctgagctctaaaaggaggagcagttttgctggcatgcagaagtggtgaaggtaaggcttggattcaattacagtaatctcagaagttcttggtagaagaggggcacagaatcccagcctccattttgcaggtaaggaagaagaattataaaaagataaaatggcttttcttaatgtcagcatctgattctttaccttctttcaccctagcaaagattgttaacataaaacagatgttccttggacaagagaaaagtaatagagctggatcttttcatgatcctgcatttattatttgtagcactggatctctaaactaggaaaagcaatgtcgattctaactagaaattatggggcatttaataacacgtgaggcaaaattatgaggaaaggcaagaaaccaagtggctcctagcttctaacaccttattttctatggtgtaagttaatgaatgatccatttttaatgccataaaaaaggaaatttccgataggctttaccttaacttcacgttgctgtttatattacagacaaaatgctaaagttaacaagtgtaaaatgccctaggtcagggtttcgagtgcccataagcaattctctagaattattttgagtgctcagattatagatttgcccccataccatatactgtattacctatcactgcaagattctttatagggtgtcaagtatgtgggaggatttaaactaattgtcttaaatgcttcatgggataggagatgatccaatgggaactgaatgttttcaattaggatgtttccatggatactattaagcatgccaagattcatagccacaggagatttttacttacttcaatattgattaagaaatctgagaacaatctcaagaagtgtaggatgtaggcggaggataaattttgaggatagtctaaaatttgctttctcttccatagttaaggcctagtccagaaaaagtctaggcagtcagccaagtctaacagcaggatttatgtcaagagaatgtccagaataaaagtgaacatgggttgtttcatttaccccaggtgtatttattaacatttatttaatgttacttattatttgtttattaccattagctttcttatgtactcggtacaaagcattagaattacaaccctttgtatctttgttgtttatgaggaaaacatcctaaatagtgtctacagacatcttaaaattcacattcctctgagaaaggtttatcccttaggttattacttttttttttttttccacacatgggttttttacctgggttctcagatctccaagaaatcggtggatagaattcaaggtgacttcttggatggagaaaaagtacgtctttattttgaccaaccatggatatttagcattttcatcaattaatgaatgcaggtgacaaatcacagtactattggccccatctttgagtttgtcctcaatagctcacagatattttcatattgtatcacagttgttgcagatatcttgaaatattgtttattctaatcactccttcaaaatttgggtggttattggcattatcaccagttttttttttttttttgaggcagtctttctctgttacccccaggctggagtgcagtggtgtgatcttggctcactgtgacctctgcctcccaggttcaagtgattctcccgcctcagcttcctgagtagctgggattacaggcacatgccaccacggcccggctaatttatttatttatttattctttattttttatttttaaattttttttagatggagtctcactctgtcgccaggctggagtgcagtggtgtgatcttggctcactgcaacctccgcctcccaggttcaagcgattctcctgcctcagcctcccgagtagttgggactacgggagcgtgccaccacgcccagctaatttttctattttaagtagagatggagttttaccatgttggccaggatggtcgcgatctcttgacctcgtgatccacctgcctcggccaaaatgctgggattacaggcgtgagccaccgtgcctggccacattaccaccagttcttgatacttaatgccataacaaaaggcacatgtatcactatatcacaaattagcattttataatattttaataacgttttcaatataagtggcttcccttgtaatcatatattttatttttgcacttaaaaatataattcctaaaagggatccataaagcttcaccagactgccaaagcgtccatggcacaggacgttaagaaccctgttccaaatggaatgaagattagaagcactatcatatgttcattttctgatcgcagtttaagaaagagtttcctacttaagtgcttttcacagaaaatctaaacttaaaggttaaaagggaattcttttgtgctggctcatgtgtgggccctacaaagtactttgcagtcatatctgactttcgtttgagagtttgtcttcagaaatggaagaagaaaaggcattcaggtatatgacaggttgcattctgtagaacattgttaaatctatgggaggggagaaaagttccattcagtgtcttgtggattgtggtaggagtcagttgtgttcttgcagaaatttccctagacagtgcctcttgcctcctcctttcttgtcccacagtactccatggagcagatgtgggaacttggatgcctgatgggaattgtaaccccatgctttgccttatcctggtggggactgatctgaggtttatccattaaactgtatcagttcatggctgggagtaggaatgcagaaaacacaagcaaaatgactgcaggaaggtttaaataaaatctcatatgtggcttttccttaacacattattttgcaaaaagtggcagagtgaatttgctgtgatatgataggatcattctggacttttacttaatttacgtgttctctagcagaatgctgaaggagcacacataaggagtggggagttggtatttggttctgtgacaagtgctatcttataacagaaaaatacatatttttgtgaaacttcaaatgcatttttattccccagcacatctgtgattctggatccactaccttcttccaagtgtgatcaagcactgtacctgacagtatcgattatccttacccgtaggcaaaaattgtattacatttattttacagtgatctggaaaaaaaaggatgacaacaaaaaccagacacacttcatttctattccggtaacattttttggtaataatttattactgtacaagtcacacaccatataagtcacacatttaaagtgtcaaattaaatggtttttagtatattcacaggatcgtgccatcatcacagtcaaatttagaacacttattacccccaacaagaaacctcatacgctttagcagtcaccctccattgccccccagttttctaaccccaggccctaacaaccactaacctactttctgtctctatgaatttgcctcttctggccatttcatataaatggaattacacattttgtaaccttttgtgactggcttttttcacttagcataatgttttttaaggtctacctatattagagtatgtatcagtactttattcctttttatggccaaataatattccattttctggatataccagattttgtttatccattcatctgttgatggacatttgagttgtttccactttgtgctattattatgaataatgctgctatgaacattcatgtttacatcatgtatacattttaatgtggacatatgtttttagttatcttgagtatatacctaggagtggaatcatatatatatgtttttaaaccaaaatcaaattttaatgttgcagaatccctgaagcacttttaggaactgttcacttccatagaacagtttgcaaatcagtgttaaagtggagagagtgttgatttttttgtgcatgtatttggtagacatcgtttgaatcttgattttataggctgtgtgaattttgtcaagttacctgtgaacatctttcttctagtatagaatgttagtacctctggatgtttcacgagttgatagactgtattattgcttgaaaaattcactgtccatttattaccatcaactttggccacggatttgctttggctagtggcctgtgaggggaagtgatgtgtgccttcttccaggcagaagctggtggtttgcctcatctcttttcctttctgccatgatgaccattgatgttccagttggacacaggctccatcagcttgtgtatcagaatgaaaatgatgtggggcagagccctcatagattttgttgcatgagtatggaaaaagtgtcattttaagccgtcaagatttggtgactatttgatactttagcacagtggtcctcaagcaatggcagttttgcatttctcacactgagatatctggcaatgtctggagacattttttggttatcacacatggggaagtgctcttggcatttagtgggcagatgctgctaagcatccaacactgcacaggacagctcccacaacaaagaattatctgatccaaaatgtcaatagtgctgaagtttagaaaccctgctttagtataacctagtttatcctggttaagatagggtgttgagaagattaaatggaaaaaaaatatataaaatacagcacacagggtggtctttttttggtaattatgtgacagagcttggcaatggctctgaggtcttcccttgcatttgtgggtcttttccaacttccctagggttcagtattcagtttaattgtagttgtgtttataaatcaaggctcgtttttagcagaatcatataccctttaaaaaagggggagaactaacattagatgcctgtttggcaccaggctctttgtatgtgttttgaatttttacagatattctctgaaactgatattccttacctccattttgttttgttttgttttgttttgttttgagacaggatctcactgtgttgcccagactggagtgcagtggtgcgatcttgtctcactgcaacctccacctcctgaattcaagcaattctcctgcctcagcctcctgagtagctgggattacaggcatgcgccaccatgcccagttaatgttttgtattttcagtagagatgggatttcgctatgttggccaggctggtctcttaacttttggcctcctgtgatcccccagccttggcctcccaaagtgctgggattacaggcatgagccaccatgcccggccctccattttgtttttgatgaagacattgaggcactgaagttaagtaatttgaccaagatcacatggcttataagtggtgggcctagaattcgaagcacatctgtttgcctccagaaccctcttctttccacactgctatactacctctttagcagtgactttaacatagagaaatgaaggtaatacctgatttctaacaattatgtgttgtattagttatctattgctgtataacaggttacctcaaaacttagcactttaacacaacaaacagttattgtctgacatagttttgagaatcagtaatttaggggaagctaagctgggtggttctggctcaggatctctatggagattgcaaacaagttgtcttccagggctgcagcgatctgaagacctgattggagcaggaagatccacttccattgtggtgcactcacagggctgttggtgggaggcctcagttcctcaccatgtgggtctctctttagggttgcttgattgtcatcatgacatggcagctggcctccttcagagtgagggatctcagagagacagcaaggcagaagccacaatatcttttgtgacctagccttagaagtcacagatgatcacttctgctcttttctattggtcacatacacaaccctgatataatgtgggagaggatgatacaagggcatcaagaatactatgagatggaaatcactgggggccatcatggaggctggttactacatgttaatgatcctcatttgccatagttacaaaattatgaattatatttccttttcatattctaatattccaaacacctgttttgtactttaagatacttaaatcatttagaatgtgagtgaaaatacaaattggcttttgtaaacacttactgaatgggtaaaataaaggccgtggtacagatacttcattggggaattttttttttaaataggtttgactagctgaggcttcttgaatcctgaaaagtttggtctgatgtacttttttttttttcctggaaaatctccttgtaccaaacactgaattcttcatttgccaaagtccacccaactttctgatgtttttattgctggtttgatgtgcttgaatgccagccagagtataaggtgaatggtagatgcaaggactgtgcagtttccacggagacttctttcaggagcccttcattttttcattcagctattgctgggaggcatccccttccagttaatgtgtggtacacatcaatttgagtggctcttagaaaggggctcagtttatacaaattaagaattgaggttttttttttctctgtatatcttcaacgttaaattagatttctatgaaacttgaagatgttaacaggaaatcttcctgaaacagtttaactatacttttgtttattacacttgattttgagcttttgggaataaaagtagggtcctggctaggtacagaggtatatggatttactgtgtctaatcgtgcaaccatgaaataaacgtttgcacttcaggaatcaacccatcactttttaaccactgttgtttgcattggcttagagctttgtgcttccttcaactattttccttttttctttcaaaactgtgttcagttggttgtgaccaattttacacagagactggctcactcacttatgttcttgactcctgctgtcccaatatcatgcttcatttacacagggatagcttttcctggctttatctgttgacttgacatcctgtgcatcatatttcttttcttagatatagagaagactgaaaaaaatccacgatttgaagaaaatttgcaaaagtgcagagcaatgtgaaagagatagctttaattttaattttcactgtagtcagaataggtggcctcctgatgggcagacttgctttctcattttactctgtccagtgtagatacccagatcaatcaaggtcaagctggtctggtcattaatacaacttttggttttaaacacagctgtgtacgggggttcttagcattattaatagaggttataatgaaaacaaggtatagtcatacagttgtctgtgtgggtagtggcatggaggtggagttgttgcttaagatctgaaagtcaggaagctggaggtttttgtaattttattcattatcaatcttaagaatttattttgatcattataaatgcatgactggtgctattttccaatcctgaggttttttgggaaatttttttgaaaagaggccaggatgaggataaaaattaattttgaaaatccatttcaaagactcattatgctatgctccatcactgcaattttaatgcaacttatatattgtgcttttacctttgggactagcattcttaaaagctgacttttaatttggactttctaatatgtgtcggctctgtcagctcacgagtgtgtttttatctgtgcatcatgttatattgggacctgggtggaatgtaaatcttttactggcctaaatctgagtctaatcctctgcatggctttggtagaaaatcaatttcctctgctctgtcaagatttttcaggtcagtgctctttggaagtttcccagttctcttagattaaaatagattttgtttctgtgctacatactggtattagttagtaggacactgggatctaaaagcaagagaacagaggcagacaagatatccatgagttcttctatttcagttaacttgttgacacactgcacctttgaggaaccaaggagtttgtgtgctttcaggcatcatttgggggagcaattgtaaatgactcctgtaggtgaggctgtgcacttaattttaatgagttcaggttcattaagtgacctgctcactgggtcattagaagtgacctcactagaagtgaatggtaaagagaagaactacctaagttccactcagcttgtttcactactgtggggtattggaagtagagtgacaacttggactttctcagttttagcactgaaaagtcccacatcccaggaacttactcagtccccagcaaactagggggagcgggggatggttggtccccctagcagtgaaaagtaaggggatggatgatttggaactggttagtacccttatagatttttttttttttttctgagacaggttcttgctgtgtcacccaggctagaatatagtggcatgatcatggctcactgcagccacgatctcctgggtccaaatgatactcccacttcagcctccccagtagctggaactacggggacaagccaccacacccagctaatttttatttatttatattaattaattaatttatttttttgtagggacagggtctcgctttgttgcccaggctggtcttgaactcctgggctcaagtgatcctcctgccttagcctctcaaagcactgggattacaggtgtaaaccaccatgcctggctgtcttataaatactttaaggagggatttattagagacatgtagcaccttgctgcccagtgatgctagtaaatgagtgactctactttgatttgacagaagaaacaatggaaagaggagagatggaagtttttctacctaaacttcctaagaggatgtgtttaggggatgtgttggtaaaaagttattagcattaatgtttacctgtatctttctcatagataatgcaaagacctttaactccacttatccctccttttaacttatgttgttattgccttgtattttaatactatatattaaactctacaagacatcattattttatgcaggcattgtttatttaatcagagttcagtaaactttttctgtaaatgccagatggtaaatattttaacccctgcaggccttatagtctctgtcacaactactcaactccactcttaatagtgccaaaatggctatagacaatatggaaatgattgtgtgtacccatgttccaataaaatttatttacagaaacagacagtgggccagatttggcctgcaggccttactttgacaactcctaatttagatttatctacatatttatttattttccctttatttcttgctatatctttgaggttctacctgggatcattttcaaggcaaggatgtctattctcatcactgtttttcagcgttgtgctagaaattccaaccagtgcaataaggcaagaaaaggaaataaaaggcatacagagcagaaaggaaaaaaaaaatgaaactggccaggtacagctgctcatactttgagaggcgagctaggaggattgcttgagcccaggagttccagaccagcttgggcaatgtagggcgacccccatctctacaaaagtaaaaataaaaaaaaaattagcagggtgttatggtgcatgtctgtggtctcagctacttgggaggctgaggtgggaggatcacttgggccttggaggtgaagtgagccatggtgactgtatcactgcattctagcctgggcaacagagtgacaccgcctgtctcagaaaacaaaacaaaaacctgtctctatttgcagatgacatgattgtctacatagaagaccctgagaaatctacagtctacagaataactcctagacctaattaagtgagttcagcaaggtttcaggatataagataaacatacaaaaatgagttgtatttctacatactagccataaacaaatggacactgaaattaaaaatacaataccatttacattcactcaaaaaatacttgggtataaatctaacaaagcatgcacaggacttgtatgctgaaaactatacaatgctgatgaaagaaatcaaagtctaaatagatggggaaacataccatgttccgggtttcaggatataagataaacttacaaaaatgagttgtatttcacatactagctagaaacaaatggacactgaaattaaaaatacaataccatttacattcactcaagaaatacttgggtataaatctaacaaagcatgcacaggacttgtatgctgaaaactacaaaatgctgatgaaagaaatcaaagtctaaatagatggggaacataccatgttccaggattggaagactcaacatagtaaagatatcatttctcccccaaattgatatacaggtttaatgtaattcctgtcaaaatcttagtaagatttttttgtagatataattataaaatttatatggaaagggaaaagaactagactagctgaaacaattttgaaaaagaataataaagcaggaggaatcagtctgtaagattttaagacatataactacagtaatcaagactgtgtgatattggtggagggatacatgtatagatcaacggaacagaacaaagaacctagaaatagaccaacagaaatgtgcccaattgatctttgacaaaattgcaacagcaattgaacggagaaggaaagatagcctttttgacaaatggtgctaggtcaattaaacatcaatatgtcaaaaaaaaaaaaaaactcttgctgtaaatagtacacgttatatgaaaaataactccaaatgtatcacaaacttcaatgtaaaacataaaactataaaaataattagagaaaatcttcaggatctaaggctaggcagagttcttagacctgacaccaaaggtatgatccataaaagaattgataaattggatttcatcaaaataaaaaatacttactctgagaaagacctcataagaggatgaaaagacagactacagagtggggggaaatatttgcaaactacgtatccgacaaaggactggcatctagaatatataaataactttcaaaacttaacagtagaaaacaacccagttagaaagtggaaaaaatacaagaagggacatttcactgaagagcatatacagatgacagataagcatgtgaaaagatgttcaacataattagccactagggaaatgtaaattcagaccaaagtgagctatcactacatacctataagaatggctaaaattaaaaatagtgacagcatcaaatgatggcaaggctgtagagaaatggaatcattcatactttgctgatgggatgtaaaatgatacagcccctctgaaaaacagtttggcagtttcttaaagacactaaacatgcaactaccatatgacccagcaattgcactcctgggcatttatcccagagaagtgaagatttatgttcatataaatgccagtatgtgaatgttttataggagttttattcataatagcccataactggaaacaatacagatgttctttagtggatgaatggttagacaaactggtatatccatagcatggaatactacccagcagtaaaaaggagtgaagtactgatacatgcaatgatctggatggatctccagagaattatgccgagtgagaaaagccaatcctgagtggtttaaataccatatgattccatttatgtaacattcttgaagtgacaaaattatggagatggagaacagattagtccatgccaggggttgagggggcaagggttgggagtaaaatggatagctataaaaggcatgatgaggccaggcgtggtggctcacgcctgtaattccagcactttaagaggccgaggcgggtgaattgcttgaggtcaggagtttgagatcagcctgaccaacatggtgaaaccctgtttttactaaaaatacaaaaagtagctgggtgtagtggcaggtgcctgtaatcccagctactccagaggctgaggcaggagaatcgcttgaacctgggaggcagaggttgtagtgagctgagattgtgccactgaactccagcctgggcaacagagcaagactctgtcttaggaaaaaaaaaaaaaggcatcatgggtccttgtgagcatgaaaatgttctctattgactgtgtcaatagagacacacaattatgttgtgtgtcacaaccataatcacaacattatggttgtgatattgtactgtagttttacaagatgttaccattgggaggaagtgggcaaagggtacataggatctctgggtatcatttcttacctctgcatataaaactacagttgtctcaaaaggtttaattaagaaagtatttaagaaaaagaaccccaggatctaaaaagatcagagtcagagaatcacaaatgctaaataagaagcacttttgtatttggtgatgttctgaaattctggctcagttttgttatgaaatggagccacgtgggtccatgtgagtgagtccctgtgcacaggtgtatgattgactttttccctcaagtgcttctaatttgggatgttcttcactgtgtgccctttgagtgtctcttgcctctggttttttgttagacaaaaaaaccagtttttaaatgtcagttccaaggtcttttctgggtacggttaacttttatgatttcatttatgcagtgggttttcacctaagggccatggtttctagacactagactcgtttttcccaagcgattcatctctttgcctgtgggatggagagattcattctcttcttctcttttgcagtagaaactccagttttgagctgggcacctggatgcccagagtaaaggttgtactgcccacatttcattgtagctaggtgtgcctgcgtgaccaagtatgaaccttctatttagattaagccacaagataagtggagctatcaattggctttaacaaatatttagtgaataggtaaaataaaatactttatataagagctgtgtgttctgggttgaattgtgtcccccacaaaaagatatattaaagtcgtaacccttagtacctcagaatgtgaccttatttggaaagagggtctttgcagatataattaatttcaggtgaggttataccggagtagggtgggctcctaatccaatatgatgagtgtcctcagaagaaggcagtcaggcacatgtaccctaaaacttaaagtagaataaaaaataaataaataaataaataaataaaaaagaaggcagtcaggtgaagacacagacacacagtgggaaccccctatgaagatgaagatagaagcaatgtatctacaagccagggaccgcctgcggctgcaagaagccaggtgagacacatggagctgattctccctcacagcccttagaaggaacgtgccctgctgacaccttggttttggacttccagtctccagaaccatgggataataaatacatttctgttgtttgaagccacccaatttgtggtactttattatagcagccctaggaaaccaatatactatgcttttgatattatttttaggatgttgtggtttgaatatttgtgtctcccccaaattcctatgttgaaacctagtctctgatgcgatagtattaagaggtggggcctttaggaggtgcatgagggcagagcccttatgatgggattagtgttcctagaaaagagacttgagggagcttgtttgccccttccagtatgtgaggatacagcaagaaagtgccatctatgaggcagagagtgagccctcactatacactgaatctgctggcaccttgatcttagacttcccagcctccagaatggaaagaaatttctgttgtttataaattactgagtctaaggtattttgttgtagcagccccaacaaactaagacatggagtattttaaaaaatgggttgaacattcagaggcttcttaatctgagtccttagatatttggactgactctgccttctttttccagtgaaaagatctcgctgtatgaaacatagacattcttcattgccccaaagcccttccaccttccttatgtttttattgctggtttgatgtgcttgaatgctagccaaagtataaggtgaatggtagatgcaaggactgggcggtttccatggagacttcttgcaggagcctttcctttctcagttcaacagttgtcaaggaaacatctagtttcaattaaataaatgtttgtggggtctgccaatttgagtgtctcttggaaggggatttggttaaacttcttaaacatcgtaataaacaaattcagagcagaggctttttaggttcccttccagttatattaggtttttctgtaacttagggatgttaactagtcctctgtctgaagtgatcagactatttattcatatccagaaaatattatttttgagtcttgtggggaggaaaactgaggcttaaagaaagagaggccaaagccagggagctggtgttacatggcaccagctatatatacatgactatagtccatgctctttagtacgtcctgcaggataagagatccaaggggcctgacctttacaaactgtttacaggctatggagtttgctggctcagcactgtgtgtttattgcttctagttagctattgttgtatcagtggctggagttggtgatggttcacggaaatagtggtgagagtacagattctaggtatatgcaattctaataaatgagacttccctagtgttatctgtattgtgacagcctccccattgtgctctttatcaaacagtaaggtatggtatattgcaaaatgctcacaatactttgcaactcttcccatcaagaggtagagtcagtttctctattcttaggatcttggctgtcctgttgatttggtctgaccctggaatacagtagaaaagaccctgtgtgggttttgatcctaggcgtgaggtagagcttcagtttcttgctgctttgggaactctgccaccttgtaaaaaaagccctggctggcctcctggaggaagagagactatgtggaggaaaatgaaggtacccagacaacccaatagtcaactgcagaagcataagtgaccctcatctgagatcaatggtgcctggctcggatcagtataattgtccagctgaactcagcccaaattactgacccccagagttatgaattaaataaatgctgttgctttaaggcacttaagttttggggtggtgtgttatacagtagtagataattgatacagccaagtttggaagctctggaatgatcagggctcacctttgacctgtcctctataaaacccaggattcttagtaacacagtcctgttaataacagaacttgcctatggcaaatctaagcggaaaagcagtttattggcaggatattgtgtagctacatctttctttaggaagaccagggacaaggcttgaaaactgcacaactagggggcagtactgccagaactacagccagataacctcacagaattggtagctactgaatattggatgcctccacctacaccaccaacattgcctgcattggacattgggtatggggctgctcctggaactggatgttgttcctgtcactagaaaacaatcatctactgttcttgctgtttcacagcactcattactgattcagatgcccgtgtgccacgtgtttatagcagtgcaatttgtaattgcaaaaatagggaaccagcccaaatgcccatcaatcgagtggataaagaaaatatatcaaaaatatattttatatgtgtgtgtgtatgtatatgtgtgtatatatgtgtgtatgtatatgtgtgtatatatacacacacgtacatatatatacatatatatacacacacgtacatatatatacacacacgtacatatatatgcacacacacatatatatacacacacgtaacatttataatacgccatggaatactactcagccataaaaaggaatgaaataatagcatttgcaacaacgtggatggagttggagaccattattctaagtgaagtgactcaggaatggaaaaccgaacgttgtattttctcacttataagtgggagctaagctatgaggatgcaaaggcataagaatgaaacagtggactttggggcctcagagggaagggtgggaggtgagggataaaagactacacattgggtacagtgtacactgctcggctgatgagtacctcaaaatctcagaaatcagcactgaagaacttaactcatgtaaccaaataccatctgttcccccaaagctatttaaataataataaaaacaaaaacaaatgcctgtgtgggtggtgtctggcagagcgtaggtcttgtgcccataccctgattgaaaagaaatcaggaaagtgagaatctgacacttttagcttatttagctgaaagcaggtggaaaatttcataaacactggcaaagggttcggataacaggcagccaaaagaaaaatggcaaatgttcattagtttctgttgtatactctggttagctcagttggttacagcacagttatgatgaagccagcattgtggtttgttcttaagttttattgaaagaaaatagttctgagattgtcccccttacacctgctccctctctcacagatgtgtgctgatagccatttgtaaggccaggcaatagtggggcctaacttgcatctgtctctggctgctaaggtacaaagattatgtgtctttcagttggtgggcccagagactccattcactggcatagtgtgccacataagagaactgaatgaatggtatctgtgtgaatctaaggggttggctaattgcgcagtgaatttggttcatgtaacatttataatacaaattgttgggcagcaagatctttcaatccagacggtttctagtttttcagaatttctctgataacttctctgaactctgaaattcttatttgcaaaaccatctatatagggttcatttaaatattagaaatagtactcataaagagaaaagcataatgcctagaggatgtgtaatagatgttcaataaatgttgatcatttccctcaaacttcttagattcacacaccccaaccagattagaaactctgacacggcttgccctttttgtgttcaattctctctcagttgttaagtgaagacccaatccagttgttaaaataataaatgcacctcttgcctccctgacattctggcaaccttactctgaggaggctggcccggttcgaagctggctgctccagggcactaaagctggagaagggcccttccaccctgttcataactgtggacagtaaactgtatttgggatagaggatcttgggaacaataaggacctagatccaagctcatgcattgtggtgggactgtcaatttagggggatgggtagattttatcagatctgtcagtggaaagtttggggagatggaatagtatctacaggtagttccaggtaggaggaagagatctacctggctcctagggatgtccatcctggcaagcattgctcagtggcaggagttgtaagagtagggaaggtttaggaatttggatatcagggaagtgtcagcaggtagctggggatgaggtgcaggacaaagacagacgagaggaagaccaagccttaaagtgatgagtatctagatagggaagaggatggatgggtatagcttggacacagaaaggggattcagtcatggaaagaggtcagtctgcaatgtaatgtggctatcaggtcacaggagggccaagagcaggacaggtttggggcttggttctggttagtcgaggcagagccccttagaggtgtttggatttgccatggtgatgcaggggacctgagtgtgctggttgtcatgagatcttgttgctgggagaacagtcaagaacagggtagaaaggcccttccccagctttagtgtgccttggagcaggcagctttgaatagggccagcttcttcagagagagctgccagaatgtcagagaggcgagaggtgcatttgttattttaacaattggattgggtcttcactgggagctctacaaagaaaccaaattagtgaagttagattgcctatcccaccaacaatggatgtttatggtatgagtttagctctgtgctagagaatctcaatatatttagatttgggcttgagagagagaacttcagtgtgatctgagactgaacttccattcacattcattcctcgaggaagcatgttgaggatctatgtgtaatatactggtgttccatttacttgaaatatcctggcttgctctattcctctcacttaggcactcactcctctaaaaaataaatgtgtatatgtgtatgtgcatgtgtgtgtacatgtaggtgtaagtgtgcataaaatatggaatagactgaaatcaacaaacttataaaaataccaaataacctcaatctgtaattttatttttgagaagcactaaaaatgtcaataaatgaattgtctgaaaaactaatcctttggctggtgagataagtctgagttgccagaaccagttaaagctttatataatttggcagtacatttgcgttcacctgagatttctctgcctccagctgtacaaaaattctgtgatatgcagagcctcgaaacctgggccagaatgctaaaactaattttctttcgtaatctgagccgtaattgcattttaactcagttctagtgtgaagactgcttttgtatgtgtgtgtgtttacttcatgtcattaatttctggcatttaagttagtgcctggcacatagtctaccctcagtaaatgttagttcttactgccgagtctactgttctttccttctaaaccagtggggtagatgcttcctttgtgcctcagtggttcattcccttgccctcttcccctctcctcacccttgagttgttagatcctggttttgccccaggcaggtgccaaccccgaggaactcctgaccctgtggtgatgcatgcctgcatgtgtgcagccagctgggcagcttggaaagccatagtattgacttgccaaataaggactagtttacaaaagtcataagagatcactgtcatcaactgctatcactatctattatcctttctctttccaaaacacaatttaggtgcataataaaaacatctgtagaattactctgtcaagcctatgtatgcccatcagttgtgcaagagcctcagttcctacttctaatgaattttatactgattatcccagacctttctgccagctccctaatagcagaggagagaatacactgttggagtcaggggcaaccaaagcagctagtctgagtatagaatttctttgaattctcatctttaagaaccatgctcagctgggcacagtggttcatgactgtaatcctagcacttcgggaggccaaggtgggaggatagtaatggcctggtgtggtggctcatttccataatcccagcactttgggaggccaaggtaagcagattgctggagtccaggagttcaagaccagcctgggcaacacagggagaccccccatctctacaaaaaaacaaaaaagtagccaggtgtgatggcacttgcctgtagtcccagctatttgcagagggctgaggcgggaggatcacttgagcctgggaggttgaggctgcaatgagctgtgattgtgccactgctctgtagcctcgaggacagcgtgaccctgtctaaaaaaaaatggatgatatatccacatgattcagaattgaagaggtacaaaacaataaccaataaactctttctccccactgtgtcctagccaccttgttttcttccctggaggcatccagaagccaattttgttagtttcaacttctggagatggcttatgaaaatataagtaaatgcatctatattcaaccccattttagaagaaatgatacctactatatcagctgctttctgtgcaccttgctttttttctttttcacactttagcatgatgatttttctgtattggcacataaagagcttcttctttgttagttggtggttcttatggcagacaactgaatccaccctagatggttaagccaaaaagggattcggattttaggtaactcatggaatcctttggagggctggaggaacaggctagcatccgggtgcccagaaacaaagccccaagacacacgtagtactagcattaagtggaagccacctgtgctgctgcctccactgaacagcagatgctaggtatttgacttgactgcaactgcctctacctccactcctgcaccgggaaggcaacctagcagtgacacctgcaaaagtagaagctctgagcagagcctctttccttacatttctcacttctaaagcaaaatctggtgtggatgtatctgattagtggtgactaggtgacacatttgcatcttagcttcaatagagtctaggaattttattctcaacttttaaacttggaggtgggacttgtaataggtgaaatttttgcaaatagagaaataattttcaaagtatgatggacagtcacagatatggcaaatgtccactagagctgcttagaattccattgtatggatcaaccacaattgattaaactaatatcttagatggtagacctctaagtgttttctagttttctagtctgtgacttaggcaatactgtattaatgaccatatacatgtgtcattttgctaatgtaaaatggaatataaatttctagcagtggaattgctagatcaaaaggtaaattgtaattcttgtggatattgccaaatggtttctggatgctatactgattttttgcttccactagtgatgttcctgattttttttttttttttttttttttgcacagagtcttttccttttttagattccttctgagccagagtggcaggctgagtgttccctgctactggggtgagttttgggccttgggccaagaatgctgacaaatcagatctgggccataacctatgccaatatagactgtatttagcatctggactggatttggcttatagtttattgtagtccttctagccctaaattaaatggcatcttggggtatctaaaagataatgttgcttccaaaattgatttgcaatgtgggagtagcttacatcttggattgttatgtgttcacaaatgcataaagatgttttcaaagaatggttctaaagaattataataccttttctttttaaaaaagcaaaatcttggccgggcacggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaaatcttatttctagtgtgtgaactattgcatagattttgccaatatctgaactatggcatccaattgctctggttggttgccatgaaagtttatagtaacataggaagctcctgtttgaaagctcctgaaaaatttaaacaaatgtatataaatgggtgaaaaatgggggctgaggaagaaggtgaatacatgtgttttcttctcatggaagtgttcactattttttattaaattttttttagagacagggtctcactatgtttctcaggctggtctcggactcctgggcccaagtgatcctcttgtctcagccttccaagtagctgggactacaggcacgggcctccacatctggctgtgtttgcagtctttaagttggcatttacctagtgcagttgattatttcaagaaaatacactttctacatggctactgagggtatctgaaaggatataaagtatagcccagggaagtagcatgttgttaggcaggggttagtaactctttctggaaagggtcagttggtattttaggctttgcaggccaagaaacagaatcaaagatattacataggtaattctataacaagagaaaaaataaacttctacaagctttttattgacaaaattcaaaacataataactgaggacttttttttttggtaatacaggtctactcataagaagaacagcattcttactttggggataacattttgcttaatgggattcaaagaatagtgttccctttcatcaaatcgattgcaaatgttcatctgtaaataccatttattttctccttgtgggccatagaaaaccaagcagtgggctggatttgacccatgagcggtagttttccaaccactgatgtaatggaaagaccatgagctttggacctggatgcatgtaggtttgagtactggctctgaatttgtgaccttgaacatatcacttaactttctgaattgggaaggtttatttgtgtataaactgagtgtaatgacacctatctcatggaaaaaatattacccccatctttgtgattttgcattagtattctagttctgtagatgctgatatgatttagctagacttacctagaaaattagtatttaactgattttaaagctgacttttcaagggatagaacactcacatggtcttaaagtacaatgtaaaaacatagctttgcaatgaagagatctggcagtcaccacattaatcaaatgaccaagctttgcaatcagtaccaatggtgggatgttctgacattgtgtgcccctcactgctgtgtacctctcactatatctcagtatcacctgtgtggtgttcttgccagaaacttttgactttaatgtaatcacaataaaacagacaaatccaaaacatgggatgttctgaggacaactggcctggattcttaaatgattcagtgtcattaagaaccaagggggattgttctagattagggggagactaagggaaaatgagataaaaatgcagtgcatgaacattgactaaatcctggatgaggaaaagaaaattcagctctgtaggcattttctggataatcaagggaatgtgaatgtggaccatatgttgtatgttagtccattttcacgctgctgataaaggcatatccgagactgggaagaaaaagaggtttaattggacttacagttccacatgcctggggaagcctcagaatcatggcaggaggcaaaaggcacttcttacatggtggtggcaggagaaaaatgaggaagaagcaaaggcagaaacgcctgataaacccaccagatctcatgagacttgttcaccatcacaagaatagcatgggaaagaccgatccccgtgattcaattacctccccctaattgttcaagtccctcccacacacgtgggaattctgggagatacaattcaagttgagatttgggtgaggacacagccaaaccatatcatgttgtatgataatattgtgttaaagttgatttccttgggtgtggtgatgatggtgcggtggtgtacgaaaatatccctgttcttagaaggtgaatagtaaagtacttaggggtggtgtgtcatgaggtgtgtctgtaacccacttttcagatggtttggcaaaatgggagggaaggagggagggagagagagaatgtgtgtgagtttgtgtgtatgtagaataggtgattctgtgcattgctgctcagttcttagcatagcactcagcacattgcttttgatagggaggtgcccaaccaaaacttgttaaactaacaagtactttaaggttttagtaggattctctgaaatcacacctcagcactgcctgtctgccctctctttagcagtgtcatttggcttaggcatatactataatgcctaatgttgggtaatcagatatgggggttcatgttttcttgagtagctcacccatgtccctctggactgaaagtctctcttgaatgttacagtataaatgaatgggaaaggaaaacccagcatagaggttgacctgcgtgttcagctgttccctgagaggctgaggtacaatttgtaagcatgtacttcagattctcttctgtatttctgttgctgagtttgcccacttggggagggttgacacctcctggggctgtgctgagtaggaggtgcatctctggagttctgactggctggagcatcactgaggtattctcctgggctatgagggctagggccaggataaagaatggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatatagcaggcatagtaaagtatgagtcctgggggatacaaataataagaatataccctcgctttctgctgggcacttagggcatagggaaaggagatgggctacagtggagataattatcaaaataccaattgtgctgtgttgcaaggctagggatgtgttagaaagctagtaaaaagtgttatgggaatgcagagaacatgccatgtggaattgactacagtttcaaagataaggttggtcttgaggtgacttgaagaatgagcctggcaggcaaagaaatgggcatctggtgtgactaaagtcttaattagctgtagggtggggaggagagagacatgacgatgttggaaaggtagtttgggccagacaggagggcctcagaagccatgcttggtttcacaggaagggcgtgaagagtcccagaagccctttgaagttggagggtgatgtggttttgataagaggtcacggagggaatgtagaagctggtgtgtgaaggtgtgtgagtctggagacaggacttgaaacagtcgaggcgagagcaaagaatctggattttgctagctgcagcagagggagagtagaaaatggggtgctcttggagaattcttccagcccctcctactaggagtttttacattttcaaatctttctaaggaaacctttaataatacttgagagaagcttatttaaacctttgaacagttctgaaaatgtattacatttcagccaggaaagaaagtattatttcaggcaaactggaacatggttactcagcacagtcgcctaatcttatagaattaggtaggagggaagctatgttagtggccttcaaccttcttccagaactttgttcagatttctcccaaatggtcggtgaatttttctgatttgtatccagcatcccagccatttagtgtacatccgtaagctgtaaggaagttgatttaatctatttctttttttcatctcttgccttccacctgagaaaacactactccataggttcttattctgtattaggaatttgcacaatgtgtaacctaagatggatccagctgggagttggatccagctgggagtgttacaggtttggagtttagactaaagaagaggagtggaatcttttcatttttttcccctttattttgaggaaagcccagtgatttggattgtttgaaggatcaattatatcaaatatctccactaattgagtatctgggataaactttttttttcaccttattttctttagataccattaagcatttcgacccacaacttacagcttttccatggagattttaaacttagaaaactttgaaccttgatgaatgaaaaaaacctttcagaactaacctttttttttttttttttgattcagaagtccatgtgtaagttccaaaggcttataattcttttctcttccttgaggcttgactatttcagaacgttcttggtatgtctcttggaggtttggtgtacaaagagcaaggaaagtaacctatgggcttaactcacttatgtgtatatattctactttggctccaaagcaatgattctagtggtgatatgggaccaagggacagatttcaaggtaaataaggctgtttactaatgtcagattaaggtattagtcttcaagtaccataaatgttttactagcaatttcagttacctgtagtaaagagctttccagttccatgtggtagttatggtaaaggagcaactgaaagttaacttgatagtagattaacactcactgaaaatatagttgttattttttcacataccaaggattacaatgtctttttttttttctatttttaaaatagagacagggtcttgctatgttgcccatagtcttgaactcttggcctcaagcgatcttccttgaggcctcccaaagtgctgaggttataggcatgagccattgtgcccggcctacaatttcttaatattaggagttattttgcaagacaactatctcaatgttggaactacactaatgttggtgtgtttttttccttgtgtgggatagtctgtatcttaagatgtgtaatgtatatattcacaataagggctacattataaaattcagagacattttatttttgaggtaggtttcattcacttaattgagaatttgttgactgtatcttgggtgcctatccttatgctaggagatgaatggaagttgccccctgccattgaagagaagacattttaatgggaggcagagataaacagataattaattataatgtgatacatttggaaatagtcacaaaaaacttgaatatggagattttcaaaagtacaaagaataggatattgaaccctcatgaacccactaccaaacttcaacaattactaactcttggttatgcttgtttcacccatgtgccccacctcctcccttcccccttttattttgaagcaagtctaagacactgtatcatgtgatggacattaatagatacttggatagagtactctgagaatacactgggaaaacatactgtatcgggacagggaaaggagctacagaaaagtaacatttgagttcaatctaggtggggaggaggatgttgttccaggtgatgggatggaaactgacaattattacaatgtcttgaaaaatgtgtatatacaacttttttgttcctctgaactgagcacccaagatgtaatttccaagattaggaaattgttttgcctgaggactttataaaaataattaattcacttttaatttagataaactagaataatccatgagtagtggtaatgactaatctgttctcttttcaccccagtgactttctagactttgaacattagaatccactccctgaaaaagtcactctcctttgtaactagagcaacagctatcctttgtcacctttatttttctctttggaagaggaggaataatcagtggctcacttctgaaacatcatgaataggtagaatttagtaatctgaattaaaaacctccctgtaaactgaaggaagaggaaattgaccagtgggcacacagaggttctcaagggacttttttggttagccactaggtgaaatccttgatatttcatcatgtaccttgtctcattttcctgttgtgaaattgggtgttcagcattgtttttcttgtctgttctcagatcacagaactgtgtggtgcaaagcgggttggttattttggtccaacacagttttacattgccctgaaattaattgctgcagcacaatctggcctcccggtacggatagagagtattaaatgtggtgagtatctcacatttgtatgttttattgtccatggcgagtcgctcatttatgagaaccatttttaatgagtttaaacttttgtggaatttctccttgcttcctccaactcttctgcaaaataaaataagaaaacttggcaggtaggtagcttagtttctttcttttttaaatggggaaaattctgagagtaacctgagattagttcattttaactgatttgcagttaaaatagattttattctttagcaggaagagattgggccaggaattctagagcctgtggcaaataatcacattgactttaattttccacttgaggtatctataatgttattgaaggctctgttagaggagtaacaagggagtttgagtggaactatgccttttctctttcccatacctgccagtgctcagcctttaattcttagtttccaaagcactgttctgatgctagtaagtacttgggtgctaccaaaattttggcagaatgaatttatcttcttaaggttctgatttaatattttctcatcttgccatccctgccctcaacccactgtatgcttgagcactttctacaatttaaacaaaaagcaaaacccccaactattagcagtatttctgctgcctcaggattggttttaaaaatctgtatgaaaaaggtgattattcaaggggtgtgccaaggtcctctgataattcagtttgatacagattactttcatatgtccatacaggtatgtaggaactttttttctttttctcattctgagactaaaaacctcttaactgctcatgcctgtcctgtgaagtctctgatagacatacaagtggattcaggatttatggtgagcccatggaaacctcgtaggacaatccaaatggccgagaagattgccatagatggctggctgtggaagaccaagcccttcacactaaccgttagcaggtggcagtcatcatgctaatctttatcagggggctagcttgtgccagacactttcatttaatcctcatgacaccctactaaattaggtacttgtgtcagtttgattgcttaggataagctgcgataacaaatgtcacaatctcagtgcctcaaccagacagaggttcgttttccactttgcagtgggtcagggtgaccctccagggcagctgccctctatgtggtgaccatgtgatcctggctgctttatcttgtggcacctcccaacacaacacctgttcccataatcgccacaccagggaaagagtatctcaccctagcggttaaatgctttggcccagacatgactgaagttattgctgcccacactgcattggccagaacttgtcacattaatctgcttcagtgcagagcaggtgggagaacacaattctctcctgtgcctgcaaggagaggacaactgcgagtctctactatggctgcacactgcaagtctctactatggttatggctgcacactgcaggtctctactatggtgctgccgttgttcgtatcttacaagtatggaaatttgaactttagggaggttgagtaacttacctaagaatataaggttagtagaatttggagccaggatctacttccagtccccatgctcttaatttctatgcaaaatagccttgtctcaattttttctatttagtaagatgctgacagtaatctgttatacaatattttctgaatgggaaaaatattggacttgaaaggcatctcttggtatgacagaattttgttctttgaaataggtttcttgatggagtgtcatttgacaggcaggcttagtattcattgctgcaagacacagcggccatttgctttgattagttgaaagttgcatcacactgaatttggatttgtggtaggcactgatagtttttattccattgtaaatgatcattaagctttattatagtatcttccaattttatcttctggaaaagttagagctgctttattgtatacagaataaacttttgacacttttgttacttattttaagttagacctaagtcttttacctgatttgtgcccagattgacagtttaatttcctgagggcagggagcaggattgttgaagttatcacttgtgtaaaggattaacagtttatcacaaatataaggctttctcagttttattttataaacccagttgctgccttttacctctgagagtttatatatgtccagagttaattctgaattatcttccttcaccactctctactaatccatttaaagattgattaaataaaattatttgcagttagcatatgttgaataagaattagggcaagattgggccaaactttgagctgccacttagaattttccagtttgttgcttgaaatctattagcttaatgcttgatgacacaaatcttgaaggccaaagggatcactctgtgagaacctaatctgaaaggctgtgctagccctgtcacacccagggcatcatacccagggagttgtggatggatacccttatgtcatgaataacatgcacctgtgtgtatgtgcgtgaccctctaatccctagtccttcccatttcggtaaatgccaccaccatcctcagctgcacaagccagaaactcagcagccatcctggattcctccttttccctcactccttaatagaatccatcaaaagtcctagcaatgtggctccaatctcactccctgttgcctctatctctttgtccctgctagaccagacaaccttcatctacttacctggacaccacaatggattgacatcctagcccctcctctcttctctactgtgatctctcttttcccactggttttttgtttgtttgttttttgacagagactcgctctgtcacccaggctggagtgcagtggcacgatcacagctcactgcagccttgacttcctgggtgcaagggatcctccaacctcagcgccccgagtagctgggactacaggcatgcgccaccactccctactaatcctactaatttttgtattttttgtagagatggggttttgccatgttgcccaggctggtcttgaactactgagctcaagtgattggcctgcctcagcagcctcccaactttttttttttgagacagggcctcactctgtcacccaggctggagtgcagtggtgtgatcacggcttgttacagcctctgcttcccaggctcaaatgatcttcctgcgtagctgagactacaggcatacatcaccatgcctggctagtatatatgtctttttgtagagatgggggtcttgttatgtttcccaggctggtctcaaactgctgagctcaagtgactctcctgtgtcagcctcccaaagtgctgggattataggaatgagccaccatacccagcctcttttcctacttttgaaagtgtgatcttttcaaaatacacagcagattattccatcctcatcctttaaaccctccagtagtctgcttgttgtactttgtaaaacattcaaagtccctacactgatctgtaacaccctacacaatctagttcttgcctacttttccatcctcatctcaaatcttaaacccttgctcactacctgttccccagtctcagtggccttctagccatttctgggtgacttttcctgctgcaggccatatgtccattttatcttgcagtcttgggttcctagggatctgtttttcctttctgcttcccctggttggctccttcccaaccttcaggattcagagtctgtccctactatcctacctaaagtagttctgtcagattcattaattcatgaaggaaccagcatatggtaaaactggctcaagaaagtatagagagtcagatttatttatagtcatagaaagaaaggatgctggaatagaattgctaaattaggtataaagctaattaacgccctacggggtaatacaagtgcagcctggctattgtacttttttctaagatgaaagtatttgcattgccgtcagacaagaattacttgttagctaacagttttttccaagttaatatctaccctttcaggattatcaaatgcccaaccaagagtaaacagtaactcagagcagaagtccatatccctaggaagtgaggtgatccttgggtgggcctgctgggtaatgcttctgcagggcaatctcctccccactttgttctttcccagcatctgtttcctgatagcacttagcagagtttgcaaatattccttacaggtttcactattttttttgtctgtcttcctcacttgtccagtttgtgtaagggggagggaagaggatctgacaccccttgcattgtggggcattataggcactctgtgtgtattggttgaatgaatgaatgaagaggtgcatgtctacgcatgaggagggtgtcttaatcatctgccactctttaatctaaaacgattggaattcagattctcctggaactccagaggagtttttacagaagtcatctcagtctgcatatcatctttcttaggcactgattttcaaccttgtcggcacttgagaaccacctggagagctttaaatataaaataaaaaaatacagatgcctgggtccatctccagaaattctaatttcatatatctgcagtccggtctgagcatcagaatttttaacagctctccaggtgatttttgtatggagacatgtttaagaataaaagctgcatcaagcatttttaagagctttgcttaaactgtgtgtgtgtgtgtgtgtgtgtgtgtgtgtgtgtgtgtgtgtagttacagtagctgcatctgaactagggtgctgtacgacacagggcacatgatttaagggggcacttactctcagggcaagtgccgactctacatttacaccaccctgagagtgcgtgcctccttaaatgttggcactaggtatctctctagccccaccctcgtctgagttggggttaaacagatggcaaaacagctagggcagaaggaaagaaggtgaaaattaaggactggtagagaatttctgatgaggaaatcatgtggtgaacatttgccctgggacctgctgttacctttctttccagggtctgaagttgagcacgtgtgaggactgagggaaggttaggcagaacctagagtagggtttctcatcatttttgtgccaggagcccctttggcagtctgaagcctgtgggccctttctcagaattatgttttaaatgcaacaaagacataagattataatggaaaccaattatactgaaataatcactaaaatagttaaattgttatataacaacatacatgcttctaggcctggcacagtttctcatgcctgtaatcccagcactttgggaggccgaggtgggcggatcacttgaggccaggagttcgggaccagcccggcaaatgtggtgaaaccttgtctctactaagttcgagaccagcctggccagcatggtgaaaccttgtctctactaaaaatacaaaaattagccgggtgtagtggcacatgcctgtaatccctgctactcaggaggctgaggcaggagactagcttaaacccaggaggtggaggttgcagtgagtcgagattgtgccactgcactccagcctgggcaacagagtgagactatatctcaaaaaaaaaaaaaaaaaccaacccccaaaacatatatgcttctttattaatgcattaaataaagcatctaacagtgtttgaaataaccactactttttcaaattagtaatatgcataaacagtacttcaagatgttggcccggcatggtggctcatgcctgtaatcctagcactttgggaggccgaggagggtggatcacgaggtcaagagattgagaccatcctggccaacatggtgaaaccccgtctctactaaaatagaaaaaaattagctgggcgtggtgacacacacctgtagtcccagctactcaggaggctgaggcaggagaatcacttgaacccgggaggcggaggttgcagtgagccaagatcacgccattgcactctagcctgggcgacagagcgagatgccatctcaaaacaacaacaacaacaacaacaacaacaacaacaaacaaaaccctaatgtgataggtgacaaagttaccggtattgctagtgataatacagtggcttgttgcctacattcataatggaaagaaatgctaaatttcagttatagtagggaaaatgaagttgtaatttttttttttttcctaatcaaggtgacagaccccgtgatttcttttcactagtccctttgggagcctgtgaactctgatggtgcaatgacatgattcatgtagtctttggggctgtgttccccaaactggtttatggtctggttgcagtctggcacagtttagaattaggacaaaaggatgagttatttataaagctaaatgtattcaaatctaagattgggttttttttggttcctcttgttaagtgtcctttgtgaaactgctaatgggtaatagtttggggtaaaattcttgacgagataaaacattggcaactttatgttggctttcttcatttctttttttgttgttgttgggggagagatttttcctattttgtgaaatccccaaatttgtgagccactgttgtggtcacgattctactgccaagaagatactgaggcaaatcattgaattccctttgactcctcccttatctgcaaaacagttgttctccacctaggtgatttcgtccctttagggactttcggcaaggtgaggagacatttttggttgtcccagctgcggaaggggactgcctggcatctagccggtagaggccagggatgctgctcaacaccctacactgcagaggacaggaccccctcttccaacaacaacaaacttatctaatctaaaatgccagtaatgttgagactgagaaagccttctgtaaaataaggatcaagacttaggaactctaatcctgctgccttgcttcctgtgctctagttagtttttttgtttttttaatcatacaagaaaggtagaaggattttgcagcattgagtcctatttctgtggcttttgttttcaaagaagaattattttattcaaggaaaaataaaagcagttattctctggttgaattgagggtggggttccctgtgctttgcctatttgacaaaccctccctatctcttagggctaggagagaaatcttttgagtgtgacaaccagtttggtaattcatagaaaagacaggataggaagcccaagggtaaagaaagaagcccaggaggtaaggttgtagctggctctgtgtgtgtgtgtgtgtgtgtgtgtgtgtgtgtgtgtgtgtccacacagtgtctctgtattttgaacactaaatactatgttgggatgtctcattaagctaaggtcaactcatcctttctgactgacgtccaacccaatccccctttccttttttttcctcagtgttcctttgtcaatttcctttaccccctctcccagccctgctacagggacacagagctgctttggacaaagttcgcctatgcaggttcactgactgtacggctggacatttgtgttttctaggggtctgtccctctaccccatagcgctgtcattagctctattgttgctcctccccaaaggttctccccaaccttttgagctgtggattttcaccttatttgtaaaaatctttgttgtgggattctttgacaatctagtaaaagctctggatcttagcaggaaaatacacattgacattatgtaaaaaatgttgccttcaatgtcaggggtttctggacccctagagctggttcatggagcccagtgaagagcccttcttccagagaaatgcagtgtatgggatggatatagaggaggtaagttggaagatgcatagtggggaaattgaaggccaaagaggtaaaataaaagggatgctgcttgctagcagcagagcccagtggattgtggacctcctaactcactcctggggttctacccgtggtatggccaggaaattgaacttatccaccatcctcctctgccaaacatttacaagatcacccttcccattgtaacctccaccccgccatctagcgattacctacccatttcctaattgacaagaggtatttcagatcaatgggcagataggaggataataggagactagatagctttgattactcaggcctgggttgataagactggcctgatttttttttttgttttgttttttgttttcccccaaagtaacttcaggaaaatgtgtagggatggtttcactttggaattatagaacattattgtcataattctttgttaacgtataagtagctggtataagtgaataggtaacaaaaagcagtgggagagaagggagccagcagtcaggagtcaagaatttttgttacggtcttagctctgccactgtattgctgcatgactaaggcaagtcttgctctctctttcctgggcttatttcctcacctgcaaaatgcagacatttgagcaggttttctctagattattttctgaaatgccacagtttcatgctaaatgttcaaatctgtactagaaagaattttaatgttcaggatggtagtatagccttgtggctgggaatgtaggtcctagcaataggctacctcattatgaatctttccttcattaccttttatttgtgtggcctccggccagtttcttaatttctctgtttcaaatgactccctggaggaaaaggtataccaataacacctgccttatagacttgttgtaagcacaaaatcagggaatcccttatcaaacattgtagaaaagcatctacaactttgttatttaatatcgtagccacttgccatgtgtggctattgagcacttgaagtgtggcagtgtggctagtgtgactgagaaactgaatttttcattaaatgatttaaataaaaggttttaaacagtgtaaaatattttctgttaaatgcaaccttattgatttagtaggaccacttttcacttcaaccatcaaattctgtaagacaagggtcaacaacctttttctttttttttcttcttttttaaattttattttattattattatactttaagttttagggtacatgtgcacaacgtgcaggtttgttacatatgtatacatgtgccatgttggtgtgctgcacccattaactcgtcatttaacattaggtatttctcctaacactatccctccccccttcccccaccccacaacagtccccggtgtgtgatgttccccttcctgtgtccatgtgttctcattgttcaattcccacctatgagtgagaacatgcggtgtttggttttttgtccttgcaatagtttgcggagaatgatggtttccagcttcatccatgtccctacaaaggacatgaactcatcattttttatggctgcatagtattccatggtgtatatgtgccacattttcttaatccagtctatcattgtgggacatttgggttggttccaagtctttgctattgtgaatagtgccgcaataaacacacatgtgcatgtgtctttatagcagcatgatttataatcctttgggtatatacccagtaatgggatggctgggtcaaatggtatttctagttctagatccctgaggaatcgccacactgacttccacaatgattgaactagtttacagtcccaccaacagtgtaaaagtgttcctgtttctccacatcctctccagcatctgttgtttcctgactttttgatgatcgccattctaactggtgtgagatggtgtctctctgtggttttgatttgcatttctctgatggccagtgatgatgagcattttttcatgtgttttttgactgcgtaaatgtcttcttttgagaagtgtctgttcatatccttcgcccactttaaagggtcagatagactttgtgggcagtatgattttggtcacaactactcaaccctgttgtagtatgaaagtagccatggacagcatgtaatcagaggatcatggctgtgtgctaataaaactttatttatgaacactgaaatttgaatttttaattttttttattttttatttttgagacagagtctcactcttgtcacccaggctggagtgctgcagaggcacgatctcagctcactgccacctccaccttctgtgttcaagctattctcctgcttcagcctcctgagtagctgggactacaggcctgtgccaccacgcctggctaatttttgtattttagtagagatggggtttcaccatgttggtcaggctagtctcaaactcctgacctcgaatgatccacccatcttggtctcccaaagtgctgggattacaggtgtgagccactatgcctggcctgacatttgaatttaatataattttcacatcatgaaatatttttcttttttctttttttttttttttttttttgcaaatattcaaacattgtgcttgcgggatgtacagaaataggcagcagactggatttggttcttaggtatacacccaagataaataaattcatgtccatcaaaaaacatttataagaatttcacagcagctttatttacaatgggcccacactggaaacaacccaaatgtttatcacaggataatggattaaaattttcaatatattcttttagggtcttgctctgtcacctagactggagtgtaatggtgctgtttcagttcactgtaacctccaccttccaagctcaagccatcctcccacctcagcctcctgagtagctgggactataggtgtacaccaccatgcctggctaatttttgtattttttgtagagatggggttttgccatgttgcccacactggtctcgaacttctgagctcaagaaatctacctacctcggcctcccaaagtgctgggatcacaggtgtgagctactgctcctggctcaatatattcttaaaagtggattgctccatagcaatgaaaaagaatgaactatgtgtacaatacattgggtgattatcacagacaaaaaggtcgtaaaaaaagcttgtcacaagaacaaatactgtatgattcaatgtatgaagttccataatggcaaagataatctgcaagtatagaaattagtacagaggttgctcggtggaacaaagggaggggattactggaaatgaacatgaaggaaaattctgtatcttaatttgggaatttgggtgttggttacagggatatatatatatatatatgtatttgtcaaaattcttcaagtggaacacttacaattccctataaatcatcccaccatacagaatactctttacataatttaaaaagaaatcaattagttgcttacatttaacattgtaataataataaaatacagtaaaatacagatttctggccacaatggctcacattcccatgtagcaactatcaactagagctgtgctgtttcagtatggtagccagtagctgcatgtggctgttgagcacataaaatgtgacaagcacaaattgaggtatgcaaggagggtaaaatatacatgggagtttgaaggcttaatatgaaaaaaaatgtaaaatatttcattaatagtttttaatgttgattacatgttgaaatgataatattgggttaaattagattattaaaattttgccattaaaaatgttttgaaatggaaaatttttaattgtgataaaatacaaataacatttcccatcttaaccattttaaatgtataattcagtaatgtgtaaatatagtcacattgttgggtaactagtttctagaaccttttcacctcaccttacaaaatggaaactctgtattcattaaacaccttcccattttctttttcctacccagatcctggcaactgcctttttttttttttttttttttttgagtgcagtgacgtgatcatggcttactgctacctctgcctcccaggctcaagagattcttgtgcctcagcctcccgagtagctgggattacaggcgcatgcaccactacacccagctaatttttgtatttttagtagagatggggttttgtcatgttggccaggctagtcttgaactcctggcctcaagtgatctgcccacctcagcctcccaaagtgctgggattacaagtgtgagccactgcacctggcctgcccatctactttctggttctatgagtttggctactcttgatgcctcatataagtgaaaccacacagtacctgtctttttgtgaccagcttgtttcacttctttctttctttctttttttttttttttaatgtggctcacattcttttttggcagataacattgaaagactgtgaacagctgctgccattttgatggaacatgagttctctgcccagcaccctccactccatattgtctagctaatgaggctcaatgtcacttgccatttattattgcatttatgctgtttacattttttctaatggattgaggaaattgaggtatttttttttcttttttgagtgacagggtttcactgtcacccaggctggagtgcagtggcatgatgcagccttgaactctcagactcaagcgatcttcctgcctcagcctcctgagtagctgggactacaggcatatgccaccatgcccagctgattttttatttttatttttttaagagaaggggtcttactgtgttgtccaggctggtctcaaactgctgggctcaagtgatcctcccacctcggcctcccaaagtgctgggattacaggcatgagccaccactcccagcctaaagtattcctaatatatctgtatctctatcaaatatggaaaaacaaaggatttttctctcttgtagagggtcaagtgtttaaaaaggagcaggcataattttctttgtggaagggaaaaatagtcatttatgtttaatatacaaagcatttctgtgttcaaagaatgtaacctaagatgaaacaacaatgaagcaaattgtcatcttggatggccactctcattgtctcctcagaccctctaaacatttagtgtgaactcttactttgtttgctgtgtgtaattcaattcagtttgggagacaagattctaaccaatgactacaaatagaccttcttcttgacagacatcattgtatagcaggtactttattgattaattttttcaaagtttcactattaaattttgtgtatgtgtgactaggaaaaacattcagttgagtatggtgactcatgcctgtaatcccagcactttaggaggccaagacgggaggatcgcttgagctcaggaatttgagacctgtctgggcaatatagcaagaccccatctttacgaaaaataaaaaaagaaattagccagcatggtggcaagcacctggagtcccagctacttgggaggctgaggcaggaggatcagttgagtctgggagttcaaggctgcaatgagctatgttagtgccactgcacttcagtctgagagacagaccttgtctcaaaaaaacaaaaaccaaaaaaaacattcagactgaaaatttacaaactacttttacctttcactttttaaaagcttgcatcagtttaagggaaatggcaccttcatgaaagttttccatgataagaatattattatgtatggttatacttctgttaagtgagagttgcttggaaccacctgaccaaagaaagtatgagagaacttcagctgtattttgtcttttgctgtttggtggctgtctgggggagagaggtggttttctaggcacatagctctaaagaaatgccatagacagggtggaagaatgtgtgaagtgacaatgtcctagacaatatctgggagccctacttaagtcctaatataataattgatattcataattcagttagtgtattccattgttccttggaggtatctgttgaatgccagtaaggcactggtcagggagcttataaatactgagcatttatttcttttctccctcaagaagtacttggaagtagagtcatcctcttatgggtagatcagggtgcaaattattttatgtgatcttgtttcatctttttagatcctttttcctgactgagctggagcacatacctgagaccaaaaccatagagttagcttatatttgatttactaagaatctagagtttcttttctcttgcttttttgcttttgaagcccattcctgctttgagtgctggagagctgcccgagattgggaaacattaagattggttactctatttatgtctcttgggcccttggctgattgatcacacagggatttgtcatattgcctgcttcttttttttttttctggtacagaattttgctcttgttgcccaggctggagtgcaatggcatgatcttggctcactgcaacctccgcctcctgggtttaagcaattctcctgcctcagcctcctgagtagctgggattacaggcgcctgacgccacgcctggctaatttttggtatttttgtgtagagacggggttttaccatgttggccaggttagtttcgaactcctgacctcaggaggtccacccgcctccgcctcccaaagtgctggaattataggcgtaagtgagccactgcgcccggccgcctgctgctttgaatcaaatgtgaacatagcaactaaaagtaaacatcatgtggatgttagagaaccaggggccttctttgcctggggaactctaggatacttgcttgctgttgctaagatgttttctggccttagcacagcatcagtcattgaaagtgcagctgtgtttttggaatagagagctgatggaagtgcaaaggcacactgatgagtattatcctgaacaatggatacagatgcaaatcattatgcataatccataatgtccccatttttgtagggttttgtgctacgtgattgtgtgtgatttgatgtgctgagaactagaagtgtgccaaagtatcatttccgctttcagaatagttttgttagaattttgaaagatgagtaaatataccagaccgttgcttttcaactctttgtagcattttgagtggctaatggttttgacagaagaatgtggctgaatgatagattgattgctctgacttgatattgttttccttattccattatgaaaagacaaccagagattggatgtgaaaattccttaaagaattacataggatgagaaactgttctacccactaagtttgccataggaacaagggaccattctgtagagcactggtaaagtaccagcttgcctgcattcaaaccgtggctctgccacagatgagttgtgtgatcctggggacattacttagctcctttatgactgtttctacttttgcaatgagggggtggtaatgatagttttatcatacagagttgttgtgaggattaaatgagttaatatttgcaaatctttaatactgtgcctggcatatttaagcattatatgaattttacctgccaccatttgtcacttattattgtattatacagtgtcatatcctttttcttggttattgaaggatgaaatgggagatcagtcccaaatctgaatttattctgcgatttggcaacattgaaaaatgttaagccagaatactttggttaaaccatagcattttaaaaatcaggacgttattataggagtactcattgtatctaaatctaaatttatatttagtgctctggaatttttcctcaaaaatgattcatcgtttggccattgagttccccttttttgcagtttttaaattaagtctgactagagcttctctgatttctggtcccaaagaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggtaaacagtttgttcagatgtgttcatttgattctgaccatgaaaccgcatgtagcagggcctcgtatctactgttcagcttccagcaaatctcaccatctggaacccaattacagacttggaagtgagccagtaaagttttctcctagcaagaaagagagaccgacacatatgaatcaccaccacccacttaagggccctttagagcctactttaaagtagaattgtgtctaaaataaggctaccgatttaatacatttattgatttcactagctcagtggttttctaaatggattcttggaaatgtaacttccaggagtttttaataggttctcttctccaaaaagaagtctgtagaaaaggtttctcctattataataaatgtgtttggagaatgctgcttcatattcccttgttgagggaaggactaaatcctcagtcttggaaattcgtagtgcacattagcacggtaaaagccctgagaagttctgcagtgaagagacctggaaatgtgtgtttactaaacttctttcaccaggaaattctttcttggggaacatatttggaatactatcttgggaaatgctgccattacccatttagcaggtttggaaccagaacagggaggataggcttttaaaattagaccactaattgcaatggtcagatgatgattggtggagacaacagtataaaatctcagaagagtgggcagatccagaagaagtaaatagtctacacattggtgtaccctgcaggcatcaaggtatagctcatacttccagcaaagatactgaatcatgcagagaagtcaaattatgttcaacatagtgtcttctataaggtaaagaaatttattataggaacacttgaggctgggcacggtggctcacgcctgtaatcccagcactttgggaggccaaggcgggtggatcacaagaggtcaggagttcaagagcagcctggccaacatggcaaaaccctgtctctactagaaatacaaaaattagccgggcgtggtggcatgtgcctgtagtcccagctacttggaaggctgaggcaggagaatggcttgaatccgggaggcggagattgcagtgagccgagatcacatcactgcactccagcctgggccacagagcaagactgtgtctcaaaaaaaaaaaaaaaggaacactcgaatgaaaatgtttttaaaatgcaatgaatattaaatgattatgttggaaaactaacttctgtgacttaccctgtgatgttgtgtagatgaggtgttgctacagaagttttatatggatagttaggggaggtgtagcacatcctgttaaacaattccatgtactgtcactttcataattctgacacattttaaatcagttcttcagggatatatttaaaaaggaagaggtataggaattttcagtcaatattctttggcatattttcccaccagcatttggagaggaatgagggtccactgtcccacggtggttgatgccctgggaaatttccaggcccagtccctgattgtgtgaatgagaatacatcctttcacttcaggctgagtttatgcatgccccacccaatctatgggtgtgagctcatgctttagagcaaacatattttgctttttcttgaagaagagtatttgatcagtatttcagattacatatttctctttagactaagggagcctatatatatagtctgtgtgttgatagaaagcattgttttggctgggtgtagtggctcatgcctgtaatcccagcagttggggaggccgaagcaggaggattgcttgagcccaagaattcaagaccagcctgggcaacatagcaagacctcatttcaaaaaaaaaaaaaaaaaattagctgtgtgtggtggcgcatgcctgtagtagctactgggggtgctgaggtgggaggattgcttgagcccaggaagtcaaggctgcagtgagctatgatcacgccactgtgccccagcctgggtgacagagcgagaccctgtctcaaacaaacaaacaaacaaaaaaaagcactgttttcttggtacttgaatactccaaagttaccagtctactagtaaagttttttttttttttttttttttttaaagaggaaactcagcagcagataaggttgcttactttgcctagggttctacatcaggttcatatttgaattgagattcaaattgtagcttgttaagatttcatcttagtgtttgggagtaagctggttggaatggtttacctataatgaattgttttgcagtctctcattgttaaaaaaaaaaagctagcattttactttgacatggtaagctccaagaatattaagtattaagcatttagaaatatatattttaatattcacatttgctggaagacttgataagtataaatccaggaaataaatttattaatgaatgaaaatgaaatctatccacagagagatcacaattgggagcgggtatgaatgttatttcatgtgatcagtgtctttcattttccaaaggaaaatattattggaataaccaaaagtgtttcaggctggttttagtaatttaggtaactcagcactgatgagattttattctctgggagactttttgaatcctcagacactgctgtttaaccatgctgcatttttgagaaaacatttccccccatttgttaaaccagctgggtcaccagcagtagagttgcgttatgcttcctgactgcagctcagaacgccaggcttgagtgagcgcctctgaactctgatctggttctttgaagcaggaaacacagtctcccacgatgtcacccctcgcctcccctccttcttccccgcctcattaccagagggtgcccttgagccatggctacagcaaactgcggagcagcgcagaacagatgcatccaggtaagaggcgacctgggggccagctgtcccaggcagtgtcttagagactccttaatttaccaggcggtaacgcttcaagctgcttaatttcctgatttaattacccctgtctttggaaacatggctcaatttaattttatattctcaagcaaggtttttttttaaaaattgatttaaacatatttgagtaatgtttcatctcctgtcctagaaactagttcgtctttagacttgtaaacagctagatgatttaatctttcatatacagattttattgaatagaacataccatattaagggcttgtattttttttggaattgttattcctttctgtaagcacaccaaagatatttatatagtaactgctttaatgaaatttcttaagaaatataactgcaaaagcaaaagagttgatccaacctttgaagactgagcacgtaaatgaaaatatataggtcctgtgctttggaataaggataaaggaaatgctaggggtagcattttgctgaggggtatgtagcatgcacagttgtggggttgccttcttgctcacatttatgctctgctggcctcgttaggtggtaaaatacgttagttctgaggatgacttgcagagttggctgtttaggctgcagtgcctaaagcactggaaattcactgcagcatcttgtgcctcctggggttcagactcctagtttaagatatgaccaattaaaggtattctagaactggatatctgtaaacccccacccccccagttttgttttgtgggctgtggccccaaatgacccagtttctgcaggtttttactgcattaaaaatagtggtgacttttagagggacacagaaataaaactgcgcgctaggctgaataaagagaggctgtaatcttgcagagagaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatgtgagtataaaatctgtttggaaattaagtcctatgcacatgcaagatgatgttgctaatggatagtaacaaaaaaatcactgtcctgtaacttgaatatctcagtggggttagaaactaaatggagttgagaattcttcattttcctcttatagtttccctgatctgatttccctattttcaggagtgggttttttttttttttttcctatttctaatcttacttgggtttggaagttggtttttaattcacaggtgaaactttttgttctactgagtcagcctgtcagcaagttctacctttggtattccttagaaaacttttctgttcctcctccttaatgccccattccctcctcattccatacaaattgggcttccatttccccagtggtaaggaagcagcttgcttctctccatctttcttgactctcagcagcctgtgccaaagctgtccatgccttcatttcttttcatacttttttaaaagtgaggtaaaatatacatatgataaaatgtacccgttttatttgttcatttttgagacaggttctcactttgtcactcaggctggagtgcactggcgcgatcatggctcactgtagccttgatctcctaggtttaggtgatcctcccacctcagcctcctgagttggtgggattacagacatgtgccaccacaccgggctaattttctttttgtatttttttgtagagatgggatttcgccatgttgcccaggctggtctcgaacccctggactcaagcgatccgctctccttgtcctcccaaagtactgggattacaggtgtgagccacaatgcctggccatgcacatgttttaaatcttcaatttgagttttagcaaatggataggcccttgtagctaccactttgatcagtaattgaacatatccattatgccagagatgaccctctccggtcactccctgccccctaacgcaatcactgttctgattttcatcaccatcattagttttgcttcttctagaacttcatatgaatgaaaacacacagaatgactgactgtactcatatgtgtttgccatctttccttcagcataatggttgaaatttatctgtattgttgtatcagtagttcattcctttttattatttagtagtgggatatattgtgtgaatgcatcacagttcgacgatctgttctcctggtgctggacatttgagttgtttccagtgtttggctattatgaataaggatactatgaacattcatgtatgagtccttctgtgacatatgctgtcatttccctggctcctaggaatagagtcactcagttttagggtagttgtatatgaaactgccaaagagttctggtttgacactgaacttcagagtgatgaaatctttaggtttttttttttttttttttttttgtacacctccccttggagaaagatggtacttccagttcttattaaacctcttgtaaggggatcaaagaattatttgttttgcactgtattgcatgtttggggtttcatttgggaagaaagagagttgagtaatagctactttttaaccttctgaattcagatccaattaaggaaggagccagaagtcagacaattgatggcctgaatatcagctttattactgatatagctgatcagagcacatgtcttagatttgtgaccagatgggctttagacactcacctttccagtcacaggcaggcttggccatcccagatttcccacacaagtaggaagagaaaatctgcctctccaaaaaaggccccccatgcagctgagtcttcatccaagccctactgatgagataggtctgtctcttccaagggaaggcccttgtaggtgagggatagaagccaagggccagatggtggcctgttcccccatgtgtctcccctggaagtagaagtagaagctcttatgggaagcagaggcacgtgggattcacttcctaaggaaagctcatgactgctagcaccccaaccatgccacagttcactgtgtttcaaaccttttggcagagcgcaattggtattagtgatttaattcagtgctccatcaacacagaatgattttaaaaatcctacttctcagaagacaatggtggcctaccagctgagacttactttttaaaatttggattatgtgctctctatgtatgtatgttttgcagtttttatatctgtattcattcttagcaggttctgaaaatctacttgatgggttgccaggcaattgttttgctattttaatgtgtgttaatgtattgtaacattgtgttccagttactaggaagaaatacaaaaagcagatgtgagcccaagagtgatttatcattcttgatgtgctattgttgtaccttctttattttaaaaagagcaaactatgttaaacatgaggtcataacaggctgctctgctctctacctaattttatttgtaagtaagctacagaaataaaacattttacttatttatatattttcaaaaacttgaactattaacctatagagatgagaaagaatttcaacttgggtgataatttctgctttctgttggagctgcatactacctggttatgtttaactgtctccctgccatattggtaaggtcattattaagtcttctggaaataaaaggagtgaaaacatacattcatttttgtggcttaaaaagttattttaaaggcagcaaaattgttttttaaaagtttggttattgaatagtagaataataaatataaaatatatttattcattttcgtagtcttctctacatgattttacattctgtttgatttatttttcaaaaataatgttggttcttagtgttcaaaatgcacattagttttcttcttggggaagtggatgatcaatggaagacatttacttaggggggatatatagaatttacctcatatttagaatttgaacacttatgacacttttctagctattgttgctttctatcccaattgaagttctcactgttccaccttcacaatttattcctaatcataacccagtgtaaatatttttctgcttatcatgaattggttgaatgtctttagattgtttagtgaaattgtgccaaagagaatcaggggttgtcagtcctagatggccctatgagtattctgttgccagttctttcctgaaaagcagatgctgtatcagtttgaatgtgaagtcataatttttgaatggaatctttgcataccatactgactttcctttctgctgtttcagcaccttatgaagctaggcagccccttgtccagcccgagggatcctcatcagggggcccaggaaccaagccccttcggcatcaggcttcccttatccgggtaagtgatgatgcagggttatgccaatgggacagtagagtcaagctttgggcttcggggacatggctttttgatggaccctttttcattgcaaggaagatataaaactgatccttcatgcaaatattgcatgtcttgtttggttgcttgtataaattactaaatcttttctactgtgtatgtctctacgccttctcagtgtctctagaataaactaggctgcttcttgatctttagtatatctaaaatgtccctctgccttcacctatctaatcattagccaccactttcaggagagcttcactttttctaaagcagcccatcttgtctctgccttattctttattattactcatttaatgcatagttaactgttttccatttgttttgtgcctctaattacatggtaaacttttggaaggcagaagtagttctgtattctctctcagtgcctagaccaagagaacagttattgtacaatggcagcagctgctgtttccttatgtaataaatacaaaagaaatattatggcaaaagcttctggctataccacagcttagacaatttcagcttccctttctgcagtgttttcctttggataaagagctcttattttgttctctgtctgcagctgttgccttgtgtagtgtctctgggtcctgtgctggggaagttatattctcaaagaagggtgtgtgtgtgtgtgtgtgtgtgtgtgtgcacgcgcgggtgtgcaggtttactatttgacactaaagaggaagtggggcagtttgtataacatttcagtcatctaactcgggaataaggaacatttttgcacaggcacttctactcagaatagaagggtggtgtcagacactcccataaagatgtgggctgctaggttggaataggataaacaaagtctaaagaaggtcctggggttcatggaataccttctggggatggggcactgtgttagatgtggtgcagaacttgattttctaaggtgggactctgtgtacaaataatttcttaaagataataatttagccataggctattttttatatttaatgcttcctacaaccataagatctagttactgctgcttctaatagtataagtgagttgactgtggttgagagaggtcaaatagctggtttaaggtttcattcataactagtcagtgacagagccagaatttgaatccaggcctgtccaatgtcaaaacctgctcctttcattactttgtcctacattagagtcccatattacaagaaggctaggttctagagttgctacataaagaaacgttgggtgtagtaaaaaatactcttgaaaaatcccttattgataccacactggagaaccaatatgccatttgctcccagggccagtacagctcagttttatccccaagttggaaaacacatttgtttcttcagctgagctccagatgtagtagttggctgtgtttagagatcctgtggtacaaaaatatgtgcctttaaacacgagaatcacacccactgtggagtgaggtttacgttagaaaaggtatcagtaggactgggatttatccctaagctctccaaaatgtggctgtgtaggttcctacagagtgtgtcctgggaatacagaggccagatcctgaatggttaggatgatagtcaaactaccagtgcatactgagctttacagcagtgtgactgggctcactagaccctttctacctagcccctggctggcatgggcatggatgctcatttggattggcaccctgtggcttctcttctaatctccatgttcccttttctgctgacaaacatgcttcatgagcccttcactcaactaatatttagtgaacacctattaagtgccaggcactgtgttgagaatacaaaaatgaggtataacactaacagtttctgccctcatggagctactggagagatggtcattaaccaaaccaccacaaagtaaatgtataattatgatatgggatatcagtaggaattacactgtactttaaggatgaaaatgggcatggggtatgacctagccttgaggggcaggggctgatcaaagaaggcttctggtgggggagcaacattcgagttggaataagggtacatgggtgttatccaggtgacagggtgggagtgcgggagcaaggtgacaagatggagggaaccgcatatacaaagacatttcctatgggtttgccattttatgaacattatctctttcagtgcccacagctatcttatgaaataattagtgttgttatcccattttcagatgtcagaacctgaggtttagagaccttatttaatttgcccaagttcacagctaggaagtggcagggctggagttcaaacactggtcaaggttcctcagtctctggctcaggaaccagatagatggtggtgtcacctgttgagctaggaagccctagatgaaatactggcactggggaaagatcacaggttcagtgtttgatgtcaggaactgaggttttgagatagtccagagaagctgttgaagaactggtagattacatgggtctggagcttgggagagagcttaggctggacataggtatttggcagcaattggctatcagaaggtctcatggtatagtgcagaaaaaaccagacaggtgctcgcccaagtccagcaaaactctgtgtgaccttgggcaagttccttctcttttctgtaatacaaatgacttcgaatggatttaacagcccattgtaacaatcagcaacagtccgattctcttaatgtgtctgtggttttcatggctggtgtgtttttctttcctctgttcttaggtttccttcttatgcctgttaacttggtttggctggactccgtgttccagaaagcaaaatgccaacctggattagtcatgtagatgaggggatttgaagtgaaggttcttggtgataagggattaatgtttactgggcatggtgctaggcctaggctggggtgactaatccccctcatgttgtcacgttgatgtgccgatggcaaccttctttctcttctaactagttctctggccttgtattcaagttcttcctgcctgattacaagggggcatgtcctctgggtcctgggggaagcctttagggactcccagccagtgctgttgcaacccatggtgttggcattttagaggtgcttatgccaatccagtgcctaaacattggaatgatttgtctttttgcttactattttaggaatttcacttttgttcgggtgttggatttttttccctttgaaatttcagacactaagcatatcctatgttggtagatgattgatagtgctttgtaaagaaattataagacttattttctgcttcatctgttatcatatgtttagatgttgttttgtggtttgtttttcacaaattaccctcaacatctagatgatgtagtcatttgtaattttgctggcaaaagatttagaattgcacgctttattcctactgttctcagctgcctctgtttttgccagggtcatgagaaactttatgttaagccgttgtctttattgtctccttggcagctgtggacactgaccatcttctcgaaatgctctcatcatttggtgtccattatgcctgctctcctggttttcctcatgcttctatggctgcccctgcctcatttgtttcaatcctccttcctctgccctccccttgttatgctggagactgctgggcctacttctcactctacttactctttagatgtgtggatgctcatgaccacatagcaccatctgccagacatcttcactctaatgttccactgtcactttcagctgacatgtctttctcataaaatcagctttcactcttccactcctagctccacccacccatcagcacaggccagaatgctggtcattgtctttgacttctctttctctccttatgcctgttcagtccccaagtcctgaccataccacttttcaaatagcttgtgtctgtccatgcctctgtacttcttcgttcaggccattatccttttcactgattgtattgtattagcctctctcttgtttcttcttgcttccacccttgccttcttccaattcattattctcattgcacacaaaaacaatcttaaaaacacaaatctaatcatcctgctgacttgattgaagcctgtccctctctgcccatggctcttaacatgtcatccatgttgctgtctggccctcgcctacctcctcggccacagcagctcactgccgctttccctccactctctggccatttcccggatggtcagtgttctctgcgtgggagccttactcttcaccctcacttttgccttctttgttttctcctttgtctcaattcatctatgcttttttccccattaagaacgtgaaacgtaagtgttttctgatattttcttgtatatgcgatgtttcctttttttttcattcttaaaaagaaaaagatctattgcttgtcagctcatttatgtgtgcaactcagccagagggatgggcgtctgatcattattggtttcccatctcagaggcaaccagggttgcctgtttcttttgtatcattctaggaacattttacgcatgtacatgcaaatataggtattcatatatattaatatgtgtgtgtatgcactatatgtatttatatatttatttatttttttagacggagttttgctcttgttgcccaggctggagtacaatggcaccatcttggctcactgcaacctccacctcctgggtccaagcgattctcctgcctcagcctcccgagtagctgggattacaggcattctccaccatgcccagctaattttgtatttttattagagacggggtttctccatgttggtcaggctggtcttgaactcctgacctcaggtgatctgcccgcctcggactcccaaagtggtgcaatatatttttacctgaatttagggagacatgtttggcaaatgaatatattcttccagctagattgcactagaaaaaattatcttttatttaaaaccaaaacacattcacttttcaaaccctcaggatactgttgtgatgttttctttgctttttggagggatgaaagtaacagttttctagaacatattctcaacactcactactcttcttcagagatgaaaaaatgacaaacagaatttagatacctctattactctaccattcctcagggggcttagctatatttttggtgtaagttttctaatgatcaggtaggggaggggatgttaggcattgttagccagcaccatattcatctcgaagtgcataacttgaaaaatgtttatttaacttagttatctcctttcctcctcatctcagtttcttgccgtacctcctcccctagatataactgcaggtacttacggccagaagcaggtgatctccactccttgggtcctcttggaacccaagagaaaaggcaagtatatgaaagatgattaaagaaatgaatattcctgaggctctgtcagagtggtgttggcctgagtcaaaagataattgatagtcaccacaaataaattgttcattctaagagctttgatgaaaacagcaggaaatagcctttgggggaggctgatattgcaccgagagatcttcttgtggcatgaaagatattttatgggtagactggaccaggatgcaagcaggataaggagagcggaggagtgagaatgactgatggtttgggatgggattgagtgaggtgggttagagttgagtcatgagagagttggtcatctgagtttggaagaagagtgaagcaggtaaacaagcggggcatactgggtactgtcttggctactctggttgtctaacctaatactcagcccagggaattgacccacagagcaggtcaggcccgcccggattcttttggggttcaagaattatttaccaaggcattacttggtaagtaagtgttcatacgaacgtgtgtgagctctcaaacacacttgttcttcagagcaaatacagattttaaaaatatgtcaaacattcaacagatacaaaagggcacagtgaaaactgtccctaccatttccccgcacagccactcatcccaggggcaactgatatgacccatttattttgtatagtactatacaaaacatttatataatattgtatatgaatatcttttttatatacaagtgaaaataggtattatatataattacatgtaatatatgcaaaacacagttatgcttttttacacatatggtggcatactatacatctaacatgcatttagcactaacaataagctttattaacgttctatagcagcacataaagtacttcctcatctttttgttttttacagatgcatagtatttccttgtctgcgtcttgtgtaaatcatttagccagccccttttgattgacatcttgtacttgcaatcactgcgttgtttgcagatatatgggagaccaattcctagaaattgaattattgggtgaaaatgcctatatatttgtaatttttgataacgactttcaaattggaggtatagcagcctatgtacttgccaacaatatatgaaaatgtctgttttctcgtacctttgtgaaaacaatgtgctaacaaatttatgggtctttgccaatctgataggtgaaaaatgatagctcactgtagtttaattagcatatctctttattagtgaagtgaaatatcttaagtttatgagtcacttgtatttccttttctgtgaactgttgattcatatcaagtgcccctttttcttttgagtattggtttgtcattcttaatggcatgaaaccagaagctggtctgtcttttcctttggaccagagatatactggagtgtgtgtggaagatttctccctgagtggtgagaggagatgctggcacctgaggctctcgaaggaggttatggaccccagctgcttcccagttctggagaaccccaggcctgcctgcagtgcagatttcttgtttataaggtcatgacagtaaagttgaattacttagtttatgggtagagattagggctaaaaaaaaatcctctgttgttagagatggtaaatgtcaacactgtgtgtgtgcgttgatctctcagcattgcttagacagctaaattatgttcctttcactgaaatgggtgggaggaggagatagaggtagagataaagatagatagagggagagagtataagtgtgtgtgtgtgtgtgtgttaggaagagtgagtttgatgccttttctaggtatgtatgtgccttattcttgagatcttctttcaccaaattcattcctcgtttcatttgagaccccagctggacgtttataccatctcctaaggggtcaaaggttaacatgtcctccaggtgtcctacttcactgagtctactatagaacccacatatacctgaacggacactattgccacaaggaggtcctattttttcatagcctccagtctcctgcttacttattttcttcacctgcttgtagttctctttctgattttctagcccttaacttttgaggaaggatttctagctcttaacttttggggaaggaaacatttaatctcaactgatactgaagtttattttctcagtgccaatcttttctacttgtttcttttttcttttttccttttcttttcattgattgattgattgattgattgagatggagtctcgctctgttgcccaggctggagtgcagtggcgcgatcttggctgactacaacctctgcctcccaggctccagcaattctcctgcctcagcttcctgagtagctgggactacaggcgtgcgccactgcgcctggctattttttgtatatatttcttttagtagagacggggtttcaccatgttggccagggtggtcttgaactcctgacctcaagtgattcacccgccttggcctcccaaagtactaggattacaggcgtgagccaccatgcccggcctctacctgtttcttagtgtattcctcaggtgctcactgtgtaccacacttcttgacaataaaagagatgtttagttaatttagcctcccagaggtagctgaaaacactggtttgaactgctggttccaggcagtactttgtaaatctggaaaggatagtagcttattccccaggaccttttggtctcagttatatgccaggctatggatatggaagacttctttacaactggcaccattttagcccctgggcccatcagtctttcccttgatctcaggcgagcagggagtgtcatgcccccccagttgcctatcccaacaatagtcactactgactgaggtgcttctttggtcccagtgctgtgctggcccttttcagtcctcccaacaatctcacaaggtaggtattattacatcttccatttgtccatttggaaatacttaagtggcttccatgagtcagccaccatgccaggggtacactgaggagtacacctatagcctcttgctctctaggtgcttgcagtcaaaaggaggagatagatttgaatcaaatgatcccacctatgcatgtggaattaaaaactgacaattgccctaaaggccttaaaacatggtaccatgtagcaaaggaatccagcctatagctagaaagtgagagaaggctcctttaacaaagtatgtgttgagctgagctgtgaaggatgaatagaagttaaccaggctaaggaaggatggtcctgggaggtgaggagaggagtggagtgtttcctgtagaggtaagagcctctccaaaaccgcacagcagagctgggctgctgagagagctttgcttctgtcacaatcagaaagctacagcattgggaaactgctgccctagtgtcagctccaaccagatccacactacaaactaccttggcagccaaatgaaagctttgttccctgcctgtaacttgggtctgcatccgtcttccgtgggtgtatttgttgagtggaacctaagtcctatttggaattctagcagcaaaggtgttttgacagtggagtttttagctagccagcttgtgcagtgctgggacttatgctgacgggtggaatggactcgtgacccagtctctaccatatttcacagggagagcagatacatttgaagaactgaaagaaggcagctgtggctagagcctggagtgggagggagatgaggtcggagagggaggcagggccctgtgggctatgtgactgccttgcaggtgggagctgatggctcagaagttaatttactggttagtaagtgaccatgccaaattggaacccaagtctgtctgcctctggaacctgtactctttttgcacctccagtcagtagcctcattctccaaagcattcttgaattctgtccaagttgtggatgcatctgtttcccatctgaactcagactgccttgagtgtgaaggggagaacgtagtgaagagacaggcagccttggcctgaccagcaaggacaggggtgggaacgtcatcgcttcgttaatggaagtctgcagccttgtcagagtctcctcttactgctgatttctcatttttcttggctttctcctctaagcagagcacaaaatcctgataatagtgaaggaaaagtgcccttctggaacagcaaatcttggcccctgaggggagaattggaggcagtggttactaatgagcatttcttatgttaatcaaaatactgttagcgccacatactgcaatcacagtaaaatgattacatacctggattgtatggctagctctaggattcttttgtgatgacgtgccagatgcttacctgcaaaaattatgtgagaaataaaatggtgctctgtcagtatgatttaatagttcgccagccaaaatctaaaactaaactagatgatggggaggaaggtgtaatacagcatagtcatagctcaagcacagatcctcaatctgcaaaattgcagcaatgatttaggcattgcagtgaggttctttttgtaataaatgctctatttttacaggatggatgaacagatagagataactatagagcttgatgatcaagtgtacgtactttggacccagtttgtattctggctctaccatgtgccataggtgtgtggtcttggtaaattacttcccttacctaatcctcagtttcctgttctgcaaaatgggaattaccggatttacctcgcagggttgtgaagatgaaaattgattgtgtgcattaggtacttacagtgcctggcacttagcaaagcaatgaatgcttgttacctgacattcttctgtgtctaagtgatcgtttcaaaaagtatagcttattgtaataagcagcaactgtgtgttgcacattaggctcagagagattcctacagtttggcagtcagccttctgaactattgaaattagatccctaagtaagttaggtaatatgtggttaaaggcatctttgtgggtttatttccctgaagaaacagataaggttaaatttctctgttgggacttaattttaactaacttctctacagaaaaaccaaattatttattgcaacttcctgtgaatctataattattttgaaataaagactagaaagaaggagttttttaaaaagttctctgacttcagaggtaagggagagggctcagcctttatagtgttggatgacattatgtgataaatgcatataaagttcagcttcagtcagcttaagagaactcaggttaacctttctctgtctctagactgggattgagaattttttcgaatgtttgtttgtttactcattcagcaaataacttattgagtgttttgtatgtgttagtgacttttccaggcatttgggatatagcagtgatcaggatagacaaaattttctgtcctcctgggttttatgggatagcatggggtagggtgagaggcagagcataaacaagattgatcaagcataatttggaatcgtttcatgttaaaacaaaattgctaagctctgtctccttttctaggtccttttcttcatttctcattgaacactttccccacaattttacttgagctgtcttttctttttaactgggaatctccttcaaatccatggaagatgaacctatattactcaaacacagaaagactactataaaaatgaatcagcatcctggtcctatagattgtctgcatagataatcaaattagaatgagaaagttgtttgggctcataatggtctaatgtcattggtcagattgcaaaaccacaatagcttcaggcttccatctccaggatgggctttgtggttgtgaagggcagatcttcctttcctttgggtcttgcttgaaggatacattcattgagggaacagctgctataacaaataggccccacattttaatgactttgcacagtaggtatatttctcactaatataatagtttggcaggccgctgtcctcagcatggtgattcatgcaccagagctccttctgtcctgtcactgtgccatcgtctgttcagtgggcacataggaaagagagtagaggagtgctacagggtactagtcctgcttggaagtagggtaggccactggtgctcacattgcaatggctacaactcagtcacatggctgcatgtaacttcaagggaggctggaaaatgtcatttctggttgggcagccacttagtgacacctctacaccaggcatagtagagcatgaattattggaggagtctgctgtaatcccacctatcagcactgccaccacttgcttctgtgacttttttttctcagccccatgactgaccaatttccttgatctttctttagacaaattgatattcacttgggctatagtgtagtctcaccagcccattagctatccttttctttacagtagtcaagtcttctcacatctttgctaatgagatcgttttgatcagcaattgccttgtggtagtcttatttccaaaatatttttggcggaggaggcatcctcagatattcactgtgggcttagtatgagcttttgctactccaaatagtttgtttactaaggcactaacaggacactgttaaaagatcattacccctcataggtgaaatggctggactctaaaacagcatttataggatgccttcggggtaggtttatattttaaacagaaatgttctatgattgaaacaatacacacacccttcttaagttctctccaacaatgcttccttgcaattcatattatttagctttgtttgatttttaagatagtttgatagtaggggtaaatgttaccttttgggattttattaatagtattactttttaatgagtcttttgaagtctttcattataaacagcctgctttccccagagataataacttgccatgccaaatatttgcatttcacttgaaacaaaaccaaggggttgaatgttttaaatataagcaaatctaattctcctgtgtctagagaaactgtataatgaaccatatgtatgtggcttaagcagacagatgtgaaagatttctccctctctccttttatttaaaaaacaaaacactggcagagctcaaaattggcaccaagtagcaaacatctctgctcagccaacaaaaccactggagctggagttgatggggggaggcctctttagggtgcatgcaaaagtggagcttttcctggtcctggcttctacttggaaagctaaggctccacagcttatttgccctcatttctcagtgccttcaggcttcaaaatgagccattctcaggtgactgacttttcagatctttgagaagattgttgtggttgattgttggactggttcagaagacatgggtccacgcatctgggtcctgcggtgacatggcctctagctgctgacagagtggtgctgagctaccaaacagactcataggcttcctttcacaaagaacatcatagggcagtgtttccacatctcttgcaatacaagacatacctctgaacttcctcaagcttgccaataagtagagctcacactaccttttagtatctgtgatgtacctgccagggactataggtgggataaagtatctgatatggctcctgtccttcacattgaaacctgggtgaagatgtttaggaacactttaaatgttcaaactgtggtacttaccatgactatcataaagattcatatatatttttttgagacagggtcttgctctatcacccaggctggggttcagtggtacgatcatggctcactgcagccttgacctcctgcgctcaggtgactctcgcacctcagcctcctgagtagctggaactacaagtgcatgccaccatgcttggcagtttttaaatattttttgtagagatggggatttgccatgttgcccaggctggtctcaaactcctagagtcaagtggtctgcctgccttggcctcccaaagtgctgagattatgggtatgagccaacatgcccagccaagattcatattttttaagacgctcaaatcacttggcttagtaaatcaatttcaagcatacagcgagaagcaaggggaaagagatgggggggtaggttagcacacttagtgcaaaccagtagaagggccactctatgggttacacagaactcatgtgccctctccctttgtcctaaggcctttctaggtttaggagtaggaactctccttgcccacttaagttttcttggaagaggggttgggttctcatgggaatctaagaaatgagagccaaggaatggcccactggtctgtaggggtgggagttcttggctgttcatgcttgttctactgttaacaggccttgccctggttgtgttaagtttgctccactgtccacttatctttaggcttctgcagcctttcttgcccccccccccggctttgtgtcctttctgtacctacctcccagcttgtgctgatgcttggttctggcgccctcataactttaagtcccacctaccctttctctatactacagccccactgagcatctgtttagggtctactttctcttctcattggccttgatatttctcatccacattcccaagaatgagcatctgacctaagcccttgtcagagcatctcaaaggccagtatactgtgtgcccatgaacccttactcccactcaggtgacgccaggtgtgaggtgggtcatggtgcccacacaaggctgccaggcccacctttgcagcagagcatgggaacgagcagtgccgtctgtcatggccgtgggtacggcaggtacattggaggatttgagcaggggaagagtgttctgggaagaagacaaacatcttacccctgaggagtgagcatgtgcagtcggaaagcctgctgagaggaggctggggtgcgaggcttctgaaggccaggtggaggaggtggacttttctgttaggcagcaggtcatctctgcaggcttttaagcagaggagttaatcacccccttctgttcattcctgatttctgttgttagagtagacctgagacctgcctgctaagaggccactaatgccacgctggagtgaggtgatgtcaagaggagctagaaagcagatggttatggcattgaggaaagagcacacatgggctgacagggacagctaagcagcagcttcatgagcaggagggaaagggcgtgttctaggggagcagcagcttccatgtcagactcaggaatgcagcagacccaacatccagcttggagatttcttctctttttcttttttttcaatggaactgtattttcgcaaaatgttacagatcacttatagcaaacagaatggtgatggtcaaggaaactgactctgggctcctttttgaccgcagcagctatgtggaagcagctgcagctgtgataagggccgcccagcatggatatttctgtgtcttcgttcactgggaagtggagggacagagcttccgacccacatcccaccttcttcacgaatcatctttgccaccaaatcgttggctcataggtgtctgttcttgtctttcctgcccatgcctggcttttaggttcctttgctccagctctttctgtcagggctgacctggagggcagtgctcctgtgagttctccacattatatcatggccggtaatctaatccaattcaagctgacattctccaccctatgttctaccaatggaacctggtcagacatctgggctcattcaggaagtgctgctagggcatggctctggaatttggtgggagtattttggaaggttgtgtggtctgtttggttgtttagtgctcggactggattttgattttttttgctttacttatttttactgagacggagtttcgctcttgttgcccaggctggagtgcaatggcgcgatctcggctcgctgcaacgtccacctcccaggttcaagtgattctcctgcctcagcctcccgagtagctgggattacaggcgcctgccaccacacctggctaattttttgtatttttttagtagagacggggtttcaccatgttggctaggttggtcttgaactcctgacctcaggtgatccacccacctcagcctcccaaagttctgggattacacgtgtgaaccactgctctgggcctgtttatttttataataataagaggtttttgaaaaaaattcagatagatgcaacccagttaaaaaaaatcccggtatacaaaatcctgcctttgaataagagattaaaaaaagatggtcattatttgctgcctgcaggggttcactaagggatatgggtaagttcccttagctcggaaaaaggataataattaatacccgcttacatctccaaagtcttgaggtgctcaaacaagtaggagtgtgtgaaatgctttgtacatatcaaaacactctgtgaaatttaaggtattaactaatggataatgacttcttgaacatttaagagtggtttgatttacgtttagtagaaactcatctagtatgaaaatgatacatttattacaaatgattaacaaccctacagctctcaacctctttatgtaaccttccttctgactaaaggacccagatgactttgaggaatagcctgtttgctgggtgcattctcactcagcacttctggaagtatccattctacagttagtatttcatctcattgtcctggccttccgaaagcacccttaacccaaggtgtgagatatcaaagtaatacatattttacttcagagatgacatctcaaggttttacagtagctcaacattttctagtctcctttctctgaacattgtcagaggggagacaggcgttcctgggaagaattaattcctggaatggtgtgtgtgtgtgggtgtggggaatgggaggagatggccggccttcttttctagggttagtgggtggaattgcccgcccaatgattaattccctccttgacagtgtgttcagaagcaggcaccttgatggctctttagcagcaataccctcctcttctttcctagcctccttttgtcataaagcctcatcttttttatttatttttatttatttttttttttttgagacagagtctcactctgttgcccaggctggagtgcagtggtgcgacctctgctcccaggttcaacttctgcctcccaggttcaacctctgcctcccaggttcaagtgattctcttgccttagcctcccgagtagctgggattacaggcacgcaccaccatgcctagctaatttttgtatttttagtagagatggggtttcatcatgtcggccaggctggtcttgaactcctgacctcgtgatccacctgcctcggcctcccaaagtgctgggattacttgcgtgagccactgcacccggccaagcctcatccttctggtgttcacctcttggtcctgttaaggtggcccttggcaagtacctctttagtcttagggttcatgggagggatagaacaaaggcccacgcctccccctagcatcgacatttcccttcgtctgccaatgcctaccatagctttgttttctcccgcactgcttccctggttttctaggctcttaaatcctcaaatttgacttgcatgccctctagtggcaggtctgatgcaccccttgttaccctgtttattgtggtaccataacagctgttctcaccacccagctctgttactaaatattgtctgtaattcacaaatgccaaatgagaggttcagtggtcctgacttgccactcaagtaggagctggaaatgtgggatttgaattggagcttttgattcctggatttatacagcatttcagtgtaacggcaacagtaaaaaagatgtggttatagttgttctagtttcttttttgtcatttaaaaagaatccagattattttactatccactcagctaatctgaaagaatgaaaatgtgaggaatagtggaaaataagaatgatcatctttttttaaaccctttattacaattagaaatttttttgtcacttactgagtattcagtatttcatgcctcagtcctgttaactttgaagaatacaaaaaatacataaagcatgatgtctgcccctaagtttctgttctagttagattctagttatgaggcagttaaatttcttcacctgaggaaaaaaattaagcataacacatgataacttttattggtgtttaatttttctacttctcactaaagacaggttctctgagcatttactttttaatttattcttacagtccttttcagtggagagggaactacaggataacagcagttaccccgacgaaccctggaggataacagaagaacagcgcgagtactatgtcaatcagttccgatcccttcagccagacccaagctctttcatttcaggtaagaatgtgggctccctaggcatcactctcaccagaacatagccaccatcttgagaaatcattcacgcaaaatgagtatggcagccttctgtgatttcagtttgtttttcatctaaagtcgaatttcttatcagatgtaaaccatgcagaagaaaagttgccaatgacgtttggaaaattatatttccatttcaaagggcttaagtgggaatttgggggcaacttggcccagaccctgcaccttatcagctgaggcagttcttgaaatgctagcgtgtcgccccaaggggccacctctcattgcttcctcgttatattagagctcgggcaaggacagaatgtggcctcctaaggagttggtgtcacaagtctttttatgttatatgtgccttcaaacttcaaactcaggctcgttttctttggctcaaatgtttgtcctccagtttttctgagagaaattaaaatgggggaggaaaattggccagtgctttcccacttgtcagttcttctgggttgtcttcagatatatagattcctgttgagttctcatgtaaaattcaagctcagaggaactggtttaatgccagtgtggctacattttaccaggctgaaagactaacagtgaaatagtagagtctagaagaaaaattcataaagctttctttttagactttaaaatttgaagaataacaatatgtccttaataattgtaacctgccatattgaagtgtgggcaaagattagttttatcttgtgaaatgaggcacataattgaaatatacttgtataagtaattgcaaacatcatttactgattggtggtaatggctttattgacggcagaatagtacagatacaacaaattaatgttgacgtcatgattaaggaaaataagcagaaacccatattgcacgatttgaccacttgctaaccttaccccgtgctcaggtgagtttctttacgacatgtgcagatatttagccaaatacaaacaggtacttgttagaaatgtttttgttttcttttaacttttgtatcttgcagaatttcagatatagacacaactagtctggctgatacaacaaacctctgtgtacctatcacatagccccaatgattttctcttacctacagttaacacataaggttgtttcagtcagtcaatgatggcggtaccataacagtatcacggagctgaaaaattccagctccattaatcacctagtgatgctgtagccatcatgatgttgtagcacaaggcagtgctcacataaatgtgatgatgctggtaaaaacaaatctgtgctaccagtcgtataaaagcctagcacatatgattatgtacagtatataatacttaataataaatggctattattagcttattatgtatttattatgctatactttttttctttcttttcttttttgagatggagtcttgctctgtcgcccaggctggagtgcaatggcacgatcttggctcactgcagcctccgcctcccgggttcaaatgattcttctgcctcagcctcccgagtagctgggactacaggtgcatgccccacaccaggctaatttttgtatttttagtagagacggggtttcaccatgttggccaggctgctctcaaacccctgacctcgtgatccacccacctcagcctcccaaagtgctgggattgcaggcatgagccaccgcacctggccttttattatgctatacttttattgttattttagagtatactcttacttatatataaaaaaaagttaactgtaaaacagcctcaggcaggaacttcaggaggtattccagaagaaggcattgttatcctaggaggcggcagctacctgcaggttattgtcctcttctagtcacctccacagtatagaggtggaagacagtgttattgatggtcctgaccttgtgaaggtctaggctgataagtgtttgtgtttcagtttttaaccaaaaagtttatacgtgtttgtgtttcagtatttaaccaaaaagtttaaatggtaaaaaaattaaaaattttaaaaatagaataatagaataaagatataaagaaagaaaatatttttgtacagctgtgcaatttttttaaatttttaaatttttgtgggtacataggtgtatatatttatggggtacatgagatgttttgatacaggcacacaatatgaaataagcacatcatgaagaatggggtatccatttcctcaagcatttatctattaagttgaaaacaatttgactacactcttaagttattttaaaattgtacagtgtgtttttgttttaagccaagtgttattacaatggagtcaagaaggttaaaataaattttaaagtttatgaagtaaaaacttacactctaaggttaatttattattgatgaaaggatttttttttttggtaaatttagtgtagcctgagtgtgcagtatttataaagtctacagtagtgtacagtaatgtcctaggccttcacagtcactcaccactcactctctgacttacctagagcaacttccagtcctgcaagctccattcatggtaagggacctacaaaggtgaaccatttttcatcttttataccatatttttactctgccttttctatgtttcttctttctttcttcctttcttcctttctttctttctttctttctttctttctttctttctttctttctttctttcttttttttttttttttgacagggtcttactctgtgcctaggctggagtgcagtgatgtgatctcggctcactgcagccttgacctcctgggctcaagtgatcctcccacctcagcctccctagtagctgggactgcaggtgcacatcactatgccttgcctggctaatttttttgtagagaggaggtctcactatgttgcccaggctgttttctatatttagttgtgtttagatacacaaatagttactattgtgtcccaactgcctatagtattcagtacaggaacatgccgtacaggtttgtagcctaggagcaataggttctaccatctagcctaggtgtatagtaggctataccatctaggtttgtgtaagtacaccctgtgctgttcgcacaatgaggaaatcacctcatgatgcatttctcagaacgtatccctttttctagaaatggaatctcataatatgtggtcttttgtgtctctttcatttagcataatgttttagttttttttttaattaaaacatttgtgtgggtacataggtgtatatatttatggggtatgtgacatgttttgatgcagacatgcaatacataataatcacatcatggtaaatggggtatccatcccctcaagcatttatcctttgagttacaaacaatccagttacattctttaagttatttaaaatatacaattaagttattgactatagtcaccctattgtgctatcaagtagtaggtcttagtcattctttctaactagttttttgtacccattagcaatccccgcctcgcccctactctctccctgccactacccctcacagcctctggtaaccttccttctactctctgtgtccatgagttcaatcattttgatttttagatcccacaaatgagaacatgcgatgtttgtctttctgtgactggcttatttcacttaacataatgatctccagttccatccatgttgttgcaaatgattggatctcattatttttttttaatggctgaatagtaccccactgtgtatacataccacattttctttattcatctgtcaatggacacataggttgcctccaaatctcagctattgtaaacagtgctgcagcaaacataggagtgcacatatttctttgatacactgatttcctttcttttaggtatatacccagtagtgggattgctgggtcatatggtagctctaattgtagttttctgaggaacttccaaactgttctccatagtggttgtactaattcccaccaacagttagcataatgttttaaaggctcattcatgttgtatgtaccagaatttcattcctttttatggctgaataattccattatatcagtacatcccattttatttatccattcatcagttgataggcatatggtgttcttccacttttggagtattaagaataatgctgatttgaatatttgtgtaccagtttttatgtgaacatatatttttatttcttttgaatacatacctaggagtggaattgctagatcaaactgtactgggagctgaaagcattcaaattcaatctcagtaaggtctaacatttcaagaacagctgggtcttgcagttatgtaacatgtaaagtggaatgattgcctgatttcagttgatacaggtaaatcaacaatgaaggaagaaagattcctggataagtttctcaaaatgccactaggaattcttaaatctcaccaaaagctttcccaagatgtctgtcttatctctgtgtggtgtgatcaatggtattaattttcttctttttggtcagttttctattacttttctatttgaaatttctatttgaaatctgccaaatttgttcaaagttttgaacttcgtcttctaaatttttggaaaaattttgcagattttggtaaaaatgaagcagaaattaatttatgtgatttgcatctttcatgagcattatgttattgcttcttttgccctattgtaatttacatatttttaaaaaagctattcatgtgttgcttttggtcccatgattcataattgctttgaggaataaatatgtttgtggttatacagaagagattgctgaatgaaaaaattgtgattcatttgtatataaatgtaaaagctactctagctgagtaattaatggtttatttaaacaatggcacttgacaggttctgtggccaagaacttcttcaccaaatcaaagctttccattccagaactctcctatatatggtaagtacaattaatgccatatgacattcataccatcatccataactcatcctttagttcctacctttgcattttttaaaggcttatgttttgaatgatgtttttaacagactacaggagtgaatacaactcagatttttgttgctgtgaaaattaaatgttatatgaaaagtacaatgaacaatgtctggcacgtattaagcactatgagtgttaactattattttaaagtaatttcctaattattatccccatctcaatcccttttcagtctaggcagttgtgggcacatgagacttaccatcctgtagatttcattttcagacttttctgctaggtgtgatacaagtaaccagaggagcttgacaaactattttttatattttataaggctgagtgaacagaaggttgaggaatattttggagttaggttagatttgactattctagctgcctctgagctttgcaaatttggctggtgtttatcagttgggccctaattcagacttgcagctgtggtatccactgcacctttatgcactctggttccaaaagggctatgctgggatggtccagatggctctatttgcattcatgaaaatgcttggtgctgctgtaaactctcggctgtgtgtgggctagttcttccccaaaactgggcaggagatcgcactgctataaatatataattaaaaacattataatgtttatataaagctttttgcatgaggatttacagaattatgataggatttaaaattgcttgtcatgttttgtgcatcttattggaaaactactccaataatactcatgcatgtcaatgtatctgggattctgagctggatttaggttcttcaacaatatatactctggcataatttttttgtttttacaagccttatattagttttgtttttgttttgttttttgtttgtttgtttgtttttttggagatgagggctcactctgtcacccaggctggagtgcagtgacatgattatagctcattgcagcctctgactcctaagctcaagcgatcctcctacctcagcctcccagctagcttttcatttttttctagagacagggtcttgctatgttgaccagtctggtcttgaactccttgcctcaggcaatcctcctgccttggtttctgaaaactctgggattacaggcatgagccaccatgcccggcccttatattagattttctggctagggaagaataaagaaattatcattttgaaaagaataccatttgttttggcagaattcccagtctaaacattgttggcatgagacctcctatctttttgttgagacacgcctatgaaagctgaatggtattctttcgatctggcgtatgaagcagtttcctgacccctcactctggggaacagctatttcagggccccagtgcattcgaaattggaggaggaggatgtaaatggtctaaaggaaagttatggagcttaccttagaaatatattttctttcaaatagtaatacctttctagaataattttgtatttgtcttatctctatgcttgtcctaacacaagtacacttgtccctgtctacctaagagatggttaagcttatggggtcttagatataatactttggcaaataagtttcttttgtgctgagtaaataggtctgtgccttttagtgggaaataatgactgaagttaagcctgtttgagactccccctttcttcctttttgtcttatctggttccagtcagctttagttactagttttatcctaaaacataattcattccattttttattgagcttacttgtgttttcccaggagggagttctcaagcaaagaacagtttggtacaaaaatttacgtgacttgaaaagttcacggttttcctttaaagctgaaaaacaaagagcttatttctgtgctccaggtaaactgcataatggctaggacaactataaaatggctggggccacccttcctctgactgttttgaacaccatgtccagggcttttcaccccatgcagcctgcatttactgaatgactgtggacttctgggtatcatttttatttctgtgccatagtttcttgtcctatgtcctcagtgttgtaagacacaccaactagggaacctgaagaatttaaatttttatttataaaatgctactgatgctgatcccatcaatcggcatttttcttcctcggagtggcccccagagatttcaaatggatttggctaggagggtttgggtatctggtagggccatcaccacagagtctgggagttttattggcacgtttgggccaagtaacttgttctgtaagccccatggtaggtactcatgacatttgtttcatttagggagcttagtgatgctgactgtgatggagccctgaccctgcctgagttctgtgctgcgtttcatctcattgtggctcggaagaacggctacccattgcctgagggcctccctccaactctgcagccagaatacctgcaggcaggtaaggcctcaccatcaactgtaaaccttaagtacttttcctccaggctgtgtaaaaaacttttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaataaaaaataaaaaaacaaacaaacaaaaaaaaaaaacaaaaaaacttttgtttcttaaaatgatgtccagatactttggggagtccttggtatttacagttattgttctttaactgctattagactttcacatctcataatgtgaggaatagggctgatctgggtaagtgtgtattacctgtttttctcattctataccctctggatggatttgaaccaaagtcacttaccctttcatgacagttgtgaaataggcaagtactgaacctcccagctggtataaaatgaagaggaagatcctgtagagccaagtgttaacttggcatttttaggcacacccgagtgtctccgggtggccctgggcaatggagtggaatggaactcttatacctaatttaaaagtcaaaaaattagccgggcgcagtggctcatgcctgtaatcccagcactttgggaggccgaggcgggcggatcatgaggtcaggagatcgagaccatcctggctaacacggtgaaaccccatctctactaaaaaatacaaagaaaaaaattagccgggtgtggtggcgggtgcctgtagtcccagctactttggaggctgaggcaggagaatggcatgaacccgggaggcggagcttgcagtgagccgagatcgcgccactgcactccagcctgggagaaagagtgagactctgtctaaaaaaaaaaagtcaaaaaattacatgcagtgaaatgtgcaaagtgttgtcaccttaaatgtatgcttgatgaatttttgtatatgtatacacccatgtaactacaatcagatgaagatatagaatattctagcatatcagaaggttagaatagaactgttatatttctccttaataaaacagtctcgctcaaattattgttttggaccctttagatgggaaagagtcatggtgagtataacatatgtattaattcctttgggagagtagaaaaattaatagtgtgtcttgcccttttcaaaggcaaatgggcactggtctgatttccattattcatggaagtatagtgctcattgagaggccccagaaacagctggtgctttcaacaacctttctcactttttagggaagggctgttaaagaaatgagagcttagtcatgggtgattattagcaagagagagcagtgtctaaagaaactttaattacttattagtagagtatgaattttgtgattagatctgcaaaaggccttagattatcttgtctagccccttcctcatgatgacaccagattcaaagtggcaaatgtcttatctaagtttgtctcggggcctctgactctcttaaataaaaagtctgtcattttctgtgttaaatagtgagaggagaggaactcaaccaaagggcagaggccaagtttgtggctgctgctaagtgacaggtaaacatgttgggggaagagtgacccattctgggatcttcttcaaatgtcctcataaaatatgtgaaggggagagttcagagagcaaaacctactaatttctggacttggattttgctaacaatacctgctttctgcctattgcaggctgtaactctagcctgctgcccttccttagatgcttggaagactctcatgggtcccaggaattagcttgcaattgaggagcatgggaaactcctcttttctctttggtgtctttctgtctccatttcattctctccctcgtcttgtcttgtcttgtctttttcttttcttttcttttctttctgtttcttctgaatcagggcaaagaagcactggcattctgggggctatcttgacgcctacatggctctcattgccaaggcagtgcggggtcatagaggagccccttttcttgggattggagacacatggggcttttgtctctctctaaagggaattaatagctggcaaagggccaagttctgttctagggttatatttaataccttcgccgtgtcctctttcaagccctggagagagtcctgggtaacctcatctcccatacccacactgagttttctgtttgggggtcatgactagtactgttttattgttttgatgccatatggccatggaacctgtgggacatgccatgactccttatttgataagtcacttttgtaggtgtccaagtgtttcacagactatttcaaaagtcactgacataacggctgggtgtggtggctcacacctgtaatctcagcactttgggagtccaaggcaggtggatcactggaggtcaggagtttgagaccagcctggccaacatggtgaaaccccatgcactaaaaatacaaaaattaaacagatgtggtggcgcacacctgtagtcctagctactagggaggccaaggcaggagaatcacttgaacctgggaggcagaggttgcagtgagccaagattgtgccactgcactccagcctgggtgacagagctagactccttctcaaaaaaaaaaaaaaaaaaagtcactgacataatttttagacatctgaaagccctgagctaaaagtatgttaacaggaaagaagtaatctcttgattcctttcctactgccaatggcttcttttgacctgcttattcagtagaggggaatctataaaaaagagtgccaatgagccccatgtttcttcctggacttttatggagactgtcagcatgcatttatacaggaacaagggaagaatccatcatatacacttcaattaaacaaaaattgcacatcatttctagggcttgtgggattaatcttaaataataattatatagttctaacagaaaacatgaaagaacccataaaactctatcaaactcagtgacggtatattttaaaatgctttatcacctatgtttatcattgtatgaagcttaagaaaatggccagaaccacctaggtctcctctgtgctttttttgcttttctttgcaaaatatgagtgatcctattcatttttttgttcattttaatggcatctcatttagtgtttttcttttttctttctttctttctttttttttttttttgagacggagtcttgctctgttgcccaggctggagtgcagtggtgcaatctcggctcactgcaagctccacctcctgggttcatgccattctcctgcctcagcttccaaagtagctgggactacaggcacatgccaccatgcccggctaattttttgtatttttagtagagatggggcttcaccatgttagccaagatggtcttgatctcctgacctcatgatccacccgcctcggcctccgaaagtgctggacaacacgcccggcctagtgtttttttttttttttttaaagcttaactcttacctttttccaacttttttctaattgatctatattcagtctttaaaaaatctaatccagtttttgataagattggtgaagagtataaatttggttgatatcttcatgcattcataactagacaagcttgttttctaaaataataattttttttttgagatggagtctcgctctgtcacccagacttgagtgcagtggcatgatcttggctcactgcaatctctgcctcccgggttcaagcaattctcctgcctcagcctctcgagtagctggaactacaggtgcctgctaccatgcctgacagatttttgtattttagtagagacggggtttcaccatgttgaccaggctggtcctgaatttctggcctcaagtgatccacccacctcggcctcccaaagtgctgggattacaggcatgaaccacccaccacacctggcctgttttctaaaataatggaacaggaattgtatctgatgccattttacttgcaattatggaaatagtcccttttccctaatagtaaaacttcaaggacagagttgtattagttggtggcttacccgctagccttttgatagtttcatcaaaagtctccttttgatagtttcatcaagagtctccttttgatagtttcatcaagagtctccttttgatagtttcatcaaaagtctccttttgatagtttcagctgggtggggtggctcacgcctgtaatcccagcactctgggaagctgaggcaggaggatcaattgaggtcaggattttgagaccagcctgggcagcatggtgaaaccctgtctccaccaaaaaatacaaaaattagccaggtgcggtggcgtgcacctgtggtccccagctactcgggtggctgaggcaggagaattgcttgaacctgggaggcagaggttgcagtgagccgagattgcgtcactgcactccagcctgggtgacagagtgagattccatttcaaaaataaaataaaataaaaataaaaaaataaaaaaagtcaccttttgataggtgattgggtgggttctggtagaaatttttgccatagagtttgttaaaaaatacctatggagtacttactgcgtgagaggtaccacattgttcactgtggtcagaatgctgtatgacagagctcctactcccatgaacttgtgggcagttgatacgtgccatgaaggggaagtacaggtgcagcaagagggtgcatgatcttagggaagatttccttaaacgtttgggctgagatgtgaaggctgagctaaggactacataggtgaagaagagagaagcttaggttctgggaagggggaacagcaggtatgctggggaggctctgagagggggcttggagcataggaggagtgggaatttcaggccacagtggctggcgtgcacagaaccggggtagagaggctgggttgaagctgaggaagaaggtggggaacatatgacgggcaataatgtcaccttattttaggcagataagtgacacaatcagatttgctatgtgaaatgatcatgcaggttactgtccagagaacaggttttgaggggcacgggtagaaaccagaagactaagttgtggtagctggccagtcaggagcagcggggtgcttgcaatggggaggtgacagtgatatggagagatgtggacaccttggagagagatttagcaggtaattgacaaaattatagttttggaaagtgttagctttcttcacaggaagatccgctcatgataaagcatcagtcatataataccagtcagagccttgattgatagactagaaagagaaatcggtgaaattcagaccagagtaagcaaatgaacaaattaaggtgcttgtactcaactccatgtggtgctgatactcagaccagtacttccttacttacttactgtatgtatgtatgcatgtatgtatttatttaaattagatagacacgtaggtaggtaggtaggtagatacaaagacagatgaaacagggtctcactatgttgcccaggctggtctcaaactcctgggctcgagcaatcctcctgccttggcctcccaaagtgctgtcattacaggtgtgagccaccatgcctggccaatggccagtactttactgcagaaggatattggcatttcagtccctgatgggagtgggagggtggggaaggattaaaaacaatgccaatccacttttcacatttgattcaaatttttttaaaccttgcattacaattttatttcctaatagcttgttgtgacaaatttgatttgtagcttctgtttattatctgccacagtctgcttttcctctttggaatattgacaaattttctagctgttgagatatttctttcctaattactttgtgacaaagtagtgaagcagaatccgcttctaagacatagcctggtgtgaagtaattagcttaccaagtagcctgatctttcctcgtgtgaattcactcaactaccgaaataacagccagtgtcactattgcatattgaaagaaacccttaatgtgattctttttttctttgttgtaaatcagcaagaatttatgctcttatttttatcattcctgccaaccaaggagataaatatttcgtaaaatcatgttgggtgcacatcattataagatcttgcctatttctaacaatagttaaatgatgtatttccttagttaatgtccctatacattagaaactacactagtaacatagttaagacttacatattgtgatagtgatggttattgtggaaaattactatgctataacatgaagtgttcagagcacatacccttcagccagactgctgagagttcaagtccctgctcttccatttatcagctgtatgaccttgagtaagttgccctgttctcagtttcatcacatgtgaaatggggataatagaagtactgggttgtccatataaagaactgaaagtactacctcagcatgatgaatgccatatgtggtctatcagagctagctgattttgttgttatatttaacaagcacagaaaagctgatgggaaacactgattactatggctataggaaatattctgatatattctttttgtttcttcttagcttttcctaagcccaaatgggactgtcaattatttgattcttattctgagtcactgccggcaaatcaacaacctcgtgacttgaatcggatggaggtaaaagatcttcatatgctaataaataaggatgtgtatggagctaaatccattggcctatgttctttacaaattctggaaaatgaactttttttttgtttgaaaatgagcttttataacatttccttttcatacttggtaattattaatactttgatgctcagcctttcagatctagacaccagatgtatctataatttttttcccttttctccctaaaactggatgtggtaaagtaagtaacataatctctagaccttctagatgtgaaatgtagatatagccaaactaagacagaaaattctagccaagttatttactttaaccaagctttaattccctagtaaacaattttgattctatttttatcagttgggcattaataagctatactgaatcagaactgttttgagaagaggtttgagaactttatatgagggccccaaatcacattcggaactccctcagggtttttagcttttgaaccaaatgaggactgatttggatgatccccagaaggaacttggagaattcccccagtgttgggccatggatggaagggcttagccaagtgcttaggaagccttagctatggatcaataaataggagttgttatagttattgttgtcatcaccattgtcattatcatcatcatcaccattatgattactgtgatgacaatttaggatacctgcttttcccttccttaaaagatctggaaatgtttaataaatggagctttattcacagactccataatagtcagagactattagagtcctctgaccctagttgaaaccactgcaagatgatagaagtcaaagtcagggaacagggacatttctttaatttcttgtgactgtgcatgatgatttattctctcacatgaggccctcatgcctgtagcatgtgttatggatggcaccgtctgctcccctgtgagccagtcaagcctgcctttccagtgcccctctgactaacatctctctgccattttgcttctctttctttgagttgtgtcctccatggtactttcctcagatttctactcatgggaaaaagacataaagaaaagtcacttcaggaggaatgacagatgtgcatttgaagaattttggttaaaattttttttttctgcagaatgcttatgacaaagagagagataaaatagtttgccacttttcatggccctcagtttactttggggcttctagcagtgtttaaagagctttgtttatcaagccaggatggatacatctatggctctctgactatgtgtgtgtgtgtgtgtgatgggccccctgcttgcataaaatgatgaagttattagttggtcttctttaaaacggccataaaatctgttacacatgcacacgtctgttttactgttacacacacacacacacacacacacacacagtctctctcgcttgctctttctctctctctaatgtcctggatggcgttacatatattcacctttgtggattttatatgcagctagttttatatacttttgcatactttaagtggcctccttggggaggggagattaaaaactacctagtcttttttttttttttgccctatccaaagaagaaagcaaaacaacaacaaaaaatcccctcttttccaaccaaattgttatttttgaggatgctatggttttagacaatgaatgcagtaaacagaattcaaggacaaagtaatagggtttattgatggtttgttcatttaagaagtacgggtcagattgcaataatgattcaatatttcatgttcttctaaactattactgattgttctttctactagtcttttaatctatcatgaatgcatggagtttaattagattttggaaccagccctgtgatcgatgactccagtataggtggttgtgttctgaacaaagctgcagctgatttaggtctcacgtcatgagaaattggcttagtgatacatctttttctaaagacagcagagctgttagccatgtacttatttccattaagaattacagatgataatttcaagtatatttctttttatgagtgtctcttacattactggatttctttctttttctaaacagctttattgatagagactttacataccatacccatttaaagtatacaattcagtaatttttattatattaacagttgttccaccatctctacagtttaattttagaagaacatcatcagcccaaagagaaacccaatactcatgagcagtcacttcctattccactgtctctgccagcctctgataatcactagtctattttctgtctctagatttgcctattctggacatttcatataaatggaagcatatagtatgtagtgttttgtgaccgtattctttcacttagtataatgttttcaaggttcactcagatcataacatgtatcagtgcttcattcctttttaatgctgaataatattgcattgtatggatatgctacattttgtttgtccattcatcagttgatggacatttgcattgcttccacttttggctattgtaaataatgctgctatgaacatagatgtacaagtttttgtgtgggtgtgtgttttcggttctctcgagtgtatacctaggagtggagttgttggattgtatcataacttaactttctgaggaaccaccaaactgctttccaaagcaactatactattttacattcttccactagcagtgtatgagggttccaattttcccacatccttgttaacacttattgtctgcctttttgattttagacaccctagtggaatgaagtggtatctcattgtggttttgatttgagtttcctaatgattaatgacgttgagcatctttttgtgtgcttattagccatttgtatatcttctttcgccaagtgtctcgtcctttgtccattttaaaattgcattacttgtctattgaattgtaagtgttcttgtgcttttggcatcatatctaagaaaccattgcctaatattaaatcacgaagatgtacttccatgttttcttctaagagttttgtttgtttgtttttttgttttgttttgttttttgagacggaatctcgctctgtcaccaggccagagtgcagtggcgtgatctcagctcattgcaacctctgcctcccgggttcaagcaattctcctgcctcagcctcctgagtagctgggactacaggtgcgtgccaccaagcccagataatttttctatttttagtggagacggggtttcaccatgttggccaggatggtcttgatctcttgacattgtgatccacccacctcggcctcccatagtgctgggattacaggcgtgaaccactgagcctggcctcttctgagagttttatagttttagacctttacatttaggtgtgtgattttgagttaatttttgtgtatgttctgaggaagaggtccaactttatttttttgtatgtggatttctagtcgtcccagcaccatttattgaaaagatgtttttttccccattgaattgtcttgcacccttgttggaaatcaactgaccatagatgtaagggtttatttctgggttttcagttctattctattgatctatatgtttatgattatgccagtaccacagtgtcttgataattttagatttgtagtaagttttgaaatcaagaagtgtgaatcctttaacttttttcttctttttcaagaatattttgctattctgacttccttgcatttccatatgaaatttaggacaagcttgccaaattctgacaaagattgcattgaatttgtagatcagtttggagagtatggccaccttaccaatattaagtcttctaactcatgaacatgagatgtctttccatttatttagatatttaatttctttcaacaattttttgagatttctttttatctacattgcctacttctaaattatgttattctccaaaggggcctgatttataatgcaggtgggaaaagacaatgaaagaaatgcactgttatgatacattgtctgttctattggagatagtagactttgaatagaaaattatatctggatacttcgttttaatgagtaaatcccagcactatgtgaggccgaggtgggcagatcacgaggtcaggagattgagaccatcctggctaacacggtgaaaccctgtctttgttaaaaatacaaaaaattagccgggcgtggtggcatatgcctgtagtcccagctactcaggaggctgaggcaggagaatcacttgaacctgggaggtggaggttgcagtgagccaagattgtgccactgcactccagcctgggcaacagagcaggactccatctcaaaaaaaagaattacctgagtgaagactgttaaatcttagaccagttttctactgagtaatacttcagtctctttcttcagaacagtttaaaaacaaaagtattgcttatctctctggggttgtttaggttctgagaggtaaaccaattaactttttggaacaccagatggctccaggcatttactctccttccttcaagataaatgttacaatttatctttatttaatttgtgactatgttttaaatataaacaatatcaaaagacatatgttgacaagtcttcctcccatctaccaactcacctttcaattcttacatatctttccagagtttgtgtatataaataaagcaaatgtgaatatatattattcttgaacttaatcttataggcattagagtgcatattcttttccagctttgaggtataattgacaaaaaatatatatttatgatgttttcatctatgtatatattgtgaaatgattactgcaatcaagctagttaacatacctgtcacctctcacatagttacctttttttggtgtggtgagaacatttaacatcaactcccttagcagttttcaagtataccatacattgttattaactatagttagaatgtgtgttaaattgagaatttacaagaagtaaatttacagtaagtagattttaaacggtttaaaactaattcatacttgatagatttgggtattcatattagtgtgaggacttcccccctgtttgcattaggagaaaattttaatctgctcatcagtaaaattcttttatcccacaacaagaaggctggtttaatcaggtttagacaccatctgcatgacagatcttggcaaacacccacattgtggggccacttgtcagaacttctttgtgtttgtgaaaaaatacataaagaacaggtttgttcttggccaaatggaccagagttgctatgcaattctgtggctgaatcccagtctgaattcagatttaatacatgtgccttaatctgaatcatttttttcctctgtgtatgtaaaatttcaatacaaattaacatatacctcactaggaacctaaaaaaaataaggtagtattaaatgcagggtttactgcagatggaaatggtggcaagaaataatagcttttaagacattttcggctgggcgcggtggctcacgcctataatcttagcactttgggaggctgaggcgggtggatcacgaggtcaggagatggagaccatcctggctaacacagtgaaagcccttctctactaaaaaatacaaaaaattagccaggcgtggtggcgggtgcctgtagtcccagctactcgggaggctgaggcaggagaatggtgtgaacccgggaggtggagcttgcagtgagccgagatcgcgccactgcactccagcctgggcgacagtgcgagactctgtctcaaaaaaaaaaaattttttttcatcatatgtgcgcatcacttaatttctgttccaaccagtttaattcatttacttttctttttcaaagaagacatctgttaaagacatggctgaccttcctgtccctaaccaggatgtaactagtgatgacaaacaaggtaggagaagaatgagttttcttctttaaccagcgttctacctgttaccttatctactcctcttggaatggtggcttctagagcatatgagggtggttctcagcatgtaaacacatttggatagactaagtagttcaaatcattgtcataaaacaatagttcacaaagtggtagcaagagcttgagtgtccagagtcttccaactcattggccccttagtcattgctgaccctcagcctactcttaacaccttacactggaatctgatcgtagcaattaggaaatgacaggaagctgaacgaattgagaacatgttgtgtttgcggatgtgatcccagacatcagtgtaaatgcacatttgcatacagctctaatccatgaggaagttctcttctggacacagcttctgtccttagtgtttatctgtttcttggctttgtgagtgtgggagtgtgacatggagcccagctacaattttcctatcttactgggcagctgagaagcagtgcagcacagcattccgtgttagagctactcccagggaagagttggcttgggaatatctagaagtgtgggagggaccctctcccccacctcctatactttgtatagtgctttataatctaccaggtccttgctcatatactgtcttattcagtcctcacaaaactgaatggaggctggtaagttttatcacctgaaatttagagatgagtaaactgaaattcagacactatgaatcatttgcctagttattaagaaaaagatttgggacaagaaccaagattttttctaagcctcaagccagtattctgcctgttatttgatattgatttactacccatgaatgagaggcttatttgaagggactaaaaatcagtgaagctatttcaggttttattgttaaggcctgccattgattaggcattgtatgggggcttaacatgaaaaataagttttccattaagtgacagtaattgcatgttctctatttaaatacttgcttgggagagacaggtagaactggacattgtctgcagtagcgtgtactctgaccattctcctaactgcacagtggaataactgggcaaactgtaaaaatattgaagcctggatttcactcccagggattctcatgtcatcagtctgggtgtcaggaatgaaagagggagaaactcccaatacttcctggtaatacttctcctatctgcttgaggtgctgtctctggaaagttgaaaatacatctttgctctttgtagaaggagaacctatttccatactccaggaggtctttattgttttagtaaatgctatagcaacttttagaggtttgtgagacctgtttttgtaagtgatgactagcgattctttgtttgaatccaatttgcctcagaaataacattttatagttttaattttttttcctcttttctctttctttttgcttaaaaaacaaaacacaactagctttgaaaagtactatcaatgaagccttaccaaaggacgtgtctgaggatccaggtaggagaaaaccatttttgtatactttatatataattattttaaaataaaaaaacagcaagtcagtgagtagaagattgatacctctgtgatagtgtgtctgtttctctctatttatttgtcttgtattttattacaaggaaaccttttggctttttaccctttctctcttttcaggtatgagaacggggtgatatcttttcaagtttttaagtttcactgaaaggatcacgaaggatcactccgtgtgaatatagggtcttgttactaagtgcaaaattgagaaggcttgaggttgagatgatttcaacaagccattttgggttttgtgtagagtaaggaacttatagggtagatcaattggaggcccagagttggtattttccatttccaaagcagaaatctcaaatatttttattatgcttcaccaccaggaaggcaactatatgtgcttatatatggagtggattccaaggagaaaaataaaagttgtccagttttttggagagtcagacctgtgtctgtggagtcatggagaatggctgcccctgtgtccgcagctctctgttgatggagccatcattgaaccaagttgaatctagttaaaaacaaagtggctacagaagacattactatttggagctctagttataaggacatgaaaaaagttgttgctttctcttttgctgttttatttcttgtatatttttaataagtcaatcatgtttgttgtgataagctagctatcatcctaggcttatttgttgaacattggaacagaggaatcaatataatgttgaggcttatgctgtggtacaatattttccaaatgtcaagttcattcagagtttcaaagagagatgggtggagggagaggaaggagttgggggagtgggagaaaaatatggtagggggaaggagagagagagagaacatgagaatgagaataaatatgaatgaatgtggatgatgaatttcaattatggaagcctgagaaggtgtatttttaggcagctccccagttggttctggtacatagcctattttgggaaccaccagctctggaaggtgatgctacaaaatagaaaattaaggttatagatcaaccatgactccaaaagtgatgggaattcccaagcttaattttgactcttgaaacagatttgaattcattccttattgggtgaaatgctctgttaatgtaggccaacgcctggggtcagttctttctagctcttatttctggagctaaagtggatgcattccagtttttgtaaacttcatgttgtagtattagtaaaagctgtttaaatttggagtgttaaattggtgcttctccaacagcctttgaggatcataacttttcctacttttttttttttttttaagggattttagcacaagatcaagtgtcctctggggcatgagctttagatctcatttttaacattccttcattgactaggacatggcatcaccaaataaaacttgtcaggtgtgccacagcatgagaagtatgtcggaattgatttctcgttgtgcctggcagcatgctatgtgttttctgatttgttcttcccactactgcccctctctgggtatgagggagttcctcatcttaaacatagttaatccctccttttctgggaaatgtttggattcccagtgggagacacaagcgtttcaaggtggtgatttagaattctggatggctgtccttgccatgtggacctcagttcagttgctgctttttggagggttaatctctaggcctgctcctctttccattcccatttcctggaaagatgacatgccttgagtgttctaggaaggtggcagtccttttccctctttccagctacacgagaagctatgatccacttgttgtaattgctgagagtgtctatgttagtggagccttaagagattttttaaaccaatatcccattccaacctaattcagcagagcaccatgcacaatggtggtctttttcttgatgtttctggcccatgttgaggtgttttcagctggttcaccctcacagtgctgtctttagactgttgttggtgattctagcagctgctccattgccaactatcaccccatgtttttattggagtagagcagttctgtccttccattacctgctcctacctgcacctcctttgctgtcctagaagaaactaaatttagaaaccagatttccaggcttaaaaaattaggagcctttatttatgcactctacaatagtaatattttgcaattctaaagtacgttcagtttttaaattactttcaccttatctgtccctgtgagaaagaaactgcatttttattgcctttgttttctaggtgaggagactgaggttcagggaagtaacagctagttagtgtcatggccaggaggagggccttagtctcaggactcctggcctggtctctagtcctgtctctccactactcatccacaccctcaccccatctgtctgtctgtctatctcttaccagcagggctcacccctccttccacacccatccctaccagcaaaaagacaaagataatggcacttgacaaaggaattaacagtcaccatggtctgatttggggaacagtattttatcatggcggggacctctcctacccatgtatttcttgaaagcagtggggcctgagggagaagagggccacggagccagctgcaggcagcctgcgtagagggcttccccagctctgtggtgagtctggtccactctgtccacccagccccaaggcagcctcctgagctgggagagaggcttcctgaggtcgctttctttgctgcctggggtttgtaggagggagggaggtctttttctgtctatatccaggtgtgggtgcacgataatgggcaaaaggggactcaaactccttgggctttccaggctttcctgcactctggcagcgtttcagctgtttgaagttggaagatctctgtgttctcactacaacaagccaaaatgcttgggttgggagaagtgtatctcttgtgcagctgaccagtagtttgctttgtgccttgttagcatttatgaggattttcacctcccctctctgtcctgttatctaacccaaggattttaatgatcatcataaattcaggctgcttcataccaaggagggtttttatctttggagcaatgtaaaagaggatgagataatgcagtgagacattttctttttggaagaattcatgcagacaaagaaattacattcttcttgttctgtgttactagcaccttttctatgattttttatgacattttatgatgaaaaatttgcaatgtttgtaacacctgagcatagctactggttcctaaagttgtcttccatagaggattgaaagcataaaaagaggatcagtgtttttgtaaatgtttctaattactcctcacaacttgtgatggggaagaaggctgtatgggcgttggtagtgagcaagttagtttatgatttaaatttgatgaggaaaagtcatatggctgggaaaagattcagcgatattgttcataattctctgtatgatttggtcacagacatgtgggacacaaggatattttcttacaggagaagctgtatagctcatttccacttacttgtgagagctttgtttttttgtggccatgctgctctggtagtgtatttttttttttttaaaacgtgtagttagatagacttcttcctatccttcagggtagactagttcaaaatctattactagactatcatgatagaacaagaaaccctgaagtgtgaatccatcattatataaaaagacaaccccctttcaagggggttgtctttttatactggaatgtcttcattaattaacttggatttgagaatggcctctcaaatagtgcttgaccaaaggaaaaatatgctggtttttctttccttttaatcgtttctttagattttgaaataaaacaaggaaatcatgaaaatgtgggagccgtccagttctccacatgggcacttttacctcacatttacctgttgatgtgttctgtactagcccaggtgctgcatataaacttgtttaactgcagaaatgaaacccaagcaatatctttgtttcagcaactcccaaggattccaacagtctcaaagcaagaccaagatccaggtagtgttcgtttaatttctgctttaatgccctttgtgccgtgcccctgcctagaaataagaaccacaaaccaaaacccaacccatgatttcctcttcctttagatgtaaagcttaggatatgagccatttcgctcgtgcatggcctgatgggaacatgcagtaatgctgggagccttggtttctgtggtcattagtgctagaaggtgaccatgaatgccctacggcccctcaacgtgaagtggattgtgtgagacaacccagttgttgcaagatgataacttatagggggaagtagctttggaaagaggaaaatatgggtaaggtaacagacacgaaaatttgctatcatgacaaggtgaacaccaaaaagtaaaaagtctgggtaataaaatctacagtagggaaagaaaatgcttctgataacttcagtgaagcttgcagtttcaggtaagcgatgtttatggtctgtttgagcctatcttagtgcccctgtaagcttcacattttttaagaggctagtacaagagagaaagccagtaaggcagagctgtggttgatgtgagactcagaagagaggtgcagaggggaaatacagagacactaatagaattaatccattaaggaagggaaatggtattggtactgtatttcactggtagaactgcagtgtaagataggataacgaggataccatgtgtgtgttttctgttttgctttggctgttagtgacatttttccctcctttgcctactagacacaatcctgaaaaagtaaatttaagtctgatcatattttatatgcttgaaatactgatatttaaggaacctcatctctttgtaagtcaaagagttatcctttagtttatatgtgcattttccaaattggggttttgtttccttgtttatgtaagatacagatatctatatttttatatttatgtgtatttaaaaacaatagagtaattcatttaggtaggaagaaaaggtgtaggcattctttctgtggtcaacacatttactcatcctttgtaaaaggatgaatggatcttttacaaactagtctgtactagttgtgggatatgctttcatagtaggaattgcctttgaattgcagaaatctgttatgtgtactatgttaaccataaatcgaacctcaaagttttagcttctgctgacttcctctctccctgaaagccagtgaaattataaaatctcatagccacacgttctgttattaatgtgtctggctaaattttacatattatcctttcagagattgcgcttttggtctaatttggaggattttattttcattacttctcactgggaagaagagaattgaattgtttttatcctcctttttgaaataataaagttttgtagaaatataagggaaagagggaaaatcaccattttaacaccactgcattcatcattttgttaactccctgcacatttatgttttaattggttgcagcagtcatggttatacaatctcacttattttatattcagtaactttccatatgaagatataaacatacaggttatatatgaaaataaaatgaaaatgaggaatgtgcgctgtgggattgtgtgcttaacagtgtgcacgcatacacattatttacacacacattatttcttttttgagtgaaagatgtcactaaagctatatgtggcatagaaagctcttttcatttctagctagggtctctaattgtcttttttaagtgaagtgttcccatttaagaaccttgtccttccgtatcagttccctttgattcttgttgaaagagccagagcattcttccctgctagtttctgcctgttgctgccttgcctgtcttgccagttatgttacagggaccaccccagaacacgtcacatgccattatggtggctttattaaagttacaaccttgtaagacagacagaaccctcaactaccacaaagaatccttgagaaatttattcaggaaaataaaaactcacaatgtcaaaaacagctctgtcaagaactgaaggggtttaatagtaactgatatattctaacttcataaatgccactctaatagctaagtacgaagaaggttttcagaggttaatttgtctctctaggatgtacctctgactcagaggtcgttttctgctttgacatgaagctagttgagaagctaaataaaacagatgtatacatctacatcttagggccttttcgtgatcatcgtattgggaacccgtccttaaacctattcctaagcagtgtatggagttgaattttatttggaaagtaagtaggtctccaataaatattctagttgctatcaccaaagtattcccccgccaactcataggcagtatgagaacattttaaaaatgggatatagaaacagagattggagtttgaatcgaactgtgtaactttctatctgaccttttgcaagttatttagttcctttttaaaaagatgatattaccagagttacaatctcagaagttgcctagttaattatgccttgctatagattgaggaagaaggttgaaaatgagacttttgctttctcagggaaagacaagctagacccctcaatctgattgatgtgtgttttcctttcccagcttcgtttgtggcatattcccctgaacattgaattcttaccctcagcttatctgtcccaattccacatgagcctgtcatcacatttgcaagtgaacaggagaaaagttctctgatcagtttataccatgaaataccatgaagcccttctgttagaacatggaaatgcctaagctgaggggctccatattattcttattaacaattccaatagaaatggatttgaatttacacaaagttttttttggggggttgattcagatctaaggtataataagaacaaagaggttgaaaagatcccaattcatagttggatttggacaattattgtacatagtggcattcaatgggtaatagaatttatggctgctttggtagctcatcggttctttgtagtcactttgacttcgtgggtattttccatttcaccccaacttcagagagtaaagctttgctatttcgcttctgaccttcccttattttgctacagatcttactctagcacctccatagaagaggccatgaaaaggggcgaggaccctcccaccccgccacctcggccacagaaaacccattccagagcctcctccttggatctgaataaagtcttccagcccagtgtgccaggtgaagtgccccttgccccctgagcccttccatttcctgttggagccagcggatgtgtgtctgccacagtggcctctgtgagtccggagaaagagcagacctggcagtttcgcattccgtgaaggtcttcacgtggctatggtattcttgggagagaaagcaattctagacacatatgtagcacatgtgtctggagccttgcccacacttgttatggatcaagaattaggaaattctctaccaagaggataaaaatgcttcactcccatgcagcctgctgagtgtgtggctggggtcttactctctgcatcattggtaatttgtgaacaagatagatcgctgtctgtcatttcctcagatgcctgtgtggtcttctatgaaagatcttggagattaaggcctagccagaaccttctcctgcattttacacttatggagaagatcctgtgtcctgtaggatttaatgctgaggggactctgaatctgactgatggttgggtggttggtggagggtcctagggcaagggctccttcaggtgggctgctctgggcttctggggatgggatgttcttgagcccgcagttgtgtagtggggctggaggtgggggaggcccagaggggccctgtctgctcccttggcttcctgtgaagtagaagataccctcctaaggaacctaaggaatagaagatgggaggcatgcctttgctttagtgaaggtgataggatacggtgctgtcccaagtgttattttgggagcagcaagggcctttccactgactcatgcaggcaagctataaatacaatgatttcctggaactttttctccatctatgtgcattttaaatcaggccagcctcagatgctagtgatttgcagattattatcttttctgctaaagcaagaaaagactttccttggctcacacattagcatgacctctgtgtctgggcagagctcagcatgttttatttgttctaataaagtattctcctcacagtaaagttatagattgttttttaatatactaaaatctggaactctctatcaaatttaattctgtgccatgagttcatcagacaaaaatttgccttgaatttcctctcatactttgatctgaattctggcataaatttcatagtgactggtatgtagggtgggagtaaccacaggtgatgatgctataaaaatttcacatggctggcggattatgacctggaagattttcctatggatgcgagaaaattaaaacaatctgggaagctatctcagtacctttaccttgcaagaagggaggctggaaatgctcacaggtctctctcaggttgtgtgacccagtaaggagatgccagctgtactggagaattcacatgctgtggtttttacgacactgcatcacatagtggaagagacaaaactgggtttggagctcagctcagctgcttattcactgtttgattttcagcaagtagcttaatgtttatgcatctcagattcctaatctgtacagtagagccaatactccatggagttgtaaggttttggtgagataataaacataatccaaatatgggttgaatattccttatccaaaatacttggggtcacaagtgtttcaggctttggatatttttggattttggaatatttgcattatatgcttaccaattgagcatataataaaaaaatctgaaatgcttcaatgaccatttcctttgagtgtcatgttggcactaaaaagtttagggttttatagcattttggattttggatttttgggattagggatactcaacctgtagtactgtatttggcccacaggccttagtaagcatgtaaggcccatattcccgtggcctgcaagtatcaagaatttaatgcctgaaatggcaagcctccaccgaggaggataacaccccgacttccttgacccctagcagacaattctgtgattcctcctacccagtttctcagaaggctcgcaaaaggactgaaccccagttgcctgccgtagtacaccattcattgatgtactttttcttgttttgcttccctcctgccctgtctcactttcccctcactcgaataatatacctgttctcaagttcatatgtcaggggcttctttagagaaaacctgaattaagacagctttctttgatatctctgtgtcaatgtgacttcaagatgaaaagtattttggtttgataatgccctgacgatctcccttgtggtagggcctgataaatctaagatttagacaaataatagctaggtgggtgatgtctctgttcatagcctaattccattgtcttttcagtacaaatttatacagatgaaattttaatgagcagtttaaatttatcacatgaagaatagaacatttctgcagtatgaaaagcaggtggtataattgcatctactttatttattttcatgttggttaattctcacagaaaagtataagggtctgtctaaattatataaaattttagtgtattgcatattgctagaaattatcgaaatgctgacaaactagaaatgcatgaaatagagcttaaacctaccagaagagtctactcactgagaatcatggtgtacatttaggcatccctttgctgcacttatctttatgtatcactttagataaatgggatcacactatgcttgctgttctgtatcctgatctttccaattaaccatctttctatttcatatagaggattgcaccgttccctttaaggtgtgcatgatatggatataccatggttgactgtgctttgatggagagatctctcccttcttctctctgccttttctcttccccatactttcctcttaagctcacccaccaccccacgaccccagcccccgttcctttctcacccttgcaaacaaacctctctctctctccaccccgacccccgtgtcctcttcatacccctctgtttctctttttgtccttctcccccatcactccttcacaggtatgagcctcccctcactctccccttgccaagctcccccacaccaccaccttgttcttataatataaacgaggcagaggttattaataatttcatgtccgtatctttgtttcatcatctaattattttcttaggttaaatcctgctggttggagttgcagggtcaaaggctgtagatgtttaaagtgtagctatatgttgccaaagggtgaggtggaacacctgtcaacttgctccatcatcaacactgtctgaaagtgtttcctcacaatcttgccaacactgcttcatgttcatctttttaatcattacctgtgtaataggcagtttcatgtccctgattcctagtgaggctgagaatctttttgtattgttattggccataaatattccttctcttatgatttgcctgctcagaaggcttggccagcttctgttgctacatctctctttgcctaaccacggggaccacttctttcttcttcattttgcctacgttctggacctccctcctgtcaggcacttgggaatgtgagggtggccatggggaagcctacctcacctgctgctgtgctgttccttgtccctccagccccgccccccatatcccctccttctgccaactttatcacttaagacagactgcctgggtcaccctgtttatgacaatagaagaataaggaaaggtaaagaaaagaggggaaaataatgtgagatgaagcaagatgtggacttgagttgaaagggaaagataaaatgaagcccttgtttaataaaatgagactcaggattgtgaaaagcagtgattgaagctaaggtgctgatacagagtggcttaaagtggagtgatagtgtggaaaggaaataggatggagagaagatgcaaagaaaaatgaaaggaaaatgaagggaaagatgggatggttgttacataggagtgatgatgtttatccaaaggaataagcaggaaatagaataaaaaattgtagaaccaatggaaggagagtccacagactcttggtgtaggattcaagcagcatttaaaggaatagcttagaagtaggtggcattaatgcctttacatttatgaaaataggtaacatgatatggggaaaaagaacaaagggctgatttagaatgtaaatctataaaaatgaataaggccaactttggaaatatagaacagttggcttcaactttggtgtctgtaaagagagtgtgaatgtgtgatttatagtagcctagatgattccagggctctctaggtactggcatcagacccgaggcatgtgttttcataaggagaagcggatacactatgatcgctgtgtgtaacagggagatcaccatttgtaatagctgacccagttcttggagccattgcctcacagtcccacacagctgctgtgtttgagagatagcaaaaatgtgcaagaaagtctaagtcagtgacaatgcaagtatgcaaaacctagaggcagtcagacctggaatttgctcagtgatgtttggattttatgtctctatatttatagctatgaaacatcttttattactgagattcctgtaagaaaaatcacactaagctggtacctaacctccttttcctcaatgaaacagttattttcatgaggtaatttttttttcataaaaaggggtttcttctgtccacggagtcagtaagaactacccctctcttctactcttgattcagacctgcctcttctcaaagccatgcctgaggtttgtagcctgaggtttccatggtgacagtaaaaagccttagctctgccttgttccagtcattgagcatctgcctggcagaaggggcagagatggtgtggaggagacatagccattcctttaaagtttcagaccgggcattttcatcatttccactcaaatctagctgggggacctaggcccatggatagacctagttgccaggcagctgggaaatgtagtccttggcagggcagccatttcccagaaatacgtttcttactgcaaaaaaggagaaggggatgttgatggtcagttgtttttttttaaaaccacatcccatatggccaaatacattgagattcacacattaaaaccattgtgatggctgaacagaacacatccagggctagtgtctgtccatgggtagctaatttcctatctctgctttagatatactgataataacaactcattccatggttaagagactatggtacatccatcctatggaattgtatgaagctgttaaaaagaacaggcacgtatactacatggagagctatctcggataaattaagtgacaaaagtatgatgcagaatgtgtatgtttataaatgtgtagacaatttcaggatgatgctaaagaaactggtaatgatagttgcttctgggcaaggggaacagtatgactgaggacaggactgggaaacaagcttactttctgttgaatgcctatttgtatctttttaattttggctcatgtacagatgtcacctattataaaaaatttgcttttcactctttagctgcaatgatggtatctgaaagtaccagagatgtctttcctgcctgaggttacctatctcaatcttccctacgattctgtattcagggtatctttatgaccatctgctaccacctcctggaatgcagctgaaatgacagaaatgttccgagcactttttttttttttttttttttttgagatgaagtctcgttctgtcacccaggctggagtgcagtggcgtgatctcagctcactgcaagctccgtctcccgggttcatgcccattctcctgcctcggcctcccaaatagctggggactacaggcacctgccaccacgccctgctaattttttgtatttttagtagagacggggtttcaccgtgttagccaggatggtctcaatctcctgacctcatgatccacccgcctcagcctcccaaagtgctgggattacaggcatgagccactgcgcccagccccgagcactcttttaagctctgatgcgttcttcagattccatttcagtgcctttccaacactgaggagtagttctggaggacctcccaaagattacattgtgagatgtatagttgggtaaaacgtcatggtaagggctctgtcttaacttggaagtggctgtgtttattgagtggcgaattgagaagtctttcctcggttttctataaatgaatatttgtttctgtaacttaagaagtaggtaaactccttgggagtaagagatgttcctaataccaaacttacctttcaggttctctaaaagatgaatttggccacaaaagcagctctgaccttatatatttccttactgtatttttcctgtgagtgctacttgtttcttttaaaatctggtaggactatgggattcctgacccaccccaaacctttgggcccacagtgcacagctatccaagggttcaatttggcagtctgggcagtttttttgttttgttttgtttttttgttttttttaaatgaaagcgttattgagatgtaacccatatactataaaattcacctttttaaagtgcacaattcagtgatatttagtatattcatagtgttatatataactatcagcactatgtaatttcagaatattttcatccccctcaaaagaaaccccatacctattagcaatcattcccattccccccttttcttcctctatcccttggcaaccactaacttactttctgtttctatggatttgcccattccggaattctgtattaatagaatcatataatatgtggtcttttgtgactggcttcattcacttagtataatgttctcaaggttcatccatgttgtagcatgaatcaatacttcattccttttatggctgaataatctttcattgtatggataaaccacattttggatatttgggttgtttccactttttgactattgtgaataactctgctatagacattcatgtccaagtttttgtgtaaacatattttttctttctcttgagtatataggtagggctggaatttctggttcatatggtaactaactctatgttgaacattttgaggagctattgaagtattttccagagcagccaaaccaatttatttcattagcaatttatgaggattccaattgtgtttcttcacgtcctcaaaacacttgttattgcctttttaattttagccatcctagtgggcatgaagtggtattgtgattttgatttgcattttctaatggctaatgatgttatacatcttttcatgtacttattggtcatatttatgttgtctttggagaatgttcagaatctttgctcatttaaaaattgggttgtctttttattgttgatttgtaaatgttctttatatattttgcataaaagttcctttacagatatttgatttacaaatattttccttcgttctgtgggttgtcctttcatctttttgatggtgtcctttgaatcataaaagattttaattttgatgaggtctaatttatgtattttgttgcttgtgcttttgctgtcatatctaaaaaaccattgcttaactcaaggtcacaaacactcctcttttcttctaaaagtcttatagttttaggtcttacatttacgtcttcgttctgttttgagttaatttttttatatggcatgagttaggagtccaaattcatttttctgcatgtggatatacagttgtcccagtaccatttgttgaaaagactattaattatccatttaattttcttggcacctttgttgaaaatcaattaaccataaacataaggatttatttctggactctcagttctgttctgttggtctataggtctatccttatgccagtaccacagtgtcttgataattgtagatttatagtaagttttgaaattgcgaagcgtgagtcctcctgctttattctttttcaggattgttttggttattctgagtcccttgcatttccacatgaaatttatgatcagcttgtcaatttctgtaaaaacaaaaaagccagctgggattttggtatggcttgcattgaatttgtatatcagtttggttagtattgcggttttaataacattaagttgtccaatgcatgaacacaggatgtttttccatttatttagatctttaagtgtctttcaacaatgtttcagtatacaagtcttgcatttcttttgttaaatgtattcctaaaagttttattctttttgatatacattatacattatttcttggagatatccatgtcagtactgataattttgtatttcttttatatatcatctatatgctggctgctctgttaaaaaccgtattatgaaaaatttcaaatttatgcaaaagttgagaacctccacccccatattattttgaagcaaatcccaaatatcatataattgtatatataaactctttgtatatctctctaagagataaggtcttaaaatacttgagcacaatacctttgtcatacataacaaaattaacaataattctttaatatcatttaatatttggccagtgttcctatttcctgaattgtctcaagtttgtctttttatactagtttgttccattcagaattcaatcgagggctacatgcacattgcacttgttttggcatattttaagtctcttaactgataggttcttctctcagtcttttttttcctctttgcttttcatttattcataaaaagtcatctaccttgtagactttttcacattctgtattttgctgattgtttgttcttccatcccatgtatttcctataaactaataggtaggtctaggcttgattagagttagtttagatttttgacaagaatactacctaaagatgctgtgtacttcttactgcaccacattaagagatctctagtgtctaatgcctttatttttgtggtgtttgattgattaatgggtttacgtagtattggcctgatccatgtgttatgataaagatcccagcgacctttcaaataatggttttatcagctattgatcatcattgcctacatccagtggtgtgtcagtgaatgtttaacaaccggccacttgccaatttttatggtgtaaacactcctgccatggctaatttcattcctactgatgtgttactgaatgtggagtttggaacagatgcacacagttggctctcacaagctggcatgagctttttccagcaaaccactgcttagatccattatttcattggtagttgcaaaatggcgatactctattttttctacctttattaattgggactatggtttatttaagcattttcctattgttggacatttaatttgtgactattatgaagcttgtgagctgaaggagatcataaaacataattctcagtacatcagtaaattctttatatacatctgaatttatagaattgtatgaaaactgaaatagacttcagtaatggtgaccagaaaagtgtcttattcaaccagtatttaatgagcatttactgggtacttggcactttggaggatcccaagagggatatggatatgcccccaaactctgctaatcaatgtcacagttgtgtgtgattgttagaagggtttagagtttgggtggttgctaactagaatgatcagtggatttgtgggcagggggtgcacagggctggtgagctaaactttgaaggatatgacttttcagtcaaatcctattcttttttgacatctgtcttgatttacttcttatgactagtttcctgggtgtctactatagtagcctcaaatctggcttgcttgctttgttctttccttcataaagcaacaggattaattttctgcagcacacctatgatcacttccctactcaaaactcttcaggacctactatgtaatcaccaaatttctggtggaactgaacccgaagccatgtgattatattagctcagtaagggacacagtactgtggcctggagtgcctggggaggagtgtattacaggaaggaagtagagactagaagattcaagttggctggctggccaagaaaaatggagactggtggagaaggagtttgtagacggtgtctttgggaagtcttaggagaacatcccattagggtggtagggttaagccagattgcaaaagattgtggcataagcaaggaactttggtgtggagaagttgtcatcacaaagtcattttgaaatgtcgaaggtttagcagttgttctgactgtatgtcacattttaaaaaataatggtagtggccaggtgcagtggctcatgcctgtaatctcagcaccctgggaggccgaggtgggtggatcacctgaggtcaggggttcaaaaccagcctggccaacatggagaaaccccatctctactaaaaatacaaaaattagccaggcgtggtgatgtgtgcctctaatcccagctattcgggaggcttaggcttgagcctgggaggtggaggtttcagtgagccgagatcgtgccactgcactgcagcctgggcaaggacagagtgagactctgtcgatagatagatagatagatagatagatagatagatagatagatagatagatagataaagatacataagatagatagatagaggtagaagagagccagttccaagatgatagactgtttttatagattgccttcctcctaacacacatttgtattctctctctctcccccaccgcattattcagcgctaatgaaagtgtgatggaaacagctgctagtgaatgaatactaactaatcctgaaaaaaagatgtgtacttcttgaaattttagtttgatttacctgaaaacatatacagaaacacaactagtgatttcaaccaaccctagagttttaatagtaaaatgcttaggaggaatgcatttgtgtaaatgtaatatgagagaggaaaccagacacccatctttgaccaagattgaatctcatgcatttttgtcacttaagtctgcccatgtctccatccaggacctagttaacccttattgcgtatcctatggtacaggaaaaatgagttattagtaaacatggataaattttagaatcatgaagtgtcaatgctaaaagagaacttgaatgtcatcttggccaactctcacatattaccaacaaggagactaagatccaggcaatataatggctttgttctccatcagaatctttctttccttttttttttttttttttaagatggagtctctctctgttgcccaggctggagtgcagtggcgtggtctcggctcactgcaagctctgcaggttcacgctgttctcctgcctcagcctcccgagtagctgggactacaggtgcccaccaccacgcctggctaattttttgtatttttagtagagacggggtttcaccatgttagctaggatggtctcaatctcctgacctcgtgatccacctgcctcggcctcccaaaatgcttggattacaggtgtgagccaccacatcctgcccagaatctttcgaagttgggaaatctttgtttagatctttgttgcagcagatttggtatcaaagaaagctatctacattaaattaatttggagggcacaccctactacttttctacgggcaataacactaattaatatctaaagttaaaggatgtattaaagaatgaatatggtaacctttgcaaggcactcttcaatgtgtttttttctgtgtttccttctatgtgatttaaaatgttagtagatttctctgaggtacttcagggagataggaaaggagcttttgccctcatagatacttggaaataatatatctattttctttttttaatttcaaaaatgaaattattattaaaagctctaaatatagcaagaatataagacaaatagtatactgaacatccagcttcaacaattaatcaactgtgtcccatcttgtttcatatctgtcttcccccacattattaattatacttttttctacccttagcttaaaaaaaactttattgaggtatatagatcataaagtttatccattttaagtgtaaaatttaatgatttctagtaaatttatcaaatagtgcaactttcaccataatccagttttaggtcattttcagcactccaataatactgcacatacctgtttacagttaatccccatgcccagccccaggcaaccactaacctattttgtgtttctgcagattttccttttctgaatatttcatataaccgaatatacaatatgaggtcttttctgtctgactttgtttacttagcatgatgtttttgaggttcattcatgttgtatcatgtatcagtacttaattcctttttattgctgaatagtattccattatatagctatatcacattttgtttatccagtcttcagtttgacagacatttgagttgtttctgctttttgtctgttatgaataatgctgccattaatatttgaatacaagtctttgtgtgaacatatgtttcatttctcttagctagatatataggggtggaattgctgggtatgtggtaaatttatgtttaactttttaagaaatggacaaattgttttctaaagtatctgcaccattttacattcacatcagaaatgtatgagggttactatttctttatatcctcacccacacttattattatctttttgattatcctacatcctagtgtgtgtgaagtgatatctcactgtggttttgatttgtattcccctgatgattaatgatgttgagcatcttttcatgtgcttattagttattcctgtattttatttgatgagatattgtgttagtctgttttcacgctgctgataaagacatacccaaaactgggcaatttacaaaagaaaggtttagttggacttacagttccacgtggccggggaagcctcacaatcatggcagaaggctaaaggcatgtctcacatggtggcagacaggagaagagagcttgtacagggaaattcccatttttaaaaccatcagatcttgtgagacccattcactatcacgagaacaccatgggaaagacctgcccccatggttcaatcatctcccactgggtccttcccacaacacatgggaattatgggagatacaagatgagatttgggtggggacacagagccaaaccatgtcagatgtctactcaaatcatgctcattaaaaaattgggtgtttgtcttattgttgagttgtatattctgtaattctttatatattctggatacaaatcctttatcggatagatgatttgcaaatattttccacagtctgtgacttgtctttttgttttcttaatgatatgttttgaagtacagaagttttgagttttgacaaagtgtaatgttaaattttttccttttggattgtgcttttgatgtcatatctgagaagtctgcctaacccaaggtcttgaagattttttcttgttgtaaaatttttatagttttagctcttacgttaagatcttgaatccattttgatttaatttttgtataaggtgtgaggtaaggatctaagttaatctcttcgtatatgaatatccagttatcccagcactatttgtcaaaaaatactctccttttcctgttgccttggcacctttgttgagaatcacttgtctgttaaatataagggcttatttttggacactgcattctgttctgttgatttatatgtttatttttatgctagcactatactgaatgttttttaacacaggggagtcatacataatcttgcaaagaggtaatcccacgactcagaagtctttaagtatttgctacaatggcatattttttagatagtatatagtagcttatttacttcatttgtggtttgtagcatgttcagaaggatcctttgagctccttgaggttgcagtacttctttgctttgaagccttctgtcatgtttattccctgaatgtagaataccctctgtctagctgtttatcctccatctctgcatttttctgctctacctgccctgtaggttcaaaatgtggtactgattactgctcgatagtagccttgtgtccttggcaaggtcattttatttctccaggtcttaattttctcatctgtaaagtgaaagaatcagattttatctcactacttttctaaactctgtcgttaatattttccttgttgaacagttacaaggatgtgtaagttaatctcttttaactggtgaaaaagtatattctgttccatagagaattaaatgagcttgtatttcggggggtggtgtgtggtcatcaggggatagaggcaggtatttctggaaaggtgttcttggcaaacattttgttacatacactggtgtatatgacatacatgtccatcactgtatgctgggtgatcaagagatatgtataaggtcatacatgcttttatgattagaaaggagagaaagaatgaacaatttctgttacaaagaaatagccatttttatgaacttgccaagaagaggaatggtccttactgatgaaatccttaaagctttgcatgtggctctttacttgattgatatttaaaagtataggtcccactgggaggctcctttcaacattttccattccttgagtgtttttcccccctttggtattcgaatgcttttattttcttcacataaaatattcctagttaggggggatgggagcccctttccacagctgaagttattccaagttttgttccccctgaagaatcggctctctgttcctgaagctttcaatggccacatctgctgctttatttccactcaataagttggaatatattttcatttagttattgattaggggctatgtaaaaatctgaaggaaattagtaaatagtaatgtttatgaataacattttacctagaaatttctaagcgtaatgaaataagaggataaaaattgttagaggttggagttttggatgaaggtaccaggaagcagagatccaataaatcagtatcagaatctgcatgtctttcaataaacttaagaaattgttttaaacactaggaattattagtctgtcttctgaatttaggattaaatgacagtttcttttcctgaagtttttaatgtggttttcaggattggggtatttattattttcctttggattacacttataaaaatttttggctggacaaagccttgctgatacctagtatcccactttattaactataacacttgacgaataaacctgcaattgcttgacgaatatggtcactttttaaagtatgtgggaacaacattcttctctcgtcttcttgccttcttttccctcccaggaaagcagttgttactattaacaagtatattgtcatcttttgcaactgcacactagattattcagctattttttttcttttttttttcctttgccttccaccatgcgatcaaagtattttttaaatttcactttgcatgaaggtgtactttttcttttgactgattagggcatactggataaaatatttggatccaattttaagtcaagagcagactgaaaatattgtaagagaagatttttaaaattaaatttaattccaattttcaaccactgtgtgagtacctactaaacataaggcagtgtgtttaggtgctgtgggagacaaaaagatgaattagacagaattgatagaatgtagctagattaatatctcccaccattaaaggaaaggaacacagaattataaatgcaaggaagagatttttcagcagcaaccgaacaaggaaaaatgcatgagttaatgctatatatatatatatatatatatatatatatataattttttttttggaaagagtggcaactgagggaaacctgaggctttgggtgcacttctgactctgcctgcttccttgcagaagctgtgtgtgtgagtaggcaaatcttgagagttctcatcgagaccctaggtctagagcaaagtgaaatgaatgagtactcgtaattttcctttttcttgactaagtggaaatgacttcaggaaagagagttggaaaagtaaataatcatagctgatatcctgatattgtagaggggaaggcccagagcttcatgctgaactggggacaaactgaagtctgagaagttcctccaaggccattgatagaactccaagacttaggagaatgcactctgctgcagggttttaaaatgttgattattttggtatttccttcgtaattctaaatagcatatttgtgtaacttcttgtagacttcaatttttgccatcatcttccctcccccattatctttctcctccacccttccaatatagttatattataattttggttagattaatatttagtgtttatattattattgttatagccatgtaagacatatagtaaattactttttttttttacttgcacaggtttttgtttgccttggagtgaataatcaacttgtttcttttcaaagtacttgcccttgattcaaccacagacgtcttcaattttccagagttcctcttatgaaattctcacacctcaggtgttctgtcagtttcagctttttgaagcaatagaaactgattgtcttcaatgcctggtacatagttttcatcatgggatctctctacactgtcatccaaggattcccttcctctttttcccatgttggatttcttttattactgtatcctgtgtctttctctttctttgtttactttcttgttttggtgaagcacatccttcagcagcttccttagaaagggtgcatggagctcaatttgagaccctgaatgtctaaaaatgtatttaattatatcatcatgcaggctgctagtcttggatatacaatcatcagttggaaataagttttctttagaattttgatggaattgtgccaatggattctagcttctaatgatatatgaagaagtctaaaaccatttggacatctgatcctttgtatatgacttgctctcttctcctatgccctgctgaaaacttgtaaattattttgactctagtactttgaaatatcatgatataccttgtcatgagtctgttttcttccattgtcctggatattcagtgagtcctttaaatttagaaattcatattcttcatttctgggaaattttattgaaccatttaattgattatttttcctgctgttttctctgtttctctttgtggatcttttatttggctactaccctattttctggaagatttcctcagattatttttgacctttctattctctttctgctatcttttaatttccaagtattctttttgttttgttttgttttctgaatgttctttgtaaatagcatcccattatttcatcttagcaaatagcatttcttatgtcttactgagactttctctggtgactctagttaaaatttcatctgtcactctctaccccattgtctcttttctcagtagaatatgagcttcataagggtatagctttttttttccctgtttttcccatggatattttcccaataccttgaacaatacctcccacatagttagtgtttaaatgtttctggaataaacttaatgatcattctgatgatattaataatatatattttaacgttttctcctagtaaaggtctagtctgtttctttgaggtcatttcttcctgtttttattgatccctaccttaggttagaacattttctgcagatatctggtaatacttagtcatccacttatatttaataatgaaggataaaaagttgcttggaatatatgagcaaattgatggaagttgccagctattggcttcatggtagaatggtctggccaggccatcctgttggagatcccttgatatcaactctttagatgtctcttcctggctgatctgattctctggaacacattctcctaatctctagaaggaagcagcagtctgggagcagaagggaagaaggctggaagaatctcagcatccaaagtgcatatttttactgaatctgtctgttttcagcatggccctcatgccttcatctgggcctggtgccttccctgaaaagaaaactatatctagcattttgctggagtgagaaacatgctgaaactgtgcagaatgtgggagaaaaaactgctcctaaactgcttcaatcagtctttttttttttttttaatgaggatggaacataatcctatagattttaagatagtttaaagaactatttgttgatcacttactgtattttgagttatcaggtgagacagatataaggcatagctactacagcagaggggactgtaagagtagggcccctgaagccaaaaacagcatgaagaatagctagaaccagatcctgaagggtcttgtcaaagtatgcccttttcctgaagggtaggaaataaatccactattagttcattgctttaggtttttattgctttcctcattttacccctacattcagaggtgtttgatgccaccaattcctgagaactggggggcttctgtggtacaaatttgttactccctgctttctcagatctgtctagtcagctattagttgctcatctgttttcccagttccaaatttaaacaagagcatttaaacagttctcttcatttttgtgttaatgagttaagagtgagattagttacatgtatttgaactgctgtctatactcaaaagtctttggataggacatttaataaaacgttgggtcatacacaagaaacaaggaattttacacagtatcaagccaagattttagtttaaagtggtcccaggttgatagtaccctcagatttctggcagaagcgatagagggaagaggaattcactttccacatgcctcaaagttttcctgtcggtaaagttccaaggaatttgagtttagagtcacaggttgctaagcacactaggaaatgaagcacaatgagcaagaacaaacaggaaatacaaagccctcagatactgaaattatataaatatgttgaaagaaaagaggaagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtcgtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaagaggaagaaaatgaatggccaagaaattataaaaatgaaaaaaacattttcaaaaaagaccaaatagaacttctagaaaagaacaattctgtaacataaactcgaagactggattttgttagacattaagaacgactaaagagggaattggttacttggacagtagatcgtagaaaattgtctagaacacagtacagttagaaagctcttgaaggagaggggagagaaaaatggtagaaatacaacatttaaagaatcactgagaattgaccaaaattaatgggttgctacatggttcagaaattccagtgaagctcaagcaagtgataaaatgatggtagagaaatacatgtgcagacataggataaagtttgatatttcagagtacccaaaacaaagaggagatcttaaaagcaaccagagagaagatgggccatctaacaaaagagtgatttgactgagagctggcttcttaatagcaatagtagaaaccagaaggcagtggaatgttaccgtcaatgtgctgggagaaaatagctgtcaatttagaattctatacccaattaaatcctctttcaagaggggaaaaatgacttttcaatcaaataaactaagtttgctactaatagacttctcaattaaggaaattctaaaagacatactttagacatcataaaataaactgtaatggaaattaggaagcttttagcactgagtgataatatcacaaataaaaacctatgatattctactaaagaggtacttggaaaaaatttataaccctaaatgcttacattagaaaataaaagctacaaattagtgaactaagcaaccaatttaagatagaaaaagaacaagatatgcccaaagaaagtaaatggaagaagataagcagcattaataaaacagaaagcaaacatacaatacagaggctcaaaaaagttaaaagttggttttttgaaaagagtaacaaaactgacaaatgccagctgagattagtgaaggaaaactggagtatgaggaatgggaaaagacaattacacatgcagagattaaaataataataagaggggggtatggacaccattatgctaataaatttgaaattttaggcaatgaataaatgcctagaaaaatatcatttatcagaatcgacttaagaattagaaagtctgaaaagtcctataacaattcaagaagcagaatcatagtttaaaatcttgtttaaagaaaactccgggctcaggtggctctcctgggaaaatttttatttgatattcaagaaaaaatttccaatcttatacaacctatttaagagtataaacagggcatggtaggggtttgggggtggtgctctccacctgaatgaagcataatagaggaccatatgagaaaggaaatcacttgcaggtctcactcatgaagatagttgcaaaaatcctaaacaaaatatcagctaaccaaatctagcagatataaaaaacttaccaagttgagattatcccaggtctgcaagggtgttttaatattagacaatccagaatgtaatttaccacattaacaaattataaggaaaaaataataccataatctcaatggctagagttacagctctgattaaaatccaacaacaaattatcctgaaaagaagtctcaaaataaggataggaattttcataataatctatttttttcagggattatatatctatagttttattaagacaaaaactgagagtgtggtgtgaagtttacattcaaacaaagttttcaaagaaatctaacacatgcctaaaaagattttacaatgtagctctagatccaagtctagataatatcaagaactgatggatctcatgactcaagacagagcattttgggtatcagttacttcttaggatttgttaaaaaatggttttgtgtgtgtgtgtgtgtgtgtgttttaaagtgaaccactgcccagtatgaaagtttaatctcctgagaccaaggcttttgaaatcactcaactcttgagtcaattcagtgaaacttgtgctgtcagtgactgaactctgccaccaatggtttcagagttcaaagctcaaaagagaatggctccaaaagttgtcccaactaagagcatgggccctttacttccctcctgtcttatctcctctaccaccctctttcccttccccaacacctcagccagtggctaggatgaacaagctgatatttataactttattattggaaaagaaagggtcttctaatttcaggaattagcacctctgaggcagaatgatctgcttgtactgtatactctccaataaaagaccttccttcctcagtcaatttccatctccaaaatggcaactctggtaacttattaactggcttagtcctttgtgagactaagtacattaagtttaggcagggaacaccatggcttatagatttcagacattcacagcttttaaagtctctcacagtccgtatttatggtgccagtgacatttttttcaaaggtaaaatattctggacatagaagcaaatcattagttttctgttctttgcattgcttcaccatgtcccctatcaggccccaaattttaatcaaaatgatgctacccatctccctttccaccctccccattcctccctctcccacataatacaccagtaatagccaaaaactacacatttgctacgctgtaaaaatgtagagttaacactattgggaagaaagttgtgcgttgcggagatgctctttgattatctacagtatttttttgctctcccacacacccagttctgcaagttttgtccttcataaagggccctttgctttttctcagcaaagtgcagaaaaggttgccttgaagcacttatcccccttcccctccactgggacgggtgtgcaaactatacagcttggaatggctttaaaacacttgggctgctgcagggcacagaaacgatactggctcttcaaagggcatcttctcaagctacctctatggtgtcaagacaagtagaacttctttccttcccacctgaaacccacagtcagatgtgatagaggctggtactcaggagagttaattcttgtcatcatcctctttggggtaggaatgccacgtcagcctttcctcatagaaggatatgacaacccgtgggcatttgacattgacttccttggcagggacgaggtcagcctcatcagaatttttccctttcatcaggaacatgagctctccactggagtctgtagctccaataatctgctccggctccaaaccctgagcaaagcctcgtggcttttctgactcttctttcttcttctttggtttgctctcctctcccttatcttcagaatcagaatcagctttgtgcttgcctccctctgatttgtctatctcatgtgctgttttctgtgacggcagaaactcatgaggtcagggcaatccaagttctcttctgactcccatgtgttgtcctcatctgagaatcccttccactttaggaggtactccactttgccctttaccaatcgacggtagagaactttttccaccacatattcctgttcctcctcttctagcacctcctccactttcttcttgttttgttttttctccatagcgtgtgtgtaaagggtgatgctgctcagagcagtgcccaggagccggaaaggaatcggtgctgcgctattggcgcattgggtcggccagggcagtggcgctcagaaaagcagcaagggtagctgcaaaggagccccttgctgaaatggtgtaccgcaggcctcggctaatggccctcctctcagccgaacaaaagagccctgcactctgtgctgcccactgcccactgcctgcaccgccttcataatctattaaagggtatctacaacatacctacagcaaacaccaacaccataccttatggtgagctagtaaatgctcccctttgagatcaagagaagacaagaatgcccattatcaccatttaaattcaacttttacagtagataattctaactaggtaagactggaaaaataaaaaacgtggcaaaggtactgaaaagaggaaacaaagctgctcttagtatttgtttaatatggttgggcacagtggctcatacctgtaatcccaacactttaggaggccgaggtgggaggattgcttgagcccaggagtttgagactgcagtgttaatgatcatgccactgcactccagcctgggcaacagagtgatatcctgtcaagtataatatttttgatataaatgtgggggcttccccccaaaaaatgctctcagaatttaatgaggaaaataacctatgccaactcttgtttttttttctttttctttttctttctttttttttttttttgagatggagtctggctctgtcacccaggctggagtgcagtggtgtgatctcggctcactgaaagctccacctctcgggttcacgccattctcctgcctcagcctcccaaatagctgggactacaggcgcccgccaccatgcctggctaatttttttttgtttttgtatttttagtagagatggggtttcactgtgttagccaggatggtctcgatctcctgacctcatgatctgcccgccttggcctcccaaagtgctgggattacaagcgtgagccatcgcgccaggcctctatgccaactcttacaatgagagattcagaatgaacaacggacacatacctgtgatactgttttgttgcttgaagctcaattgtgagaaattaaaacaattccatattaaatggcctcagtcttttaccctatttcttcttcatatttggggcaatttctgataaaccacaataaatgatgttgtaggtgacatgcttttatctaaaagtgtattcagaaatagacccacacatcatcttttacaagagcagggcatttgtctttaaaaaaaattaaatcatacaaaagaacttaatgagatccgaatcaggatctaaatactgtttctaataactctcaaggcagtgagtagggacagtcagccacagggctcacctggttggttcctctctctcaggggtcactgtcttttgttgcctgattttctagtgccttgaaaactgttgtttcatatttttttttctatgtgtttttggttgttttaaatgggtgggtaaatctctctgttacttcatcttggctggaagcacaagtcaatttaattaaatggctcatcatttcttgtatagtcctcttttttgttaataaggagttgttttaacacacgttaatacaattgcttggcctttcccttaaagtttgcgtagatttattttattttattttatgttatgttatgttatgttatgttatgttatgttatgttatgttatgttattttattttatttatgaatgagacagggtctcactctgttgcctaggctggagtgcagtggcacaatcatggctcacggaagcctcaactcctgggttcaagtgatccttccgtctcagcctcccaagtagctgggactacaggtgtgcactaccacgcctggctagtttttgtattttttgtagataaggggtttatccatgttgcctatgccagtctcaaactcctgagctcaagggatccgcctaccttggcctcccaaagtgctaggactacagcatgaggcaccatgcctggcttgtttcatttgttttgaaagtaactgttaattttaaaggtccaatctgtgaggatctaaagagtaggagccctgagatgaataattcctgaaggctttcagcattctctcctgctgtgtgctttgttattgacagctgttcaaggtctcaccacctctggagttttaacccaccgatgtgtttcataaattttaatgaaagacagatagagagaaatcatagataggccaacatgattgtaccatatccatgcactggctcaaaatgaaaatctctgtgatattaccctgagttacatttgtggaacacaccaaactccgtcttctagcttgtctgatccagctagctaagggaaatcaaaagtaatttgcaaaatcttttatgttcttttatgttcttggtacattgctctgatttattttttaaggcacagaaaattgtccaaatgcatagtacaaatttgcaaataaactacatatagttatttggacgatggtgtttttctaaggagttttgtaaagaatgtggtttaacttgccagtgtgtaatgctaaacttatttcttgtgtgttattatgaactttatttataatttcatagcagctgtttattttcattgctaaggtacaattcagatgttcttggcttaactcagtattctctatctcacaaaatttaaaattagactgatactttgtaaagattcttcagatgtggccagattattttaggaacagctttagttatccctgataataaatattagggagagaaaaagaaattgaggtctttgaagaatccctaaatatcatttcagtctatcactgtcagcctccctcactgctttcagatccattcccaggagcatttacagggtggccaagcttcctcatttgggttccagctctcttagtttctgtagcctactcattgagctaatgagcagtgtagtggctgagagctagggagaaatatgagagaaatcaaagaagaccctttctgacttttgccctagattgtttgaaacgaaataacattagaataatgaggaattgaccacctttcccttgctgcgttttaggtgtcttttctgtaccattttattatgtcgtcttaatcataacagcctacataaatacttgagtttgggttaggatgacaatgaaaaagggattagaaataacgtgtactcttttttcttaagccttcagaaggactgtaaaaacttaaagatgttaaatgcaaatgccattgccattccaagttaacaagcataagagttttttgttgtttatttttggggggtgatccttaatagtatgtgtttttcttttcagctaccaagtcaggattgttacccccaccacctgcgctccctccaagaccttgtccatcacaggtaggagacatatttgatttatgtaaactgttcggtggtagggaagttgtcctatcgctgtgcttctttgcaagggttgatcgccacagatctggtccatgagattcccaagctgataccctgtgaagagagcagagagtggtttaatttattctcatccagccagctccccagcctcatgtggaagagagaaagtttcctcaataagccaccaagcatacatatactagttcactcttggctgtccaggggtgcgtctgttttcatccccagagaagggtagaagaaggggcctctctctaattggaggtggagacatggtttttctgtatagtatgtgcaatctgggtgcctatattttcgtcagtactttaggagctatgttaattctacataaatgaaaaataaatggttatcaacatggggttagtgccgtggttttggcctatggtgctttctgtaggatggtatttttcctcagaacaaaaagctgagatagcaggagggggagaacatgtcaccaagatctgtttcacccctaaattaattctgccttatttacatgtgccactatggccttattcatcaacactttgcagagctgaaaatgagaagcaaacagtggagtgtggtatatggtgctacagatctttccttttgttaattgctgctgaagaaactttctatctttaaagaccctttctgatttttggcagaaaattttgggaaatttctctgtacacagtccctgtttctacttcattgttctgggtggttcagagctatccttccatacggggacatctcaggactcatgagtcactgaaaccacttttaacacatgcttgtccttctttcagtgaatgaaatggtttttagcatccactcaaccttgagatgcaaatactatgagatattggcttcctgctttagtgcgaagggtaataaaaagcccatttcttcctgacctgcatataaaccagcgagaactcctttccaggatgtaacattggccttaagagatattggttgaaccgtcaacaagtatttattgagtccctgctgtatatctaatgccaaaccttagttttgccctaagcctttcattggctgtaatttcttctcattcaaattattagctgtgtctgttgagcatctccaataaatcaggcattgtgctaagtgctttcagtgcattatttaatcctcacaaaacccctctgaggtagatacaggtactaatattatcccttttttttttttaacagataaggaagttgaagtatatgggggctaagcaagttacccaaggtggcatagctagtaaatagtagagccagctcccaaattgcaatctgtctcctaaaggctcctcctgtcaccatcactggagtctgagtgtctatgtgtacagccagacagcagatccattacacttgcaatggaggctttcatcacaggcccctaaggaggaccttgatgagatgaggctcctgctccacaccaacagcaaacctggacttggtcacaacaaaatgagcaggcatttgctagctgctagttcaagcctggggcttgagagccacctggttgaatgcatggaagacctgtctgaattgacttttgtaaccaaccttctagctttctcttcctgcacaaatgccagtagttactacccggtcccaaaatatgctgctgctatcagcagtcttcatctgagctgcttgaggtgggcttcttgcctgcttttggagcttagtcaccaaagatctgactgggggatctgggaattctctagtcactgttaatgaatgagtctgcttctttgtctaccagatttcccatcacaatataaacagtgagcccagtactcagcctatcagctgcctaactatggagatttcagatttcaggaacaggtgtgtaagaaatggaggcagaagatccacattccatttctctcccctattccctcctttcacccactgtaagtgggacacacatattcagatatatgaagtcctgggcaataaacacatggttatatttagtttttgtgccatgtcaagttggtattgaccctatgagcgtcttactaaccactttgtatgggacacctatatattctagtctttcccaaactgcttgtgataaaacagtctctgggagatattaatagggctctgtggtacagatttgcagactgctgcccctctacccctctgggagagtcgctgtgcaagtgagctcactaaaggctttggaggcctacagtaagtaaagctagtaaattttgttaaagccagcaatttcctagcttctgtgaccattgatatctttatttataaaatacctgttaggatacaaaatcagtgtgcaaaaagcacaagcattcctttacaccaagaataggcaagcagagagccaaatcatgaatgaactcccattcacaatcactacaaagagaataaaatacttagaatacagctaacaagggatgtgaaggacctcttcagggagaactacaaaccactgctaaaggaaattagagaggacacaaacaaatggaaaaacattccatccttatggataggaagaatcaatatcgtgaaaatggccatactgcctgaagtaacttttttttttttttttgagacggagtgtcgcactatcgcccaggctggagtgcagtggggtgatctcagctcactgcaagctctgcctcccgggtgcacgccattctcctgtctcagcctcccgagtagctgggactacaggtgcctgccaccacgcccggttaattttctgtattttttagtagagacgggatttaactgtgttagccgggatgatctcgatctcctgacctcgtgatccacctgcctcggccttccaaagtgctgggattacaggcatgagccaccatgcccggctgcccaaagtaatttatagattcaatgatattcccatcaaactaccattgacattcttcacagaattagaaaaaactgttttcaatttcatatggaatcaaagaagaccccatataaccaagacaatcctaagccaaaagaacaaagctggaggcatcatgctacctgacttcaaactatactacaaggctacagtaaccaaaagagcatggtactggtatcaaaatagacatatagactagtggagcataacagagacctcagaaataacaccacacatctacaaccatctgatctttgacaaacctgacaaaaacaagcaatggggaaaggatcaaaggtcaaaataaagggctctattttaaagtgaaatcaggttctgataaatttatcatttgccctagataacattgttttaagtttatcaaggttgaatattcaagtggaatgcttgttttgtgtaatgtatttttcctttgttaactttggcagtaccttttactgtatgttccctagttatagaatcggttcatagattgctcagagctactcatatctctggattcatgtattatgaagaaacaattctgtttcagaccagcttgtgttgattgaatctcaagttttggaagttctcttgtgaggatttcttaaatttgaaaactactattctcaagtagttagggaccataggcacacactaccaaacctggctttccaggttttaagtatgtaagaaaaatgagtttgtacatttgcaatatgcatacagagatatataaagattgtttctacatacaccaaaagcatatattcttttatcaaatgagagagatgaagtataggttttcagcataacatgcagtttagctggctcatacttattcaagcaccactgtgatatgaacatctggattaagttatacaaatggggccctggagttaggaaaaggaataagttaaaagaaacatctttttatttttcatactataggtaagatcaagaagaacctagtgactatatacaaaattaagtagtttgtgtttcacattttcctgtggcaagactagagactagggcatggtcttttggctcagctcagaagaggtgacttttttttgaaaaaagacttatttatagcataaataaccaaaaagcaattaaagtaaactatttcatatagagcagtgcattcttttgtttgtttttgttttgttttcttaagacggtctcgctgtgtcacccagactggagtgcagtggcatgttcagggcttactgcagccttgacctcccaggctcaagtgatcttcccacctcagcctaaagtgttggggattacaggcgtgtgctactgtgcccggcctagagcagtgttaaagtgagagttaaatgtattagcccactgtttgtatcattttaataaatccagtaaattgccatctgtagagtttgtgtttattcttttttttttttttgagatggagtttcgctcttgttgcccaggctggagtgcaatggcgcgatcttggctcaccgcaacctccacctccccggttcaagcgattctcctgcctcagccttccgagtagctgggataacaggcatgcaccaccacgcccggctaattctgtatttttagtagagatgggggtttcaccatgttggccaggctggtctcgaactcctgacctcgtgatctgcccacttcagcctcccaaagtgctgggattacaggcatgagccaccgtgcccggcgagtttgtgtttattctgtaggtcagttctctgccaagggactgtttggtacttcagtagctaagtccttttaatagtgttgatctcatgacagttttcttatggcaattgtgatagagccacagcttcagtgtaactataataaagaaaagattttgggggtgcaagacattatcttttaagttttctattagcaccacatttgataaattggggttccctgcagactaatgtgctcagaattttcctatttctgccactaatttctcaccttatatgtaacaaagttttcctcactagcaatgtaatgagtactaaaaatagcactggaaggtgaaagcactgtgggagaagcatttgatgaatacctttaagcttagagagaccaagaagactcatggaaggggtgagatgaccaatgaaattagttttaaagaaacaacagaactttttttttttttttagctggctaaaagatacagagctttactgcagatttaaaaaaaaaaaaaaaacccaaatgcagagaaacaggcttgcaagaggtcctggtatgtttgaggagctgcctgagatttggaaagccagattgtagggaaaatggctgtagtgttctggaagtggccatggggagcaagcctcctgctcacttccagttccagttctggtagggatgtgggagagaaacagcccctaccaaaggagttctgtctggggagcagaaactgacgggaggacagggttttagcctagtggttctcacccttggctgcacagtggaatcatctgggggagctttgaacgtgctgaggcctggagcccctcccagagattttggcatggggtgctgaggtccggccactgggaggtttaaaaacctctccaggtgattctgaagtgcagccagagttgagaagcactgaattagggcaagaggaaggaatgctcagagaagaggttgagaatatagggaattttattgatgagttcttatagggcacaatgaaaggggttctggagttggggaggcatgaggtcagcttaggggatgtactcagaccctatggggacaagaactcagatcacaaggggcctgggagtcaagggattcttgtggtgactgatgtgaacagggctagaggatgtgacaggaaggtcctgctggaagaactagtcactgtgtgcctcaggtcctgtgtgtactactgtgagaggctagccatgaacacagatggcctcaagaggaaaccagaacaactgtggtccattgagttaattcttcatctaacttcataatctggctagaatcaggtcctgaaagtgatattgaacccaataggaatatggcagtcatgctactctttttcaaagactaattttttagacacaactttttataaaatactacatttgttttatttggaagtaaaaactgcagctcacttaaacttaaatggcagttcgtaggccctgaatttgtgaaatattcaacaccattttaaatactctatccttttaattaatatcctgtcatttaaattattctttccacaagttaatacacagttggtgattcaaaatagtaaattcttctgggagaaattaagagttttagaccacacatacttttttggggcaggggaaggaattcctggtgattatgtaagtctcttacagggctatctaatccatttttaagtgttaattttattaaagcataacatacatactgaatctatttttaatacatactaaatcaatttttaagatagtaaaatgaagtataggttgagtaccctttgtctgaagtgcttgggaccagaagtggtttagatttcacttttttttttttttttttgggaatatctacgttacacttacctagttgaccatctcaaatctgaaaatccaaaatcctaaatgctccagtgagcatttcctttgagtgtcatgttggtactcaaaaagttttgggaggccgaggtgggtggatcacctgaggtcagaagttcgagaccagcctggccaacatggtgaaacctcatctctactcaaaaaaaaaaaaacaaaaattagccgggcggggtggcaggcgcctgtagtcccagctactcaggaggctgaggcaggagaatctcttgaacctgcaaggcggaggttgcagtgagccaagaccacgacattgcactccagcctgggcaacaagagtgaaactctgtctcaaacaaacaaacaaacaaacaaacaataaaaaaagaagaggccaggcttagtggctcacgcctgtaatcccaacactttgggaggctgaagtgggcagatcacctaaggtcaggagttcgagaccagcctgaccaacatggtgaaaccccatctctactaaaaatacaaaaattagcctggcgtgatggtacgtgcctgtaatcccagctactcgggaggctgaggcaggagaattgcttgaacccaggaggttgaggttgcagggagccgagattgagccactgcactccagcgtgggtgacagagcaagactctgtctcaacaacaacaacagaagttttgggttttggagcattttggattttgtattttcggattttggatacttaacctgtattatattgttgtcagctttcaaatatctataagaaaatagcaagaaacattatttaatgtgaacaatagagaaatgtcactgcttttaaaattgcatgttttttttatcaaattaaaactccgtgaataaacaccaaacatcatgaaatctcttgctgtaatatattcaaatgacctcatgtaatatataagtcattgaatcaccttaagatactgcctgttaaagcatatttatgaactttcaaaggtatatacaacatcctaatttttactcatcaaaatacgaatttaatatgtatcaagatagtttctattcatgcatgtattagaaaatcagaaattattccaaagtgaatttataaacgtatatcacttaagatgccaccttcattttcttccaaagtgttactttgttctgtcctacagtgtatgctgtagattagctgaaaatcacaacatgttaatgagtatttcagtgattaaggaaagaagatataaaccaaggctgtaccttcatttgtgatgatgaaagaacatactgaaagctgtaccacactgtgctgaatgtagtaatatgaatgtgtctgtctgtggtcttatccttagtcctgctactgtgtagctctctggctttgtgggaattaagtaagttagtctcatggacctatcgccccttctataaagtaagaagattggactagagggatcctactagtgctaagatgtctgattctattttgtattctctgttcaagaattttttttgtaatatagataaaacttcatgaaacacagttgagggacaagataggttggactaattttctctgctcctccctgctaagtacaactaaaacccccagaaatactataatggaaagaggattttttttttttgagacagggtctcgctctgttgtccaggctggagtgcagtggtgtgatcatggcttactgcaccctcaacctcctgggctgaagggactcagcctcctgggtagctgggactataggtccttgctgccacaccgagctaatgtttttattttttgtagagacagggtcttcctatattgcccaggctggtctcaaattcctgagctcaagtaatcctcccacctcagcctcccaaagccttgggattacaggtgtgagccatcatgcctggccagaacagactttgaaaggtttaaagaggaaagaggactggcatgacagtgaactagagacttcaagtagacagaagaccaataaggaaatagaaagcttgaacaataccatggttcaacttgatataacataactatagaacacccagcatcagcacaatagacatttttctcaagtgcacttggaatattcttcaggatagaccatatgttaggccacaaaacaagtctcaataaatttcaaaagattgaaattatattaaacatcttctctgatgtcaatggaatgaaactagaaatcaataacagaagtaaaatggaagattcactaatatgtagaaattaacatactcttaaaaacacaaagaagaaattataagtgaaattagaaaataccttgagatgagcgaaaacaaaatcatatcaaaacctatgggatgcagtgatagcagtactcggcgggaaagttttagctataaacacttaacattaaaaaagaagagatccaaaatcaacagttagctttacaccttaagaaactggaagaaggctgggcacagtggctcacgcctgtaatcccagcactttgggaaaccaagacgggtggatcacgaggtcaggagatcaagaccatcctggctaacacgggaaactccgtctctactaaaaatacaaaaaaaatgttattctgggcatggtggcgggcgcctgtagtcccagttactcgggaggctgaggcaggagaatggtgtgaacccaggaggcggagcttgcagtgagccaagattgcaccactgcactccagcccgggcgacagagcaagactctgtctcaaaaaaaaaaaaaaaaaaaaaaaaagaaactggaagaaaaagagcacactagatccaaagctagcaggacagaaataataaagagtagagtggagataaacaaaatagagaacagaaaaacaacagagaaaatagttgaaaagttgattttttgcaaagatcaacgaaattgacaaaactttagctagactgaccaagagtataattaagcatgtgttaacctctggtcaaaataaagggctctattttaaagtgaaatcaggttctgataaatttatcatttgccctagataacattgttttaaatttatcgaggttgaatattcaagtggaatgcttgttttgtgtaatgtatttttcctttgttaactttggcagtaccttttactgtatgttccctagttgtagaatcggttcatagattgctcagagctactcatatctctagattcatgtatcatgaagaaacaattctgtttcggaccaacctgtgttgattgaatctcaagagttttggaagttctcttatgaggatttcttaaatttgaaaactattctcaaatagttcgcactgaatgacaaattcaaaaggcaaaggaaatggccatagtgataagtgcaaggagaagagagggtgagaattagtaatgaaataccagcattggaatggaggagaaaagtgtaagcctgtcccccttccttctttttgaaagaagtactcagcattttgctctttatcaataagtgtctttagaattaatcctagtaactaattcaaaagaaaggaaaagttctatgatgacatttattttagtattataaaaataagaacaatacagaccaccttaatatctaggaagaaggcactggtcaagggtaatgtatatctgcctgattagaatattaggcatctattaaaatgattacatgacaaaacagtagaaaagaggggtaacagctgaatacagaggtgtttcctgattgtaccacataagtatatggtagacctttgatggtaaggttttctcatctctgaggatgaccttgaaggtccatggtgcatggtaattggcccctttccagtggtcggatttcgaattacttttacattagccactgttccctccccagtagggttttgagattcttagctgcttagtgaatttctactaactctttttaggggtctaaagggatcgcttaggtgactcatttataatttacctatcttgtcttataacttgtttttataagtttttatattttgggagatgatgtatgtgtagtatttatgtgaattgggatatctgtgaaggtctccagatggttcagtcctaaatgtcaagtgcctactgttaaatacttggagaagactgctaagtaattggtagaagtttaaatggctgttttggtggggaagttatgcagtttttcttttaaaaattttgtcttaaaattaaggattggggaaaagaaaaaaaagtcctctgatatgacaactagaataaaaagtcatttgaagatttaccagaataaaatgacctttggaaactacttttagagaccagctctcagaaatagtgataagacatatattgcataattacattgttacgatgactctagcaattgtgaggttcaaagaaatagtgtactgaagtattatcatctagtcattttttaaatctatgttctttggatagtaaactcttattgccctcactcttaaatagtaattctgctgtgtacagaattttagactgaaagtaatttttcctcagtattttgaatgcattacctcctcttctagcatttattgctgccactgctccggattgtactgtcaatctattttttattcctttggtgcagctttgtctttcctctgggattgcttttaaaagtttatttttactttctgaaggggtgggttgcccctccacacctgtgggtgtttctcgttaggtggaacgtgagacttggaaaagaaaaagacacagagacaaagtatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaagtgctgtgctttagatatgcatacacataaacatctcaatgcgttagagagcagtattgttgcccgcatgtcccacctccagccctaaggcggttttcccctatctcagtagatggaacatacaatcgggttttataccgagacattccattgcccagggacgggcaggagacagatgccttcctcttgtctcaattgcaagaggcatgccttcctcttatactaatcctcctcagcacagaccctttacgggtgtcgagctgggggacggtcaggtctttctcttcccacgaggccatatttcagactatcacatggggagaaaccttggacaatacctggctttcctaggcagaggtccctgcggccttccgcagtgtttgtgtccctgggtacttgagattagggagtggtgatgactcttaactagcatgctgccttcaagcatctgtttaacaaagcacatcttgcaccgcccttaatccgtttaaccctgagttgacacagcacgtgtttcagagagcacggggttgggggtaaggttatagattaacagcatctcaaggcagaagaatttttctcagtacagaacaaaatggagtctcctatgtctacttctttcgacacagacacagtaacaatctgatctctcttgcttttccccacactttcagtgttctgttttgatggcgctgcgatgggtttaagcgtagatttaaatttgtttatgccaggtgacacttggcatgcattttccttctggaaaatcatctttaattttaggacatttagtgatatctctgtgggttttgcttctctacttatttcttctgttttcttctggaactaactatatttctgtcaacacatttaaaaaaaactctagtaatgtgtctttcatcttttttttttcttttttgagacagggtcttgctctgtcacccaggctgtgcaatgggatgatccatggctcactgcagcctcaacctcctgggctgaagctgtcctcccacttcagcctcctgagtagctgggactacaggcgcatgccaccacacctggctaattttttgtattttttgtagagatggggttttttcatgttacccaagctggtcttgaactcctgggcccaagcagtcctcccatctcaacctcccaaagtgctgggatgtacagatgtgagcaccgcaccttgtcactttcatctatttatgttgtgatctttctgggcttgctctggatgaaatcttcatcttccaaattaaaaatcctctgcataactatatagcctagaatttttcctattctgttattaagcctctatcactattctttgattctaggttttataatccattcttttttataacaacctgttcttgttttacttttccctatttttgttttatacccatctattcttttttaggatctattctccacttttaactttgaggattctaaaatacttactttaaagttatttttaacttgttctatttttgtttttgtcaggagcgaatttgccttttttatttggctgttctaccatgctttttggaattttgttttgtaggcttattttgagttggagttcaatctcattctcagttctctgagctcctcactttctgccagttcagtggctgtctctaccaactattcctggcatccatggcctccagtcaagagctgattcttatacttgaaatacagtacttccatctggtgcaggtgtcaggggtcttgtagatggcacccaatggtgcttagcccagaaccaggcttcagtgttatatctgcttcagttcctttcctaagtaggcaacccagagcttctccacaggcttcatcttggttttgcagcttcacaggtagcaaagtgataccttagcctctggcatcagggaatgagcttggtaccagtcccctgcctcatgcgggacatttatttatttttattttttattattattatactttaagttttagggtacatgtgcacaacgtgcaggtttgttacatatgtatacatgtgccatgttggtgtgctgcacccattaactcgtcatttagcattaggtatatctcctaatgctatccctcccctcttcccccaccccacaacagtccccagtgtgtgatgttccccttcctgtgtccatgtgttctcattgttcaattcccacctatgagtgagaacatgcagtgtttggttttttgtccttgcgatagtttgctgagaatgatagttaacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctctgggtatatacccagtaatgggatgactgggtcaactggtatttctagttctagatccctgaggaatcgccacaatgacttccacaatggttgaactagtttacagtcccaccaacagtgtaaaagtgttcctatttctccacatcctctccagcacctgttgtttcctgactttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccgtttcctgactttttaatgattcatgtgggacatttaaatccctgttattaggaactctcagctgcctctgtctgcttctgcaccctctgcctgcttctgcaccctctgcctgacctaccactttgtgatttggccccacagagacctttatcttgcttctgagtgggactgagtcttttaaattttaacagttcatgctaacactctcacatctgtcattgcatatcattttatgtaaggggaagttgagattcagagagcagaagttaactacttgggcctcgcagttggtaagtaagccagcctgctgtagaagaaaagggctggaaaaggtttctggggaagtgctagaaatttaataagcatgtagagagagaaaaatcattcattatacatcacaaaaattaactgtagatctgctaagtaaaagttgattaaatttctacactctgtgcccaccaataattttctaaatgtgaactctttcctacattaatctcaaatgcttatttttaaagtgccttccccagtgcagacttacattcatcttagccaaaatggccttcacatttggtctgtgggacatatttgatgtagcaaaaggccaagggtaacccttattctaccccctaaaagggaacagaaagagaacttttgcataataaataattatttatgcatttcaaaattgattttaagagtacacaaaccatagaggctttgcgattcttcatgtattttattaatttatcaagcacttcaacagagtgcccgatgctcttctagatgctttacaaatattaactcatttaagcctcacaacaaccacgtgcagtgggttctattgctatcctaacattgcagataagtaaacaaggcacagagaacctcagcaacttgcttgaggtcagtgacagaaagaaagagttaaggctatgattcctaccttggctatttagccccagtgtaccagctcctactatactactatgctgtgctgtgaaaccacgtctcacaattattttattaacaatcaaactgacacactatctttgtcagggacacattttatttcatggaactagttaaaaattagctttaactcacttctggtgacttgttttctttcttaggttcttcctcattatattatgcccatgctattgttatataaagctcactctgctggtatcattcttctggaagatgccataaattcatctaatcatttcatcagatgttaacggaatgtgctcactgtaggcccacagtttgctgagaactataggagcacaaagattgtgatgtgatccttatcctgtagttcctttatcctgcgtcaccctctcacagcagtcatgcccaacactatctattctatagtctctcatggttcttacaactgagtcattttctgtgtgtctcatttaaacccatttcttaatgctttattgacacaggttgtaagcaataaactggtcaccatgtttctaataactaccaatatagcccagttttcccctggggggctcagttatggtggttttctaggtttctgagcaatggaatcctcatttctcttctctgctgtcccctatcgcactgtgacttttttttttttttttttttttttttgagaaagagtcttgctccgttgcccaggctagagtgcagtggcgcgattctggctcgctgcaacctccgcctcccaggttcaagcaattctcctgccttagcctcccgagtagctgggattacaggcacatgccaccacgtccggctaatttttgtatttttagtagagatagggtttcaccatgttggccaggctggtctggaactcctgaccttgtgatccacctgccttggcctcccaaagtgttgggattacaggcgtgagccactgtgcacggcccacactgtgactttaaggaagcactcctgagggggtcaggggaggagcagatgtggattgggaggatgcccaaatgtgctactgtgctaatgggaaaggacaatggaggacaaccaggggttgggctcagggaggcagcttgacagaggatttaagagcatgggcttggggtttcaaatcctatctgcctcttactggctttgtgactttgggcaagttagtctctctgtgcctcaatttcatcatctgtaaaatggggatcatggtagtatccattttcatagggttatgatgattaaatgagtgaagatctctaaagcacttagaatgatgcctggtgccatagtcaaccctcaataacatttagctgttataattatcatcaccacaggcctagtgaaacagaggtggggtctagttggcaaacacagaacagactccagatagctagaaattagttgcaaccagcccagaatgagtgctgaagtggctcgctaaagcacttgcagtcaaagcacattgttaccctcatctgtgacctttcatgggctgtctctctgcctatgtcaggggttggcaaactatagcctacaggccaaatccagatggtcacctgtttctataaataatggaaatgtgaaggagaatcaattggcaagaggcacgcatagcgcatcttcaaccttttccatcggggaacatgagtcttgagaatcctgccatagatcaaaagaatggcaatgagaagaaccagtggacaggtggataggcctccccatcagcctttaaccctcctgctcttatctcaaggatcatatgcccgtgtctgtggtttctgatttttccttgaggacctttgaccgagatgatctgtctttcagactttactagcaaaattctgagcagtatcttttatacaactggcagcttcaaaggcttgcagtgggtaggcctccccaactctgtttcgcaagataattaaaagaagccagactccttcatccttgaaggagaggaagaagaaaacaagcctgtccagagaaaatggggtgaaggaatttttctccccaacttcctcctaaataccctgctctgcccatcaaattttgtaagtatcacccagtggtgtgttggtaaaccttctcccctgcggggtgggggaaagccccaatttgcagccgttgttgctgtctgtgttgtgaatgctcccaccatgctgactgcaagtggagctgggaagagatgtgtaccatcggctcactaacactagcatgctctgtggtagacagcttcccttgcctctgaatccttgtgtcaggattctacgtgccaggcaacaagagctttttttctttatgtatcatgccagtgattttagtctagggcactgttttagcccaatcccagaatgtgctattagaaatggggccatatttttgaagttgctaggggcaaaacttccctcttgtttatgtttaacttgtgccactaggtggcactttaaggacattacaggaaatcggctctactggatttttaaaacttttttttttttgagacggagtctcactctgtcgcccaggctggagtgcagtggcatgatctcagctcactgcaacctccgcttcccgggttcaagcaatttagctcactgcaacctccacttcccgggttcaagtaattttcctgcctcagccttccgagtagctgggactacaggcatgtgccaccacacccagataatttttgtattttagtagagatggggttttgccatgttggccaggctggtctcaaactcctgacctgagttgatctgcccacctcggcctcccaaagtgctaggattacaggcgtgagccactgtgcctggcccaaaacactttttattgaagtataattgcatatagaaaagcaagctgcacatttaatgtgcaactcaattttcacaagcagaacacatgcatataatcagcacccaaatcaagaaacagaatattactagcaccccagaagccctccttgtgctgttttccagtcgctatctcttattcttagggttaccactattctgacttctaacagcataaattagtttgacttgtgttctactttatataagtggaattatgcggtatatactctgtgtctggctttttattaaatgatgtttgtgtgatttattcatactgttgtgtgtaattgagatcattgctgtatagtattccattgtatgtgcaaatataacactgttttctactattgatggacatttttgtacttttcagatttgggcaattatgaatagtgctgctgtgaacactcgtatccaagttgttgagtggatgagtgttttcatttctcttggatatatacctaagagtagaatttctaggtcatggtgtaggcatatgttcagctttagtaggtactgccaaacagttttacgaagtgtttgtactgatttacactccattaatggtgttcccactccagttccatgtcctcatcaatgctgaatttattttatggatggttcctaactcttaacataatttttatagctccctttctggccagctatttctaattgaaaaattttaaagccacattattctgatggacatggctcatgcaggaagggctatgtcaacccaaaaggggacatttatcacagtctaagtgtgaactatcagtaagtcggaaaggatgttactctaatactccatcacactgatacacagagcaaagaaaccaggaaaggaattcagattgtaagtgtgataaaatatcggttcataggccagggctctgaggcattttgaaatttgtatatacatttgttattattgccaggcctatatatgtcagagattggggcccaacagaaagaatttctaaaggcctcataatgaagtgcctttcaattgtgctgctggtgggtgcctgttttactaagggtctctttggtttggcaagaggcatgcatggggcatctttcttcaacctcatccctggggagcgtgagtctctagagaatcctgctttagatcaccttacctgtgaggctcatgttgttgactctgcagatggtgttataatatggctttaggtatgtgatatagagagtacagttcagacttgactcagatttctgttccattactagaaattggacatagaagaacaaaacccaggtcatggtcaaaatatttgtcttttagaccaaaataaagtgctcatagtcctttagttgtaacagtaagtctgtctcatggatgttgtccataatctaatgggttccaagaatccccaaggcattctgccatgtgactcttgaatccagcaactagttgcccattatagtcactggtacccactttcaccaaagttgttcctgagcccctctgtcagtgttttcctgagtgtctccagtgttggattggtctaccgaggggggtgcccaccagagatgttcactgcacactgcctgagatatccatgttaaagcagccgtgaaacatgaaagtctgaccgggcttttatttttaaaattttctccccccaatattagtagcggtaatatccagtggcacagatttagactgtggatagcctgctttgtgggatctgcttatattctaaattggagccagcattttctcagcctaggttttcatctgtttggcaaggaggaaaatgcccttatgttggattggctgctgcttgcagtaggaggaactatgcctgggaaaccaatcataattttaatcctaatgataatagtagctgctgttgtcaaacagttactgtgtaattgtgcttagcacactagacagatattttgcttaatcttcacaatattgtgagttaggtgaattatcccactttgcagatgaagaaattgcagctcagagagactaagcatgtgaccagctcacacaatgagcaactgcaaagcctgggtttgactccagagcctatatcctgtaactgttctgtgctctgtgggtgcagttaccaaggaatgaattactgacctcttctccagtggaacatgaaacagtattgggttcattgctggcttattccacacattgattagaggacctgttgtttgctggcatgcagcttaggtatcaagaaaatgatagggaagcaagacagatcctgccctccaggtgcttaccattcgtttatcatgttctgtctctcacaggtgacttgagtcatggattttggtaatcattcttgctgagaattcagtctcttggaccttcttgaggctctatttacccctctctctgagcctggttggggaatgatggggtggaacagtggtgtgctgggccattggttctacatcttctgtgactgggtttagcaaatggctttctgttgtgttcttgcctagcggagatgggggacaggtgaaaactaggcaccaaatgacatttagaatactgacagaatgctggaaaggccctggaggcagcagcaggattgtcttcttgtctgcctagaatttagctgctgcctttgtgatccccattcttggaatccacctggatccttggatgataaagcctgagttcgtttttctgacctgccaatattgcaaacctaaaaaaaaaaaagttacctattatccacaccttggcaaagttctacagatggacttcttttttttttttttttttgagacagagtcttgctctgtcacccaggctggaatgtggagtgcagtagcgagatttcagctcactgcaacctccgcctcccgggttcaagtgattttcgtgcctcagcctcctgaatagctgggattacaggagcgtgtcactacgcccagctaatttttgtatttttagtagagacggggtttcatcatgttggtaggctggtctcaaactcctggtgtcaagtgatccacctcccaaagtgctgggattactagcgtgagccaccatgcccggccagactattttttaagtgggatttgactttttttttggttgcaaatttgacttttaaacaaaatcttactgctgaagattttgcccagctgcaaatatttatctatagaaccatgtggcatatacccccattccctctatgatgaatggatgagaaaacaattaagaagcctagttagttttgcaagagcacctgtggccttgcccagactagggccttggagacttggttttctcatctcttaaatgaagagtttggaccatcagtggttcccagttgatctgggctggctacataaaaatcacttagggtgcttgttaaaatataagtttctaatgccccatccctaagggattctgatgagggaagtctggaatagcatctacaaatctgaatttataaaaagttccccagataattatcctgctctggttatatttgggagccactgggctagagggtctagaacaaacataattaagttagggagaaacttctgatgtgcttgaagatttggggaatacctatatgcctggagcaggttccatatgggcgaactaacccagttatgttgcagaggtaaattggagccagaggatggaagacctttaactggctgagggattgtgttgtgtgccataggctttggggagccagtgaagggctttgagaaaaagcattttgattagatggtgctttaccagattaatttctcagtggtgtgcagggtggatcagagtgcactagaactgaaggctggaaaaagacccagtgaagtctttgcagtggcccaggtgataagtgtgacgagtacctggactcagatgggaccagtgggacctttgtaaagctaacctgcctcagtggaactggaatctgagacatactgttttaaactccttaaaaaatgcataatttattaatgtcatgttcatctgcctaaactattataattaactatttttattgtgtttttgtccaagaggttttaaaggagccctgtaaataaattcatgcaaagaagtagttggcagcagcaacagctgctaccgcagggagaagggacccccttctggccaggcagcaacctcattctcaccctgtctccatactctaagccaaagcgagaggggaggggagtgcaacaggggcccctggagttggatctgccaaccacagtggagaatgcacctccccaagggttaggtgtggaatatggcgtttggcattaagtcaaatagaatattcttcctttgttcctctaaaatccagtctatagtcaatgtttctcaaagtatgttccacagaacattagttcttcaggatgttaatagaagttacatgagaataaggagatgaaaccaaataaatttgggaactgatgggctacgcaaaggcaagtgacttcctttcagaatttcagagtgtgtaatgttctgtgtgctcagtgaatctccaagagggagatagaccaggcagtgtttcctaagcttatctgtagattcttcttccccctaggccaggggctgacaaattatggctcataggcctcatctatcccaccactttttttttgtaaataaagtttattggaacacagttgtgcccattcatcgtattgtctgtagctgctttagcacaacaggagagttgcagagtggctacagaggtagtctggccctcaaagcctaagatatttactatctgcccattacagaaaggtttgctaatccctgctctagacaattcatggaactggtgcttcctggtaccccctttcagagatgctactagaagaagatatacatgggttgttctagcactgctttatgataaatctgcctcattttattctgtttccatactgccatcattcctgcctcttgctttaaactactttatctctcaaccatttacccattatccaggatccaaacctgggttccatgtgtccttatcttttcttgcactcacaacattccaaaaatggccaagggtgtcttcaatttccagtctgggtagctcttaagtcagcccgaacccattcctaccaacctggcctacatgaccgtcatcttttctttttcagcattcgaattaggttccttttccccagatatgagttacctctagtcctttttactcactgaatctagaataacctttgtaaaatacaaatctagtcagattgattccttacttaaaatccttcagtggtccctgtggccctcaggataagctcagatcctcaggatggatgtgtgtcagtctggttgggcaaacagaaactactcctggtatttcgtactggaagagatttaatttaaggaattagttacttaagaaaaggagtagatatttccaggcttctgcctgctgtggcatagagaagggcatggaaatgggggatggtgttgagtgtttagcaaatgacccagaacaaaccaggtctgggaaaccatgtgttatcccctgctgcccttctccagcttcagctctcccatttttctcctgactcctcacccttcctccaccctgcaagtccccaaattctagatatatcaggatgcctttttgtccccccagaaacttaaaacaactgacatttacgaactcacagtctctttgggtcaggaacttgggagtgacttagctgggtggttcggggttacatcctctcatgaggcttctgtcaagatgtcttccagggctgcagtcatctgaaggcttaactggagctgatgatccacctctaagatggctcactcacagggctgttggcaggaggcctcacttctttgctgtatggaccccttgttaggactgcttgggtgtcctcacaatgtggcagctgactgtctccagaacaagtgatatgagagtgagagatagagatagaaacagagacaacaaggaggagcatactagagtgctttcagtcccctctcctgggagtacgttgcatagtgtctcaggtcagcttccctagaagcagaaccctgagatgaggattcttcaaaagtgatttgttgaaggagtgctctttaggaaaaaacctagaaggaggagagggaagaaaagtagggaaggggaaggagccaagcaatgatatagtctcagataaaatctgaccttggcctgatccacacaggcaggattctggtacataattgcataatagagttaaccctgtttgagacaggggactggccttttatatccttctctaagtcagtcattataggctgctggaggtgggggtgggaggtaggctcccattagttgagaataagtctctagagaagagggtggctgtgagtcctcagtagctaacactcagagcagctgggggatggtgtgccagccagggaaaggtgacccaggtggggccaacacagcacctactacagtgggcctccccgtacccatgtcccaagcacctaccatggtccctgacataccagaggtacgaaaaaaatatctgtgtaattgaataaatgaatgcatagaaatgcttagcctctctggacctgtgtccatttctgggaagtcagctcagcagggatcatattgtcccatcaaccatgggaatggtcgaagacccaggacagtttgccacatcatgagtggcagcactgtctaagtccaggattttcattgcaaaattagagtgaaagtatatttgccatttgtgaataaggaagtattaatattacaatattatatatttttaaaaggaactttagctcacatttcagtgagctctttgctaaaagtacattttcctggtttgtcacatcctgactgggtacatgttgttacacatggaaccgtgagggcagaactgccatttgttatattaattgtaatccatatatctgtttttttcccacaagaatcagtcactggatttcagttcagaaaaccaaaactgtcggacaaagccatattatcgtgttggcagagttgttccccatgaccccaaatacacagaggaggaagagaaccactgaggccccttgttttcttggattatcattcttccaaagttggtaactaagaaaagtctcaagaaatagcaaagaaacctccccaccttattctgctttccacatcccaagcctaacataagcctcaaactatttttatgaaggaaagcttattgtgaagagggtcttttacatgcctaaatctcatctttagtttttcttatcacacagccggttatctttgcccatctcttttcctgggataatgtctggctctgtcaaggctgtgccttattctgggaccttcctaatgcctgtgttccaggtccctcctgagattcgctcctccgaatgcttgatagatggatcaatttaggggattgatggtcagatttagcctgacataacaccatgcagtggtctgttaccagacatagagctggaaaacccaggcccttgcatacaagttcaggaaggtaaatttgcaaatgaaaaacattttaagacacatctcacagctgcttcctcatcccccaccctattgtttgtgtttttagagatgtttaagagaaaaggaggcaataacaaagacgctctgctgtgctttggaatcctcatttatgttgaaaaagggtccatttatcatctccttggatatttccacaaggagactttgctcatctcaccagggaatggagtggtagagcaaacacttctctgtccacctgatgatggaggagaaccaactaactgaaaggcagagagcctgaaattattatcctctctctgcctgcctgctgcaagatattgctgcatacctgtggtccctgcaggaggctgcatgcgtagacttgggccagaacatatattaccttccaagcaatagatttctaggtaaaaggcaagaaggggcctcaggttcaagttgcattcttcagtggggttcacaggaggccctgcattcagggggttactgggccctccttcagctgttaataaaactgacttttggctcatagagcttggagtatgcgtccatttgtatgaacctccagggaaagcagggtgagggcttgtgttccctagactcctggcagtgaatggctcctggacagctttgcttggttgtttcccaggtacttcaaactcaatctgcctaaagatgagttccccctcactcctgcttctcctgtgtttcccatcttggggattgaccttagtgttcttgtggtagccctggctgaaattatggatgttggagcatgggaggccctttgtgaacttacttttgggtctttctcaccattcccacacattgctcttttagcccaggcctcagctgagacatcacctgctcctgagtctttgccgacccatgagactgggtgcttctgtattccccatacttgccctccacagtccactgaagcaagttggctttgtcacttccctgttgctcccactagacttcaagcttctcttaagcaggatctgtatcttgttcatccttgagtgccagtgctagcacagggcctgcctgtagtagctgcttaataaatatgtcttgaatgagtaacactcaggcctgagaatacctgagactgtatggcatagtggttataagcttagctttggaaatcaaggcctgtgttcagactctgctatttgtgtgattttgggtgagttccttaacttcttgatcttcaatttcttcaccaataagatggggataataactacttcctagggctgtgatgatgaattgcaatgatccatgcaaagccctttgatcaatgtatgacacatagtaagtgttgtgtgcatcatagtacctattagtaacaacaacaacaatatagttatcgttaatggaagggagaaagctataagaactagttggaactagaagtcaggaatattgagtgcttgcatagtggatttagaggagatggggaattgcttgggataaaatgtaggaacagatgggattaccctgggagagaatgaacagggagggaaaaatgggtggagcaactaaagacagaaccttgagaaatcctacatttgagggataagaggagtcaaaacaggaaaaagagtgaatgactacagttaggagattgcagcttctcagatgccaggggcaggagtttaaaaaagatagtcaaaggtgctatactgggcagaagatcaatgaggagaagacgagaagaggtagccataacgtgttaaatgggggtatgttagcgcccttgggaactagccatttcagtggagtcagaggaagaagccatgctctgaaggaggttagagaaggccacgttagggatgaagtgggcatactaagtcagtttgttgtgctacaatgtgtgtttctgtaatgaggattatctgtgggtcagtagatgactggtgtcagtatgatgtagaagtcacattggttcatatgtagggttcattctcagcacatgaatgttttggcatcactggctactagtggctgaaagcagactaacacacctgaaggcagaagactgggggaaatgggggacatagagagctgctcatgaggcgcagtcaccctgtgttcttccacttgactgattggcacccactctgtcttgaagtgctttggggacattccttgccaatcttggtgagtttagtcactgattccattccactcagcacccttgacccttctgataactccttcgaccacagtcccccttccttttttaagaagggccatatttactagagtttttttttttttttttcccaaactgtgtccaggtttattaaagatactttttgtgaacagtcatggtatttcaggcaggacatgagcgacaatcattaacagtatacaactttcagactccctccttcaatggacttccaaaatcagaaagccatggtaaaacccaatgaagtcttcatttggtaccctgaagagggaaagttcagagtgagggttgacatttcacattcaacgtgctgtttaacaacttttcatgagctgaccctgactttcaggaaatgaaatgaaaatggcagaatttatctgaagatccacaatctagaaacagagcacgtgtctttcaagggttctcgctggaaagtccagattgccagcctgactggtaaccagttattgggggccagaccccaacaggtatctgggtttgagggagttaagtgtatactgaaggcagagagggagagggggaaataaagaggaatttgtttctccacaccacaaggcctttgtgcgaaggtgactgtgtgtgtcaacgtcagacagtccctctttctgggagccaagaagatgtctttaaaactagaagggaaaggtgttttctccacatcagtccagcttcatagacattctttttcttttttttctttcctgagacgaagtcttgctcttgttgcccaggttggagtgcagtggcacgatcttggctcactgcagcctccgcctcccggcttcaagtgattctcttgcctcagcctcctgagtagctgggattacaggaacccatcatcacgcctggctagtttttgtacttttagtagagacggggtttcgccatgttggtcgggctggtctcaaactcctgacctcaggtgatccgcctgcttcggcctcccaaagtgctgggattacaggcatgagccacggtgcctggcctcagagacattctattagtgacatataccccttctccataaaacaacaatgacgtgttccgtgtgctaacaacatggcttaaaataaaggcataaaaacaattctgcatttttataaaacttaataaaaaaataatacttcaaactgcacagtcaccagaaatacacagttatcaaaaatgcacacacttcccttggcatccccagcgccttcaactttctgtgcctgctctgttttggcctctgcattttctgcagagttattcccctccttgccagcatgggctttttcctttttcccctttaccttctctcccttctttgcaggggcctctttaggcttgggcttcggaggagcaggtttggcagacaaccttgcagatcttctctgtggtttgtccttactttggttttatctcctttagcgtccccttcagcctttctcttgggcatggtggaggcgactgcagtggaatgtaggtgctggatctggggatgcagcagtgcgtgggctttggttggcctgggggatagttcttacctcttcttcttcacactgctcatagagtatttctttattagaaatttaacatttaaaaaattcagtgtttttaatgatgttgattgtttttgttggtgctcaagttaaaatctttgttttcaaccctgtttttccgataagccttgttacttttagagtttgttgttgcgaagcattagttttttagcaatacatatgttcaattacagaagaaattcccatgattccttttcctaaggttgaacaatctgggaaggagggatgggaaggttaatagcagcatctatgggaggtttttcccaaggatcagcagacttaagcattcttggctgcaacttggcctaaatcagttttcccttggtgactatcttcctaagtgctctttattgtatatttaggtgattgtggttttgcatttctgtcctctctctgatctcttgctacagtctgaacaagtgtcggaggccgagttactcccacagctgagcagagccccatcccaggctgcagaaagtagtccagcaaagaaggtaaggtcagcctgaggatgctgtcagatggcgttgcgagtcccaccccgggcttcttatctctattagctgatctattgttttaaggtttctgtgtcctgaaatgaatgtcaatgatccagatttcctagaatgtgggttctttgtgaagattggggtcctgaagattcctgggcttgacccttgatgcattttgtacatgacagtacatactcaacctccttagccccccagctaaacatggtggccttgtttatggcaagagctaaaagggctgtggggagggacagatgtctttagcaaaaccccatccacctgctaagcctctgtgaatacctcttggggtggggtagtctctcctttttggtctttgtaccatggtttcctcttgcatcgtggcattttcacctggcatctgcccagccatgccattgggtcacctgtaatttgctcagtaagtacccctcactcatcatgctctccattcatctcctcaccctcttcttgtccttctcccaggctcttctttcagagagagtgggccttgggctcaggagcacaggtgaggtagagtcctccaaagaagcagaccaactgtgtccttccagaatacactgtggctctttttcttgactttatgtaggaattggggataggagaatgatgagcatatgactaagacctttaaaaacttccaaagcttaggtttttttttgtttttgtttttgtttttttttcctgagacagagtctcgctttgttgcccaggctggagtgcagtggcgcgatctcggctcactgcaagctcccaggttcacgccattctcctgcctcagccttccgagtagctgggactacaggcatcttccagcaggccggctaattttttgtatttttagtagagacggggtttcaccgtgttagccaggatggtctcgatctcctgacctcgtgatccgaccgtctcggcctcccaaagtgctgggattacaggcatgagccactgcgcccggccaaaatttaggtttaaaaggcttcaaagtgaggcaggagcctatcttgtcttcagttaggaaaggccccatggtgtgagatgcacacagggtctgtgtgagtttcaggtgacaagaagtaatagacttcttgaaacatttaaaaagaaaaagaaaaaagggaagaccactggactctgatgcctgtgtccccccagttcttgctgagccatgggtcagtaaatagagtaccctcctgatcttggggttggggctaaaggcatgtgggacactggaaggaagagtggagggaacattgaaatgtttaactttttaatttttattttgttttaaatccacaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagtaagtagaccacataaacaagagtgaggtaggaatctcgctctgagatgtcgacggatatgtaaatgtgttgacatttacgtgcgcaccaacagaaggatttcatggttgtaagtttatcttgctcatctctgtgatgggattcaagtctcccagtcacatagaaggctttataagctataggacttaacctgacctaaaggggcaggcgagtcctaggctgtggtgtttggtttggtttgatttctttcccttcctctcaccttctgttgtttcctactcctcttccttgtgagggcccaaattttcctggcaagatgaaagtattgtaagtggcaattttgcctctctgcctgtgttatctccttttccttcagggcaaatggctagctccttcacccacagacacactttcagtaggtgtggtatgtgattcttttaaaatctccgtaaagagtttctgttgttggtcgcctcagcacagaatggatacatgcagaacttccattatatttatctaaccagctggaacaggtattggagggagggtgaagacacctgtggacatggccagggactgagacaatgatgctctggacaaactatccttctctgtaaaactttggctttgagaagagccatcacttgcttcaatttctttgtagtgaaattgagggaggtgttgaggacagaaacctgctcctgtcacttgactgcaagtgagcctgaccggtcactaacataaatgctcaagacccatcatgaccctgcttttggggtcttgcaggtctcagatgctgctgcagattttcttctgcttacacgttgtagaatgaaaagcagcaggttctgtgggagatgttagcaacttgtctttgaagccaaagtcccattctgaatctctgcagccctctccttcagaagattttctttttttcaaatggacaggtccctggtggtatcagtccataaaggaagtatattttgttcatcacattcaccgagaactttgaccatcttccagcccctgttaagcctggaaggtgaagaatccctatcagggacaaagatggctcaattttcttccatgttctaccccagcactccactttaatttcagctttatgttcattttagtcagcagtggcttaacagtctccagagtagatgtcagggcatctggtggagttcatacagagatcttttctttttctcttttttataacagctttattgcaatataattcacatagcatacagttcatgtttttaaatgtacaattcagtggttcttagtttattcacaaagtcatgcaaccatcaccacaatctaacttttgtcatgcctaaaataatatatatccacgcccattagcaatcactccccattctctccttccccctcagcccctggcaaccacgaatctcctttctgtctccatggctttgcatattcttgtcatttcacataaatggaataatgaaacgtggtcttttgtgactggcttctttcacttagcataatattttcaaggtttatccaagttgtagcataaatctgaacttatctttttatggctgaataatattccattgtatggatagaccacattttattcatccattcatcagtcaatggacattttggttatttctgcttttttggctcttaagagtaatgccactatactgtttgtgtacatgtttttgtgtggacttacattttcatttctcttgggtctgtacctaggagtggaattgctaggtcatgtggtaactctgtctttaatatttcgaagaactaccacacttttcatagtggctgcaccattttatgttcccgttggcaacgtatgagggttccaatttctccattttgtcaacacttatcttttttttttattatagccatcctagtgagtgtgaagtgtgatctcatggttttgatttgcatttcttttgtggctaacgacattgatcatcttttcatgtgcctattggccatttgtttatcttctttggagaaatgtgtattcacaccctttgcccacttttaattggattattaatctttttacttttgagttatgaattctttatatattctggatacaactcccttgttagatatatgagaaaattgagccctctttgtaaatattttctctcattctgtgggctgtcttttcactttctattttttatttttattttttagagacaaagtctcactctgtcacccaggctggggtgcagtagcatgatcatggctcattgtagcctcgaattcctgggctcaagtgatcctttccccctcagcctcctgagtagctggaactacaggcatgagccaccattcccagccaatttcattttattttttatagtgatggagtcttactatgttgcccagtctggtctcaaactcctggcctcaagtgatcatcctgcctcaacctctcaaagtgctgggattacaggcctgagccactgcacccagccaattatcaatattaatcagatctgtacagtggtcacagtccattctagttcagttgctcttttctagaacctatctcccagtaatggcacatatggctgtttttctaggagaacatcagttgctcttttgctctaagaattcggtgtttcttgctgtgggatgaaaggttgtagattatccctgtggtaactgcactgatttatcatcccaaccatggacggttttgaaaagtaaagagagtgctaatgtacttatgctggacagacagttttaaatggagactgtaatgggcgcagtaggatgcgtggtcactctggttatgcgtgttctgtgaatttgttgttaattgggaaatactggtattaaaacgttctgtatttttctcaagagccacagatatatgctggtccatgcacatacacgagtgcacatttatgcacacacacacatatacttaggcattcatgcctaataatacataaggtagaggtaggtagtctggctaagttaatgtagaatttttgctaaaaataatgttcttgtattattttccttcagacttgttcacaggggacacctgcaggtcttctaagtgctattaattcttacacaaaaagggcattccagttaatatggtttgtcaggaagaaatacttattaaaatgtcttggaataaatggaacacaaatgtttgaaaaggcccatttcacagcttttattcaagttataaaatgggaattacttcaggtgtaaataattcatcccaataaatttgtttcatttggtgtctatcttcctgaccgcctgtgaatatgagattttatttttggagccctgtgttgttaaccacttgttagtttaacacctctcatgaatcagagttctgaccctcaagggtccagacctctaagtcctttttcactgaagtgtttgtgcttttctataggcagtcttccaaacagaagaaggccattcaaactgctatccgcaaaaataaagaggcaaacgcagtgctggctcggctgaacagtgagctccagcagcagctcaaggtaaggaatgagtcccagatttggatgaccaggcttttccctggcttttaaaaagcttttttttaatttaataggcatataataattgtacatatttatagggtggggtacatagtgatgtctccatacctatcatgtacagtgatctgatgtgtccattggctgaccatttagttccatccctgttgataagacttgcctcttcgttctcaaaccctttttggaaggtggagaattactgtatttaagtttcatgggttggttcttgcatagtcagaggaagactagtgactttaatatgtaggcttcatattgtgtatgagttaaaaggaaagacaatctattacgaaggctgtttgaagcattctttattatccaaagcttctgggtaagcccttaattatttacatcctctctgaaagaggatgtaaatacttatttcagtagaaggaagtcaccttggtactatcaaagcccagcccctcctctggtgccttgcaaatggttccatttcaccttctcaatgacatcacccctgtttctcttcatcgttactctcccctgtgttagtttctcggggctgctataacaaaatactacaaatgtggtggcttaagataaccaaaaatgattctctcacagctctggaggctagaactctgaaatcaagatattggcagagctatgatctctttgaaggctctagaagatgatccttccttacctcttcccagcttctgatgttgctggcagccctgggcattccttggcttgtagctgcgtcactccaatctctgcctctgttgtcacatggccttcttcctgtatctctctgtgtctgtgtccaaatttctcttcttattgtatcctcttataaggacaccaatcattggattaggacccaccctaatctagcatgacctcatcttaacttgattacatctgcaaagaacctatttgcatataaggtcacatttacagatactgggggttaggacttaaacatatattttgagaggacatgattctacccactatatcccccagttctctactggatcattcgccatccacatgtaaatatgctccagtattgtccattacacttggccaattactgcctcatttctttggtccccttcacagcaaagtttcttaggagtggttttattcattatctttactttcaaaccagtaattttctcttccttccacttcagttggcttcgtcctcctccactcacacccgtcttgtggctaaatccaatagggctgttttaatattattatttttttttcagaagaattctacacaattgatcatttcctcctctgaaatggcttttataactggtttttgacataccatactctcctggttttccttctgcttcactggtgcttcccattttcattctctgctgtctcttccttccctgacttaacttttataccccaaccccatttgccccaatattttagtatgaaaattttcaaacatacaggaaagttgaaagaatcataagtgactgcttgtatagacatcacttcagttctacaataacattttactatacttatttttaatcacatatctacccatttatccttgtgtccatcagttcatcttatttttgacatattttcaaataaattgcagatatctgtatactttccctgaatattttagcatgcgtataattagctagagttcaatatatttttacagttttttcttatgatgtaaaatgtttatacaaaatgcatgcacaaatattattattattattattattattattattattattattattattattatttgagatggagtctcgctctgtcgcccacgctggagtgcggtggcgtgatctctgctcactgcaagctccgcctcctgggttcacaccattcttctggcttagcctcctgagtagctgggactacaggcgcctgccaccacgcccggccaactttttgtatttttagtagaggtggggtttcactgtgttagccaggttggtctcgatttcctgaccttgtgatctgcccgcctaggtctcccagagtgctgggattacaggcgtgagccaccgcgccagcgcacgcacaaaccttaagtgtacatttgctgagtttgtaacaagtacatgtacttacggaatccaaacccccaaaaagatagagaatattaccatcaccccaggaagctccctcatgctttttcctagtcaattcctgccctacccacacagaggcaatcactattctaatttttataccatagttttgcctgttctataactttatataagcggtgtcttacaacttatacttcttgtaaagcttctttcactaagtattatgtttttgagattcatttatattgttgtgtgtatcagtaattcattcatttttattgatgagtagtatcccattgggtgaatatgttacagtttggttatcaattctattgacagacacctgagcggtttccagtttttggcaatttggaataaaactgcattttttaataagtctctgtatggaaatatgttctcatttctcttggattgggattcgtaggtatcatggtaagtgtatgtgattagtttctgagaaactgctagatcattttccaaggtggttgtagcaatctgtactcctaccactaatgtatgagagttccaattgttccgcgtctttgccaacatttggtgttatgattcttattaattttagctagccctgtagtgatatagtttttatcatctccttgctgactaattatgttgtccacttttctttgtgattatttacctttcatatcttactttatgaaatatcttttcaaatgttatttttctccaaagtagtctatagatttattacaaaaccaataaaaatcccagcaggattttttgtgagtatagacaagctaatcccaaaacttatatgtaaaggccaaggagctggaattgcttaaacaaatttgaaaaggaagaacaaagttggaggaatcactttactgtcaagctccagtaatcaagatgctgatgcacaggtcagtggaataggatacagagtcctgaaatagaccacatgaaaacagccatttgatctttgacaaaggtgcaaaatcgattcaatgagaaataatagttttcaacaaattgttttataacaatttgtcatttgcatttaaaaaaataaccttgatctaagcctcacatctatacagagattaacttgaaatgagtcatagatgtaaatgtaaaacatagagctataaaatttttagaagaaaacagaaaaatcttcatgatctggagttagaaataacaccaaaagcacaatctataacagagaaaaactaaaaaaattggacttcatcaaaattaaaaccttttattttgccaagcacagttaagaaaattaagagacaagctgctgagtgggagaaagtatttgcaaaacacgtatttgataaaagacttatatctcaattatataaagaactcttaaaactcaataataagaactctcaaaaccaaagcatctcaatttaaaaatgggcaaaggatttgaacagacacttcactaaagaatatataaagatggcaaataagtacatgagaagatattcaacatcattagccatttgggaaatgcaaatttaaaccacaattacataccactatacacatactagaattgctaaaacaaaaaatgtgacatcaccaagtgctggcaattagaactctcatttattggtggtgggaatgcagaatggtaccaccactctgaaaaatcgttcagcagtttcctatgaagttatacatacactaaccatgtgacccagctgtctctctaccttagtgaaatgaaaatttatgttcgctcaaaaatctatatatgaacttacatagcagttttattcatgatagcccaaacctggaaacaacacaaatgtccttcaaaagatgaatgaataaattgggatacattcatacaatggaatagtactcaacagagaaaagaaatgatacacaacttggatgaaactcagacattatgcagagtgagacaagccagtatcaaaaggttgtgtactgtatgattccttttatttgacattcttgaaaaggtaaaactatagtgatgtgaaacaaatcagtggctatcaggggttatgcatgagatgagagtttgtatgagtagtcccagggaacttttggggttggttgaactgtaatgtgtcttctttgtggtggtggttacacaaatctgtacactaaaagaaaaaaattgttttaccctatgataattttaaaaagttattttttaaatttcaaagttcattctgttttctaaaactttgtatgtgaacttgttttgttttgcattttgtttggttttggttttctcctctctccctctgctttggggtaggccagtttcatccattgttctctacatttggtgggcccttttggaaactgatattccccagttctgaagggttttttattttcatttttgttgtcgttgattatttcctcccccctgccctcacccccatttttttctcattctcccttactgatattcagacattggacttcttagcttagttctctaattttctcatattttctcttctgttttctttcttttctcttcctacattttcttctttatttttgtctatttctggaaacttaattatatattctaaatcttctgttgtttaataaccaataattttttgttctctgtttatttttgacggtatcctattcttgtttcattgttgtgatcttttttttaattatactttaagttctgggaaacatgtgcagaactcgttgtgatctttttttatggtcatttttctttcttcttcctgaatagtttgtgtttgttgtgttgtgttgtatgtgctttatcttagatgctttcctttgatatctgatggcccttctttgctcatatttaaaaggaagatgaaaacactgattagaagttcattgtacgttgtaaggcttgtcaactctgagcttcactgtctggcaatttggctcggctgtatagttggggaacccccaaagggagtatgattagctctttcctcttggtctggttggagtgtccagagtggagactgttttggtcacctacatggagggatagagttggttcagtggagcaagagggctgtaggtctcagcattccaggatattcattcactctccctatttctggcccagtatcttgtcctcaactgtgcttgtttcttgctaatccagatgctctctgttgtaccttttcaagaaataaaccttcagcattctgccctggtggcaggaatgatctggggatctaattgcttctgaaacagattttcagccaacacttattttagccaactcccatctccccttatgtactcccactttaataggtatctggtgttgccaatttgagtctttcaggaattctcctacgtaaaatcaagttggttcttatttttcttcatgttagcctgggactcagctttctttacttgatctgtatgagtggaaaagttctaagtctagtgaacagaagtctgaagaatcattgaaacagaactatagtcatagcccctcaattaattcccaggctaagccagtttatagatccagaacctcttgaatgatgaaggggcatctatgtctccttaaggaaggaccccactgtgcagccaaaaatttacactgcaaatctttctcctagcctttcctaagggggaccctgctgccatttaccagggtgactgtgcattagaggaagggaaataattagacttttggggaattaccagacactggctctgaactcacactaattccaggagatgcaaagtgtcactgtggcccatcagagttggggcttagggagatcaggtgatcaatggagttttagcttatgttcgtctcacagtggacccagtggactcccaaactcaccctatggttatttccctagctctggaatggcatgcttggaatagacatactcagcagctggcagaattcccacatttattttcctggatttcctaagtcatttaccattcaccagtttgccactcagctttcaaattttattgctatcatcttgtcccttttgttttccctgtcttgtgggtccgtgactttgaaaagttgctgtattgttttagtggtgctccaggagggagagagtgtggtacccctggtcagtcttccatctttacctgaaacctctatctatactgttttgctagatgatgttatatggtctcatggctttgaagaccatccataaactaatgaaacctaatttatgtctcaagccctacttctcctttcctctgtgctctagacttgcatatataacttcttactcaatgttttctccttagatatccaatacacatctcagataattaattgccaaccctctccttgaaatactcatttcttatctaatcttctcattctcaatatcactaccagccagctactttcttcatacaaaaatcccaggagtcatcctcagatttttcttctctcctacatcaactttatcagcaagtcctaccagttctagattcaagatttatctagaattcatccacttctcttcatcttcatggcttctaccctgacggaagccattttcatttctcacctgggtccctgcagtaacctcccagttgctcccctgcttccactctcatcctgctataatctactgtctacacagtagccagagtgaaaattttgaattttaagttgggtcatgttccttccctgattagaaacactcaatgccaggccgggtgcagtggcccacgcctgtaatcccagcactttgggaggccgaggtgggcagatcacgaggtcaggagatcgagaccatcctggctaacgtggtgaaaccccgtttctactaaaaatacagaaaattagccgggcgtggtggcgggcgcctgtagtcccagctacttgggaggctgaggcaggagaatggcgtgaacctgggaggcggagcttgcagtgagccgagatcgcgccattgcactccagcctgggcgacagagtgagactctgtctcagaaaaaaaaaaaaaaagaaagaaagaaaccctcaatgccatccccgctacatttccatactatttcctctgcccacaaggccctgtacgatctggctccttgcttaaatctctgacttcatttcctgccaatgtcttccttgttccatctactctggtcacacaggctttttgttcatcaaattcaccaaactcactcgctcctcagggcctttgcagttgcccttttgtctctgtgaatatccttccccccatatcttcatatggctcactcctcatttcattcaagtctttgctcaagtattgctaactctgagaagccttcccagggcactctctctcctttctcccatatccccctctgttactctctattatgttatcttatttccttctggaagtatcttgttcattaactttattatctttctcaagtcatttgaatataagccctattgctctgatctggcatattctttgctgataccatcacagctacagcattacctcacctgtaggagatagaaaccaagagacttccggctgggtggctaggagagcatgtgaataaatacttgtgaagttgtatactgactattagtatgctgattcttctgaatctcacaattcagcctttctacaggattctttcccaccttgactgattctacttgaatacctttatgtgtcccctctcttcctgccaaaaaaatccgttttaggcccgaaagtttgaattcccaaagagcagattgctcagcctcttttctgcctttcacccagatgttgtaccttacaccatatgttgtgcagaaacttggatgagactttggtggaggggcaactagcgtacctttttggccctcagacctaactgagtatggtgcgggattacgagccagagattgcaactagaaatttaagtcctgttggctcactgctcagtattgggagtctgtttttgctttctgctttctcctagtcttttaatttttaatgactctgtctaccagctactgatcttgtcaaaacaggctaaaactagggcagggtggtagaggggagtaggtcagtttcatttcatcacgttcagaaaggagttgagagattacaaattgtgaagccccttttgtctggtcaccagcattaaatctgatacctcccagtcctcctgttcttgagttatacagcacttgtatttgtgggtccagttataagtttccttttaaatctgatgaagtagggatgaattcaagaaatgacccctttgcttttttgtttttcttgtgttttgtacaactcaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattatttatttaaagaatttatgttttctataaaaccttataaccaagaaccttcaggatgcttgtaaccaagtactttcaggatgctttttgtatgtatatcacatagagtaggttggtttcctgagtaattgggattccaactagatagtcattggtgtgaccataataaaaacaaaagctaaaataaaagcatcagatttagactggcgctgtgccctctaccactatatgccaaaaattgcttctctagtgccattttgatattatatctagctataaataatacatgactatcgttttctattgaatgtcaaagacttactgggtctttacacctctgtaaagtggaggttttggcaatgagctgtttaacttggccaagctaggctgtcaacccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccacccatcaaatatgaaaggctgatgagactgttaggattgataaacatttgttgtttgaacccagctatccaaactggggaagaaggggaaatggttgttaccaacaatctctagtagttattttaatctttattttaacctggattgcaaatgtatggggtatgaggagataatgaaagaaaagtggtcctcatgctggatatgtgactgttttgttctctgtaaagtgtattcttgggaagtgattggtttatatcagattcagaggagcccaattaactccagtgtaggtaatgtaaaacagtaagctcaaattgcagaagccagtatcctacagaaatttaagtagctactgcttctcctgaaagcccaagttgaaaatgggaccacaggggcacagggctactgaccctcacagggcatgccagcgttaacaccactttgagagaccaatggcaagaaatgctgtctcttgtgcattttactaatttccccattcttagggtagcagggtgggggtgtatagggtctttttgaagcagttttggataggtttgcaatatgtgggattcagcctttgatttcaatagagctgagagcttttagaacaagcaggcatttatttaatgtttccttagtccattggcaagctttatcaatagcttaatggcagaggataaaggctcaaacagatgatgttttttccacagaaaaacaaattgttgaatctattccgtgcatatttaaggattttgaattgattttgaaaatcatgaaacttgaactatttttctattccctttttttcttccccatttgctgccttttttgtttttgtgggggaagggttgggagtaagtttaaactcttccgaagattatgaatgggtcagcacaaatttttaggcaactgctttttccatgttctgagatctacgggctacaacaaattttatcagcagtgttttttgtttttttgagatggagacttgctctgtcgcccaggctggagcgcagtggcgcaatctcggctcactgcaacctccacctcctgggttcaagcaattcttgtgcctcagcctcccgagtagctgggattacaggcacccaccaccacgctcagctaatttttgtatttttagtagagatgggattttgtcatgttggctaggctagtctcgaattcctgacctcaagtgatccacccgccttggcctctcgaagtgctgggattacaggcgtgagccacccgcccggctatcagcactgttctgattgcagacgtttcacagcatgtttggcttttggtaaattcaatccaggaaagactagcatgtgcactttatctcataatcttccagtacatatgctctcagttgggatagcagttcatttccattaggcagacgtataaactaaggaatgttagtctgcagtattcattttaaaaatattgacatgcttttcccctcccctccatgaagtcagtgccagagtgagccagattgggaggttggggttttgtttggttggcttggttttcattaagggaaaaaacttgcattggacaatcaaattcccctgagtttcataatctcatcaatattttaagataggcgagcacacactaataatatctatgcctaccttcttgggtggactcaactgtaaccacagtttattagttgcttagaagtggatttttaaaaaacagttaaatgtgtgtgcataacacacaagtaatgacacactactattattattacctaagtagtgctcatcctctctttctgtgttttcttaggatgtgcactttaatttaggattgtaacgcctaataatatttctgtgagcctttaatgtgatttataagatggccgaattactgaaatcaccattatacctcttccataaaacgactccaaagttagacctgcctgttggggagaattctatagacagaaggtcaatgttgtccccatccataggggttgaattaccttgctgttaagtggtcttcccccattgggatcctacagtcccacagatgaaagcacagtagtagctgacagctggcttatttggtccctcggcatctctcgtatgtggcatattgcttttgccactttcctatccagcagacatcaaagcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaaccccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaagtctgtgaagaacatagttaaagatctccaactttggaaaatatacatgatgtgaaactggggtgctatgttaaaaataaatgtatgataactaa

SEQ ID NO: 3124 - DNA, 206581 bp, human; identical to SEQ ID NO: 3120

SEQ ID NO: 3125 - DNA, 202322 bp, human; identical to SEQ ID NO: 3121

SEQ ID NO: 3126 - DNA, 169078 bp, human
ggatgctctgagctctaaaaggaggagcagttttgctggcatgcagaagtggtgaaggtaaggcttggattcaattacagtaatctcagaagttcttggtagaagaggggcacagaatcccagcctccattttgcaggtaaggaagaagaattataaaaagataaaatggcttttcttaatgtcagcatctgattctttaccttctttcaccctagcaaagattgttaacataaaacagatgttccttggacaagagaaaagtaatagagctggatcttttcatgatcctgcatttattatttgtagcactggatctctaaactaggaaaagcaatgtcgattctaactagaaattatggggcatttaataacacgtgaggcaaaattatgaggaaaggcaagaaaccaagtggctcctagcttctaacaccttattttctatggtgtaagttaatgaatgatccatttttaatgccataaaaaaggaaatttccgataggctttaccttaacttcacgttgctgtttatattacagacaaaatgctaaagttaacaagtgtaaaatgccctaggtcagggtttcgagtgcccataagcaattctctagaattattttgagtgctcagattatagatttgcccccataccatatactgtattacctatcactgcaagattctttatagggtgtcaagtatgtgggaggatttaaactaattgtcttaaatgcttcatgggataggagatgatccaatgggaactgaatgttttcaattaggatgtttccatggatactattaagcatgccaagattcatagccacaggagatttttacttacttcaatattgattaagaaatctgagaacaatctcaagaagtgtaggatgtaggcggaggataaattttgaggatagtctaaaatttgctttctcttccatagttaaggcctagtccagaaaaagtctaggcagtcagccaagtctaacagcaggatttatgtcaagagaatgtccagaataaaagtgaacatgggttgtttcatttaccccaggtgtatttattaacatttatttaatgttacttattatttgtttattaccattagctttcttatgtactcggtacaaagcattagaattacaaccctttgtatctttgttgtttatgaggaaaacatcctaaatagtgtctacagacatcttaaaattcacattcctctgagaaaggtttatcccttaggttattacttttttttttttttccacacatgggttttttacctgggttctcagatctccaagaaatcggtggatagaattcaaggtgacttcttggatggagaaaaagtacgtctttattttgaccaaccatggatatttagcattttcatcaattaatgaatgcaggtgacaaatcacagtactattggccccatctttgagtttgtcctcaatagctcacagatattttcatattgtatcacagttgttgcagatatcttgaaatattgtttattctaatcactccttcaaaatttgggtggttattggcattatcaccagttttttttttttttttgaggcagtctttctctgttacccccaggctggagtgcagtggtgtgatcttggctcactgtgacctctgcctcccaggttcaagtgattctcccgcctcagcttcctgagtagctgggattacaggcacatgccaccacggcccggctaatttatttatttatttattctttattttttatttttaaattttttttagatggagtctcactctgtcgccaggctggagtgcagtggtgtgatcttggctcactgcaacctccgcctcccaggttcaagcgattctcctgcctcagcctcccgagtagttgggactacgggagcgtgccaccacgcccagctaatttttctattttaagtagagatggagttttaccatgttggccaggatggtcgcgatctcttgacctcgtgatccacctgcctcggccaaaatgctgggattacaggcgtgagccaccgtgcctggccacattaccaccagttcttgatacttaatgccataacaaaaggcacatgtatcactatatcacaaattagcattttataatattttaataacgttttcaatataagtggcttcccttgtaatcatatattttatttttgcacttaaaaatataattcctaaaagggatccataaagcttcaccagactgccaaagcgtccatggcacaggacgttaagaaccctgttccaaatggaatgaagattagaagcactatcatatgttcattttctgatcgcagtttaagaaagagtttcctacttaagtgcttttcacagaaaatctaaacttaaaggttaaaagggaattcttttgtgctggctcatgtgtgggccctacaaagtactttgcagtcatatctgactttcgtttgagagtttgtcttcagaaatggaagaagaaaaggcattcaggtatatgacaggttgcattctgtagaacattgttaaatctatgggaggggagaaaagttccattcagtgtcttgtggattgtggtaggagtcagttgtgttcttgcagaaatttccctagacagtgcctcttgcctcctcctttcttgtcccacagtactccatggagcagatgtgggaacttggatgcctgatgggaattgtaaccccatgctttgccttatcctggtggggactgatctgaggtttatccattaaactgtatcagttcatggctgggagtaggaatgcagaaaacacaagcaaaatgactgcaggaaggtttaaataaaatctcatatgtggcttttccttaacacattattttgcaaaaagtggcagagtgaatttgctgtgatatgataggatcattctggacttttacttaatttacgtgttctctagcagaatgctgaaggagcacacataaggagtggggagttggtatttggttctgtgacaagtgctatcttataacagaaaaatacatatttttgtgaaacttcaaatgcatttttattccccagcacatctgtgattctggatccactaccttcttccaagtgtgatcaagcactgtacctgacagtatcgattatccttacccgtaggcaaaaattgtattacatttattttacagtgatctggaaaaaaaaggatgacaacaaaaaccagacacacttcatttctattccggtaacattttttggtaataatttattactgtacaagtcacacaccatataagtcacacatttaaagtgtcaaattaaatggtttttagtatattcacaggatcgtgccatcatcacagtcaaatttagaacacttattacccccaacaagaaacctcatacgctttagcagtcaccctccattgccccccagttttctaaccccaggccctaacaaccactaacctactttctgtctctatgaatttgcctcttctggccatttcatataaatggaattacacattttgtaaccttttgtgactggcttttttcacttagcataatgttttttaaggtctacctatattagagtatgtatcagtactttattcctttttatggccaaataatattccattttctggatataccagattttgtttatccattcatctgttgatggacatttgagttgtttccactttgtgctattattatgaataatgctgctatgaacattcatgtttacatcatgtatacattttaatgtggacatatgtttttagttatcttgagtatatacctaggagtggaatcatatatatatgtttttaaaccaaaatcaaattttaatgttgcagaatccctgaagcacttttaggaactgttcacttccatagaacagtttgcaaatcagtgttaaagtggagagagtgttgatttttttgtgcatgtatttggtagacatcgtttgaatcttgattttataggctgtgtgaattttgtcaagttacctgtgaacatctttcttctagtatagaatgttagtacctctggatgtttcacgagttgatagactgtattattgcttgaaaaattcactgtccatttattaccatcaactttggccacggatttgctttggctagtggcctgtgaggggaagtgatgtgtgccttcttccaggcagaagctggtggtttgcctcatctcttttcctttctgccatgatgaccattgatgttccagttggacacaggctccatcagcttgtgtatcagaatgaaaatgatgtggggcagagccctcatagattttgttgcatgagtatggaaaaagtgtcattttaagccgtcaagatttggtgactatttgatactttagcacagtggtcctcaagcaatggcagttttgcatttctcacactgagatatctggcaatgtctggagacattttttggttatcacacatggggaagtgctcttggcatttagtgggcagatgctgctaagcatccaacactgcacaggacagctcccacaacaaagaattatctgatccaaaatgtcaatagtgctgaagtttagaaaccctgctttagtataacctagtttatcctggttaagatagggtgttgagaagattaaatggaaaaaaaatatataaaatacagcacacagggtggtctttttttggtaattatgtgacagagcttggcaatggctctgaggtcttcccttgcatttgtgggtcttttccaacttccctagggttcagtattcagtttaattgtagttgtgtttataaatcaaggctcgtttttagcagaatcatataccctttaaaaaagggggagaactaacattagatgcctgtttggcaccaggctctttgtatgtgttttgaatttttacagatattctctgaaactgatattccttacctccattttgttttgttttgttttgttttgttttgagacaggatctcactgtgttgcccagactggagtgcagtggtgcgatcttgtctcactgcaacctccacctcctgaattcaagcaattctcctgcctcagcctcctgagtagctgggattacaggcatgcgccaccatgcccagttaatgttttgtattttcagtagagatgggatttcgctatgttggccaggctggtctcttaacttttggcctcctgtgatcccccagccttggcctcccaaagtgctgggattacaggcatgagccaccatgcccggccctccattttgtttttgatgaagacattgaggcactgaagttaagtaatttgaccaagatcacatggcttataagtggtgggcctagaattcgaagcacatctgtttgcctccagaaccctcttctttccacactgctatactacctctttagcagtgactttaacatagagaaatgaaggtaatacctgatttctaacaattatgtgttgtattagttatctattgctgtataacaggttacctcaaaacttagcactttaacacaacaaacagttattgtctgacatagttttgagaatcagtaatttaggggaagctaagctgggtggttctggctcaggatctctatggagattgcaaacaagttgtcttccagggctgcagcgatctgaagacctgattggagcaggaagatccacttccattgtggtgcactcacagggctgttggtgggaggcctcagttcctcaccatgtgggtctctctttagggttgcttgattgtcatcatgacatggcagctggcctccttcagagtgagggatctcagagagacagcaaggcagaagccacaatatcttttgtgacctagccttagaagtcacagatgatcacttctgctcttttctattggtcacatacacaaccctgatataatgtgggagaggatgatacaagggcatcaagaatactatgagatggaaatcactgggggccatcatggaggctggttactacatgttaatgatcctcatttgccatagttacaaaattatgaattatatttccttttcatattctaatattccaaacacctgttttgtactttaagatacttaaatcatttagaatgtgagtgaaaatacaaattggcttttgtaaacacttactgaatgggtaaaataaaggccgtggtacagatacttcattggggaattttttttttaaataggtttgactagctgaggcttcttgaatcctgaaaagtttggtctgatgtacttttttttttttcctggaaaatctccttgtaccaaacactgaattcttcatttgccaaagtccacccaactttctgatgtttttattgctggtttgatgtgcttgaatgccagccagagtataaggtgaatggtagatgcaaggactgtgcagtttccacggagacttctttcaggagcccttcattttttcattcagctattgctgggaggcatccccttccagttaatgtgtggtacacatcaatttgagtggctcttagaaaggggctcagtttatacaaattaagaattgaggttttttttttctctgtatatcttcaacgttaaattagatttctatgaaacttgaagatgttaacaggaaatcttcctgaaacagtttaactatacttttgtttattacacttgattttgagcttttgggaataaaagtagggtcctggctaggtacagaggtatatggatttactgtgtctaatcgtgcaaccatgaaataaacgtttgcacttcaggaatcaacccatcactttttaaccactgttgtttgcattggcttagagctttgtgcttccttcaactattttccttttttctttcaaaactgtgttcagttggttgtgaccaattttacacagagactggctcactcacttatgttcttgactcctgctgtcccaatatcatgcttcatttacacagggatagcttttcctggctttatctgttgacttgacatcctgtgcatcatatttcttttcttagatatagagaagactgaaaaaaatccacgatttgaagaaaatttgcaaaagtgcagagcaatgtgaaagagatagctttaattttaattttcactgtagtcagaataggtggcctcctgatgggcagacttgctttctcattttactctgtccagtgtagatacccagatcaatcaaggtcaagctggtctggtcattaatacaacttttggttttaaacacagctgtgtacgggggttcttagcattattaatagaggttataatgaaaacaaggtatagtcatacagttgtctgtgtgggtagtggcatggaggtggagttgttgcttaagatctgaaagtcaggaagctggaggtttttgtaattttattcattatcaatcttaagaatttattttgatcattataaatgcatgactggtgctattttccaatcctgaggttttttgggaaatttttttgaaaagaggccaggatgaggataaaaattaattttgaaaatccatttcaaagactcattatgctatgctccatcactgcaattttaatgcaacttatatattgtgcttttacctttgggactagcattcttaaaagctgacttttaatttggactttctaatatgtgtcggctctgtcagctcacgagtgtgtttttatctgtgcatcatgttatattgggacctgggtggaatgtaaatcttttactggcctaaatctgagtctaatcctctgcatggctttggtagaaaatcaatttcctctgctctgtcaagatttttcaggtcagtgctctttggaagtttcccagttctcttagattaaaatagattttgtttctgtgctacatactggtattagttagtaggacactgggatctaaaagcaagagaacagaggcagacaagatatccatgagttcttctatttcagttaacttgttgacacactgcacctttgaggaaccaaggagtttgtgtgctttcaggcatcatttgggggagcaattgtaaatgactcctgtaggtgaggctgtgcacttaattttaatgagttcaggttcattaagtgacctgctcactgggtcattagaagtgacctcactagaagtgaatggtaaagagaagaactacctaagttccactcagcttgtttcactactgtggggtattggaagtagagtgacaacttggactttctcagttttagcactgaaaagtcccacatcccaggaacttactcagtccccagcaaactagggggagcgggggatggttggtccccctagcagtgaaaagtaaggggatggatgatttggaactggttagtacccttatagatttttttttttttttctgagacaggttcttgctgtgtcacccaggctagaatatagtggcatgatcatggctcactgcagccacgatctcctgggtccaaatgatactcccacttcagcctccccagtagctggaactacggggacaagccaccacacccagctaatttttatttatttatattaattaattaatttatttttttgtagggacagggtctcgctttgttgcccaggctggtcttgaactcctgggctcaagtgatcctcctgccttagcctctcaaagcactgggattacaggtgtaaaccaccatgcctggctgtcttataaatactttaaggagggatttattagagacatgtagcaccttgctgcccagtgatgctagtaaatgagtgactctactttgatttgacagaagaaacaatggaaagaggagagatggaagtttttctacctaaacttcctaagaggatgtgtttaggggatgtgttggtaaaaagttattagcattaatgtttacctgtatctttctcatagataatgcaaagacctttaactccacttatccctccttttaacttatgttgttattgccttgtattttaatactatatattaaactctacaagacatcattattttatgcaggcattgtttatttaatcagagttcagtaaactttttctgtaaatgccagatggtaaatattttaacccctgcaggccttatagtctctgtcacaactactcaactccactcttaatagtgccaaaatggctatagacaatatggaaatgattgtgtgtacccatgttccaataaaatttatttacagaaacagacagtgggccagatttggcctgcaggccttactttgacaactcctaatttagatttatctacatatttatttattttccctttatttcttgctatatctttgaggttctacctgggatcattttcaaggcaaggatgtctattctcatcactgtttttcagcgttgtgctagaaattccaaccagtgcaataaggcaagaaaaggaaataaaaggcatacagagcagaaaggaaaaaaaaaatgaaactggccaggtacagctgctcatactttgagaggcgagctaggaggattgcttgagcccaggagttccagaccagcttgggcaatgtagggcgacccccatctctacaaaagtaaaaataaaaaaaaaattagcagggtgttatggtgcatgtctgtggtctcagctacttgggaggctgaggtgggaggatcacttgggccttggaggtgaagtgagccatggtgactgtatcactgcattctagcctgggcaacagagtgacaccgcctgtctcagaaaacaaaacaaaaacctgtctctatttgcagatgacatgattgtctacatagaagaccctgagaaatctacagtctacagaataactcctagacctaattaagtgagttcagcaaggtttcaggatataagataaacatacaaaaatgagttgtatttctacatactagccataaacaaatggacactgaaattaaaaatacaataccatttacattcactcaaaaaatacttgggtataaatctaacaaagcatgcacaggacttgtatgctgaaaactatacaatgctgatgaaagaaatcaaagtctaaatagatggggaaacataccatgttccgggtttcaggatataagataaacttacaaaaatgagttgtatttcacatactagctagaaacaaatggacactgaaattaaaaatacaataccatttacattcactcaagaaatacttgggtataaatctaacaaagcatgcacaggacttgtatgctgaaaactacaaaatgctgatgaaagaaatcaaagtctaaatagatggggaacataccatgttccaggattggaagactcaacatagtaaagatatcatttctcccccaaattgatatacaggtttaatgtaattcctgtcaaaatcttagtaagatttttttgtagatataattataaaatttatatggaaagggaaaagaactagactagctgaaacaattttgaaaaagaataataaagcaggaggaatcagtctgtaagattttaagacatataactacagtaatcaagactgtgtgatattggtggagggatacatgtatagatcaacggaacagaacaaagaacctagaaatagaccaacagaaatgtgcccaattgatctttgacaaaattgcaacagcaattgaacggagaaggaaagatagcctttttgacaaatggtgctaggtcaattaaacatcaatatgtcaaaaaaaaaaaaaaactcttgctgtaaatagtacacgttatatgaaaaataactccaaatgtatcacaaacttcaatgtaaaacataaaactataaaaataattagagaaaatcttcaggatctaaggctaggcagagttcttagacctgacaccaaaggtatgatccataaaagaattgataaattggatttcatcaaaataaaaaatacttactctgagaaagacctcataagaggatgaaaagacagactacagagtggggggaaatatttgcaaactacgtatccgacaaaggactggcatctagaatatataaataactttcaaaacttaacagtagaaaacaacccagttagaaagtggaaaaaatacaagaagggacatttcactgaagagcatatacagatgacagataagcatgtgaaaagatgttcaacataattagccactagggaaatgtaaattcagaccaaagtgagctatcactacatacctataagaatggctaaaattaaaaatagtgacagcatcaaatgatggcaaggctgtagagaaatggaatcattcatactttgctgatgggatgtaaaatgatacagcccctctgaaaaacagtttggcagtttcttaaagacactaaacatgcaactaccatatgacccagcaattgcactcctgggcatttatcccagagaagtgaagatttatgttcatataaatgccagtatgtgaatgttttataggagttttattcataatagcccataactggaaacaatacagatgttctttagtggatgaatggttagacaaactggtatatccatagcatggaatactacccagcagtaaaaaggagtgaagtactgatacatgcaatgatctggatggatctccagagaattatgccgagtgagaaaagccaatcctgagtggtttaaataccatatgattccatttatgtaacattcttgaagtgacaaaattatggagatggagaacagattagtccatgccaggggttgagggggcaagggttgggagtaaaatggatagctataaaaggcatgatgaggccaggcgtggtggctcacgcctgtaattccagcactttaagaggccgaggcgggtgaattgcttgaggtcaggagtttgagatcagcctgaccaacatggtgaaaccctgtttttactaaaaatacaaaaagtagctgggtgtagtggcaggtgcctgtaatcccagctactccagaggctgaggcaggagaatcgcttgaacctgggaggcagaggttgtagtgagctgagattgtgccactgaactccagcctgggcaacagagcaagactctgtcttaggaaaaaaaaaaaaaggcatcatgggtccttgtgagcatgaaaatgttctctattgactgtgtcaatagagacacacaattatgttgtgtgtcacaaccataatcacaacattatggttgtgatattgtactgtagttttacaagatgttaccattgggaggaagtgggcaaagggtacataggatctctgggtatcatttcttacctctgcatataaaactacagttgtctcaaaaggtttaattaagaaagtatttaagaaaaagaaccccaggatctaaaaagatcagagtcagagaatcacaaatgctaaataagaagcacttttgtatttggtgatgttctgaaattctggctcagttttgttatgaaatggagccacgtgggtccatgtgagtgagtccctgtgcacaggtgtatgattgactttttccctcaagtgcttctaatttgggatgttcttcactgtgtgccctttgagtgtctcttgcctctggttttttgttagacaaaaaaaccagtttttaaatgtcagttccaaggtcttttctgggtacggttaacttttatgatttcatttatgcagtgggttttcacctaagggccatggtttctagacactagactcgtttttcccaagcgattcatctctttgcctgtgggatggagagattcattctcttcttctcttttgcagtagaaactccagttttgagctgggcacctggatgcccagagtaaaggttgtactgcccacatttcattgtagctaggtgtgcctgcgtgaccaagtatgaaccttctatttagattaagccacaagataagtggagctatcaattggctttaacaaatatttagtgaataggtaaaataaaatactttatataagagctgtgtgttctgggttgaattgtgtcccccacaaaaagatatattaaagtcgtaacccttagtacctcagaatgtgaccttatttggaaagagggtctttgcagatataattaatttcaggtgaggttataccggagtagggtgggctcctaatccaatatgatgagtgtcctcagaagaaggcagtcaggcacatgtaccctaaaacttaaagtagaataaaaaataaataaataaataaataaataaaaaagaaggcagtcaggtgaagacacagacacacagtgggaaccccctatgaagatgaagatagaagcaatgtatctacaagccagggaccgcctgcggctgcaagaagccaggtgagacacatggagctgattctccctcacagcccttagaaggaacgtgccctgctgacaccttggttttggacttccagtctccagaaccatgggataataaatacatttctgttgtttgaagccacccaatttgtggtactttattatagcagccctaggaaaccaatatactatgcttttgatattatttttaggatgttgtggtttgaatatttgtgtctcccccaaattcctatgttgaaacctagtctctgatgcgatagtattaagaggtggggcctttaggaggtgcatgagggcagagcccttatgatgggattagtgttcctagaaaagagacttgagggagcttgtttgccccttccagtatgtgaggatacagcaagaaagtgccatctatgaggcagagagtgagccctcactatacactgaatctgctggcaccttgatcttagacttcccagcctccagaatggaaagaaatttctgttgtttataaattactgagtctaaggtattttgttgtagcagccccaacaaactaagacatggagtattttaaaaaatgggttgaacattcagaggcttcttaatctgagtccttagatatttggactgactctgccttctttttccagtgaaaagatctcgctgtatgaaacatagacattcttcattgccccaaagcccttccaccttccttatgtttttattgctggtttgatgtgcttgaatgctagccaaagtataaggtgaatggtagatgcaaggactgggcggtttccatggagacttcttgcaggagcctttcctttctcagttcaacagttgtcaaggaaacatctagtttcaattaaataaatgtttgtggggtctgccaatttgagtgtctcttggaaggggatttggttaaacttcttaaacatcgtaataaacaaattcagagcagaggctttttaggttcccttccagttatattaggtttttctgtaacttagggatgttaactagtcctctgtctgaagtgatcagactatttattcatatccagaaaatattatttttgagtcttgtggggaggaaaactgaggcttaaagaaagagaggccaaagccagggagctggtgttacatggcaccagctatatatacatgactatagtccatgctctttagtacgtcctgcaggataagagatccaaggggcctgacctttacaaactgtttacaggctatggagtttgctggctcagcactgtgtgtttattgcttctagttagctattgttgtatcagtggctggagttggtgatggttcacggaaatagtggtgagagtacagattctaggtatatgcaattctaataaatgagacttccctagtgttatctgtattgtgacagcctccccattgtgctctttatcaaacagtaaggtatggtatattgcaaaatgctcacaatactttgcaactcttcccatcaagaggtagagtcagtttctctattcttaggatcttggctgtcctgttgatttggtctgaccctggaatacagtagaaaagaccctgtgtgggttttgatcctaggcgtgaggtagagcttcagtttcttgctgctttgggaactctgccaccttgtaaaaaaagccctggctggcctcctggaggaagagagactatgtggaggaaaatgaaggtacccagacaacccaatagtcaactgcagaagcataagtgaccctcatctgagatcaatggtgcctggctcggatcagtataattgtccagctgaactcagcccaaattactgacccccagagttatgaattaaataaatgctgttgctttaaggcacttaagttttggggtggtgtgttatacagtagtagataattgatacagccaagtttggaagctctggaatgatcagggctcacctttgacctgtcctctataaaacccaggattcttagtaacacagtcctgttaataacagaacttgcctatggcaaatctaagcggaaaagcagtttattggcaggatattgtgtagctacatctttctttaggaagaccagggacaaggcttgaaaactgcacaactagggggcagtactgccagaactacagccagataacctcacagaattggtagctactgaatattggatgcctccacctacaccaccaacattgcctgcattggacattgggtatggggctgctcctggaactggatgttgttcctgtcactagaaaacaatcatctactgttcttgctgtttcacagcactcattactgattcagatgcccgtgtgccacgtgtttatagcagtgcaatttgtaattgcaaaaatagggaaccagcccaaatgcccatcaatcgagtggataaagaaaatatatcaaaaatatattttatatgtgtgtgtgtatgtatatgtgtgtatatatgtgtgtatgtatatgtgtgtatatatacacacacgtacatatatatacatatatatacacacacgtacatatatatacacacacgtacatatatatgcacacacacatatatatacacacacgtaacatttataatacgccatggaatactactcagccataaaaaggaatgaaataatagcatttgcaacaacgtggatggagttggagaccattattctaagtgaagtgactcaggaatggaaaaccgaacgttgtattttctcacttataagtgggagctaagctatgaggatgcaaaggcataagaatgaaacagtggactttggggcctcagagggaagggtgggaggtgagggataaaagactacacattgggtacagtgtacactgctcggctgatgagtacctcaaaatctcagaaatcagcactgaagaacttaactcatgtaaccaaataccatctgttcccccaaagctatttaaataataataaaaacaaaaacaaatgcctgtgtgggtggtgtctggcagagcgtaggtcttgtgcccataccctgattgaaaagaaatcaggaaagtgagaatctgacacttttagcttatttagctgaaagcaggtggaaaatttcataaacactggcaaagggttcggataacaggcagccaaaagaaaaatggcaaatgttcattagtttctgttgtatactctggttagctcagttggttacagcacagttatgatgaagccagcattgtggtttgttcttaagttttattgaaagaaaatagttctgagattgtcccccttacacctgctccctctctcacagatgtgtgctgatagccatttgtaaggccaggcaatagtggggcctaacttgcatctgtctctggctgctaaggtacaaagattatgtgtctttcagttggtgggcccagagactccattcactggcatagtgtgccacataagagaactgaatgaatggtatctgtgtgaatctaaggggttggctaattgcgcagtgaatttggttcatgtaacatttataatacaaattgttgggcagcaagatctttcaatccagacggtttctagtttttcagaatttctctgataacttctctgaactctgaaattcttatttgcaaaaccatctatatagggttcatttaaatattagaaatagtactcataaagagaaaagcataatgcctagaggatgtgtaatagatgttcaataaatgttgatcatttccctcaaacttcttagattcacacaccccaaccagattagaaactctgacacggcttgccctttttgtgttcaattctctctcagttgttaagtgaagacccaatccagttgttaaaataataaatgcacctcttgcctccctgacattctggcaaccttactctgaggaggctggcccggttcgaagctggctgctccagggcactaaagctggagaagggcccttccaccctgttcataactgtggacagtaaactgtatttgggatagaggatcttgggaacaataaggacctagatccaagctcatgcattgtggtgggactgtcaatttagggggatgggtagattttatcagatctgtcagtggaaagtttggggagatggaatagtatctacaggtagttccaggtaggaggaagagatctacctggctcctagggatgtccatcctggcaagcattgctcagtggcaggagttgtaagagtagggaaggtttaggaatttggatatcagggaagtgtcagcaggtagctggggatgaggtgcaggacaaagacagacgagaggaagaccaagccttaaagtgatgagtatctagatagggaagaggatggatgggtatagcttggacacagaaaggggattcagtcatggaaagaggtcagtctgcaatgtaatgtggctatcaggtcacaggagggccaagagcaggacaggtttggggcttggttctggttagtcgaggcagagccccttagaggtgtttggatttgccatggtgatgcaggggacctgagtgtgctggttgtcatgagatcttgttgctgggagaacagtcaagaacagggtagaaaggcccttccccagctttagtgtgccttggagcaggcagctttgaatagggccagcttcttcagagagagctgccagaatgtcagagaggcgagaggtgcatttgttattttaacaattggattgggtcttcactgggagctctacaaagaaaccaaattagtgaagttagattgcctatcccaccaacaatggatgtttatggtatgagtttagctctgtgctagagaatctcaatatatttagatttgggcttgagagagagaacttcagtgtgatctgagactgaacttccattcacattcattcctcgaggaagcatgttgaggatctatgtgtaatatactggtgttccatttacttgaaatatcctggcttgctctattcctctcacttaggcactcactcctctaaaaaataaatgtgtatatgtgtatgtgcatgtgtgtgtacatgtaggtgtaagtgtgcataaaatatggaatagactgaaatcaacaaacttataaaaataccaaataacctcaatctgtaattttatttttgagaagcactaaaaatgtcaataaatgaattgtctgaaaaactaatcctttggctggtgagataagtctgagttgccagaaccagttaaagctttatataatttggcagtacatttgcgttcacctgagatttctctgcctccagctgtacaaaaattctgtgatatgcagagcctcgaaacctgggccagaatgctaaaactaattttctttcgtaatctgagccgtaattgcattttaactcagttctagtgtgaagactgcttttgtatgtgtgtgtgtttacttcatgtcattaatttctggcatttaagttagtgcctggcacatagtctaccctcagtaaatgttagttcttactgccgagtctactgttctttccttctaaaccagtggggtagatgcttcctttgtgcctcagtggttcattcccttgccctcttcccctctcctcacccttgagttgttagatcctggttttgccccaggcaggtgccaaccccgaggaactcctgaccctgtggtgatgcatgcctgcatgtgtgcagccagctgggcagcttggaaagccatagtattgacttgccaaataaggactagtttacaaaagtcataagagatcactgtcatcaactgctatcactatctattatcctttctctttccaaaacacaatttaggtgcataataaaaacatctgtagaattactctgtcaagcctatgtatgcccatcagttgtgcaagagcctcagttcctacttctaatgaattttatactgattatcccagacctttctgccagctccctaatagcagaggagagaatacactgttggagtcaggggcaaccaaagcagctagtctgagtatagaatttctttgaattctcatctttaagaaccatgctcagctgggcacagtggttcatgactgtaatcctagcacttcgggaggccaaggtgggaggatagtaatggcctggtgtggtggctcatttccataatcccagcactttgggaggccaaggtaagcagattgctggagtccaggagttcaagaccagcctgggcaacacagggagaccccccatctctacaaaaaaacaaaaaagtagccaggtgtgatggcacttgcctgtagtcccagctatttgcagagggctgaggcgggaggatcacttgagcctgggaggttgaggctgcaatgagctgtgattgtgccactgctctgtagcctcgaggacagcgtgaccctgtctaaaaaaaaatggatgatatatccacatgattcagaattgaagaggtacaaaacaataaccaataaactctttctccccactgtgtcctagccaccttgttttcttccctggaggcatccagaagccaattttgttagtttcaacttctggagatggcttatgaaaatataagtaaatgcatctatattcaaccccattttagaagaaatgatacctactatatcagctgctttctgtgcaccttgctttttttctttttcacactttagcatgatgatttttctgtattggcacataaagagcttcttctttgttagttggtggttcttatggcagacaactgaatccaccctagatggttaagccaaaaagggattcggattttaggtaactcatggaatcctttggagggctggaggaacaggctagcatccgggtgcccagaaacaaagccccaagacacacgtagtactagcattaagtggaagccacctgtgctgctgcctccactgaacagcagatgctaggtatttgacttgactgcaactgcctctacctccactcctgcaccgggaaggcaacctagcagtgacacctgcaaaagtagaagctctgagcagagcctctttccttacatttctcacttctaaagcaaaatctggtgtggatgtatctgattagtggtgactaggtgacacatttgcatcttagcttcaatagagtctaggaattttattctcaacttttaaacttggaggtgggacttgtaataggtgaaatttttgcaaatagagaaataattttcaaagtatgatggacagtcacagatatggcaaatgtccactagagctgcttagaattccattgtatggatcaaccacaattgattaaactaatatcttagatggtagacctctaagtgttttctagttttctagtctgtgacttaggcaatactgtattaatgaccatatacatgtgtcattttgctaatgtaaaatggaatataaatttctagcagtggaattgctagatcaaaaggtaaattgtaattcttgtggatattgccaaatggtttctggatgctatactgattttttgcttccactagtgatgttcctgattttttttttttttttttttttttgcacagagtcttttccttttttagattccttctgagccagagtggcaggctgagtgttccctgctactggggtgagttttgggccttgggccaagaatgctgacaaatcagatctgggccataacctatgccaatatagactgtatttagcatctggactggatttggcttatagtttattgtagtccttctagccctaaattaaatggcatcttggggtatctaaaagataatgttgcttccaaaattgatttgcaatgtgggagtagcttacatcttggattgttatgtgttcacaaatgcataaagatgttttcaaagaatggttctaaagaattataataccttttctttttaaaaaagcaaaatcttggccgggcacggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaaatcttatttctagtgtgtgaactattgcatagattttgccaatatctgaactatggcatccaattgctctggttggttgccatgaaagtttatagtaacataggaagctcctgtttgaaagctcctgaaaaatttaaacaaatgtatataaatgggtgaaaaatgggggctgaggaagaaggtgaatacatgtgttttcttctcatggaagtgttcactattttttattaaattttttttagagacagggtctcactatgtttctcaggctggtctcggactcctgggcccaagtgatcctcttgtctcagccttccaagtagctgggactacaggcacgggcctccacatctggctgtgtttgcagtctttaagttggcatttacctagtgcagttgattatttcaagaaaatacactttctacatggctactgagggtatctgaaaggatataaagtatagcccagggaagtagcatgttgttaggcaggggttagtaactctttctggaaagggtcagttggtattttaggctttgcaggccaagaaacagaatcaaagatattacataggtaattctataacaagagaaaaaataaacttctacaagctttttattgacaaaattcaaaacataataactgaggacttttttttttggtaatacaggtctactcataagaagaacagcattcttactttggggataacattttgcttaatgggattcaaagaatagtgttccctttcatcaaatcgattgcaaatgttcatctgtaaataccatttattttctccttgtgggccatagaaaaccaagcagtgggctggatttgacccatgagcggtagttttccaaccactgatgtaatggaaagaccatgagctttggacctggatgcatgtaggtttgagtactggctctgaatttgtgaccttgaacatatcacttaactttctgaattgggaaggtttatttgtgtataaactgagtgtaatgacacctatctcatggaaaaaatattacccccatctttgtgattttgcattagtattctagttctgtagatgctgatatgatttagctagacttacctagaaaattagtatttaactgattttaaagctgacttttcaagggatagaacactcacatggtcttaaagtacaatgtaaaaacatagctttgcaatgaagagatctggcagtcaccacattaatcaaatgaccaagctttgcaatcagtaccaatggtgggatgttctgacattgtgtgcccctcactgctgtgtacctctcactatatctcagtatcacctgtgtggtgttcttgccagaaacttttgactttaatgtaatcacaataaaacagacaaatccaaaacatgggatgttctgaggacaactggcctggattcttaaatgattcagtgtcattaagaaccaagggggattgttctagattagggggagactaagggaaaatgagataaaaatgcagtgcatgaacattgactaaatcctggatgaggaaaagaaaattcagctctgtaggcattttctggataatcaagggaatgtgaatgtggaccatatgttgtatgttagtccattttcacgctgctgataaaggcatatccgagactgggaagaaaaagaggtttaattggacttacagttccacatgcctggggaagcctcagaatcatggcaggaggcaaaaggcacttcttacatggtggtggcaggagaaaaatgaggaagaagcaaaggcagaaacgcctgataaacccaccagatctcatgagacttgttcaccatcacaagaatagcatgggaaagaccgatccccgtgattcaattacctccccctaattgttcaagtccctcccacacacgtgggaattctgggagatacaattcaagttgagatttgggtgaggacacagccaaaccatatcatgttgtatgataatattgtgttaaagttgatttccttgggtgtggtgatgatggtgcggtggtgtacgaaaatatccctgttcttagaaggtgaatagtaaagtacttaggggtggtgtgtcatgaggtgtgtctgtaacccacttttcagatggtttggcaaaatgggagggaaggagggagggagagagagaatgtgtgtgagtttgtgtgtatgtagaataggtgattctgtgcattgctgctcagttcttagcatagcactcagcacattgcttttgatagggaggtgcccaaccaaaacttgttaaactaacaagtactttaaggttttagtaggattctctgaaatcacacctcagcactgcctgtctgccctctctttagcagtgtcatttggcttaggcatatactataatgcctaatgttgggtaatcagatatgggggttcatgttttcttgagtagctcacccatgtccctctggactgaaagtctctcttgaatgttacagtataaatgaatgggaaaggaaaacccagcatagaggttgacctgcgtgttcagctgttccctgagaggctgaggtacaatttgtaagcatgtacttcagattctcttctgtatttctgttgctgagtttgcccacttggggagggttgacacctcctggggctgtgctgagtaggaggtgcatctctggagttctgactggctggagcatcactgaggtattctcctgggctatgagggctagggccaggataaagaatggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatatagcaggcatagtaaagtatgagtcctgggggatacaaataataagaatataccctcgctttctgctgggcacttagggcatagggaaaggagatgggctacagtggagataattatcaaaataccaattgtgctgtgttgcaaggctagggatgtgttagaaagctagtaaaaagtgttatgggaatgcagagaacatgccatgtggaattgactacagtttcaaagataaggttggtcttgaggtgacttgaagaatgagcctggcaggcaaagaaatgggcatctggtgtgactaaagtcttaattagctgtagggtggggaggagagagacatgacgatgttggaaaggtagtttgggccagacaggagggcctcagaagccatgcttggtttcacaggaagggcgtgaagagtcccagaagccctttgaagttggagggtgatgtggttttgataagaggtcacggagggaatgtagaagctggtgtgtgaaggtgtgtgagtctggagacaggacttgaaacagtcgaggcgagagcaaagaatctggattttgctagctgcagcagagggagagtagaaaatggggtgctcttggagaattcttccagcccctcctactaggagtttttacattttcaaatctttctaaggaaacctttaataatacttgagagaagcttatttaaacctttgaacagttctgaaaatgtattacatttcagccaggaaagaaagtattatttcaggcaaactggaacatggttactcagcacagtcgcctaatcttatagaattaggtaggagggaagctatgttagtggccttcaaccttcttccagaactttgttcagatttctcccaaatggtcggtgaatttttctgatttgtatccagcatcccagccatttagtgtacatccgtaagctgtaaggaagttgatttaatctatttctttttttcatctcttgccttccacctgagaaaacactactccataggttcttattctgtattaggaatttgcacaatgtgtaacctaagatggatccagctgggagttggatccagctgggagtgttacaggtttggagtttagactaaagaagaggagtggaatcttttcatttttttcccctttattttgaggaaagcccagtgatttggattgtttgaaggatcaattatatcaaatatctccactaattgagtatctgggataaactttttttttcaccttattttctttagataccattaagcatttcgacccacaacttacagcttttccatggagattttaaacttagaaaactttgaaccttgatgaatgaaaaaaacctttcagaactaacctttttttttttttttttgattcagaagtccatgtgtaagttccaaaggcttataattcttttctcttccttgaggcttgactatttcagaacgttcttggtatgtctcttggaggtttggtgtacaaagagcaaggaaagtaacctatgggcttaactcacttatgtgtatatattctactttggctccaaagcaatgattctagtggtgatatgggaccaagggacagatttcaaggtaaataaggctgtttactaatgtcagattaaggtattagtcttcaagtaccataaatgttttactagcaatttcagttacctgtagtaaagagctttccagttccatgtggtagttatggtaaaggagcaactgaaagttaacttgatagtagattaacactcactgaaaatatagttgttattttttcacataccaaggattacaatgtctttttttttttctatttttaaaatagagacagggtcttgctatgttgcccatagtcttgaactcttggcctcaagcgatcttccttgaggcctcccaaagtgctgaggttataggcatgagccattgtgcccggcctacaatttcttaatattaggagttattttgcaagacaactatctcaatgttggaactacactaatgttggtgtgtttttttccttgtgtgggatagtctgtatcttaagatgtgtaatgtatatattcacaataagggctacattataaaattcagagacattttatttttgaggtaggtttcattcacttaattgagaatttgttgactgtatcttgggtgcctatccttatgctaggagatgaatggaagttgccccctgccattgaagagaagacattttaatgggaggcagagataaacagataattaattataatgtgatacatttggaaatagtcacaaaaaacttgaatatggagattttcaaaagtacaaagaataggatattgaaccctcatgaacccactaccaaacttcaacaattactaactcttggttatgcttgtttcacccatgtgccccacctcctcccttcccccttttattttgaagcaagtctaagacactgtatcatgtgatggacattaatagatacttggatagagtactctgagaatacactgggaaaacatactgtatcgggacagggaaaggagctacagaaaagtaacatttgagttcaatctaggtggggaggaggatgttgttccaggtgatgggatggaaactgacaattattacaatgtcttgaaaaatgtgtatatacaacttttttgttcctctgaactgagcacccaagatgtaatttccaagattaggaaattgttttgcctgaggactttataaaaataattaattcacttttaatttagataaactagaataatccatgagtagtggtaatgactaatctgttctcttttcaccccagtgactttctagactttgaacattagaatccactccctgaaaaagtcactctcctttgtaactagagcaacagctatcctttgtcacctttatttttctctttggaagaggaggaataatcagtggctcacttctgaaacatcatgaataggtagaatttagtaatctgaattaaaaacctccctgtaaactgaaggaagaggaaattgaccagtgggcacacagaggttctcaagggacttttttggttagccactaggtgaaatccttgatatttcatcatgtaccttgtctcattttcctgttgtgaaattgggtgttcagcattgtttttcttgtctgttctcagatcacagaactgtgtggtgcaaagcgggttggttattttggtccaacacagttttacattgccctgaaattaattgctgcagcacaatctggcctcccggtacggatagagagtattaaatgtggtgagtatctcacatttgtatgttttattgtccatggcgagtcgctcatttatgagaaccatttttaatgagtttaaacttttgtggaatttctccttgcttcctccaactcttctgcaaaataaaataagaaaacttggcaggtaggtagcttagtttctttcttttttaaatggggaaaattctgagagtaacctgagattagttcattttaactgatttgcagttaaaatagattttattctttagcaggaagagattgggccaggaattctagagcctgtggcaaataatcacattgactttaattttccacttgaggtatctataatgttattgaaggctctgttagaggagtaacaagggagtttgagtggaactatgccttttctctttcccatacctgccagtgctcagcctttaattcttagtttccaaagcactgttctgatgctagtaagtacttgggtgctaccaaaattttggcagaatgaatttatcttcttaaggttctgatttaatattttctcatcttgccatccctgccctcaacccactgtatgcttgagcactttctacaatttaaacaaaaagcaaaacccccaactattagcagtatttctgctgcctcaggattggttttaaaaatctgtatgaaaaaggtgattattcaaggggtgtgccaaggtcctctgataattcagtttgatacagattactttcatatgtccatacaggtatgtaggaactttttttctttttctcattctgagactaaaaacctcttaactgctcatgcctgtcctgtgaagtctctgatagacatacaagtggattcaggatttatggtgagcccatggaaacctcgtaggacaatccaaatggccgagaagattgccatagatggctggctgtggaagaccaagcccttcacactaaccgttagcaggtggcagtcatcatgctaatctttatcagggggctagcttgtgccagacactttcatttaatcctcatgacaccctactaaattaggtacttgtgtcagtttgattgcttaggataagctgcgataacaaatgtcacaatctcagtgcctcaaccagacagaggttcgttttccactttgcagtgggtcagggtgaccctccagggcagctgccctctatgtggtgaccatgtgatcctggctgctttatcttgtggcacctcccaacacaacacctgttcccataatcgccacaccagggaaagagtatctcaccctagcggttaaatgctttggcccagacatgactgaagttattgctgcccacactgcattggccagaacttgtcacattaatctgcttcagtgcagagcaggtgggagaacacaattctctcctgtgcctgcaaggagaggacaactgcgagtctctactatggctgcacactgcaagtctctactatggttatggctgcacactgcaggtctctactatggtgctgccgttgttcgtatcttacaagtatggaaatttgaactttagggaggttgagtaacttacctaagaatataaggttagtagaatttggagccaggatctacttccagtccccatgctcttaatttctatgcaaaatagccttgtctcaattttttctatttagtaagatgctgacagtaatctgttatacaatattttctgaatgggaaaaatattggacttgaaaggcatctcttggtatgacagaattttgttctttgaaataggtttcttgatggagtgtcatttgacaggcaggcttagtattcattgctgcaagacacagcggccatttgctttgattagttgaaagttgcatcacactgaatttggatttgtggtaggcactgatagtttttattccattgtaaatgatcattaagctttattatagtatcttccaattttatcttctggaaaagttagagctgctttattgtatacagaataaacttttgacacttttgttacttattttaagttagacctaagtcttttacctgatttgtgcccagattgacagtttaatttcctgagggcagggagcaggattgttgaagttatcacttgtgtaaaggattaacagtttatcacaaatataaggctttctcagttttattttataaacccagttgctgccttttacctctgagagtttatatatgtccagagttaattctgaattatcttccttcaccactctctactaatccatttaaagattgattaaataaaattatttgcagttagcatatgttgaataagaattagggcaagattgggccaaactttgagctgccacttagaattttccagtttgttgcttgaaatctattagcttaatgcttgatgacacaaatcttgaaggccaaagggatcactctgtgagaacctaatctgaaaggctgtgctagccctgtcacacccagggcatcatacccagggagttgtggatggatacccttatgtcatgaataacatgcacctgtgtgtatgtgcgtgaccctctaatccctagtccttcccatttcggtaaatgccaccaccatcctcagctgcacaagccagaaactcagcagccatcctggattcctccttttccctcactccttaatagaatccatcaaaagtcctagcaatgtggctccaatctcactccctgttgcctctatctctttgtccctgctagaccagacaaccttcatctacttacctggacaccacaatggattgacatcctagcccctcctctcttctctactgtgatctctcttttcccactggttttttgtttgtttgttttttgacagagactcgctctgtcacccaggctggagtgcagtggcacgatcacagctcactgcagccttgacttcctgggtgcaagggatcctccaacctcagcgccccgagtagctgggactacaggcatgcgccaccactccctactaatcctactaatttttgtattttttgtagagatggggttttgccatgttgcccaggctggtcttgaactactgagctcaagtgattggcctgcctcagcagcctcccaactttttttttttgagacagggcctcactctgtcacccaggctggagtgcagtggtgtgatcacggcttgttacagcctctgcttcccaggctcaaatgatcttcctgcgtagctgagactacaggcatacatcaccatgcctggctagtatatatgtctttttgtagagatgggggtcttgttatgtttcccaggctggtctcaaactgctgagctcaagtgactctcctgtgtcagcctcccaaagtgctgggattataggaatgagccaccatacccagcctcttttcctacttttgaaagtgtgatcttttcaaaatacacagcagattattccatcctcatcctttaaaccctccagtagtctgcttgttgtactttgtaaaacattcaaagtccctacactgatctgtaacaccctacacaatctagttcttgcctacttttccatcctcatctcaaatcttaaacccttgctcactacctgttccccagtctcagtggccttctagccatttctgggtgacttttcctgctgcaggccatatgtccattttatcttgcagtcttgggttcctagggatctgtttttcctttctgcttcccctggttggctccttcccaaccttcaggattcagagtctgtccctactatcctacctaaagtagttctgtcagattcattaattcatgaaggaaccagcatatggtaaaactggctcaagaaagtatagagagtcagatttatttatagtcatagaaagaaaggatgctggaatagaattgctaaattaggtataaagctaattaacgccctacggggtaatacaagtgcagcctggctattgtacttttttctaagatgaaagtatttgcattgccgtcagacaagaattacttgttagctaacagttttttccaagttaatatctaccctttcaggattatcaaatgcccaaccaagagtaaacagtaactcagagcagaagtccatatccctaggaagtgaggtgatccttgggtgggcctgctgggtaatgcttctgcagggcaatctcctccccactttgttctttcccagcatctgtttcctgatagcacttagcagagtttgcaaatattccttacaggtttcactattttttttgtctgtcttcctcacttgtccagtttgtgtaagggggagggaagaggatctgacaccccttgcattgtggggcattataggcactctgtgtgtattggttgaatgaatgaatgaagaggtgcatgtctacgcatgaggagggtgtcttaatcatctgccactctttaatctaaaacgattggaattcagattctcctggaactccagaggagtttttacagaagtcatctcagtctgcatatcatctttcttaggcactgattttcaaccttgtcggcacttgagaaccacctggagagctttaaatataaaataaaaaaatacagatgcctgggtccatctccagaaattctaatttcatatatctgcagtccggtctgagcatcagaatttttaacagctctccaggtgatttttgtatggagacatgtttaagaataaaagctgcatcaagcatttttaagagctttgcttaaactgtgtgtgtgtgtgtgtgtgtgtgtgtgtgtgtgtgtgtgtgtagttacagtagctgcatctgaactagggtgctgtacgacacagggcacatgatttaagggggcacttactctcagggcaagtgccgactctacatttacaccaccctgagagtgcgtgcctccttaaatgttggcactaggtatctctctagccccaccctcgtctgagttggggttaaacagatggcaaaacagctagggcagaaggaaagaaggtgaaaattaaggactggtagagaatttctgatgaggaaatcatgtggtgaacatttgccctgggacctgctgttacctttctttccagggtctgaagttgagcacgtgtgaggactgagggaaggttaggcagaacctagagtagggtttctcatcatttttgtgccaggagcccctttggcagtctgaagcctgtgggccctttctcagaattatgttttaaatgcaacaaagacataagattataatggaaaccaattatactgaaataatcactaaaatagttaaattgttatataacaacatacatgcttctaggcctggcacagtttctcatgcctgtaatcccagcactttgggaggccgaggtgggcggatcacttgaggccaggagttcgggaccagcccggcaaatgtggtgaaaccttgtctctactaagttcgagaccagcctggccagcatggtgaaaccttgtctctactaaaaatacaaaaattagccgggtgtagtggcacatgcctgtaatccctgctactcaggaggctgaggcaggagactagcttaaacccaggaggtggaggttgcagtgagtcgagattgtgccactgcactccagcctgggcaacagagtgagactatatctcaaaaaaaaaaaaaaaaaccaacccccaaaacatatatgcttctttattaatgcattaaataaagcatctaacagtgtttgaaataaccactactttttcaaattagtaatatgcataaacagtacttcaagatgttggcccggcatggtggctcatgcctgtaatcctagcactttgggaggccgaggagggtggatcacgaggtcaagagattgagaccatcctggccaacatggtgaaaccccgtctctactaaaatagaaaaaaattagctgggcgtggtgacacacacctgtagtcccagctactcaggaggctgaggcaggagaatcacttgaacccgggaggcggaggttgcagtgagccaagatcacgccattgcactctagcctgggcgacagagcgagatgccatctcaaaacaacaacaacaacaacaacaacaacaacaacaaacaaaaccctaatgtgataggtgacaaagttaccggtattgctagtgataatacagtggcttgttgcctacattcataatggaaagaaatgctaaatttcagttatagtagggaaaatgaagttgtaatttttttttttttcctaatcaaggtgacagaccccgtgatttcttttcactagtccctttgggagcctgtgaactctgatggtgcaatgacatgattcatgtagtctttggggctgtgttccccaaactggtttatggtctggttgcagtctggcacagtttagaattaggacaaaaggatgagttatttataaagctaaatgtattcaaatctaagattgggttttttttggttcctcttgttaagtgtcctttgtgaaactgctaatgggtaatagtttggggtaaaattcttgacgagataaaacattggcaactttatgttggctttcttcatttctttttttgttgttgttgggggagagatttttcctattttgtgaaatccccaaatttgtgagccactgttgtggtcacgattctactgccaagaagatactgaggcaaatcattgaattccctttgactcctcccttatctgcaaaacagttgttctccacctaggtgatttcgtccctttagggactttcggcaaggtgaggagacatttttggttgtcccagctgcggaaggggactgcctggcatctagccggtagaggccagggatgctgctcaacaccctacactgcagaggacaggaccccctcttccaacaacaacaaacttatctaatctaaaatgccagtaatgttgagactgagaaagccttctgtaaaataaggatcaagacttaggaactctaatcctgctgccttgcttcctgtgctctagttagtttttttgtttttttaatcatacaagaaaggtagaaggattttgcagcattgagtcctatttctgtggcttttgttttcaaagaagaattattttattcaaggaaaaataaaagcagttattctctggttgaattgagggtggggttccctgtgctttgcctatttgacaaaccctccctatctcttagggctaggagagaaatcttttgagtgtgacaaccagtttggtaattcatagaaaagacaggataggaagcccaagggtaaagaaagaagcccaggaggtaaggttgtagctggctctgtgtgtgtgtgtgtgtgtgtgtgtgtgtgtgtgtgtgtgtccacacagtgtctctgtattttgaacactaaatactatgttgggatgtctcattaagctaaggtcaactcatcctttctgactgacgtccaacccaatccccctttccttttttttcctcagtgttcctttgtcaatttcctttaccccctctcccagccctgctacagggacacagagctgctttggacaaagttcgcctatgcaggttcactgactgtacggctggacatttgtgttttctaggggtctgtccctctaccccatagcgctgtcattagctctattgttgctcctccccaaaggttctccccaaccttttgagctgtggattttcaccttatttgtaaaaatctttgttgtgggattctttgacaatctagtaaaagctctggatcttagcaggaaaatacacattgacattatgtaaaaaatgttgccttcaatgtcaggggtttctggacccctagagctggttcatggagcccagtgaagagcccttcttccagagaaatgcagtgtatgggatggatatagaggaggtaagttggaagatgcatagtggggaaattgaaggccaaagaggtaaaataaaagggatgctgcttgctagcagcagagcccagtggattgtggacctcctaactcactcctggggttctacccgtggtatggccaggaaattgaacttatccaccatcctcctctgccaaacatttacaagatcacccttcccattgtaacctccaccccgccatctagcgattacctacccatttcctaattgacaagaggtatttcagatcaatgggcagataggaggataataggagactagatagctttgattactcaggcctgggttgataagactggcctgatttttttttttgttttgttttttgttttcccccaaagtaacttcaggaaaatgtgtagggatggtttcactttggaattatagaacattattgtcataattctttgttaacgtataagtagctggtataagtgaataggtaacaaaaagcagtgggagagaagggagccagcagtcaggagtcaagaatttttgttacggtcttagctctgccactgtattgctgcatgactaaggcaagtcttgctctctctttcctgggcttatttcctcacctgcaaaatgcagacatttgagcaggttttctctagattattttctgaaatgccacagtttcatgctaaatgttcaaatctgtactagaaagaattttaatgttcaggatggtagtatagccttgtggctgggaatgtaggtcctagcaataggctacctcattatgaatctttccttcattaccttttatttgtgtggcctccggccagtttcttaatttctctgtttcaaatgactccctggaggaaaaggtataccaataacacctgccttatagacttgttgtaagcacaaaatcagggaatcccttatcaaacattgtagaaaagcatctacaactttgttatttaatatcgtagccacttgccatgtgtggctattgagcacttgaagtgtggcagtgtggctagtgtgactgagaaactgaatttttcattaaatgatttaaataaaaggttttaaacagtgtaaaatattttctgttaaatgcaaccttattgatttagtaggaccacttttcacttcaaccatcaaattctgtaagacaagggtcaacaacctttttctttttttttcttcttttttaaattttattttattattattatactttaagttttagggtacatgtgcacaacgtgcaggtttgttacatatgtatacatgtgccatgttggtgtgctgcacccattaactcgtcatttaacattaggtatttctcctaacactatccctccccccttcccccaccccacaacagtccccggtgtgtgatgttccccttcctgtgtccatgtgttctcattgttcaattcccacctatgagtgagaacatgcggtgtttggttttttgtccttgcaatagtttgcggagaatgatggtttccagcttcatccatgtccctacaaaggacatgaactcatcattttttatggctgcatagtattccatggtgtatatgtgccacattttcttaatccagtctatcattgtgggacatttgggttggttccaagtctttgctattgtgaatagtgccgcaataaacacacatgtgcatgtgtctttatagcagcatgatttataatcctttgggtatatacccagtaatgggatggctgggtcaaatggtatttctagttctagatccctgaggaatcgccacactgacttccacaatgattgaactagtttacagtcccaccaacagtgtaaaagtgttcctgtttctccacatcctctccagcatctgttgtttcctgactttttgatgatcgccattctaactggtgtgagatggtgtctctctgtggttttgatttgcatttctctgatggccagtgatgatgagcattttttcatgtgttttttgactgcgtaaatgtcttcttttgagaagtgtctgttcatatccttcgcccactttaaagggtcagatagactttgtgggcagtatgattttggtcacaactactcaaccctgttgtagtatgaaagtagccatggacagcatgtaatcagaggatcatggctgtgtgctaataaaactttatttatgaacactgaaatttgaatttttaattttttttattttttatttttgagacagagtctcactcttgtcacccaggctggagtgctgcagaggcacgatctcagctcactgccacctccaccttctgtgttcaagctattctcctgcttcagcctcctgagtagctgggactacaggcctgtgccaccacgcctggctaatttttgtattttagtagagatggggtttcaccatgttggtcaggctagtctcaaactcctgacctcgaatgatccacccatcttggtctcccaaagtgctgggattacaggtgtgagccactatgcctggcctgacatttgaatttaatataattttcacatcatgaaatatttttcttttttctttttttttttttttttttttgcaaatattcaaacattgtgcttgcgggatgtacagaaataggcagcagactggatttggttcttaggtatacacccaagataaataaattcatgtccatcaaaaaacatttataagaatttcacagcagctttatttacaatgggcccacactggaaacaacccaaatgtttatcacaggataatggattaaaattttcaatatattcttttagggtcttgctctgtcacctagactggagtgtaatggtgctgtttcagttcactgtaacctccaccttccaagctcaagccatcctcccacctcagcctcctgagtagctgggactataggtgtacaccaccatgcctggctaatttttgtattttttgtagagatggggttttgccatgttgcccacactggtctcgaacttctgagctcaagaaatctacctacctcggcctcccaaagtgctgggatcacaggtgtgagctactgctcctggctcaatatattcttaaaagtggattgctccatagcaatgaaaaagaatgaactatgtgtacaatacattgggtgattatcacagacaaaaaggtcgtaaaaaaagcttgtcacaagaacaaatactgtatgattcaatgtatgaagttccataatggcaaagataatctgcaagtatagaaattagtacagaggttgctcggtggaacaaagggaggggattactggaaatgaacatgaaggaaaattctgtatcttaatttgggaatttgggtgttggttacagggatatatatatatatatatgtatttgtcaaaattcttcaagtggaacacttacaattccctataaatcatcccaccatacagaatactctttacataatttaaaaagaaatcaattagttgcttacatttaacattgtaataataataaaatacagtaaaatacagatttctggccacaatggctcacattcccatgtagcaactatcaactagagctgtgctgtttcagtatggtagccagtagctgcatgtggctgttgagcacataaaatgtgacaagcacaaattgaggtatgcaaggagggtaaaatatacatgggagtttgaaggcttaatatgaaaaaaaatgtaaaatatttcattaatagtttttaatgttgattacatgttgaaatgataatattgggttaaattagattattaaaattttgccattaaaaatgttttgaaatggaaaatttttaattgtgataaaatacaaataacatttcccatcttaaccattttaaatgtataattcagtaatgtgtaaatatagtcacattgttgggtaactagtttctagaaccttttcacctcaccttacaaaatggaaactctgtattcattaaacaccttcccattttctttttcctacccagatcctggcaactgcctttttttttttttttttttttttgagtgcagtgacgtgatcatggcttactgctacctctgcctcccaggctcaagagattcttgtgcctcagcctcccgagtagctgggattacaggcgcatgcaccactacacccagctaatttttgtatttttagtagagatggggttttgtcatgttggccaggctagtcttgaactcctggcctcaagtgatctgcccacctcagcctcccaaagtgctgggattacaagtgtgagccactgcacctggcctgcccatctactttctggttctatgagtttggctactcttgatgcctcatataagtgaaaccacacagtacctgtctttttgtgaccagcttgtttcacttctttctttctttctttttttttttttttaatgtggctcacattcttttttggcagataacattgaaagactgtgaacagctgctgccattttgatggaacatgagttctctgcccagcaccctccactccatattgtctagctaatgaggctcaatgtcacttgccatttattattgcatttatgctgtttacattttttctaatggattgaggaaattgaggtatttttttttcttttttgagtgacagggtttcactgtcacccaggctggagtgcagtggcatgatgcagccttgaactctcagactcaagcgatcttcctgcctcagcctcctgagtagctgggactacaggcatatgccaccatgcccagctgattttttatttttatttttttaagagaaggggtcttactgtgttgtccaggctggtctcaaactgctgggctcaagtgatcctcccacctcggcctcccaaagtgctgggattacaggcatgagccaccactcccagcctaaagtattcctaatatatctgtatctctatcaaatatggaaaaacaaaggatttttctctcttgtagagggtcaagtgtttaaaaaggagcaggcataattttctttgtggaagggaaaaatagtcatttatgtttaatatacaaagcatttctgtgttcaaagaatgtaacctaagatgaaacaacaatgaagcaaattgtcatcttggatggccactctcattgtctcctcagaccctctaaacatttagtgtgaactcttactttgtttgctgtgtgtaattcaattcagtttgggagacaagattctaaccaatgactacaaatagaccttcttcttgacagacatcattgtatagcaggtactttattgattaattttttcaaagtttcactattaaattttgtgtatgtgtgactaggaaaaacattcagttgagtatggtgactcatgcctgtaatcccagcactttaggaggccaagacgggaggatcgcttgagctcaggaatttgagacctgtctgggcaatatagcaagaccccatctttacgaaaaataaaaaaagaaattagccagcatggtggcaagcacctggagtcccagctacttgggaggctgaggcaggaggatcagttgagtctgggagttcaaggctgcaatgagctatgttagtgccactgcacttcagtctgagagacagaccttgtctcaaaaaaacaaaaaccaaaaaaaacattcagactgaaaatttacaaactacttttacctttcactttttaaaagcttgcatcagtttaagggaaatggcaccttcatgaaagttttccatgataagaatattattatgtatggttatacttctgttaagtgagagttgcttggaaccacctgaccaaagaaagtatgagagaacttcagctgtattttgtcttttgctgtttggtggctgtctgggggagagaggtggttttctaggcacatagctctaaagaaatgccatagacagggtggaagaatgtgtgaagtgacaatgtcctagacaatatctgggagccctacttaagtcctaatataataattgatattcataattcagttagtgtattccattgttccttggaggtatctgttgaatgccagtaaggcactggtcagggagcttataaatactgagcatttatttcttttctccctcaagaagtacttggaagtagagtcatcctcttatgggtagatcagggtgcaaattattttatgtgatcttgtttcatctttttagatcctttttcctgactgagctggagcacatacctgagaccaaaaccatagagttagcttatatttgatttactaagaatctagagtttcttttctcttgcttttttgcttttgaagcccattcctgctttgagtgctggagagctgcccgagattgggaaacattaagattggttactctatttatgtctcttgggcccttggctgattgatcacacagggatttgtcatattgcctgcttcttttttttttttctggtacagaattttgctcttgttgcccaggctggagtgcaatggcatgatcttggctcactgcaacctccgcctcctgggtttaagcaattctcctgcctcagcctcctgagtagctgggattacaggcgcctgacgccacgcctggctaatttttggtatttttgtgtagagacggggttttaccatgttggccaggttagtttcgaactcctgacctcaggaggtccacccgcctccgcctcccaaagtgctggaattataggcgtaagtgagccactgcgcccggccgcctgctgctttgaatcaaatgtgaacatagcaactaaaagtaaacatcatgtggatgttagagaaccaggggccttctttgcctggggaactctaggatacttgcttgctgttgctaagatgttttctggccttagcacagcatcagtcattgaaagtgcagctgtgtttttggaatagagagctgatggaagtgcaaaggcacactgatgagtattatcctgaacaatggatacagatgcaaatcattatgcataatccataatgtccccatttttgtagggttttgtgctacgtgattgtgtgtgatttgatgtgctgagaactagaagtgtgccaaagtatcatttccgctttcagaatagttttgttagaattttgaaagatgagtaaatataccagaccgttgcttttcaactctttgtagcattttgagtggctaatggttttgacagaagaatgtggctgaatgatagattgattgctctgacttgatattgttttccttattccattatgaaaagacaaccagagattggatgtgaaaattccttaaagaattacataggatgagaaactgttctacccactaagtttgccataggaacaagggaccattctgtagagcactggtaaagtaccagcttgcctgcattcaaaccgtggctctgccacagatgagttgtgtgatcctggggacattacttagctcctttatgactgtttctacttttgcaatgagggggtggtaatgatagttttatcatacagagttgttgtgaggattaaatgagttaatatttgcaaatctttaatactgtgcctggcatatttaagcattatatgaattttacctgccaccatttgtcacttattattgtattatacagtgtcatatcctttttcttggttattgaaggatgaaatgggagatcagtcccaaatctgaatttattctgcgatttggcaacattgaaaaatgttaagccagaatactttggttaaaccatagcattttaaaaatcaggacgttattataggagtactcattgtatctaaatctaaatttatatttagtgctctggaatttttcctcaaaaatgattcatcgtttggccattgagttccccttttttgcagtttttaaattaagtctgactagagcttctctgatttctggtcccaaagaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggtaaacagtttgttcagatgtgttcatttgattctgaccatgaaaccgcatgtagcagggcctcgtatctactgttcagcttccagcaaatctcaccatctggaacccaattacagacttggaagtgagccagtaaagttttctcctagcaagaaagagagaccgacacatatgaatcaccaccacccacttaagggccctttagagcctactttaaagtagaattgtgtctaaaataaggctaccgatttaatacatttattgatttcactagctcagtggttttctaaatggattcttggaaatgtaacttccaggagtttttaataggttctcttctccaaaaagaagtctgtagaaaaggtttctcctattataataaatgtgtttggagaatgctgcttcatattcccttgttgagggaaggactaaatcctcagtcttggaaattcgtagtgcacattagcacggtaaaagccctgagaagttctgcagtgaagagacctggaaatgtgtgtttactaaacttctttcaccaggaaattctttcttggggaacatatttggaatactatcttgggaaatgctgccattacccatttagcaggtttggaaccagaacagggaggataggcttttaaaattagaccactaattgcaatggtcagatgatgattggtggagacaacagtataaaatctcagaagagtgggcagatccagaagaagtaaatagtctacacattggtgtaccctgcaggcatcaaggtatagctcatacttccagcaaagatactgaatcatgcagagaagtcaaattatgttcaacatagtgtcttctataaggtaaagaaatttattataggaacacttgaggctgggcacggtggctcacgcctgtaatcccagcactttgggaggccaaggcgggtggatcacaagaggtcaggagttcaagagcagcctggccaacatggcaaaaccctgtctctactagaaatacaaaaattagccgggcgtggtggcatgtgcctgtagtcccagctacttggaaggctgaggcaggagaatggcttgaatccgggaggcggagattgcagtgagccgagatcacatcactgcactccagcctgggccacagagcaagactgtgtctcaaaaaaaaaaaaaaaggaacactcgaatgaaaatgtttttaaaatgcaatgaatattaaatgattatgttggaaaactaacttctgtgacttaccctgtgatgttgtgtagatgaggtgttgctacagaagttttatatggatagttaggggaggtgtagcacatcctgttaaacaattccatgtactgtcactttcataattctgacacattttaaatcagttcttcagggatatatttaaaaaggaagaggtataggaattttcagtcaatattctttggcatattttcccaccagcatttggagaggaatgagggtccactgtcccacggtggttgatgccctgggaaatttccaggcccagtccctgattgtgtgaatgagaatacatcctttcacttcaggctgagtttatgcatgccccacccaatctatgggtgtgagctcatgctttagagcaaacatattttgctttttcttgaagaagagtatttgatcagtatttcagattacatatttctctttagactaagggagcctatatatatagtctgtgtgttgatagaaagcattgttttggctgggtgtagtggctcatgcctgtaatcccagcagttggggaggccgaagcaggaggattgcttgagcccaagaattcaagaccagcctgggcaacatagcaagacctcatttcaaaaaaaaaaaaaaaaaattagctgtgtgtggtggcgcatgcctgtagtagctactgggggtgctgaggtgggaggattgcttgagcccaggaagtcaaggctgcagtgagctatgatcacgccactgtgccccagcctgggtgacagagcgagaccctgtctcaaacaaacaaacaaacaaaaaaaagcactgttttcttggtacttgaatactccaaagttaccagtctactagtaaagttttttttttttttttttttttttaaagaggaaactcagcagcagataaggttgcttactttgcctagggttctacatcaggttcatatttgaattgagattcaaattgtagcttgttaagatttcatcttagtgtttgggagtaagctggttggaatggtttacctataatgaattgttttgcagtctctcattgttaaaaaaaaaaagctagcattttactttgacatggtaagctccaagaatattaagtattaagcatttagaaatatatattttaatattcacatttgctggaagacttgataagtataaatccaggaaataaatttattaatgaatgaaaatgaaatctatccacagagagatcacaattgggagcgggtatgaatgttatttcatgtgatcagtgtctttcattttccaaaggaaaatattattggaataaccaaaagtgtttcaggctggttttagtaatttaggtaactcagcactgatgagattttattctctgggagactttttgaatcctcagacactgctgtttaaccatgctgcatttttgagaaaacatttccccccatttgttaaaccagctgggtcaccagcagtagagttgcgttatgcttcctgactgcagctcagaacgccaggcttgagtgagcgcctctgaactctgatctggttctttgaagcaggaaacacagtctcccacgatgtcacccctcgcctcccctccttcttccccgcctcattaccagagggtgcccttgagccatggctacagcaaactgcggagcagcgcagaacagatgcatccaggtaagaggcgacctgggggccagctgtcccaggcagtgtcttagagactccttaatttaccaggcggtaacgcttcaagctgcttaatttcctgatttaattacccctgtctttggaaacatggctcaatttaattttatattctcaagcaaggtttttttttaaaaattgatttaaacatatttgagtaatgtttcatctcctgtcctagaaactagttcgtctttagacttgtaaacagctagatgatttaatctttcatatacagattttattgaatagaacataccatattaagggcttgtattttttttggaattgttattcctttctgtaagcacaccaaagatatttatatagtaactgctttaatgaaatttcttaagaaatataactgcaaaagcaaaagagttgatccaacctttgaagactgagcacgtaaatgaaaatatataggtcctgtgctttggaataaggataaaggaaatgctaggggtagcattttgctgaggggtatgtagcatgcacagttgtggggttgccttcttgctcacatttatgctctgctggcctcgttaggtggtaaaatacgttagttctgaggatgacttgcagagttggctgtttaggctgcagtgcctaaagcactggaaattcactgcagcatcttgtgcctcctggggttcagactcctagtttaagatatgaccaattaaaggtattctagaactggatatctgtaaacccccacccccccagttttgttttgtgggctgtggccccaaatgacccagtttctgcaggtttttactgcattaaaaatagtggtgacttttagagggacacagaaataaaactgcgcgctaggctgaataaagagaggctgtaatcttgcagagagaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatgtgagtataaaatctgtttggaaattaagtcctatgcacatgcaagatgatgttgctaatggatagtaacaaaaaaatcactgtcctgtaacttgaatatctcagtggggttagaaactaaatggagttgagaattcttcattttcctcttatagtttccctgatctgatttccctattttcaggagtgggttttttttttttttttcctatttctaatcttacttgggtttggaagttggtttttaattcacaggtgaaactttttgttctactgagtcagcctgtcagcaagttctacctttggtattccttagaaaacttttctgttcctcctccttaatgccccattccctcctcattccatacaaattgggcttccatttccccagtggtaaggaagcagcttgcttctctccatctttcttgactctcagcagcctgtgccaaagctgtccatgccttcatttcttttcatacttttttaaaagtgaggtaaaatatacatatgataaaatgtacccgttttatttgttcatttttgagacaggttctcactttgtcactcaggctggagtgcactggcgcgatcatggctcactgtagccttgatctcctaggtttaggtgatcctcccacctcagcctcctgagttggtgggattacagacatgtgccaccacaccgggctaattttctttttgtatttttttgtagagatgggatttcgccatgttgcccaggctggtctcgaacccctggactcaagcgatccgctctccttgtcctcccaaagtactgggattacaggtgtgagccacaatgcctggccatgcacatgttttaaatcttcaatttgagttttagcaaatggataggcccttgtagctaccactttgatcagtaattgaacatatccattatgccagagatgaccctctccggtcactccctgccccctaacgcaatcactgttctgattttcatcaccatcattagttttgcttcttctagaacttcatatgaatgaaaacacacagaatgactgactgtactcatatgtgtttgccatctttccttcagcataatggttgaaatttatctgtattgttgtatcagtagttcattcctttttattatttagtagtgggatatattgtgtgaatgcatcacagttcgacgatctgttctcctggtgctggacatttgagttgtttccagtgtttggctattatgaataaggatactatgaacattcatgtatgagtccttctgtgacatatgctgtcatttccctggctcctaggaatagagtcactcagttttagggtagttgtatatgaaactgccaaagagttctggtttgacactgaacttcagagtgatgaaatctttaggtttttttttttttttttttttttgtacacctccccttggagaaagatggtacttccagttcttattaaacctcttgtaaggggatcaaagaattatttgttttgcactgtattgcatgtttggggtttcatttgggaagaaagagagttgagtaatagctactttttaaccttctgaattcagatccaattaaggaaggagccagaagtcagacaattgatggcctgaatatcagctttattactgatatagctgatcagagcacatgtcttagatttgtgaccagatgggctttagacactcacctttccagtcacaggcaggcttggccatcccagatttcccacacaagtaggaagagaaaatctgcctctccaaaaaaggccccccatgcagctgagtcttcatccaagccctactgatgagataggtctgtctcttccaagggaaggcccttgtaggtgagggatagaagccaagggccagatggtggcctgttcccccatgtgtctcccctggaagtagaagtagaagctcttatgggaagcagaggcacgtgggattcacttcctaaggaaagctcatgactgctagcaccccaaccatgccacagttcactgtgtttcaaaccttttggcagagcgcaattggtattagtgatttaattcagtgctccatcaacacagaatgattttaaaaatcctacttctcagaagacaatggtggcctaccagctgagacttactttttaaaatttggattatgtgctctctatgtatgtatgttttgcagtttttatatctgtattcattcttagcaggttctgaaaatctacttgatgggttgccaggcaattgttttgctattttaatgtgtgttaatgtattgtaacattgtgttccagttactaggaagaaatacaaaaagcagatgtgagcccaagagtgatttatcattcttgatgtgctattgttgtaccttctttattttaaaaagagcaaactatgttaaacatgaggtcataacaggctgctctgctctctacctaattttatttgtaagtaagctacagaaataaaacattttacttatttatatattttcaaaaacttgaactattaacctatagagatgagaaagaatttcaacttgggtgataatttctgctttctgttggagctgcatactacctggttatgtttaactgtctccctgccatattggtaaggtcattattaagtcttctggaaataaaaggagtgaaaacatacattcatttttgtggcttaaaaagttattttaaaggcagcaaaattgttttttaaaagtttggttattgaatagtagaataataaatataaaatatatttattcattttcgtagtcttctctacatgattttacattctgtttgatttatttttcaaaaataatgttggttcttagtgttcaaaatgcacattagttttcttcttggggaagtggatgatcaatggaagacatttacttaggggggatatatagaatttacctcatatttagaatttgaacacttatgacacttttctagctattgttgctttctatcccaattgaagttctcactgttccaccttcacaatttattcctaatcataacccagtgtaaatatttttctgcttatcatgaattggttgaatgtctttagattgtttagtgaaattgtgccaaagagaatcaggggttgtcagtcctagatggccctatgagtattctgttgccagttctttcctgaaaagcagatgctgtatcagtttgaatgtgaagtcataatttttgaatggaatctttgcataccatactgactttcctttctgctgtttcagcaccttatgaagctaggcagccccttgtccagcccgagggatcctcatcagggggcccaggaaccaagccccttcggcatcaggcttcccttatccgggtaagtgatgatgcagggttatgccaatgggacagtagagtcaagctttgggcttcggggacatggctttttgatggaccctttttcattgcaaggaagatataaaactgatccttcatgcaaatattgcatgtcttgtttggttgcttgtataaattactaaatcttttctactgtgtatgtctctacgccttctcagtgtctctagaataaactaggctgcttcttgatctttagtatatctaaaatgtccctctgccttcacctatctaatcattagccaccactttcaggagagcttcactttttctaaagcagcccatcttgtctctgccttattctttattattactcatttaatgcatagttaactgttttccatttgttttgtgcctctaattacatggtaaacttttggaaggcagaagtagttctgtattctctctcagtgcctagaccaagagaacagttattgtacaatggcagcagctgctgtttccttatgtaataaatacaaaagaaatattatggcaaaagcttctggctataccacagcttagacaatttcagcttccctttctgcagtgttttcctttggataaagagctcttattttgttctctgtctgcagctgttgccttgtgtagtgtctctgggtcctgtgctggggaagttatattctcaaagaagggtgtgtgtgtgtgtgtgtgtgtgtgtgtgcacgcgcgggtgtgcaggtttactatttgacactaaagaggaagtggggcagtttgtataacatttcagtcatctaactcgggaataaggaacatttttgcacaggcacttctactcagaatagaagggtggtgtcagacactcccataaagatgtgggctgctaggttggaataggataaacaaagtctaaagaaggtcctggggttcatggaataccttctggggatggggcactgtgttagatgtggtgcagaacttgattttctaaggtgggactctgtgtacaaataatttcttaaagataataatttagccataggctattttttatatttaatgcttcctacaaccataagatctagttactgctgcttctaatagtataagtgagttgactgtggttgagagaggtcaaatagctggtttaaggtttcattcataactagtcagtgacagagccagaatttgaatccaggcctgtccaatgtcaaaacctgctcctttcattactttgtcctacattagagtcccatattacaagaaggctaggttctagagttgctacataaagaaacgttgggtgtagtaaaaaatactcttgaaaaatcccttattgataccacactggagaaccaatatgccatttgctcccagggccagtacagctcagttttatccccaagttggaaaacacatttgtttcttcagctgagctccagatgtagtagttggctgtgtttagagatcctgtggtacaaaaatatgtgcctttaaacacgagaatcacacccactgtggagtgaggtttacgttagaaaaggtatcagtaggactgggatttatccctaagctctccaaaatgtggctgtgtaggttcctacagagtgtgtcctgggaatacagaggccagatcctgaatggttaggatgatagtcaaactaccagtgcatactgagctttacagcagtgtgactgggctcactagaccctttctacctagcccctggctggcatgggcatggatgctcatttggattggcaccctgtggcttctcttctaatctccatgttcccttttctgctgacaaacatgcttcatgagcccttcactcaactaatatttagtgaacacctattaagtgccaggcactgtgttgagaatacaaaaatgaggtataacactaacagtttctgccctcatggagctactggagagatggtcattaaccaaaccaccacaaagtaaatgtataattatgatatgggatatcagtaggaattacactgtactttaaggatgaaaatgggcatggggtatgacctagccttgaggggcaggggctgatcaaagaaggcttctggtgggggagcaacattcgagttggaataagggtacatgggtgttatccaggtgacagggtgggagtgcgggagcaaggtgacaagatggagggaaccgcatatacaaagacatttcctatgggtttgccattttatgaacattatctctttcagtgcccacagctatcttatgaaataattagtgttgttatcccattttcagatgtcagaacctgaggtttagagaccttatttaatttgcccaagttcacagctaggaagtggcagggctggagttcaaacactggtcaaggttcctcagtctctggctcaggaaccagatagatggtggtgtcacctgttgagctaggaagccctagatgaaatactggcactggggaaagatcacaggttcagtgtttgatgtcaggaactgaggttttgagatagtccagagaagctgttgaagaactggtagattacatgggtctggagcttgggagagagcttaggctggacataggtatttggcagcaattggctatcagaaggtctcatggtatagtgcagaaaaaaccagacaggtgctcgcccaagtccagcaaaactctgtgtgaccttgggcaagttccttctcttttctgtaatacaaatgacttcgaatggatttaacagcccattgtaacaatcagcaacagtccgattctcttaatgtgtctgtggttttcatggctggtgtgtttttctttcctctgttcttaggtttccttcttatgcctgttaacttggtttggctggactccgtgttccagaaagcaaaatgccaacctggattagtcatgtagatgaggggatttgaagtgaaggttcttggtgataagggattaatgtttactgggcatggtgctaggcctaggctggggtgactaatccccctcatgttgtcacgttgatgtgccgatggcaaccttctttctcttctaactagttctctggccttgtattcaagttcttcctgcctgattacaagggggcatgtcctctgggtcctgggggaagcctttagggactcccagccagtgctgttgcaacccatggtgttggcattttagaggtgcttatgccaatccagtgcctaaacattggaatgatttgtctttttgcttactattttaggaatttcacttttgttcgggtgttggatttttttccctttgaaatttcagacactaagcatatcctatgttggtagatgattgatagtgctttgtaaagaaattataagacttattttctgcttcatctgttatcatatgtttagatgttgttttgtggtttgtttttcacaaattaccctcaacatctagatgatgtagtcatttgtaattttgctggcaaaagatttagaattgcacgctttattcctactgttctcagctgcctctgtttttgccagggtcatgagaaactttatgttaagccgttgtctttattgtctccttggcagctgtggacactgaccatcttctcgaaatgctctcatcatttggtgtccattatgcctgctctcctggttttcctcatgcttctatggctgcccctgcctcatttgtttcaatcctccttcctctgccctccccttgttatgctggagactgctgggcctacttctcactctacttactctttagatgtgtggatgctcatgaccacatagcaccatctgccagacatcttcactctaatgttccactgtcactttcagctgacatgtctttctcataaaatcagctttcactcttccactcctagctccacccacccatcagcacaggccagaatgctggtcattgtctttgacttctctttctctccttatgcctgttcagtccccaagtcctgaccataccacttttcaaatagcttgtgtctgtccatgcctctgtacttcttcgttcaggccattatccttttcactgattgtattgtattagcctctctcttgtttcttcttgcttccacccttgccttcttccaattcattattctcattgcacacaaaaacaatcttaaaaacacaaatctaatcatcctgctgacttgattgaagcctgtccctctctgcccatggctcttaacatgtcatccatgttgctgtctggccctcgcctacctcctcggccacagcagctcactgccgctttccctccactctctggccatttcccggatggtcagtgttctctgcgtgggagccttactcttcaccctcacttttgccttctttgttttctcctttgtctcaattcatctatgcttttttccccattaagaacgtgaaacgtaagtgttttctgatattttcttgtatatgcgatgtttcctttttttttcattcttaaaaagaaaaagatctattgcttgtcagctcatttatgtgtgcaactcagccagagggatgggcgtctgatcattattggtttcccatctcagaggcaaccagggttgcctgtttcttttgtatcattctaggaacattttacgcatgtacatgcaaatataggtattcatatatattaatatgtgtgtgtatgcactatatgtatttatatatttatttatttttttagacggagttttgctcttgttgcccaggctggagtacaatggcaccatcttggctcactgcaacctccacctcctgggtccaagcgattctcctgcctcagcctcccgagtagctgggattacaggcattctccaccatgcccagctaattttgtatttttattagagacggggtttctccatgttggtcaggctggtcttgaactcctgacctcaggtgatctgcccgcctcggactcccaaagtggtgcaatatatttttacctgaatttagggagacatgtttggcaaatgaatatattcttccagctagattgcactagaaaaaattatcttttatttaaaaccaaaacacattcacttttcaaaccctcaggatactgttgtgatgttttctttgctttttggagggatgaaagtaacagttttctagaacatattctcaacactcactactcttcttcagagatgaaaaaatgacaaacagaatttagatacctctattactctaccattcctcagggggcttagctatatttttggtgtaagttttctaatgatcaggtaggggaggggatgttaggcattgttagccagcaccatattcatctcgaagtgcataacttgaaaaatgtttatttaacttagttatctcctttcctcctcatctcagtttcttgccgtacctcctcccctagatataactgcaggtacttacggccagaagcaggtgatctccactccttgggtcctcttggaacccaagagaaaaggcaagtatatgaaagatgattaaagaaatgaatattcctgaggctctgtcagagtggtgttggcctgagtcaaaagataattgatagtcaccacaaataaattgttcattctaagagctttgatgaaaacagcaggaaatagcctttgggggaggctgatattgcaccgagagatcttcttgtggcatgaaagatattttatgggtagactggaccaggatgcaagcaggataaggagagcggaggagtgagaatgactgatggtttgggatgggattgagtgaggtgggttagagttgagtcatgagagagttggtcatctgagtttggaagaagagtgaagcaggtaaacaagcggggcatactgggtactgtcttggctactctggttgtctaacctaatactcagcccagggaattgacccacagagcaggtcaggcccgcccggattcttttggggttcaagaattatttaccaaggcattacttggtaagtaagtgttcatacgaacgtgtgtgagctctcaaacacacttgttcttcagagcaaatacagattttaaaaatatgtcaaacattcaacagatacaaaagggcacagtgaaaactgtccctaccatttccccgcacagccactcatcccaggggcaactgatatgacccatttattttgtatagtactatacaaaacatttatataatattgtatatgaatatcttttttatatacaagtgaaaataggtattatatataattacatgtaatatatgcaaaacacagttatgcttttttacacatatggtggcatactatacatctaacatgcatttagcactaacaataagctttattaacgttctatagcagcacataaagtacttcctcatctttttgttttttacagatgcatagtatttccttgtctgcgtcttgtgtaaatcatttagccagccccttttgattgacatcttgtacttgcaatcactgcgttgtttgcagatatatgggagaccaattcctagaaattgaattattgggtgaaaatgcctatatatttgtaatttttgataacgactttcaaattggaggtatagcagcctatgtacttgccaacaatatatgaaaatgtctgttttctcgtacctttgtgaaaacaatgtgctaacaaatttatgggtctttgccaatctgataggtgaaaaatgatagctcactgtagtttaattagcatatctctttattagtgaagtgaaatatcttaagtttatgagtcacttgtatttccttttctgtgaactgttgattcatatcaagtgcccctttttcttttgagtattggtttgtcattcttaatggcatgaaaccagaagctggtctgtcttttcctttggaccagagatatactggagtgtgtgtggaagatttctccctgagtggtgagaggagatgctggcacctgaggctctcgaaggaggttatggaccccagctgcttcccagttctggagaaccccaggcctgcctgcagtgcagatttcttgtttataaggtcatgacagtaaagttgaattacttagtttatgggtagagattagggctaaaaaaaaatcctctgttgttagagatggtaaatgtcaacactgtgtgtgtgcgttgatctctcagcattgcttagacagctaaattatgttcctttcactgaaatgggtgggaggaggagatagaggtagagataaagatagatagagggagagagtataagtgtgtgtgtgtgtgtgtgttaggaagagtgagtttgatgccttttctaggtatgtatgtgccttattcttgagatcttctttcaccaaattcattcctcgtttcatttgagaccccagctggacgtttataccatctcctaaggggtcaaaggttaacatgtcctccaggtgtcctacttcactgagtctactatagaacccacatatacctgaacggacactattgccacaaggaggtcctattttttcatagcctccagtctcctgcttacttattttcttcacctgcttgtagttctctttctgattttctagcccttaacttttgaggaaggatttctagctcttaacttttggggaaggaaacatttaatctcaactgatactgaagtttattttctcagtgccaatcttttctacttgtttcttttttcttttttccttttcttttcattgattgattgattgattgattgagatggagtctcgctctgttgcccaggctggagtgcagtggcgcgatcttggctgactacaacctctgcctcccaggctccagcaattctcctgcctcagcttcctgagtagctgggactacaggcgtgcgccactgcgcctggctattttttgtatatatttcttttagtagagacggggtttcaccatgttggccagggtggtcttgaactcctgacctcaagtgattcacccgccttggcctcccaaagtactaggattacaggcgtgagccaccatgcccggcctctacctgtttcttagtgtattcctcaggtgctcactgtgtaccacacttcttgacaataaaagagatgtttagttaatttagcctcccagaggtagctgaaaacactggtttgaactgctggttccaggcagtactttgtaaatctggaaaggatagtagcttattccccaggaccttttggtctcagttatatgccaggctatggatatggaagacttctttacaactggcaccattttagcccctgggcccatcagtctttcccttgatctcaggcgagcagggagtgtcatgcccccccagttgcctatcccaacaatagtcactactgactgaggtgcttctttggtcccagtgctgtgctggcccttttcagtcctcccaacaatctcacaaggtaggtattattacatcttccatttgtccatttggaaatacttaagtggcttccatgagtcagccaccatgccaggggtacactgaggagtacacctatagcctcttgctctctaggtgcttgcagtcaaaaggaggagatagatttgaatcaaatgatcccacctatgcatgtggaattaaaaactgacaattgccctaaaggccttaaaacatggtaccatgtagcaaaggaatccagcctatagctagaaagtgagagaaggctcctttaacaaagtatgtgttgagctgagctgtgaaggatgaatagaagttaaccaggctaaggaaggatggtcctgggaggtgaggagaggagtggagtgtttcctgtagaggtaagagcctctccaaaaccgcacagcagagctgggctgctgagagagctttgcttctgtcacaatcagaaagctacagcattgggaaactgctgccctagtgtcagctccaaccagatccacactacaaactaccttggcagccaaatgaaagctttgttccctgcctgtaacttgggtctgcatccgtcttccgtgggtgtatttgttgagtggaacctaagtcctatttggaattctagcagcaaaggtgttttgacagtggagtttttagctagccagcttgtgcagtgctgggacttatgctgacgggtggaatggactcgtgacccagtctctaccatatttcacagggagagcagatacatttgaagaactgaaagaaggcagctgtggctagagcctggagtgggagggagatgaggtcggagagggaggcagggccctgtgggctatgtgactgccttgcaggtgggagctgatggctcagaagttaatttactggttagtaagtgaccatgccaaattggaacccaagtctgtctgcctctggaacctgtactctttttgcacctccagtcagtagcctcattctccaaagcattcttgaattctgtccaagttgtggatgcatctgtttcccatctgaactcagactgccttgagtgtgaaggggagaacgtagtgaagagacaggcagccttggcctgaccagcaaggacaggggtgggaacgtcatcgcttcgttaatggaagtctgcagccttgtcagagtctcctcttactgctgatttctcatttttcttggctttctcctctaagcagagcacaaaatcctgataatagtgaaggaaaagtgcccttctggaacagcaaatcttggcccctgaggggagaattggaggcagtggttactaatgagcatttcttatgttaatcaaaatactgttagcgccacatactgcaatcacagtaaaatgattacatacctggattgtatggctagctctaggattcttttgtgatgacgtgccagatgcttacctgcaaaaattatgtgagaaataaaatggtgctctgtcagtatgatttaatagttcgccagccaaaatctaaaactaaactagatgatggggaggaaggtgtaatacagcatagtcatagctcaagcacagatcctcaatctgcaaaattgcagcaatgatttaggcattgcagtgaggttctttttgtaataaatgctctatttttacaggatggatgaacagatagagataactatagagcttgatgatcaagtgtacgtactttggacccagtttgtattctggctctaccatgtgccataggtgtgtggtcttggtaaattacttcccttacctaatcctcagtttcctgttctgcaaaatgggaattaccggatttacctcgcagggttgtgaagatgaaaattgattgtgtgcattaggtacttacagtgcctggcacttagcaaagcaatgaatgcttgttacctgacattcttctgtgtctaagtgatcgtttcaaaaagtatagcttattgtaataagcagcaactgtgtgttgcacattaggctcagagagattcctacagtttggcagtcagccttctgaactattgaaattagatccctaagtaagttaggtaatatgtggttaaaggcatctttgtgggtttatttccctgaagaaacagataaggttaaatttctctgttgggacttaattttaactaacttctctacagaaaaaccaaattatttattgcaacttcctgtgaatctataattattttgaaataaagactagaaagaaggagttttttaaaaagttctctgacttcagaggtaagggagagggctcagcctttatagtgttggatgacattatgtgataaatgcatataaagttcagcttcagtcagcttaagagaactcaggttaacctttctctgtctctagactgggattgagaattttttcgaatgtttgtttgtttactcattcagcaaataacttattgagtgttttgtatgtgttagtgacttttccaggcatttgggatatagcagtgatcaggatagacaaaattttctgtcctcctgggttttatgggatagcatggggtagggtgagaggcagagcataaacaagattgatcaagcataatttggaatcgtttcatgttaaaacaaaattgctaagctctgtctccttttctaggtccttttcttcatttctcattgaacactttccccacaattttacttgagctgtcttttctttttaactgggaatctccttcaaatccatggaagatgaacctatattactcaaacacagaaagactactataaaaatgaatcagcatcctggtcctatagattgtctgcatagataatcaaattagaatgagaaagttgtttgggctcataatggtctaatgtcattggtcagattgcaaaaccacaatagcttcaggcttccatctccaggatgggctttgtggttgtgaagggcagatcttcctttcctttgggtcttgcttgaaggatacattcattgagggaacagctgctataacaaataggccccacattttaatgactttgcacagtaggtatatttctcactaatataatagtttggcaggccgctgtcctcagcatggtgattcatgcaccagagctccttctgtcctgtcactgtgccatcgtctgttcagtgggcacataggaaagagagtagaggagtgctacagggtactagtcctgcttggaagtagggtaggccactggtgctcacattgcaatggctacaactcagtcacatggctgcatgtaacttcaagggaggctggaaaatgtcatttctggttgggcagccacttagtgacacctctacaccaggcatagtagagcatgaattattggaggagtctgctgtaatcccacctatcagcactgccaccacttgcttctgtgacttttttttctcagccccatgactgaccaatttccttgatctttctttagacaaattgatattcacttgggctatagtgtagtctcaccagcccattagctatccttttctttacagtagtcaagtcttctcacatctttgctaatgagatcgttttgatcagcaattgccttgtggtagtcttatttccaaaatatttttggcggaggaggcatcctcagatattcactgtgggcttagtatgagcttttgctactccaaatagtttgtttactaaggcactaacaggacactgttaaaagatcattacccctcataggtgaaatggctggactctaaaacagcatttataggatgccttcggggtaggtttatattttaaacagaaatgttctatgattgaaacaatacacacacccttcttaagttctctccaacaatgcttccttgcaattcatattatttagctttgtttgatttttaagatagtttgatagtaggggtaaatgttaccttttgggattttattaatagtattactttttaatgagtcttttgaagtctttcattataaacagcctgctttccccagagataataacttgccatgccaaatatttgcatttcacttgaaacaaaaccaaggggttgaatgttttaaatataagcaaatctaattctcctgtgtctagagaaactgtataatgaaccatatgtatgtggcttaagcagacagatgtgaaagatttctccctctctccttttatttaaaaaacaaaacactggcagagctcaaaattggcaccaagtagcaaacatctctgctcagccaacaaaaccactggagctggagttgatggggggaggcctctttagggtgcatgcaaaagtggagcttttcctggtcctggcttctacttggaaagctaaggctccacagcttatttgccctcatttctcagtgccttcaggcttcaaaatgagccattctcaggtgactgacttttcagatctttgagaagattgttgtggttgattgttggactggttcagaagacatgggtccacgcatctgggtcctgcggtgacatggcctctagctgctgacagagtggtgctgagctaccaaacagactcataggcttcctttcacaaagaacatcatagggcagtgtttccacatctcttgcaatacaagacatacctctgaacttcctcaagcttgccaataagtagagctcacactaccttttagtatctgtgatgtacctgccagggactataggtgggataaagtatctgatatggctcctgtccttcacattgaaacctgggtgaagatgtttaggaacactttaaatgttcaaactgtggtacttaccatgactatcataaagattcatatatatttttttgagacagggtcttgctctatcacccaggctggggttcagtggtacgatcatggctcactgcagccttgacctcctgcgctcaggtgactctcgcacctcagcctcctgagtagctggaactacaagtgcatgccaccatgcttggcagtttttaaatattttttgtagagatggggatttgccatgttgcccaggctggtctcaaactcctagagtcaagtggtctgcctgccttggcctcccaaagtgctgagattatgggtatgagccaacatgcccagccaagattcatattttttaagacgctcaaatcacttggcttagtaaatcaatttcaagcatacagcgagaagcaaggggaaagagatgggggggtaggttagcacacttagtgcaaaccagtagaagggccactctatgggttacacagaactcatgtgccctctccctttgtcctaaggcctttctaggtttaggagtaggaactctccttgcccacttaagttttcttggaagaggggttgggttctcatgggaatctaagaaatgagagccaaggaatggcccactggtctgtaggggtgggagttcttggctgttcatgcttgttctactgttaacaggccttgccctggttgtgttaagtttgctccactgtccacttatctttaggcttctgcagcctttcttgcccccccccccggctttgtgtcctttctgtacctacctcccagcttgtgctgatgcttggttctggcgccctcataactttaagtcccacctaccctttctctatactacagccccactgagcatctgtttagggtctactttctcttctcattggccttgatatttctcatccacattcccaagaatgagcatctgacctaagcccttgtcagagcatctcaaaggccagtatactgtgtgcccatgaacccttactcccactcaggtgacgccaggtgtgaggtgggtcatggtgcccacacaaggctgccaggcccacctttgcagcagagcatgggaacgagcagtgccgtctgtcatggccgtgggtacggcaggtacattggaggatttgagcaggggaagagtgttctgggaagaagacaaacatcttacccctgaggagtgagcatgtgcagtcggaaagcctgctgagaggaggctggggtgcgaggcttctgaaggccaggtggaggaggtggacttttctgttaggcagcaggtcatctctgcaggcttttaagcagaggagttaatcacccccttctgttcattcctgatttctgttgttagagtagacctgagacctgcctgctaagaggccactaatgccacgctggagtgaggtgatgtcaagaggagctagaaagcagatggttatggcattgaggaaagagcacacatgggctgacagggacagctaagcagcagcttcatgagcaggagggaaagggcgtgttctaggggagcagcagcttccatgtcagactcaggaatgcagcagacccaacatccagcttggagatttcttctctttttcttttttttcaatggaactgtattttcgcaaaatgttacagatcacttatagcaaacagaatggtgatggtcaaggaaactgactctgggctcctttttgaccgcagcagctatgtggaagcagctgcagctgtgataagggccgcccagcatggatatttctgtgtcttcgttcactgggaagtggagggacagagcttccgacccacatcccaccttcttcacgaatcatctttgccaccaaatcgttggctcataggtgtctgttcttgtctttcctgcccatgcctggcttttaggttcctttgctccagctctttctgtcagggctgacctggagggcagtgctcctgtgagttctccacattatatcatggccggtaatctaatccaattcaagctgacattctccaccctatgttctaccaatggaacctggtcagacatctgggctcattcaggaagtgctgctagggcatggctctggaatttggtgggagtattttggaaggttgtgtggtctgtttggttgtttagtgctcggactggattttgattttttttgctttacttatttttactgagacggagtttcgctcttgttgcccaggctggagtgcaatggcgcgatctcggctcgctgcaacgtccacctcccaggttcaagtgattctcctgcctcagcctcccgagtagctgggattacaggcgcctgccaccacacctggctaattttttgtatttttttagtagagacggggtttcaccatgttggctaggttggtcttgaactcctgacctcaggtgatccacccacctcagcctcccaaagttctgggattacacgtgtgaaccactgctctgggcctgtttatttttataataataagaggtttttgaaaaaaattcagatagatgcaacccagttaaaaaaaatcccggtatacaaaatcctgcctttgaataagagattaaaaaaagatggtcattatttgctgcctgcaggggttcactaagggatatgggtaagttcccttagctcggaaaaaggataataattaatacccgcttacatctccaaagtcttgaggtgctcaaacaagtaggagtgtgtgaaatgctttgtacatatcaaaacactctgtgaaatttaaggtattaactaatggataatgacttcttgaacatttaagagtggtttgatttacgtttagtagaaactcatctagtatgaaaatgatacatttattacaaatgattaacaaccctacagctctcaacctctttatgtaaccttccttctgactaaaggacccagatgactttgaggaatagcctgtttgctgggtgcattctcactcagcacttctggaagtatccattctacagttagtatttcatctcattgtcctggccttccgaaagcacccttaacccaaggtgtgagatatcaaagtaatacatattttacttcagagatgacatctcaaggttttacagtagctcaacattttctagtctcctttctctgaacattgtcagaggggagacaggcgttcctgggaagaattaattcctggaatggtgtgtgtgtgtgggtgtggggaatgggaggagatggccggccttcttttctagggttagtgggtggaattgcccgcccaatgattaattccctccttgacagtgtgttcagaagcaggcaccttgatggctctttagcagcaataccctcctcttctttcctagcctccttttgtcataaagcctcatcttttttatttatttttatttatttttttttttttgagacagagtctcactctgttgcccaggctggagtgcagtggtgcgacctctgctcccaggttcaacttctgcctcccaggttcaacctctgcctcccaggttcaagtgattctcttgccttagcctcccgagtagctgggattacaggcacgcaccaccatgcctagctaatttttgtatttttagtagagatggggtttcatcatgtcggccaggctggtcttgaactcctgacctcgtgatccacctgcctcggcctcccaaagtgctgggattacttgcgtgagccactgcacccggccaagcctcatccttctggtgttcacctcttggtcctgttaaggtggcccttggcaagtacctctttagtcttagggttcatgggagggatagaacaaaggcccacgcctccccctagcatcgacatttcccttcgtctgccaatgcctaccatagctttgttttctcccgcactgcttccctggttttctaggctcttaaatcctcaaatttgacttgcatgccctctagtggcaggtctgatgcaccccttgttaccctgtttattgtggtaccataacagctgttctcaccacccagctctgttactaaatattgtctgtaattcacaaatgccaaatgagaggttcagtggtcctgacttgccactcaagtaggagctggaaatgtgggatttgaattggagcttttgattcctggatttatacagcatttcagtgtaacggcaacagtaaaaaagatgtggttatagttgttctagtttcttttttgtcatttaaaaagaatccagattattttactatccactcagctaatctgaaagaatgaaaatgtgaggaatagtggaaaataagaatgatcatctttttttaaaccctttattacaattagaaatttttttgtcacttactgagtattcagtatttcatgcctcagtcctgttaactttgaagaatacaaaaaatacataaagcatgatgtctgcccctaagtttctgttctagttagattctagttatgaggcagttaaatttcttcacctgaggaaaaaaattaagcataacacatgataacttttattggtgtttaatttttctacttctcactaaagacaggttctctgagcatttactttttaatttattcttacagtccttttcagtggagagggaactacaggataacagcagttaccccgacgaaccctggaggataacagaagaacagcgcgagtactatgtcaatcagttccgatcccttcagccagacccaagctctttcatttcaggtaagaatgtgggctccctaggcatcactctcaccagaacatagccaccatcttgagaaatcattcacgcaaaatgagtatggcagccttctgtgatttcagtttgtttttcatctaaagtcgaatttcttatcagatgtaaaccatgcagaagaaaagttgccaatgacgtttggaaaattatatttccatttcaaagggcttaagtgggaatttgggggcaacttggcccagaccctgcaccttatcagctgaggcagttcttgaaatgctagcgtgtcgccccaaggggccacctctcattgcttcctcgttatattagagctcgggcaaggacagaatgtggcctcctaaggagttggtgtcacaagtctttttatgttatatgtgccttcaaacttcaaactcaggctcgttttctttggctcaaatgtttgtcctccagtttttctgagagaaattaaaatgggggaggaaaattggccagtgctttcccacttgtcagttcttctgggttgtcttcagatatatagattcctgttgagttctcatgtaaaattcaagctcagaggaactggtttaatgccagtgtggctacattttaccaggctgaaagactaacagtgaaatagtagagtctagaagaaaaattcataaagctttctttttagactttaaaatttgaagaataacaatatgtccttaataattgtaacctgccatattgaagtgtgggcaaagattagttttatcttgtgaaatgaggcacataattgaaatatacttgtataagtaattgcaaacatcatttactgattggtggtaatggctttattgacggcagaatagtacagatacaacaaattaatgttgacgtcatgattaaggaaaataagcagaaacccatattgcacgatttgaccacttgctaaccttaccccgtgctcaggtgagtttctttacgacatgtgcagatatttagccaaatacaaacaggtacttgttagaaatgtttttgttttcttttaacttttgtatcttgcagaatttcagatatagacacaactagtctggctgatacaacaaacctctgtgtacctatcacatagccccaatgattttctcttacctacagttaacacataaggttgtttcagtcagtcaatgatggcggtaccataacagtatcacggagctgaaaaattccagctccattaatcacctagtgatgctgtagccatcatgatgttgtagcacaaggcagtgctcacataaatgtgatgatgctggtaaaaacaaatctgtgctaccagtcgtataaaagcctagcacatatgattatgtacagtatataatacttaataataaatggctattattagcttattatgtatttattatgctatactttttttctttcttttcttttttgagatggagtcttgctctgtcgcccaggctggagtgcaatggcacgatcttggctcactgcagcctccgcctcccgggttcaaatgattcttctgcctcagcctcccgagtagctgggactacaggtgcatgccccacaccaggctaatttttgtatttttagtagagacggggtttcaccatgttggccaggctgctctcaaacccctgacctcgtgatccacccacctcagcctcccaaagtgctgggattgcaggcatgagccaccgcacctggccttttattatgctatacttttattgttattttagagtatactcttacttatatataaaaaaaagttaactgtaaaacagcctcaggcaggaacttcaggaggtattccagaagaaggcattgttatcctaggaggcggcagctacctgcaggttattgtcctcttctagtcacctccacagtatagaggtggaagacagtgttattgatggtcctgaccttgtgaaggtctaggctgataagtgtttgtgtttcagtttttaaccaaaaagtttatacgtgtttgtgtttcagtatttaaccaaaaagtttaaatggtaaaaaaattaaaaattttaaaaatagaataatagaataaagatataaagaaagaaaatatttttgtacagctgtgcaatttttttaaatttttaaatttttgtgggtacataggtgtatatatttatggggtacatgagatgttttgatacaggcacacaatatgaaataagcacatcatgaagaatggggtatccatttcctcaagcatttatctattaagttgaaaacaatttgactacactcttaagttattttaaaattgtacagtgtgtttttgttttaagccaagtgttattacaatggagtcaagaaggttaaaataaattttaaagtttatgaagtaaaaacttacactctaaggttaatttattattgatgaaaggatttttttttttggtaaatttagtgtagcctgagtgtgcagtatttataaagtctacagtagtgtacagtaatgtcctaggccttcacagtcactcaccactcactctctgacttacctagagcaacttccagtcctgcaagctccattcatggtaagggacctacaaaggtgaaccatttttcatcttttataccatatttttactctgccttttctatgtttcttctttctttcttcctttcttcctttctttctttctttctttctttctttctttctttctttctttctttctttcttttttttttttttttgacagggtcttactctgtgcctaggctggagtgcagtgatgtgatctcggctcactgcagccttgacctcctgggctcaagtgatcctcccacctcagcctccctagtagctgggactgcaggtgcacatcactatgccttgcctggctaatttttttgtagagaggaggtctcactatgttgcccaggctgttttctatatttagttgtgtttagatacacaaatagttactattgtgtcccaactgcctatagtattcagtacaggaacatgccgtacaggtttgtagcctaggagcaataggttctaccatctagcctaggtgtatagtaggctataccatctaggtttgtgtaagtacaccctgtgctgttcgcacaatgaggaaatcacctcatgatgcatttctcagaacgtatccctttttctagaaatggaatctcataatatgtggtcttttgtgtctctttcatttagcataatgttttagttttttttttaattaaaacatttgtgtgggtacataggtgtatatatttatggggtatgtgacatgttttgatgcagacatgcaatacataataatcacatcatggtaaatggggtatccatcccctcaagcatttatcctttgagttacaaacaatccagttacattctttaagttatttaaaatatacaattaagttattgactatagtcaccctattgtgctatcaagtagtaggtcttagtcattctttctaactagttttttgtacccattagcaatccccgcctcgcccctactctctccctgccactacccctcacagcctctggtaaccttccttctactctctgtgtccatgagttcaatcattttgatttttagatcccacaaatgagaacatgcgatgtttgtctttctgtgactggcttatttcacttaacataatgatctccagttccatccatgttgttgcaaatgattggatctcattatttttttttaatggctgaatagtaccccactgtgtatacataccacattttctttattcatctgtcaatggacacataggttgcctccaaatctcagctattgtaaacagtgctgcagcaaacataggagtgcacatatttctttgatacactgatttcctttcttttaggtatatacccagtagtgggattgctgggtcatatggtagctctaattgtagttttctgaggaacttccaaactgttctccatagtggttgtactaattcccaccaacagttagcataatgttttaaaggctcattcatgttgtatgtaccagaatttcattcctttttatggctgaataattccattatatcagtacatcccattttatttatccattcatcagttgataggcatatggtgttcttccacttttggagtattaagaataatgctgatttgaatatttgtgtaccagtttttatgtgaacatatatttttatttcttttgaatacatacctaggagtggaattgctagatcaaactgtactgggagctgaaagcattcaaattcaatctcagtaaggtctaacatttcaagaacagctgggtcttgcagttatgtaacatgtaaagtggaatgattgcctgatttcagttgatacaggtaaatcaacaatgaaggaagaaagattcctggataagtttctcaaaatgccactaggaattcttaaatctcaccaaaagctttcccaagatgtctgtcttatctctgtgtggtgtgatcaatggtattaattttcttctttttggtcagttttctattacttttctatttgaaatttctatttgaaatctgccaaatttgttcaaagttttgaacttcgtcttctaaatttttggaaaaattttgcagattttggtaaaaatgaagcagaaattaatttatgtgatttgcatctttcatgagcattatgttattgcttcttttgccctattgtaatttacatatttttaaaaaagctattcatgtgttgcttttggtcccatgattcataattgctttgaggaataaatatgtttgtggttatacagaagagattgctgaatgaaaaaattgtgattcatttgtatataaatgtaaaagctactctagctgagtaattaatggtttatttaaacaatggcacttgacaggttctgtggccaagaacttcttcaccaaatcaaagctttccattccagaactctcctatatatggtaagtacaattaatgccatatgacattcataccatcatccataactcatcctttagttcctacctttgcattttttaaaggcttatgttttgaatgatgtttttaacagactacaggagtgaatacaactcagatttttgttgctgtgaaaattaaatgttatatgaaaagtacaatgaacaatgtctggcacgtattaagcactatgagtgttaactattattttaaagtaatttcctaattattatccccatctcaatcccttttcagtctaggcagttgtgggcacatgagacttaccatcctgtagatttcattttcagacttttctgctaggtgtgatacaagtaaccagaggagcttgacaaactattttttatattttataaggctgagtgaacagaaggttgaggaatattttggagttaggttagatttgactattctagctgcctctgagctttgcaaatttggctggtgtttatcagttgggccctaattcagacttgcagctgtggtatccactgcacctttatgcactctggttccaaaagggctatgctgggatggtccagatggctctatttgcattcatgaaaatgcttggtgctgctgtaaactctcggctgtgtgtgggctagttcttccccaaaactgggcaggagatcgcactgctataaatatataattaaaaacattataatgtttatataaagctttttgcatgaggatttacagaattatgataggatttaaaattgcttgtcatgttttgtgcatcttattggaaaactactccaataatactcatgcatgtcaatgtatctgggattctgagctggatttaggttcttcaacaatatatactctggcataatttttttgtttttacaagccttatattagttttgtttttgttttgttttttgtttgtttgtttgtttttttggagatgagggctcactctgtcacccaggctggagtgcagtgacatgattatagctcattgcagcctctgactcctaagctcaagcgatcctcctacctcagcctcccagctagcttttcatttttttctagagacagggtcttgctatgttgaccagtctggtcttgaactccttgcctcaggcaatcctcctgccttggtttctgaaaactctgggattacaggcatgagccaccatgcccggcccttatattagattttctggctagggaagaataaagaaattatcattttgaaaagaataccatttgttttggcagaattcccagtctaaacattgttggcatgagacctcctatctttttgttgagacacgcctatgaaagctgaatggtattctttcgatctggcgtatgaagcagtttcctgacccctcactctggggaacagctatttcagggccccagtgcattcgaaattggaggaggaggatgtaaatggtctaaaggaaagttatggagcttaccttagaaatatattttctttcaaatagtaatacctttctagaataattttgtatttgtcttatctctatgcttgtcctaacacaagtacacttgtccctgtctacctaagagatggttaagcttatggggtcttagatataatactttggcaaataagtttcttttgtgctgagtaaataggtctgtgccttttagtgggaaataatgactgaagttaagcctgtttgagactccccctttcttcctttttgtcttatctggttccagtcagctttagttactagttttatcctaaaacataattcattccattttttattgagcttacttgtgttttcccaggagggagttctcaagcaaagaacagtttggtacaaaaatttacgtgacttgaaaagttcacggttttcctttaaagctgaaaaacaaagagcttatttctgtgctccaggtaaactgcataatggctaggacaactataaaatggctggggccacccttcctctgactgttttgaacaccatgtccagggcttttcaccccatgcagcctgcatttactgaatgactgtggacttctgggtatcatttttatttctgtgccatagtttcttgtcctatgtcctcagtgttgtaagacacaccaactagggaacctgaagaatttaaatttttatttataaaatgctactgatgctgatcccatcaatcggcatttttcttcctcggagtggcccccagagatttcaaatggatttggctaggagggtttgggtatctggtagggccatcaccacagagtctgggagttttattggcacgtttgggccaagtaacttgttctgtaagccccatggtaggtactcatgacatttgtttcatttagggagcttagtgatgctgactgtgatggagccctgaccctgcctgagttctgtgctgcgtttcatctcattgtggctcggaagaacggctacccattgcctgagggcctccctccaactctgcagccagaatacctgcaggcaggtaaggcctcaccatcaactgtaaaccttaagtacttttcctccaggctgtgtaaaaaacttttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaataaaaaataaaaaaacaaacaaacaaaaaaaaaaaacaaaaaaacttttgtttcttaaaatgatgtccagatactttggggagtccttggtatttacagttattgttctttaactgctattagactttcacatctcataatgtgaggaatagggctgatctgggtaagtgtgtattacctgtttttctcattctataccctctggatggatttgaaccaaagtcacttaccctttcatgacagttgtgaaataggcaagtactgaacctcccagctggtataaaatgaagaggaagatcctgtagagccaagtgttaacttggcatttttaggcacacccgagtgtctccgggtggccctgggcaatggagtggaatggaactcttatacctaatttaaaagtcaaaaaattagccgggcgcagtggctcatgcctgtaatcccagcactttgggaggccgaggcgggcggatcatgaggtcaggagatcgagaccatcctggctaacacggtgaaaccccatctctactaaaaaatacaaagaaaaaaattagccgggtgtggtggcgggtgcctgtagtcccagctactttggaggctgaggcaggagaatggcatgaacccgggaggcggagcttgcagtgagccgagatcgcgccactgcactccagcctgggagaaagagtgagactctgtctaaaaaaaaaaagtcaaaaaattacatgcagtgaaatgtgcaaagtgttgtcaccttaaatgtatgcttgatgaatttttgtatatgtatacacccatgtaactacaatcagatgaagatatagaatattctagcatatcagaaggttagaatagaactgttatatttctccttaataaaacagtctcgctcaaattattgttttggaccctttagatgggaaagagtcatggtgagtataacatatgtattaattcctttgggagagtagaaaaattaatagtgtgtcttgcccttttcaaaggcaaatgggcactggtctgatttccattattcatggaagtatagtgctcattgagaggccccagaaacagctggtgctttcaacaacctttctcactttttagggaagggctgttaaagaaatgagagcttagtcatgggtgattattagcaagagagagcagtgtctaaagaaactttaattacttattagtagagtatgaattttgtgattagatctgcaaaaggccttagattatcttgtctagccccttcctcatgatgacaccagattcaaagtggcaaatgtcttatctaagtttgtctcggggcctctgactctcttaaataaaaagtctgtcattttctgtgttaaatagtgagaggagaggaactcaaccaaagggcagaggccaagtttgtggctgctgctaagtgacaggtaaacatgttgggggaagagtgacccattctgggatcttcttcaaatgtcctcataaaatatgtgaaggggagagttcagagagcaaaacctactaatttctggacttggattttgctaacaatacctgctttctgcctattgcaggctgtaactctagcctgctgcccttccttagatgcttggaagactctcatgggtcccaggaattagcttgcaattgaggagcatgggaaactcctcttttctctttggtgtctttctgtctccatttcattctctccctcgtcttgtcttgtcttgtctttttcttttcttttcttttctttctgtttcttctgaatcagggcaaagaagcactggcattctgggggctatcttgacgcctacatggctctcattgccaaggcagtgcggggtcatagaggagccccttttcttgggattggagacacatggggcttttgtctctctctaaagggaattaatagctggcaaagggccaagttctgttctagggttatatttaataccttcgccgtgtcctctttcaagccctggagagagtcctgggtaacctcatctcccatacccacactgagttttctgtttgggggtcatgactagtactgttttattgttttgatgccatatggccatggaacctgtgggacatgccatgactccttatttgataagtcacttttgtaggtgtccaagtgtttcacagactatttcaaaagtcactgacataacggctgggtgtggtggctcacacctgtaatctcagcactttgggagtccaaggcaggtggatcactggaggtcaggagtttgagaccagcctggccaacatggtgaaaccccatgcactaaaaatacaaaaattaaacagatgtggtggcgcacacctgtagtcctagctactagggaggccaaggcaggagaatcacttgaacctgggaggcagaggttgcagtgagccaagattgtgccactgcactccagcctgggtgacagagctagactccttctcaaaaaaaaaaaaaaaaaaagtcactgacataatttttagacatctgaaagccctgagctaaaagtatgttaacaggaaagaagtaatctcttgattcctttcctactgccaatggcttcttttgacctgcttattcagtagaggggaatctataaaaaagagtgccaatgagccccatgtttcttcctggacttttatggagactgtcagcatgcatttatacaggaacaagggaagaatccatcatatacacttcaattaaacaaaaattgcacatcatttctagggcttgtgggattaatcttaaataataattatatagttctaacagaaaacatgaaagaacccataaaactctatcaaactcagtgacggtatattttaaaatgctttatcacctatgtttatcattgtatgaagcttaagaaaatggccagaaccacctaggtctcctctgtgctttttttgcttttctttgcaaaatatgagtgatcctattcatttttttgttcattttaatggcatctcatttagtgtttttcttttttctttctttctttctttttttttttttttgagacggagtcttgctctgttgcccaggctggagtgcagtggtgcaatctcggctcactgcaagctccacctcctgggttcatgccattctcctgcctcagcttccaaagtagctgggactacaggcacatgccaccatgcccggctaattttttgtatttttagtagagatggggcttcaccatgttagccaagatggtcttgatctcctgacctcatgatccacccgcctcggcctccgaaagtgctggacaacacgcccggcctagtgtttttttttttttttttaaagcttaactcttacctttttccaacttttttctaattgatctatattcagtctttaaaaaatctaatccagtttttgataagattggtgaagagtataaatttggttgatatcttcatgcattcataactagacaagcttgttttctaaaataataattttttttttgagatggagtctcgctctgtcacccagacttgagtgcagtggcatgatcttggctcactgcaatctctgcctcccgggttcaagcaattctcctgcctcagcctctcgagtagctggaactacaggtgcctgctaccatgcctgacagatttttgtattttagtagagacggggtttcaccatgttgaccaggctggtcctgaatttctggcctcaagtgatccacccacctcggcctcccaaagtgctgggattacaggcatgaaccacccaccacacctggcctgttttctaaaataatggaacaggaattgtatctgatgccattttacttgcaattatggaaatagtcccttttccctaatagtaaaacttcaaggacagagttgtattagttggtggcttacccgctagccttttgatagtttcatcaaaagtctccttttgatagtttcatcaagagtctccttttgatagtttcatcaagagtctccttttgatagtttcatcaaaagtctccttttgatagtttcagctgggtggggtggctcacgcctgtaatcccagcactctgggaagctgaggcaggaggatcaattgaggtcaggattttgagaccagcctgggcagcatggtgaaaccctgtctccaccaaaaaatacaaaaattagccaggtgcggtggcgtgcacctgtggtccccagctactcgggtggctgaggcaggagaattgcttgaacctgggaggcagaggttgcagtgagccgagattgcgtcactgcactccagcctgggtgacagagtgagattccatttcaaaaataaaataaaataaaaataaaaaaataaaaaaagtcaccttttgataggtgattgggtgggttctggtagaaatttttgccatagagtttgttaaaaaatacctatggagtacttactgcgtgagaggtaccacattgttcactgtggtcagaatgctgtatgacagagctcctactcccatgaacttgtgggcagttgatacgtgccatgaaggggaagtacaggtgcagcaagagggtgcatgatcttagggaagatttccttaaacgtttgggctgagatgtgaaggctgagctaaggactacataggtgaagaagagagaagcttaggttctgggaagggggaacagcaggtatgctggggaggctctgagagggggcttggagcataggaggagtgggaatttcaggccacagtggctggcgtgcacagaaccggggtagagaggctgggttgaagctgaggaagaaggtggggaacatatgacgggcaataatgtcaccttattttaggcagataagtgacacaatcagatttgctatgtgaaatgatcatgcaggttactgtccagagaacaggttttgaggggcacgggtagaaaccagaagactaagttgtggtagctggccagtcaggagcagcggggtgcttgcaatggggaggtgacagtgatatggagagatgtggacaccttggagagagatttagcaggtaattgacaaaattatagttttggaaagtgttagctttcttcacaggaagatccgctcatgataaagcatcagtcatataataccagtcagagccttgattgatagactagaaagagaaatcggtgaaattcagaccagagtaagcaaatgaacaaattaaggtgcttgtactcaactccatgtggtgctgatactcagaccagtacttccttacttacttactgtatgtatgtatgcatgtatgtatttatttaaattagatagacacgtaggtaggtaggtaggtagatacaaagacagatgaaacagggtctcactatgttgcccaggctggtctcaaactcctgggctcgagcaatcctcctgccttggcctcccaaagtgctgtcattacaggtgtgagccaccatgcctggccaatggccagtactttactgcagaaggatattggcatttcagtccctgatgggagtgggagggtggggaaggattaaaaacaatgccaatccacttttcacatttgattcaaatttttttaaaccttgcattacaattttatttcctaatagcttgttgtgacaaatttgatttgtagcttctgtttattatctgccacagtctgcttttcctctttggaatattgacaaattttctagctgttgagatatttctttcctaattactttgtgacaaagtagtgaagcagaatccgcttctaagacatagcctggtgtgaagtaattagcttaccaagtagcctgatctttcctcgtgtgaattcactcaactaccgaaataacagccagtgtcactattgcatattgaaagaaacccttaatgtgattctttttttctttgttgtaaatcagcaagaatttatgctcttatttttatcattcctgccaaccaaggagataaatatttcgtaaaatcatgttgggtgcacatcattataagatcttgcctatttctaacaatagttaaatgatgtatttccttagttaatgtccctatacattagaaactacactagtaacatagttaagacttacatattgtgatagtgatggttattgtggaaaattactatgctataacatgaagtgttcagagcacatacccttcagccagactgctgagagttcaagtccctgctcttccatttatcagctgtatgaccttgagtaagttgccctgttctcagtttcatcacatgtgaaatggggataatagaagtactgggttgtccatataaagaactgaaagtactacctcagcatgatgaatgccatatgtggtctatcagagctagctgattttgttgttatatttaacaagcacagaaaagctgatgggaaacactgattactatggctataggaaatattctgatatattctttttgtttcttcttagcttttcctaagcccaaatgggactgtcaattatttgattcttattctgagtcactgccggcaaatcaacaacctcgtgacttgaatcggatggaggtaaaagatcttcatatgctaataaataaggatgtgtatggagctaaatccattggcctatgttctttacaaattctggaaaatgaactttttttttgtttgaaaatgagcttttataacatttccttttcatacttggtaattattaatactttgatgctcagcctttcagatctagacaccagatgtatctataatttttttcccttttctccctaaaactggatgtggtaaagtaagtaacataatctctagaccttctagatgtgaaatgtagatatagccaaactaagacagaaaattctagccaagttatttactttaaccaagctttaattccctagtaaacaattttgattctatttttatcagttgggcattaataagctatactgaatcagaactgttttgagaagaggtttgagaactttatatgagggccccaaatcacattcggaactccctcagggtttttagcttttgaaccaaatgaggactgatttggatgatccccagaaggaacttggagaattcccccagtgttgggccatggatggaagggcttagccaagtgcttaggaagccttagctatggatcaataaataggagttgttatagttattgttgtcatcaccattgtcattatcatcatcatcaccattatgattactgtgatgacaatttaggatacctgcttttcccttccttaaaagatctggaaatgtttaataaatggagctttattcacagactccataatagtcagagactattagagtcctctgaccctagttgaaaccactgcaagatgatagaagtcaaagtcagggaacagggacatttctttaatttcttgtgactgtgcatgatgatttattctctcacatgaggccctcatgcctgtagcatgtgttatggatggcaccgtctgctcccctgtgagccagtcaagcctgcctttccagtgcccctctgactaacatctctctgccattttgcttctctttctttgagttgtgtcctccatggtactttcctcagatttctactcatgggaaaaagacataaagaaaagtcacttcaggaggaatgacagatgtgcatttgaagaattttggttaaaattttttttttctgcagaatgcttatgacaaagagagagataaaatagtttgccacttttcatggccctcagtttactttggggcttctagcagtgtttaaagagctttgtttatcaagccaggatggatacatctatggctctctgactatgtgtgtgtgtgtgtgtgatgggccccctgcttgcataaaatgatgaagttattagttggtcttctttaaaacggccataaaatctgttacacatgcacacgtctgttttactgttacacacacacacacacacacacacacacagtctctctcgcttgctctttctctctctctaatgtcctggatggcgttacatatattcacctttgtggattttatatgcagctagttttatatacttttgcatactttaagtggcctccttggggaggggagattaaaaactacctagtcttttttttttttttgccctatccaaagaagaaagcaaaacaacaacaaaaaatcccctcttttccaaccaaattgttatttttgaggatgctatggttttagacaatgaatgcagtaaacagaattcaaggacaaagtaatagggtttattgatggtttgttcatttaagaagtacgggtcagattgcaataatgattcaatatttcatgttcttctaaactattactgattgttctttctactagtcttttaatctatcatgaatgcatggagtttaattagattttggaaccagccctgtgatcgatgactccagtataggtggttgtgttctgaacaaagctgcagctgatttaggtctcacgtcatgagaaattggcttagtgatacatctttttctaaagacagcagagctgttagccatgtacttatttccattaagaattacagatgataatttcaagtatatttctttttatgagtgtctcttacattactggatttctttctttttctaaacagctttattgatagagactttacataccatacccatttaaagtatacaattcagtaatttttattatattaacagttgttccaccatctctacagtttaattttagaagaacatcatcagcccaaagagaaacccaatactcatgagcagtcacttcctattccactgtctctgccagcctctgataatcactagtctattttctgtctctagatttgcctattctggacatttcatataaatggaagcatatagtatgtagtgttttgtgaccgtattctttcacttagtataatgttttcaaggttcactcagatcataacatgtatcagtgcttcattcctttttaatgctgaataatattgcattgtatggatatgctacattttgtttgtccattcatcagttgatggacatttgcattgcttccacttttggctattgtaaataatgctgctatgaacatagatgtacaagtttttgtgtgggtgtgtgttttcggttctctcgagtgtatacctaggagtggagttgttggattgtatcataacttaactttctgaggaaccaccaaactgctttccaaagcaactatactattttacattcttccactagcagtgtatgagggttccaattttcccacatccttgttaacacttattgtctgcctttttgattttagacaccctagtggaatgaagtggtatctcattgtggttttgatttgagtttcctaatgattaatgacgttgagcatctttttgtgtgcttattagccatttgtatatcttctttcgccaagtgtctcgtcctttgtccattttaaaattgcattacttgtctattgaattgtaagtgttcttgtgcttttggcatcatatctaagaaaccattgcctaatattaaatcacgaagatgtacttccatgttttcttctaagagttttgtttgtttgtttttttgttttgttttgttttttgagacggaatctcgctctgtcaccaggccagagtgcagtggcgtgatctcagctcattgcaacctctgcctcccgggttcaagcaattctcctgcctcagcctcctgagtagctgggactacaggtgcgtgccaccaagcccagataatttttctatttttagtggagacggggtttcaccatgttggccaggatggtcttgatctcttgacattgtgatccacccacctcggcctcccatagtgctgggattacaggcgtgaaccactgagcctggcctcttctgagagttttatagttttagacctttacatttaggtgtgtgattttgagttaatttttgtgtatgttctgaggaagaggtccaactttatttttttgtatgtggatttctagtcgtcccagcaccatttattgaaaagatgtttttttccccattgaattgtcttgcacccttgttggaaatcaactgaccatagatgtaagggtttatttctgggttttcagttctattctattgatctatatgtttatgattatgccagtaccacagtgtcttgataattttagatttgtagtaagttttgaaatcaagaagtgtgaatcctttaacttttttcttctttttcaagaatattttgctattctgacttccttgcatttccatatgaaatttaggacaagcttgccaaattctgacaaagattgcattgaatttgtagatcagtttggagagtatggccaccttaccaatattaagtcttctaactcatgaacatgagatgtctttccatttatttagatatttaatttctttcaacaattttttgagatttctttttatctacattgcctacttctaaattatgttattctccaaaggggcctgatttataatgcaggtgggaaaagacaatgaaagaaatgcactgttatgatacattgtctgttctattggagatagtagactttgaatagaaaattatatctggatacttcgttttaatgagtaaatcccagcactatgtgaggccgaggtgggcagatcacgaggtcaggagattgagaccatcctggctaacacggtgaaaccctgtctttgttaaaaatacaaaaaattagccgggcgtggtggcatatgcctgtagtcccagctactcaggaggctgaggcaggagaatcacttgaacctgggaggtggaggttgcagtgagccaagattgtgccactgcactccagcctgggcaacagagcaggactccatctcaaaaaaaagaattacctgagtgaagactgttaaatcttagaccagttttctactgagtaatacttcagtctctttcttcagaacagtttaaaaacaaaagtattgcttatctctctggggttgtttaggttctgagaggtaaaccaattaactttttggaacaccagatggctccaggcatttactctccttccttcaagataaatgttacaatttatctttatttaatttgtgactatgttttaaatataaacaatatcaaaagacatatgttgacaagtcttcctcccatctaccaactcacctttcaattcttacatatctttccagagtttgtgtatataaataaagcaaatgtgaatatatattattcttgaacttaatcttataggcattagagtgcatattcttttccagctttgaggtataattgacaaaaaatatatatttatgatgttttcatctatgtatatattgtgaaatgattactgcaatcaagctagttaacatacctgtcacctctcacatagttacctttttttggtgtggtgagaacatttaacatcaactcccttagcagttttcaagtataccatacattgttattaactatagttagaatgtgtgttaaattgagaatttacaagaagtaaatttacagtaagtagattttaaacggtttaaaactaattcatacttgatagatttgggtattcatattagtgtgaggacttcccccctgtttgcattaggagaaaattttaatctgctcatcagtaaaattcttttatcccacaacaagaaggctggtttaatcaggtttagacaccatctgcatgacagatcttggcaaacacccacattgtggggccacttgtcagaacttctttgtgtttgtgaaaaaatacataaagaacaggtttgttcttggccaaatggaccagagttgctatgcaattctgtggctgaatcccagtctgaattcagatttaatacatgtgccttaatctgaatcatttttttcctctgtgtatgtaaaatttcaatacaaattaacatatacctcactaggaacctaaaaaaaataaggtagtattaaatgcagggtttactgcagatggaaatggtggcaagaaataatagcttttaagacattttcggctgggcgcggtggctcacgcctataatcttagcactttgggaggctgaggcgggtggatcacgaggtcaggagatggagaccatcctggctaacacagtgaaagcccttctctactaaaaaatacaaaaaattagccaggcgtggtggcgggtgcctgtagtcccagctactcgggaggctgaggcaggagaatggtgtgaacccgggaggtggagcttgcagtgagccgagatcgcgccactgcactccagcctgggcgacagtgcgagactctgtctcaaaaaaaaaaaattttttttcatcatatgtgcgcatcacttaatttctgttccaaccagtttaattcatttacttttctttttcaaagaagacatctgttaaagacatggctgaccttcctgtccctaaccaggatgtaactagtgatgacaaacaaggtaggagaagaatgagttttcttctttaaccagcgttctacctgttaccttatctactcctcttggaatggtggcttctagagcatatgagggtggttctcagcatgtaaacacatttggatagactaagtagttcaaatcattgtcataaaacaatagttcacaaagtggtagcaagagcttgagtgtccagagtcttccaactcattggccccttagtcattgctgaccctcagcctactcttaacaccttacactggaatctgatcgtagcaattaggaaatgacaggaagctgaacgaattgagaacatgttgtgtttgcggatgtgatcccagacatcagtgtaaatgcacatttgcatacagctctaatccatgaggaagttctcttctggacacagcttctgtccttagtgtttatctgtttcttggctttgtgagtgtgggagtgtgacatggagcccagctacaattttcctatcttactgggcagctgagaagcagtgcagcacagcattccgtgttagagctactcccagggaagagttggcttgggaatatctagaagtgtgggagggaccctctcccccacctcctatactttgtatagtgctttataatctaccaggtccttgctcatatactgtcttattcagtcctcacaaaactgaatggaggctggtaagttttatcacctgaaatttagagatgagtaaactgaaattcagacactatgaatcatttgcctagttattaagaaaaagatttgggacaagaaccaagattttttctaagcctcaagccagtattctgcctgttatttgatattgatttactacccatgaatgagaggcttatttgaagggactaaaaatcagtgaagctatttcaggttttattgttaaggcctgccattgattaggcattgtatgggggcttaacatgaaaaataagttttccattaagtgacagtaattgcatgttctctatttaaatacttgcttgggagagacaggtagaactggacattgtctgcagtagcgtgtactctgaccattctcctaactgcacagtggaataactgggcaaactgtaaaaatattgaagcctggatttcactcccagggattctcatgtcatcagtctgggtgtcaggaatgaaagagggagaaactcccaatacttcctggtaatacttctcctatctgcttgaggtgctgtctctggaaagttgaaaatacatctttgctctttgtagaaggagaacctatttccatactccaggaggtctttattgttttagtaaatgctatagcaacttttagaggtttgtgagacctgtttttgtaagtgatgactagcgattctttgtttgaatccaatttgcctcagaaataacattttatagttttaattttttttcctcttttctctttctttttgcttaaaaaacaaaacacaactagctttgaaaagtactatcaatgaagccttaccaaaggacgtgtctgaggatccaggtaggagaaaaccatttttgtatactttatatataattattttaaaataaaaaaacagcaagtcagtgagtagaagattgatacctctgtgatagtgtgtctgtttctctctatttatttgtcttgtattttattacaaggaaaccttttggctttttaccctttctctcttttcaggtatgagaacggggtgatatcttttcaagtttttaagtttcactgaaaggatcacgaaggatcactccgtgtgaatatagggtcttgttactaagtgcaaaattgagaaggcttgaggttgagatgatttcaacaagccattttgggttttgtgtagagtaaggaacttatagggtagatcaattggaggcccagagttggtattttccatttccaaagcagaaatctcaaatatttttattatgcttcaccaccaggaaggcaactatatgtgcttatatatggagtggattccaaggagaaaaataaaagttgtccagttttttggagagtcagacctgtgtctgtggagtcatggagaatggctgcccctgtgtccgcagctctctgttgatggagccatcattgaaccaagttgaatctagttaaaaacaaagtggctacagaagacattactatttggagctctagttataaggacatgaaaaaagttgttgctttctcttttgctgttttatttcttgtatatttttaataagtcaatcatgtttgttgtgataagctagctatcatcctaggcttatttgttgaacattggaacagaggaatcaatataatgttgaggcttatgctgtggtacaatattttccaaatgtcaagttcattcagagtttcaaagagagatgggtggagggagaggaaggagttgggggagtgggagaaaaatatggtagggggaaggagagagagagagaacatgagaatgagaataaatatgaatgaatgtggatgatgaatttcaattatggaagcctgagaaggtgtatttttaggcagctccccagttggttctggtacatagcctattttgggaaccaccagctctggaaggtgatgctacaaaatagaaaattaaggttatagatcaaccatgactccaaaagtgatgggaattcccaagcttaattttgactcttgaaacagatttgaattcattccttattgggtgaaatgctctgttaatgtaggccaacgcctggggtcagttctttctagctcttatttctggagctaaagtggatgcattccagtttttgtaaacttcatgttgtagtattagtaaaagctgtttaaatttggagtgttaaattggtgcttctccaacagcctttgaggatcataacttttcctacttttttttttttttttaagggattttagcacaagatcaagtgtcctctggggcatgagctttagatctcatttttaacattccttcattgactaggacatggcatcaccaaataaaacttgtcaggtgtgccacagcatgagaagtatgtcggaattgatttctcgttgtgcctggcagcatgctatgtgttttctgatttgttcttcccactactgcccctctctgggtatgagggagttcctcatcttaaacatagttaatccctccttttctgggaaatgtttggattcccagtgggagacacaagcgtttcaaggtggtgatttagaattctggatggctgtccttgccatgtggacctcagttcagttgctgctttttggagggttaatctctaggcctgctcctctttccattcccatttcctggaaagatgacatgccttgagtgttctaggaaggtggcagtccttttccctctttccagctacacgagaagctatgatccacttgttgtaattgctgagagtgtctatgttagtggagccttaagagattttttaaaccaatatcccattccaacctaattcagcagagcaccatgcacaatggtggtctttttcttgatgtttctggcccatgttgaggtgttttcagctggttcaccctcacagtgctgtctttagactgttgttggtgattctagcagctgctccattgccaactatcaccccatgtttttattggagtagagcagttctgtccttccattacctgctcctacctgcacctcctttgctgtcctagaagaaactaaatttagaaaccagatttccaggcttaaaaaattaggagcctttatttatgcactctacaatagtaatattttgcaattctaaagtacgttcagtttttaaattactttcaccttatctgtccctgtgagaaagaaactgcatttttattgcctttgttttctaggtgaggagactgaggttcagggaagtaacagctagttagtgtcatggccaggaggagggccttagtctcaggactcctggcctggtctctagtcctgtctctccactactcatccacaccctcaccccatctgtctgtctgtctatctcttaccagcagggctcacccctccttccacacccatccctaccagcaaaaagacaaagataatggcacttgacaaaggaattaacagtcaccatggtctgatttggggaacagtattttatcatggcggggacctctcctacccatgtatttcttgaaagcagtggggcctgagggagaagagggccacggagccagctgcaggcagcctgcgtagagggcttccccagctctgtggtgagtctggtccactctgtccacccagccccaaggcagcctcctgagctgggagagaggcttcctgaggtcgctttctttgctgcctggggtttgtaggagggagggaggtctttttctgtctatatccaggtgtgggtgcacgataatgggcaaaaggggactcaaactccttgggctttccaggctttcctgcactctggcagcgtttcagctgtttgaagttggaagatctctgtgttctcactacaacaagccaaaatgcttgggttgggagaagtgtatctcttgtgcagctgaccagtagtttgctttgtgccttgttagcatttatgaggattttcacctcccctctctgtcctgttatctaacccaaggattttaatgatcatcataaattcaggctgcttcataccaaggagggtttttatctttggagcaatgtaaaagaggatgagataatgcagtgagacattttctttttggaagaattcatgcagacaaagaaattacattcttcttgttctgtgttactagcaccttttctatgattttttatgacattttatgatgaaaaatttgcaatgtttgtaacacctgagcatagctactggttcctaaagttgtcttccatagaggattgaaagcataaaaagaggatcagtgtttttgtaaatgtttctaattactcctcacaacttgtgatggggaagaaggctgtatgggcgttggtagtgagcaagttagtttatgatttaaatttgatgaggaaaagtcatatggctgggaaaagattcagcgatattgttcataattctctgtatgatttggtcacagacatgtgggacacaaggatattttcttacaggagaagctgtatagctcatttccacttacttgtgagagctttgtttttttgtggccatgctgctctggtagtgtatttttttttttttaaaacgtgtagttagatagacttcttcctatccttcagggtagactagttcaaaatctattactagactatcatgatagaacaagaaaccctgaagtgtgaatccatcattatataaaaagacaaccccctttcaagggggttgtctttttatactggaatgtcttcattaattaacttggatttgagaatggcctctcaaatagtgcttgaccaaaggaaaaatatgctggtttttctttccttttaatcgtttctttagattttgaaataaaacaaggaaatcatgaaaatgtgggagccgtccagttctccacatgggcacttttacctcacatttacctgttgatgtgttctgtactagcccaggtgctgcatataaacttgtttaactgcagaaatgaaacccaagcaatatctttgtttcagcaactcccaaggattccaacagtctcaaagcaagaccaagatccaggtagtgttcgtttaatttctgctttaatgccctttgtgccgtgcccctgcctagaaataagaaccacaaaccaaaacccaacccatgatttcctcttcctttagatgtaaagcttaggatatgagccatttcgctcgtgcatggcctgatgggaacatgcagtaatgctgggagccttggtttctgtggtcattagtgctagaaggtgaccatgaatgccctacggcccctcaacgtgaagtggattgtgtgagacaacccagttgttgcaagatgataacttatagggggaagtagctttggaaagaggaaaatatgggtaaggtaacagacacgaaaatttgctatcatgacaaggtgaacaccaaaaagtaaaaagtctgggtaataaaatctacagtagggaaagaaaatgcttctgataacttcagtgaagcttgcagtttcaggtaagcgatgtttatggtctgtttgagcctatcttagtgcccctgtaagcttcacattttttaagaggctagtacaagagagaaagccagtaaggcagagctgtggttgatgtgagactcagaagagaggtgcagaggggaaatacagagacactaatagaattaatccattaaggaagggaaatggtattggtactgtatttcactggtagaactgcagtgtaagataggataacgaggataccatgtgtgtgttttctgttttgctttggctgttagtgacatttttccctcctttgcctactagacacaatcctgaaaaagtaaatttaagtctgatcatattttatatgcttgaaatactgatatttaaggaacctcatctctttgtaagtcaaagagttatcctttagtttatatgtgcattttccaaattggggttttgtttccttgtttatgtaagatacagatatctatatttttatatttatgtgtatttaaaaacaatagagtaattcatttaggtaggaagaaaaggtgtaggcattctttctgtggtcaacacatttactcatcctttgtaaaaggatgaatggatcttttacaaactagtctgtactagttgtgggatatgctttcatagtaggaattgcctttgaattgcagaaatctgttatgtgtactatgttaaccataaatcgaacctcaaagttttagcttctgctgacttcctctctccctgaaagccagtgaaattataaaatctcatagccacacgttctgttattaatgtgtctggctaaattttacatattatcctttcagagattgcgcttttggtctaatttggaggattttattttcattacttctcactgggaagaagagaattgaattgtttttatcctcctttttgaaataataaagttttgtagaaatataagggaaagagggaaaatcaccattttaacaccactgcattcatcattttgttaactccctgcacatttatgttttaattggttgcagcagtcatggttatacaatctcacttattttatattcagtaactttccatatgaagatataaacatacaggttatatatgaaaataaaatgaaaatgaggaatgtgcgctgtgggattgtgtgcttaacagtgtgcacgcatacacattatttacacacacattatttcttttttgagtgaaagatgtcactaaagctatatgtggcatagaaagctcttttcatttctagctagggtctctaattgtcttttttaagtgaagtgttcccatttaagaaccttgtccttccgtatcagttccctttgattcttgttgaaagagccagagcattcttccctgctagtttctgcctgttgctgccttgcctgtcttgccagttatgttacagggaccaccccagaacacgtcacatgccattatggtggctttattaaagttacaaccttgtaagacagacagaaccctcaactaccacaaagaatccttgagaaatttattcaggaaaataaaaactcacaatgtcaaaaacagctctgtcaagaactgaaggggtttaatagtaactgatatattctaacttcataaatgccactctaatagctaagtacgaagaaggttttcagaggttaatttgtctctctaggatgtacctctgactcagaggtcgttttctgctttgacatgaagctagttgagaagctaaataaaacagatgtatacatctacatcttagggccttttcgtgatcatcgtattgggaacccgtccttaaacctattcctaagcagtgtatggagttgaattttatttggaaagtaagtaggtctccaataaatattctagttgctatcaccaaagtattcccccgccaactcataggcagtatgagaacattttaaaaatgggatatagaaacagagattggagtttgaatcgaactgtgtaactttctatctgaccttttgcaagttatttagttcctttttaaaaagatgatattaccagagttacaatctcagaagttgcctagttaattatgccttgctatagattgaggaagaaggttgaaaatgagacttttgctttctcagggaaagacaagctagacccctcaatctgattgatgtgtgttttcctttcccagcttcgtttgtggcatattcccctgaacattgaattcttaccctcagcttatctgtcccaattccacatgagcctgtcatcacatttgcaagtgaacaggagaaaagttctctgatcagtttataccatgaaataccatgaagcccttctgttagaacatggaaatgcctaagctgaggggctccatattattcttattaacaattccaatagaaatggatttgaatttacacaaagttttttttggggggttgattcagatctaaggtataataagaacaaagaggttgaaaagatcccaattcatagttggatttggacaattattgtacatagtggcattcaatgggtaatagaatttatggctgctttggtagctcatcggttctttgtagtcactttgacttcgtgggtattttccatttcaccccaacttcagagagtaaagctttgctatttcgcttctgaccttcccttattttgctacagatcttactctagcacctccatagaagaggccatgaaaaggggcgaggaccctcccaccccgccacctcggccacagaaaacccattccagagcctcctccttggatctgaataaagtcttccagcccagtgtgccaggtgaagtgccccttgccccctgagcccttccatttcctgttggagccagcggatgtgtgtctgccacagtggcctctgtgagtccggagaaagagcagacctggcagtttcgcattccgtgaaggtcttcacgtggctatggtattcttgggagagaaagcaattctagacacatatgtagcacatgtgtctggagccttgcccacacttgttatggatcaagaattaggaaattctctaccaagaggataaaaatgcttcactcccatgcagcctgctgagtgtgtggctggggtcttactctctgcatcattggtaatttgtgaacaagatagatcgctgtctgtcatttcctcagatgcctgtgtggtcttctatgaaagatcttggagattaaggcctagccagaaccttctcctgcattttacacttatggagaagatcctgtgtcctgtaggatttaatgctgaggggactctgaatctgactgatggttgggtggttggtggagggtcctagggcaagggctccttcaggtgggctgctctgggcttctggggatgggatgttcttgagcccgcagttgtgtagtggggctggaggtgggggaggcccagaggggccctgtctgctcccttggcttcctgtgaagtagaagataccctcctaaggaacctaaggaatagaagatgggaggcatgcctttgctttagtgaaggtgataggatacggtgctgtcccaagtgttattttgggagcagcaagggcctttccactgactcatgcaggcaagctataaatacaatgatttcctggaactttttctccatctatgtgcattttaaatcaggccagcctcagatgctagtgatttgcagattattatcttttctgctaaagcaagaaaagactttccttggctcacacattagcatgacctctgtgtctgggcagagctcagcatgttttatttgttctaataaagtattctcctcacagtaaagttatagattgttttttaatatactaaaatctggaactctctatcaaatttaattctgtgccatgagttcatcagacaaaaatttgccttgaatttcctctcatactttgatctgaattctggcataaatttcatagtgactggtatgtagggtgggagtaaccacaggtgatgatgctataaaaatttcacatggctggcggattatgacctggaagattttcctatggatgcgagaaaattaaaacaatctgggaagctatctcagtacctttaccttgcaagaagggaggctggaaatgctcacaggtctctctcaggttgtgtgacccagtaaggagatgccagctgtactggagaattcacatgctgtggtttttacgacactgcatcacatagtggaagagacaaaactgggtttggagctcagctcagctgcttattcactgtttgattttcagcaagtagcttaatgtttatgcatctcagattcctaatctgtacagtagagccaatactccatggagttgtaaggttttggtgagataataaacataatccaaatatgggttgaatattccttatccaaaatacttggggtcacaagtgtttcaggctttggatatttttggattttggaatatttgcattatatgcttaccaattgagcatataataaaaaaatctgaaatgcttcaatgaccatttcctttgagtgtcatgttggcactaaaaagtttagggttttatagcattttggattttggatttttgggattagggatactcaacctgtagtactgtatttggcccacaggccttagtaagcatgtaaggcccatattcccgtggcctgcaagtatcaagaatttaatgcctgaaatggcaagcctccaccgaggaggataacaccccgacttccttgacccctagcagacaattctgtgattcctcctacccagtttctcagaaggctcgcaaaaggactgaaccccagttgcctgccgtagtacaccattcattgatgtactttttcttgttttgcttccctcctgccctgtctcactttcccctcactcgaataatatacctgttctcaagttcatatgtcaggggcttctttagagaaaacctgaattaagacagctttctttgatatctctgtgtcaatgtgacttcaagatgaaaagtattttggtttgataatgccctgacgatctcccttgtggtagggcctgataaatctaagatttagacaaataatagctaggtgggtgatgtctctgttcatagcctaattccattgtcttttcagtacaaatttatacagatgaaattttaatgagcagtttaaatttatcacatgaagaatagaacatttctgcagtatgaaaagcaggtggtataattgcatctactttatttattttcatgttggttaattctcacagaaaagtataagggtctgtctaaattatataaaattttagtgtattgcatattgctagaaattatcgaaatgctgacaaactagaaatgcatgaaatagagcttaaacctaccagaagagtctactcactgagaatcatggtgtacatttaggcatccctttgctgcacttatctttatgtatcactttagataaatgggatcacactatgcttgctgttctgtatcctgatctttccaattaaccatctttctatttcatatagaggattgcaccgttccctttaaggtgtgcatgatatggatataccatggttgactgtgctttgatggagagatctctcccttcttctctctgccttttctcttccccatactttcctcttaagctcacccaccaccccacgaccccagcccccgttcctttctcacccttgcaaacaaacctctctctctctccaccccgacccccgtgtcctcttcatacccctctgtttctctttttgtccttctcccccatcactccttcacaggtatgagcctcccctcactctccccttgccaagctcccccacaccaccaccttgttcttataatataaacgaggcagaggttattaataatttcatgtccgtatctttgtttcatcatctaattattttcttaggttaaatcctgctggttggagttgcagggtcaaaggctgtagatgtttaaagtgtagctatatgttgccaaagggtgaggtggaacacctgtcaacttgctccatcatcaacactgtctgaaagtgtttcctcacaatcttgccaacactgcttcatgttcatctttttaatcattacctgtgtaataggcagtttcatgtccctgattcctagtgaggctgagaatctttttgtattgttattggccataaatattccttctcttatgatttgcctgctcagaaggcttggccagcttctgttgctacatctctctttgcctaaccacggggaccacttctttcttcttcattttgcctacgttctggacctccctcctgtcaggcacttgggaatgtgagggtggccatggggaagcctacctcacctgctgctgtgctgttccttgtccctccagccccgccccccatatcccctccttctgccaactttatcacttaagacagactgcctgggtcaccctgtttatgacaatagaagaataaggaaaggtaaagaaaagaggggaaaataatgtgagatgaagcaagatgtggacttgagttgaaagggaaagataaaatgaagcccttgtttaataaaatgagactcaggattgtgaaaagcagtgattgaagctaaggtgctgatacagagtggcttaaagtggagtgatagtgtggaaaggaaataggatggagagaagatgcaaagaaaaatgaaaggaaaatgaagggaaagatgggatggttgttacataggagtgatgatgtttatccaaaggaataagcaggaaatagaataaaaaattgtagaaccaatggaaggagagtccacagactcttggtgtaggattcaagcagcatttaaaggaatagcttagaagtaggtggcattaatgcctttacatttatgaaaataggtaacatgatatggggaaaaagaacaaagggctgatttagaatgtaaatctataaaaatgaataaggccaactttggaaatatagaacagttggcttcaactttggtgtctgtaaagagagtgtgaatgtgtgatttatagtagcctagatgattccagggctctctaggtactggcatcagacccgaggcatgtgttttcataaggagaagcggatacactatgatcgctgtgtgtaacagggagatcaccatttgtaatagctgacccagttcttggagccattgcctcacagtcccacacagctgctgtgtttgagagatagcaaaaatgtgcaagaaagtctaagtcagtgacaatgcaagtatgcaaaacctagaggcagtcagacctggaatttgctcagtgatgtttggattttatgtctctatatttatagctatgaaacatcttttattactgagattcctgtaagaaaaatcacactaagctggtacctaacctccttttcctcaatgaaacagttattttcatgaggtaatttttttttcataaaaaggggtttcttctgtccacggagtcagtaagaactacccctctcttctactcttgattcagacctgcctcttctcaaagccatgcctgaggtttgtagcctgaggtttccatggtgacagtaaaaagccttagctctgccttgttccagtcattgagcatctgcctggcagaaggggcagagatggtgtggaggagacatagccattcctttaaagtttcagaccgggcattttcatcatttccactcaaatctagctgggggacctaggcccatggatagacctagttgccaggcagctgggaaatgtagtccttggcagggcagccatttcccagaaatacgtttcttactgcaaaaaaggagaaggggatgttgatggtcagttgtttttttttaaaaccacatcccatatggccaaatacattgagattcacacattaaaaccattgtgatggctgaacagaacacatccagggctagtgtctgtccatgggtagctaatttcctatctctgctttagatatactgataataacaactcattccatggttaagagactatggtacatccatcctatggaattgtatgaagctgttaaaaagaacaggcacgtatactacatggagagctatctcggataaattaagtgacaaaagtatgatgcagaatgtgtatgtttataaatgtgtagacaatttcaggatgatgctaaagaaactggtaatgatagttgcttctgggcaaggggaacagtatgactgaggacaggactgggaaacaagcttactttctgttgaatgcctatttgtatctttttaattttggctcatgtacagatgtcacctattataaaaaatttgcttttcactctttagctgcaatgatggtatctgaaagtaccagagatgtctttcctgcctgaggttacctatctcaatcttccctacgattctgtattcagggtatctttatgaccatctgctaccacctcctggaatgcagctgaaatgacagaaatgttccgagcactttttttttttttttttttttttgagatgaagtctcgttctgtcacccaggctggagtgcagtggcgtgatctcagctcactgcaagctccgtctcccgggttcatgcccattctcctgcctcggcctcccaaatagctggggactacaggcacctgccaccacgccctgctaattttttgtatttttagtagagacggggtttcaccgtgttagccaggatggtctcaatctcctgacctcatgatccacccgcctcagcctcccaaagtgctgggattacaggcatgagccactgcgcccagccccgagcactcttttaagctctgatgcgttcttcagattccatttcagtgcctttccaacactgaggagtagttctggaggacctcccaaagattacattgtgagatgtatagttgggtaaaacgtcatggtaagggctctgtcttaacttggaagtggctgtgtttattgagtggcgaattgagaagtctttcctcggttttctataaatgaatatttgtttctgtaacttaagaagtaggtaaactccttgggagtaagagatgttcctaataccaaacttacctttcaggttctctaaaagatgaatttggccacaaaagcagctctgaccttatatatttccttactgtatttttcctgtgagtgctacttgtttcttttaaaatctggtaggactatgggattcctgacccaccccaaacctttgggcccacagtgcacagctatccaagggttcaatttggcagtctgggcagtttttttgttttgttttgtttttttgttttttttaaatgaaagcgttattgagatgtaacccatatactataaaattcacctttttaaagtgcacaattcagtgatatttagtatattcatagtgttatatataactatcagcactatgtaatttcagaatattttcatccccctcaaaagaaaccccatacctattagcaatcattcccattccccccttttcttcctctatcccttggcaaccactaacttactttctgtttctatggatttgcccattccggaattctgtattaatagaatcatataatatgtggtcttttgtgactggcttcattcacttagtataatgttctcaaggttcatccatgttgtagcatgaatcaatacttcattccttttatggctgaataatctttcattgtatggataaaccacattttggatatttgggttgtttccactttttgactattgtgaataactctgctatagacattcatgtccaagtttttgtgtaaacatattttttctttctcttgagtatataggtagggctggaatttctggttcatatggtaactaactctatgttgaacattttgaggagctattgaagtattttccagagcagccaaaccaatttatttcattagcaatttatgaggattccaattgtgtttcttcacgtcctcaaaacacttgttattgcctttttaattttagccatcctagtgggcatgaagtggtattgtgattttgatttgcattttctaatggctaatgatgttatacatcttttcatgtacttattggtcatatttatgttgtctttggagaatgttcagaatctttgctcatttaaaaattgggttgtctttttattgttgatttgtaaatgttctttatatattttgcataaaagttcctttacagatatttgatttacaaatattttccttcgttctgtgggttgtcctttcatctttttgatggtgtcctttgaatcataaaagattttaattttgatgaggtctaatttatgtattttgttgcttgtgcttttgctgtcatatctaaaaaaccattgcttaactcaaggtcacaaacactcctcttttcttctaaaagtcttatagttttaggtcttacatttacgtcttcgttctgttttgagttaatttttttatatggcatgagttaggagtccaaattcatttttctgcatgtggatatacagttgtcccagtaccatttgttgaaaagactattaattatccatttaattttcttggcacctttgttgaaaatcaattaaccataaacataaggatttatttctggactctcagttctgttctgttggtctataggtctatccttatgccagtaccacagtgtcttgataattgtagatttatagtaagttttgaaattgcgaagcgtgagtcctcctgctttattctttttcaggattgttttggttattctgagtcccttgcatttccacatgaaatttatgatcagcttgtcaatttctgtaaaaacaaaaaagccagctgggattttggtatggcttgcattgaatttgtatatcagtttggttagtattgcggttttaataacattaagttgtccaatgcatgaacacaggatgtttttccatttatttagatctttaagtgtctttcaacaatgtttcagtatacaagtcttgcatttcttttgttaaatgtattcctaaaagttttattctttttgatatacattatacattatttcttggagatatccatgtcagtactgataattttgtatttcttttatatatcatctatatgctggctgctctgttaaaaaccgtattatgaaaaatttcaaatttatgcaaaagttgagaacctccacccccatattattttgaagcaaatcccaaatatcatataattgtatatataaactctttgtatatctctctaagagataaggtcttaaaatacttgagcacaatacctttgtcatacataacaaaattaacaataattctttaatatcatttaatatttggccagtgttcctatttcctgaattgtctcaagtttgtctttttatactagtttgttccattcagaattcaatcgagggctacatgcacattgcacttgttttggcatattttaagtctcttaactgataggttcttctctcagtcttttttttcctctttgcttttcatttattcataaaaagtcatctaccttgtagactttttcacattctgtattttgctgattgtttgttcttccatcccatgtatttcctataaactaataggtaggtctaggcttgattagagttagtttagatttttgacaagaatactacctaaagatgctgtgtacttcttactgcaccacattaagagatctctagtgtctaatgcctttatttttgtggtgtttgattgattaatgggtttacgtagtattggcctgatccatgtgttatgataaagatcccagcgacctttcaaataatggttttatcagctattgatcatcattgcctacatccagtggtgtgtcagtgaatgtttaacaaccggccacttgccaatttttatggtgtaaacactcctgccatggctaatttcattcctactgatgtgttactgaatgtggagtttggaacagatgcacacagttggctctcacaagctggcatgagctttttccagcaaaccactgcttagatccattatttcattggtagttgcaaaatggcgatactctattttttctacctttattaattgggactatggtttatttaagcattttcctattgttggacatttaatttgtgactattatgaagcttgtgagctgaaggagatcataaaacataattctcagtacatcagtaaattctttatatacatctgaatttatagaattgtatgaaaactgaaatagacttcagtaatggtgaccagaaaagtgtcttattcaaccagtatttaatgagcatttactgggtacttggcactttggaggatcccaagagggatatggatatgcccccaaactctgctaatcaatgtcacagttgtgtgtgattgttagaagggtttagagtttgggtggttgctaactagaatgatcagtggatttgtgggcagggggtgcacagggctggtgagctaaactttgaaggatatgacttttcagtcaaatcctattcttttttgacatctgtcttgatttacttcttatgactagtttcctgggtgtctactatagtagcctcaaatctggcttgcttgctttgttctttccttcataaagcaacaggattaattttctgcagcacacctatgatcacttccctactcaaaactcttcaggacctactatgtaatcaccaaatttctggtggaactgaacccgaagccatgtgattatattagctcagtaagggacacagtactgtggcctggagtgcctggggaggagtgtattacaggaaggaagtagagactagaagattcaagttggctggctggccaagaaaaatggagactggtggagaaggagtttgtagacggtgtctttgggaagtcttaggagaacatcccattagggtggtagggttaagccagattgcaaaagattgtggcataagcaaggaactttggtgtggagaagttgtcatcacaaagtcattttgaaatgtcgaaggtttagcagttgttctgactgtatgtcacattttaaaaaataatggtagtggccaggtgcagtggctcatgcctgtaatctcagcaccctgggaggccgaggtgggtggatcacctgaggtcaggggttcaaaaccagcctggccaacatggagaaaccccatctctactaaaaatacaaaaattagccaggcgtggtgatgtgtgcctctaatcccagctattcgggaggcttaggcttgagcctgggaggtggaggtttcagtgagccgagatcgtgccactgcactgcagcctgggcaaggacagagtgagactctgtcgatagatagatagatagatagatagatagatagatagatagatagatagatagataaagatacataagatagatagatagaggtagaagagagccagttccaagatgatagactgtttttatagattgccttcctcctaacacacatttgtattctctctctctcccccaccgcattattcagcgctaatgaaagtgtgatggaaacagctgctagtgaatgaatactaactaatcctgaaaaaaagatgtgtacttcttgaaattttagtttgatttacctgaaaacatatacagaaacacaactagtgatttcaaccaaccctagagttttaatagtaaaatgcttaggaggaatgcatttgtgtaaatgtaatatgagagaggaaaccagacacccatctttgaccaagattgaatctcatgcatttttgtcacttaagtctgcccatgtctccatccaggacctagttaacccttattgcgtatcctatggtacaggaaaaatgagttattagtaaacatggataaattttagaatcatgaagtgtcaatgctaaaagagaacttgaatgtcatcttggccaactctcacatattaccaacaaggagactaagatccaggcaatataatggctttgttctccatcagaatctttctttccttttttttttttttttttaagatggagtctctctctgttgcccaggctggagtgcagtggcgtggtctcggctcactgcaagctctgcaggttcacgctgttctcctgcctcagcctcccgagtagctgggactacaggtgcccaccaccacgcctggctaattttttgtatttttagtagagacggggtttcaccatgttagctaggatggtctcaatctcctgacctcgtgatccacctgcctcggcctcccaaaatgcttggattacaggtgtgagccaccacatcctgcccagaatctttcgaagttgggaaatctttgtttagatctttgttgcagcagatttggtatcaaagaaagctatctacattaaattaatttggagggcacaccctactacttttctacgggcaataacactaattaatatctaaagttaaaggatgtattaaagaatgaatatggtaacctttgcaaggcactcttcaatgtgtttttttctgtgtttccttctatgtgatttaaaatgttagtagatttctctgaggtacttcagggagataggaaaggagcttttgccctcatagatacttggaaataatatatctattttctttttttaatttcaaaaatgaaattattattaaaagctctaaatatagcaagaatataagacaaatagtatactgaacatccagcttcaacaattaatcaactgtgtcccatcttgtttcatatctgtcttcccccacattattaattatacttttttctacccttagcttaaaaaaaactttattgaggtatatagatcataaagtttatccattttaagtgtaaaatttaatgatttctagtaaatttatcaaatagtgcaactttcaccataatccagttttaggtcattttcagcactccaataatactgcacatacctgtttacagttaatccccatgcccagccccaggcaaccactaacctattttgtgtttctgcagattttccttttctgaatatttcatataaccgaatatacaatatgaggtcttttctgtctgactttgtttacttagcatgatgtttttgaggttcattcatgttgtatcatgtatcagtacttaattcctttttattgctgaatagtattccattatatagctatatcacattttgtttatccagtcttcagtttgacagacatttgagttgtttctgctttttgtctgttatgaataatgctgccattaatatttgaatacaagtctttgtgtgaacatatgtttcatttctcttagctagatatataggggtggaattgctgggtatgtggtaaatttatgtttaactttttaagaaatggacaaattgttttctaaagtatctgcaccattttacattcacatcagaaatgtatgagggttactatttctttatatcctcacccacacttattattatctttttgattatcctacatcctagtgtgtgtgaagtgatatctcactgtggttttgatttgtattcccctgatgattaatgatgttgagcatcttttcatgtgcttattagttattcctgtattttatttgatgagatattgtgttagtctgttttcacgctgctgataaagacatacccaaaactgggcaatttacaaaagaaaggtttagttggacttacagttccacgtggccggggaagcctcacaatcatggcagaaggctaaaggcatgtctcacatggtggcagacaggagaagagagcttgtacagggaaattcccatttttaaaaccatcagatcttgtgagacccattcactatcacgagaacaccatgggaaagacctgcccccatggttcaatcatctcccactgggtccttcccacaacacatgggaattatgggagatacaagatgagatttgggtggggacacagagccaaaccatgtcagatgtctactcaaatcatgctcattaaaaaattgggtgtttgtcttattgttgagttgtatattctgtaattctttatatattctggatacaaatcctttatcggatagatgatttgcaaatattttccacagtctgtgacttgtctttttgttttcttaatgatatgttttgaagtacagaagttttgagttttgacaaagtgtaatgttaaattttttccttttggattgtgcttttgatgtcatatctgagaagtctgcctaacccaaggtcttgaagattttttcttgttgtaaaatttttatagttttagctcttacgttaagatcttgaatccattttgatttaatttttgtataaggtgtgaggtaaggatctaagttaatctcttcgtatatgaatatccagttatcccagcactatttgtcaaaaaatactctccttttcctgttgccttggcacctttgttgagaatcacttgtctgttaaatataagggcttatttttggacactgcattctgttctgttgatttatatgtttatttttatgctagcactatactgaatgttttttaacacaggggagtcatacataatcttgcaaagaggtaatcccacgactcagaagtctttaagtatttgctacaatggcatattttttagatagtatatagtagcttatttacttcatttgtggtttgtagcatgttcagaaggatcctttgagctccttgaggttgcagtacttctttgctttgaagccttctgtcatgtttattccctgaatgtagaataccctctgtctagctgtttatcctccatctctgcatttttctgctctacctgccctgtaggttcaaaatgtggtactgattactgctcgatagtagccttgtgtccttggcaaggtcattttatttctccaggtcttaattttctcatctgtaaagtgaaagaatcagattttatctcactacttttctaaactctgtcgttaatattttccttgttgaacagttacaaggatgtgtaagttaatctcttttaactggtgaaaaagtatattctgttccatagagaattaaatgagcttgtatttcggggggtggtgtgtggtcatcaggggatagaggcaggtatttctggaaaggtgttcttggcaaacattttgttacatacactggtgtatatgacatacatgtccatcactgtatgctgggtgatcaagagatatgtataaggtcatacatgcttttatgattagaaaggagagaaagaatgaacaatttctgttacaaagaaatagccatttttatgaacttgccaagaagaggaatggtccttactgatgaaatccttaaagctttgcatgtggctctttacttgattgatatttaaaagtataggtcccactgggaggctcctttcaacattttccattccttgagtgtttttcccccctttggtattcgaatgcttttattttcttcacataaaatattcctagttaggggggatgggagcccctttccacagctgaagttattccaagttttgttccccctgaagaatcggctctctgttcctgaagctttcaatggccacatctgctgctttatttccactcaataagttggaatatattttcatttagttattgattaggggctatgtaaaaatctgaaggaaattagtaaatagtaatgtttatgaataacattttacctagaaatttctaagcgtaatgaaataagaggataaaaattgttagaggttggagttttggatgaaggtaccaggaagcagagatccaataaatcagtatcagaatctgcatgtctttcaataaacttaagaaattgttttaaacactaggaattattagtctgtcttctgaatttaggattaaatgacagtttcttttcctgaagtttttaatgtggttttcaggattggggtatttattattttcctttggattacacttataaaaatttttggctggacaaagccttgctgatacctagtatcccactttattaactataacacttgacgaataaacctgcaattgcttgacgaatatggtcactttttaaagtatgtgggaacaacattcttctctcgtcttcttgccttcttttccctcccaggaaagcagttgttactattaacaagtatattgtcatcttttgcaactgcacactagattattcagctattttttttcttttttttttcctttgccttccaccatgcgatcaaagtattttttaaatttcactttgcatgaaggtgtactttttcttttgactgattagggcatactggataaaatatttggatccaattttaagtcaagagcagactgaaaatattgtaagagaagatttttaaaattaaatttaattccaattttcaaccactgtgtgagtacctactaaacataaggcagtgtgtttaggtgctgtgggagacaaaaagatgaattagacagaattgatagaatgtagctagattaatatctcccaccattaaaggaaaggaacacagaattataaatgcaaggaagagatttttcagcagcaaccgaacaaggaaaaatgcatgagttaatgctatatatatatatatatatatatatatatatataattttttttttggaaagagtggcaactgagggaaacctgaggctttgggtgcacttctgactctgcctgcttccttgcagaagctgtgtgtgtgagtaggcaaatcttgagagttctcatcgagaccctaggtctagagcaaagtgaaatgaatgagtactcgtaattttcctttttcttgactaagtggaaatgacttcaggaaagagagttggaaaagtaaataatcatagctgatatcctgatattgtagaggggaaggcccagagcttcatgctgaactggggacaaactgaagtctgagaagttcctccaaggccattgatagaactccaagacttaggagaatgcactctgctgcagggttttaaaatgttgattattttggtatttccttcgtaattctaaatagcatatttgtgtaacttcttgtagacttcaatttttgccatcatcttccctcccccattatctttctcctccacccttccaatatagttatattataattttggttagattaatatttagtgtttatattattattgttatagccatgtaagacatatagtaaattactttttttttttacttgcacaggtttttgtttgccttggagtgaataatcaacttgtttcttttcaaagtacttgcccttgattcaaccacagacgtcttcaattttccagagttcctcttatgaaattctcacacctcaggtgttctgtcagtttcagctttttgaagcaatagaaactgattgtcttcaatgcctggtacatagttttcatcatgggatctctctacactgtcatccaaggattcccttcctctttttcccatgttggatttcttttattactgtatcctgtgtctttctctttctttgtttactttcttgttttggtgaagcacatccttcagcagcttccttagaaagggtgcatggagctcaatttgagaccctgaatgtctaaaaatgtatttaattatatcatcatgcaggctgctagtcttggatatacaatcatcagttggaaataagttttctttagaattttgatggaattgtgccaatggattctagcttctaatgatatatgaagaagtctaaaaccatttggacatctgatcctttgtatatgacttgctctcttctcctatgccctgctgaaaacttgtaaattattttgactctagtactttgaaatatcatgatataccttgtcatgagtctgttttcttccattgtcctggatattcagtgagtcctttaaatttagaaattcatattcttcatttctgggaaattttattgaaccatttaattgattatttttcctgctgttttctctgtttctctttgtggatcttttatttggctactaccctattttctggaagatttcctcagattatttttgacctttctattctctttctgctatcttttaatttccaagtattctttttgttttgttttgttttctgaatgttctttgtaaatagcatcccattatttcatcttagcaaatagcatttcttatgtcttactgagactttctctggtgactctagttaaaatttcatctgtcactctctaccccattgtctcttttctcagtagaatatgagcttcataagggtatagctttttttttccctgtttttcccatggatattttcccaataccttgaacaatacctcccacatagttagtgtttaaatgtttctggaataaacttaatgatcattctgatgatattaataatatatattttaacgttttctcctagtaaaggtctagtctgtttctttgaggtcatttcttcctgtttttattgatccctaccttaggttagaacattttctgcagatatctggtaatacttagtcatccacttatatttaataatgaaggataaaaagttgcttggaatatatgagcaaattgatggaagttgccagctattggcttcatggtagaatggtctggccaggccatcctgttggagatcccttgatatcaactctttagatgtctcttcctggctgatctgattctctggaacacattctcctaatctctagaaggaagcagcagtctgggagcagaagggaagaaggctggaagaatctcagcatccaaagtgcatatttttactgaatctgtctgttttcagcatggccctcatgccttcatctgggcctggtgccttccctgaaaagaaaactatatctagcattttgctggagtgagaaacatgctgaaactgtgcagaatgtgggagaaaaaactgctcctaaactgcttcaatcagtctttttttttttttttaatgaggatggaacataatcctatagattttaagatagtttaaagaactatttgttgatcacttactgtattttgagttatcaggtgagacagatataaggcatagctactacagcagaggggactgtaagagtagggcccctgaagccaaaaacagcatgaagaatagctagaaccagatcctgaagggtcttgtcaaagtatgcccttttcctgaagggtaggaaataaatccactattagttcattgctttaggtttttattgctttcctcattttacccctacattcagaggtgtttgatgccaccaattcctgagaactggggggcttctgtggtacaaatttgttactccctgctttctcagatctgtctagtcagctattagttgctcatctgttttcccagttccaaatttaaacaagagcatttaaacagttctcttcatttttgtgttaatgagttaagagtgagattagttacatgtatttgaactgctgtctatactcaaaagtctttggataggacatttaataaaacgttgggtcatacacaagaaacaaggaattttacacagtatcaagccaagattttagtttaaagtggtcccaggttgatagtaccctcagatttctggcagaagcgatagagggaagaggaattcactttccacatgcctcaaagttttcctgtcggtaaagttccaaggaatttgagtttagagtcacaggttgctaagcacactaggaaatgaagcacaatgagcaagaacaaacaggaaatacaaagccctcagatactgaaattatataaatatgttgaaagaaaagaggaagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtcgtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaagaggaagaaaatgaatggccaagaaattataaaaatgaaaaaaacattttcaaaaaagaccaaatagaacttctagaaaagaacaattctgtaacataaactcgaagactggattttgttagacattaagaacgactaaagagggaattggttacttggacagtagatcgtagaaaattgtctagaacacagtacagttagaaagctcttgaaggagaggggagagaaaaatggtagaaatacaacatttaaagaatcactgagaattgaccaaaattaatgggttgctacatggttcagaaattccagtgaagctcaagcaagtgataaaatgatggtagagaaatacatgtgcagacataggataaagtttgatatttcagagtacccaaaacaaagaggagatcttaaaagcaaccagagagaagatgggccatctaacaaaagagtgatttgactgagagctggcttcttaatagcaatagtagaaaccagaaggcagtggaatgttaccgtcaatgtgctgggagaaaatagctgtcaatttagaattctatacccaattaaatcctctttcaagaggggaaaaatgacttttcaatcaaataaactaagtttgctactaatagacttctcaattaaggaaattctaaaagacatactttagacatcataaaataaactgtaatggaaattaggaagcttttagcactgagtgataatatcacaaataaaaacctatgatattctactaaagaggtacttggaaaaaatttataaccctaaatgcttacattagaaaataaaagctacaaattagtgaactaagcaaccaatttaagatagaaaaagaacaagatatgcccaaagaaagtaaatggaagaagataagcagcattaataaaacagaaagcaaacatacaatacagaggctcaaaaaagttaaaagttggttttttgaaaagagtaacaaaactgacaaatgccagctgagattagtgaaggaaaactggagtatgaggaatgggaaaagacaattacacatgcagagattaaaataataataagaggggggtatggacaccattatgctaataaatttgaaattttaggcaatgaataaatgcctagaaaaatatcatttatcagaatcgacttaagaattagaaagtctgaaaagtcctataacaattcaagaagcagaatcatagtttaaaatcttgtttaaagaaaactccgggctcaggtggctctcctgggaaaatttttatttgatattcaagaaaaaatttccaatcttatacaacctatttaagagtataaacagggcatggtaggggtttgggggtggtgctctccacctgaatgaagcataatagaggaccatatgagaaaggaaatcacttgcaggtctcactcatgaagatagttgcaaaaatcctaaacaaaatatcagctaaccaaatctagcagatataaaaaacttaccaagttgagattatcccaggtctgcaagggtgttttaatattagacaatccagaatgtaatttaccacattaacaaattataaggaaaaaataataccataatctcaatggctagagttacagctctgattaaaatccaacaacaaattatcctgaaaagaagtctcaaaataaggataggaattttcataataatctatttttttcagggattatatatctatagttttattaagacaaaaactgagagtgtggtgtgaagtttacattcaaacaaagttttcaaagaaatctaacacatgcctaaaaagattttacaatgtagctctagatccaagtctagataatatcaagaactgatggatctcatgactcaagacagagcattttgggtatcagttacttcttaggatttgttaaaaaatggttttgtgtgtgtgtgtgtgtgtgtgttttaaagtgaaccactgcccagtatgaaagtttaatctcctgagaccaaggcttttgaaatcactcaactcttgagtcaattcagtgaaacttgtgctgtcagtgactgaactctgccaccaatggtttcagagttcaaagctcaaaagagaatggctccaaaagttgtcccaactaagagcatgggccctttacttccctcctgtcttatctcctctaccaccctctttcccttccccaacacctcagccagtggctaggatgaacaagctgatatttataactttattattggaaaagaaagggtcttctaatttcaggaattagcacctctgaggcagaatgatctgcttgtactgtatactctccaataaaagaccttccttcctcagtcaatttccatctccaaaatggcaactctggtaacttattaactggcttagtcctttgtgagactaagtacattaagtttaggcagggaacaccatggcttatagatttcagacattcacagcttttaaagtctctcacagtccgtatttatggtgccagtgacatttttttcaaaggtaaaatattctggacatagaagcaaatcattagttttctgttctttgcattgcttcaccatgtcccctatcaggccccaaattttaatcaaaatgatgctacccatctccctttccaccctccccattcctccctctcccacataatacaccagtaatagccaaaaactacacatttgctacgctgtaaaaatgtagagttaacactattgggaagaaagttgtgcgttgcggagatgctctttgattatctacagtatttttttgctctcccacacacccagttctgcaagttttgtccttcataaagggccctttgctttttctcagcaaagtgcagaaaaggttgccttgaagcacttatcccccttcccctccactgggacgggtgtgcaaactatacagcttggaatggctttaaaacacttgggctgctgcagggcacagaaacgatactggctcttcaaagggcatcttctcaagctacctctatggtgtcaagacaagtagaacttctttccttcccacctgaaacccacagtcagatgtgatagaggctggtactcaggagagttaattcttgtcatcatcctctttggggtaggaatgccacgtcagcctttcctcatagaaggatatgacaacccgtgggcatttgacattgacttccttggcagggacgaggtcagcctcatcagaatttttccctttcatcaggaacatgagctctccactggagtctgtagctccaataatctgctccggctccaaaccctgagcaaagcctcgtggcttttctgactcttctttcttcttctttggtttgctctcctctcccttatcttcagaatcagaatcagctttgtgcttgcctccctctgatttgtctatctcatgtgctgttttctgtgacggcagaaactcatgaggtcagggcaatccaagttctcttctgactcccatgtgttgtcctcatctgagaatcccttccactttaggaggtactccactttgccctttaccaatcgacggtagagaactttttccaccacatattcctgttcctcctcttctagcacctcctccactttcttcttgttttgttttttctccatagcgtgtgtgtaaagggtgatgctgctcagagcagtgcccaggagccggaaaggaatcggtgctgcgctattggcgcattgggtcggccagggcagtggcgctcagaaaagcagcaagggtagctgcaaaggagccccttgctgaaatggtgtaccgcaggcctcggctaatggccctcctctcagccgaacaaaagagccctgcactctgtgctgcccactgcccactgcctgcaccgccttcataatctattaaagggtatctacaacatacctacagcaaacaccaacaccataccttatggtgagctagtaaatgctcccctttgagatcaagagaagacaagaatgcccattatcaccatttaaattcaacttttacagtagataattctaactaggtaagactggaaaaataaaaaacgtggcaaaggtactgaaaagaggaaacaaagctgctcttagtatttgtttaatatggttgggcacagtggctcatacctgtaatcccaacactttaggaggccgaggtgggaggattgcttgagcccaggagtttgagactgcagtgttaatgatcatgccactgcactccagcctgggcaacagagtgatatcctgtcaagtataatatttttgatataaatgtgggggcttccccccaaaaaatgctctcagaatttaatgaggaaaataacctatgccaactcttgtttttttttctttttctttttctttctttttttttttttttgagatggagtctggctctgtcacccaggctggagtgcagtggtgtgatctcggctcactgaaagctccacctctcgggttcacgccattctcctgcctcagcctcccaaatagctgggactacaggcgcccgccaccatgcctggctaatttttttttgtttttgtatttttagtagagatggggtttcactgtgttagccaggatggtctcgatctcctgacctcatgatctgcccgccttggcctcccaaagtgctgggattacaagcgtgagccatcgcgccaggcctctatgccaactcttacaatgagagattcagaatgaacaacggacacatacctgtgatactgttttgttgcttgaagctcaattgtgagaaattaaaacaattccatattaaatggcctcagtcttttaccctatttcttcttcatatttggggcaatttctgataaaccacaataaatgatgttgtaggtgacatgcttttatctaaaagtgtattcagaaatagacccacacatcatcttttacaagagcagggcatttgtctttaaaaaaaattaaatcatacaaaagaacttaatgagatccgaatcaggatctaaatactgtttctaataactctcaaggcagtgagtagggacagtcagccacagggctcacctggttggttcctctctctcaggggtcactgtcttttgttgcctgattttctagtgccttgaaaactgttgtttcatatttttttttctatgtgtttttggttgttttaaatgggtgggtaaatctctctgttacttcatcttggctggaagcacaagtcaatttaattaaatggctcatcatttcttgtatagtcctcttttttgttaataaggagttgttttaacacacgttaatacaattgcttggcctttcccttaaagtttgcgtagatttattttattttattttatgttatgttatgttatgttatgttatgttatgttatgttatgttatgttattttattttatttatgaatgagacagggtctcactctgttgcctaggctggagtgcagtggcacaatcatggctcacggaagcctcaactcctgggttcaagtgatccttccgtctcagcctcccaagtagctgggactacaggtgtgcactaccacgcctggctagtttttgtattttttgtagataaggggtttatccatgttgcctatgccagtctcaaactcctgagctcaagggatccgcctaccttggcctcccaaagtgctaggactacagcatgaggcaccatgcctggcttgtttcatttgttttgaaagtaactgttaattttaaaggtccaatctgtgaggatctaaagagtaggagccctgagatgaataattcctgaaggctttcagcattctctcctgctgtgtgctttgttattgacagctgttcaaggtctcaccacctctggagttttaacccaccgatgtgtttcataaattttaatgaaagacagatagagagaaatcatagataggccaacatgattgtaccatatccatgcactggctcaaaatgaaaatctctgtgatattaccctgagttacatttgtggaacacaccaaactccgtcttctagcttgtctgatccagctagctaagggaaatcaaaagtaatttgcaaaatcttttatgttcttttatgttcttggtacattgctctgatttattttttaaggcacagaaaattgtccaaatgcatagtacaaatttgcaaataaactacatatagttatttggacgatggtgtttttctaaggagttttgtaaagaatgtggtttaacttgccagtgtgtaatgctaaacttatttcttgtgtgttattatgaactttatttataatttcatagcagctgtttattttcattgctaaggtacaattcagatgttcttggcttaactcagtattctctatctcacaaaatttaaaattagactgatactttgtaaagattcttcagatgtggccagattattttaggaacagctttagttatccctgataataaatattagggagagaaaaagaaattgaggtctttgaagaatccctaaatatcatttcagtctatcactgtcagcctccctcactgctttcagatccattcccaggagcatttacagggtggccaagcttcctcatttgggttccagctctcttagtttctgtagcctactcattgagctaatgagcagtgtagtggctgagagctagggagaaatatgagagaaatcaaagaagaccctttctgacttttgccctagattgtttgaaacgaaataacattagaataatgaggaattgaccacctttcccttgctgcgttttaggtgtcttttctgtaccattttattatgtcgtcttaatcataacagcctacataaatacttgagtttgggttaggatgacaatgaaaaagggattagaaataacgtgtactcttttttcttaagccttcagaaggactgtaaaaacttaaagatgttaaatgcaaatgccattgccattccaagttaacaagcataagagttttttgttgtttatttttggggggtgatccttaatagtatgtgtttttcttttcagctaccaagtcaggattgttacccccaccacctgcgctccctccaagaccttgtccatcacaggtaggagacatatttgatttatgtaaactgttcggtggtagggaagttgtcctatcgctgtgcttctttgcaagggttgatcgccacagatctggtccatgagattcccaagctgataccctgtgaagagagcagagagtggtttaatttattctcatccagccagctccccagcctcatgtggaagagagaaagtttcctcaataagccaccaagcatacatatactagttcactcttggctgtccaggggtgcgtctgttttcatccccagagaagggtagaagaaggggcctctctctaattggaggtggagacatggtttttctgtatagtatgtgcaatctgggtgcctatattttcgtcagtactttaggagctatgttaattctacataaatgaaaaataaatggttatcaacatggggttagtgccgtggttttggcctatggtgctttctgtaggatggtatttttcctcagaacaaaaagctgagatagcaggagggggagaacatgtcaccaagatctgtttcacccctaaattaattctgccttatttacatgtgccactatggccttattcatcaacactttgcagagctgaaaatgagaagcaaacagtggagtgtggtatatggtgctacagatctttccttttgttaattgctgctgaagaaactttctatctttaaagaccctttctgatttttggcagaaaattttgggaaatttctctgtacacagtccctgtttctacttcattgttctgggtggttcagagctatccttccatacggggacatctcaggactcatgagtcactgaaaccacttttaacacatgcttgtccttctttcagtgaatgaaatggtttttagcatccactcaaccttgagatgcaaatactatgagatattggcttcctgctttagtgcgaagggtaataaaaagcccatttcttcctgacctgcatataaaccagcgagaactcctttccaggatgtaacattggccttaagagatattggttgaaccgtcaacaagtatttattgagtccctgctgtatatctaatgccaaaccttagttttgccctaagcctttcattggctgtaatttcttctcattcaaattattagctgtgtctgttgagcatctccaataaatcaggcattgtgctaagtgctttcagtgcattatttaatcctcacaaaacccctctgaggtagatacaggtactaatattatcccttttttttttttaacagataaggaagttgaagtatatgggggctaagcaagttacccaaggtggcatagctagtaaatagtagagccagctcccaaattgcaatctgtctcctaaaggctcctcctgtcaccatcactggagtctgagtgtctatgtgtacagccagacagcagatccattacacttgcaatggaggctttcatcacaggcccctaaggaggaccttgatgagatgaggctcctgctccacaccaacagcaaacctggacttggtcacaacaaaatgagcaggcatttgctagctgctagttcaagcctggggcttgagagccacctggttgaatgcatggaagacctgtctgaattgacttttgtaaccaaccttctagctttctcttcctgcacaaatgccagtagttactacccggtcccaaaatatgctgctgctatcagcagtcttcatctgagctgcttgaggtgggcttcttgcctgcttttggagcttagtcaccaaagatctgactgggggatctgggaattctctagtcactgttaatgaatgagtctgcttctttgtctaccagatttcccatcacaatataaacagtgagcccagtactcagcctatcagctgcctaactatggagatttcagatttcaggaacaggtgtgtaagaaatggaggcagaagatccacattccatttctctcccctattccctcctttcacccactgtaagtgggacacacatattcagatatatgaagtcctgggcaataaacacatggttatatttagtttttgtgccatgtcaagttggtattgaccctatgagcgtcttactaaccactttgtatgggacacctatatattctagtctttcccaaactgcttgtgataaaacagtctctgggagatattaatagggctctgtggtacagatttgcagactgctgcccctctacccctctgggagagtcgctgtgcaagtgagctcactaaaggctttggaggcctacagtaagtaaagctagtaaattttgttaaagccagcaatttcctagcttctgtgaccattgatatctttatttataaaatacctgttaggatacaaaatcagtgtgcaaaaagcacaagcattcctttacaccaagaataggcaagcagagagccaaatcatgaatgaactcccattcacaatcactacaaagagaataaaatacttagaatacagctaacaagggatgtgaaggacctcttcagggagaactacaaaccactgctaaaggaaattagagaggacacaaacaaatggaaaaacattccatccttatggataggaagaatcaatatcgtgaaaatggccatactgcctgaagtaacttttttttttttttttgagacggagtgtcgcactatcgcccaggctggagtgcagtggggtgatctcagctcactgcaagctctgcctcccgggtgcacgccattctcctgtctcagcctcccgagtagctgggactacaggtgcctgccaccacgcccggttaattttctgtattttttagtagagacgggatttaactgtgttagccgggatgatctcgatctcctgacctcgtgatccacctgcctcggccttccaaagtgctgggattacaggcatgagccaccatgcccggctgcccaaagtaatttatagattcaatgatattcccatcaaactaccattgacattcttcacagaattagaaaaaactgttttcaatttcatatggaatcaaagaagaccccatataaccaagacaatcctaagccaaaagaacaaagctggaggcatcatgctacctgacttcaaactatactacaaggctacagtaaccaaaagagcatggtactggtatcaaaatagacatatagactagtggagcataacagagacctcagaaataacaccacacatctacaaccatctgatctttgacaaacctgacaaaaacaagcaatggggaaaggatcaaaggtcaaaataaagggctctattttaaagtgaaatcaggttctgataaatttatcatttgccctagataacattgttttaagtttatcaaggttgaatattcaagtggaatgcttgttttgtgtaatgtatttttcctttgttaactttggcagtaccttttactgtatgttccctagttatagaatcggttcatagattgctcagagctactcatatctctggattcatgtattatgaagaaacaattctgtttcagaccagcttgtgttgattgaatctcaagttttggaagttctcttgtgaggatttcttaaatttgaaaactactattctcaagtagttagggaccataggcacacactaccaaacctggctttccaggttttaagtatgtaagaaaaatgagtttgtacatttgcaatatgcatacagagatatataaagattgtttctacatacaccaaaagcatatattcttttatcaaatgagagagatgaagtataggttttcagcataacatgcagtttagctggctcatacttattcaagcaccactgtgatatgaacatctggattaagttatacaaatggggccctggagttaggaaaaggaataagttaaaagaaacatctttttatttttcatactataggtaagatcaagaagaacctagtgactatatacaaaattaagtagtttgtgtttcacattttcctgtggcaagactagagactagggcatggtcttttggctcagctcagaagaggtgacttttttttgaaaaaagacttatttatagcataaataaccaaaaagcaattaaagtaaactatttcatatagagcagtgcattcttttgtttgtttttgttttgttttcttaagacggtctcgctgtgtcacccagactggagtgcagtggcatgttcagggcttactgcagccttgacctcccaggctcaagtgatcttcccacctcagcctaaagtgttggggattacaggcgtgtgctactgtgcccggcctagagcagtgttaaagtgagagttaaatgtattagcccactgtttgtatcattttaataaatccagtaaattgccatctgtagagtttgtgtttattcttttttttttttttgagatggagtttcgctcttgttgcccaggctggagtgcaatggcgcgatcttggctcaccgcaacctccacctccccggttcaagcgattctcctgcctcagccttccgagtagctgggataacaggcatgcaccaccacgcccggctaattctgtatttttagtagagatgggggtttcaccatgttggccaggctggtctcgaactcctgacctcgtgatctgcccacttcagcctcccaaagtgctgggattacaggcatgagccaccgtgcccggcgagtttgtgtttattctgtaggtcagttctctgccaagggactgtttggtacttcagtagctaagtccttttaatagtgttgatctcatgacagttttcttatggcaattgtgatagagccacagcttcagtgtaactataataaagaaaagattttgggggtgcaagacattatcttttaagttttctattagcaccacatttgataaattggggttccctgcagactaatgtgctcagaattttcctatttctgccactaatttctcaccttatatgtaacaaagttttcctcactagcaatgtaatgagtactaaaaatagcactggaaggtgaaagcactgtgggagaagcatttgatgaatacctttaagcttagagagaccaagaagactcatggaaggggtgagatgaccaatgaaattagttttaaagaaacaacagaactttttttttttttttagctggctaaaagatacagagctttactgcagatttaaaaaaaaaaaaaaaacccaaatgcagagaaacaggcttgcaagaggtcctggtatgtttgaggagctgcctgagatttggaaagccagattgtagggaaaatggctgtagtgttctggaagtggccatggggagcaagcctcctgctcacttccagttccagttctggtagggatgtgggagagaaacagcccctaccaaaggagttctgtctggggagcagaaactgacgggaggacagggttttagcctagtggttctcacccttggctgcacagtggaatcatctgggggagctttgaacgtgctgaggcctggagcccctcccagagattttggcatggggtgctgaggtccggccactgggaggtttaaaaacctctccaggtgattctgaagtgcagccagagttgagaagcactgaattagggcaagaggaaggaatgctcagagaagaggttgagaatatagggaattttattgatgagttcttatagggcacaatgaaaggggttctggagttggggaggcatgaggtcagcttaggggatgtactcagaccctatggggacaagaactcagatcacaaggggcctgggagtcaagggattcttgtggtgactgatgtgaacagggctagaggatgtgacaggaaggtcctgctggaagaactagtcactgtgtgcctcaggtcctgtgtgtactactgtgagaggctagccatgaacacagatggcctcaagaggaaaccagaacaactgtggtccattgagttaattcttcatctaacttcataatctggctagaatcaggtcctgaaagtgatattgaacccaataggaatatggcagtcatgctactctttttcaaagactaattttttagacacaactttttataaaatactacatttgttttatttggaagtaaaaactgcagctcacttaaacttaaatggcagttcgtaggccctgaatttgtgaaatattcaacaccattttaaatactctatccttttaattaatatcctgtcatttaaattattctttccacaagttaatacacagttggtgattcaaaatagtaaattcttctgggagaaattaagagttttagaccacacatacttttttggggcaggggaaggaattcctggtgattatgtaagtctcttacagggctatctaatccatttttaagtgttaattttattaaagcataacatacatactgaatctatttttaatacatactaaatcaatttttaagatagtaaaatgaagtataggttgagtaccctttgtctgaagtgcttgggaccagaagtggtttagatttcacttttttttttttttttttgggaatatctacgttacacttacctagttgaccatctcaaatctgaaaatccaaaatcctaaatgctccagtgagcatttcctttgagtgtcatgttggtactcaaaaagttttgggaggccgaggtgggtggatcacctgaggtcagaagttcgagaccagcctggccaacatggtgaaacctcatctctactcaaaaaaaaaaaaacaaaaattagccgggcggggtggcaggcgcctgtagtcccagctactcaggaggctgaggcaggagaatctcttgaacctgcaaggcggaggttgcagtgagccaagaccacgacattgcactccagcctgggcaacaagagtgaaactctgtctcaaacaaacaaacaaacaaacaaacaataaaaaaagaagaggccaggcttagtggctcacgcctgtaatcccaacactttgggaggctgaagtgggcagatcacctaaggtcaggagttcgagaccagcctgaccaacatggtgaaaccccatctctactaaaaatacaaaaattagcctggcgtgatggtacgtgcctgtaatcccagctactcgggaggctgaggcaggagaattgcttgaacccaggaggttgaggttgcagggagccgagattgagccactgcactccagcgtgggtgacagagcaagactctgtctcaacaacaacaacagaagttttgggttttggagcattttggattttgtattttcggattttggatacttaacctgtattatattgttgtcagctttcaaatatctataagaaaatagcaagaaacattatttaatgtgaacaatagagaaatgtcactgcttttaaaattgcatgttttttttatcaaattaaaactccgtgaataaacaccaaacatcatgaaatctcttgctgtaatatattcaaatgacctcatgtaatatataagtcattgaatcaccttaagatactgcctgttaaagcatatttatgaactttcaaaggtatatacaacatcctaatttttactcatcaaaatacgaatttaatatgtatcaagatagtttctattcatgcatgtattagaaaatcagaaattattccaaagtgaatttataaacgtatatcacttaagatgccaccttcattttcttccaaagtgttactttgttctgtcctacagtgtatgctgtagattagctgaaaatcacaacatgttaatgagtatttcagtgattaaggaaagaagatataaaccaaggctgtaccttcatttgtgatgatgaaagaacatactgaaagctgtaccacactgtgctgaatgtagtaatatgaatgtgtctgtctgtggtcttatccttagtcctgctactgtgtagctctctggctttgtgggaattaagtaagttagtctcatggacctatcgccccttctataaagtaagaagattggactagagggatcctactagtgctaagatgtctgattctattttgtattctctgttcaagaattttttttgtaatatagataaaacttcatgaaacacagttgagggacaagataggttggactaattttctctgctcctccctgctaagtacaactaaaacccccagaaatactataatggaaagaggattttttttttttgagacagggtctcgctctgttgtccaggctggagtgcagtggtgtgatcatggcttactgcaccctcaacctcctgggctgaagggactcagcctcctgggtagctgggactataggtccttgctgccacaccgagctaatgtttttattttttgtagagacagggtcttcctatattgcccaggctggtctcaaattcctgagctcaagtaatcctcccacctcagcctcccaaagccttgggattacaggtgtgagccatcatgcctggccagaacagactttgaaaggtttaaagaggaaagaggactggcatgacagtgaactagagacttcaagtagacagaagaccaataaggaaatagaaagcttgaacaataccatggttcaacttgatataacataactatagaacacccagcatcagcacaatagacatttttctcaagtgcacttggaatattcttcaggatagaccatatgttaggccacaaaacaagtctcaataaatttcaaaagattgaaattatattaaacatcttctctgatgtcaatggaatgaaactagaaatcaataacagaagtaaaatggaagattcactaatatgtagaaattaacatactcttaaaaacacaaagaagaaattataagtgaaattagaaaataccttgagatgagcgaaaacaaaatcatatcaaaacctatgggatgcagtgatagcagtactcggcgggaaagttttagctataaacacttaacattaaaaaagaagagatccaaaatcaacagttagctttacaccttaagaaactggaagaaggctgggcacagtggctcacgcctgtaatcccagcactttgggaaaccaagacgggtggatcacgaggtcaggagatcaagaccatcctggctaacacgggaaactccgtctctactaaaaatacaaaaaaaatgttattctgggcatggtggcgggcgcctgtagtcccagttactcgggaggctgaggcaggagaatggtgtgaacccaggaggcggagcttgcagtgagccaagattgcaccactgcactccagcccgggcgacagagcaagactctgtctcaaaaaaaaaaaaaaaaaaaaaaaaagaaactggaagaaaaagagcacactagatccaaagctagcaggacagaaataataaagagtagagtggagataaacaaaatagagaacagaaaaacaacagagaaaatagttgaaaagttgattttttgcaaagatcaacgaaattgacaaaactttagctagactgaccaagagtataattaagcatgtgttaacctctggtcaaaataaagggctctattttaaagtgaaatcaggttctgataaatttatcatttgccctagataacattgttttaaatttatcgaggttgaatattcaagtggaatgcttgttttgtgtaatgtatttttcctttgttaactttggcagtaccttttactgtatgttccctagttgtagaatcggttcatagattgctcagagctactcatatctctagattcatgtatcatgaagaaacaattctgtttcggaccaacctgtgttgattgaatctcaagagttttggaagttctcttatgaggatttcttaaatttgaaaactattctcaaatagttcgcactgaatgacaaattcaaaaggcaaaggaaatggccatagtgataagtgcaaggagaagagagggtgagaattagtaatgaaataccagcattggaatggaggagaaaagtgtaagcctgtcccccttccttctttttgaaagaagtactcagcattttgctctttatcaataagtgtctttagaattaatcctagtaactaattcaaaagaaaggaaaagttctatgatgacatttattttagtattataaaaataagaacaatacagaccaccttaatatctaggaagaaggcactggtcaagggtaatgtatatctgcctgattagaatattaggcatctattaaaatgattacatgacaaaacagtagaaaagaggggtaacagctgaatacagaggtgtttcctgattgtaccacataagtatatggtagacctttgatggtaaggttttctcatctctgaggatgaccttgaaggtccatggtgcatggtaattggcccctttccagtggtcggatttcgaattacttttacattagccactgttccctccccagtagggttttgagattcttagctgcttagtgaatttctactaactctttttaggggtctaaagggatcgcttaggtgactcatttataatttacctatcttgtcttataacttgtttttataagtttttatattttgggagatgatgtatgtgtagtatttatgtgaattgggatatctgtgaaggtctccagatggttcagtcctaaatgtcaagtgcctactgttaaatacttggagaagactgctaagtaattggtagaagtttaaatggctgttttggtggggaagttatgcagtttttcttttaaaaattttgtcttaaaattaaggattggggaaaagaaaaaaaagtcctctgatatgacaactagaataaaaagtcatttgaagatttaccagaataaaatgacctttggaaactacttttagagaccagctctcagaaatagtgataagacatatattgcataattacattgttacgatgactctagcaattgtgaggttcaaagaaatagtgtactgaagtattatcatctagtcattttttaaatctatgttctttggatagtaaactcttattgccctcactcttaaatagtaattctgctgtgtacagaattttagactgaaagtaatttttcctcagtattttgaatgcattacctcctcttctagcatttattgctgccactgctccggattgtactgtcaatctattttttattcctttggtgcagctttgtctttcctctgggattgcttttaaaagtttatttttactttctgaaggggtgggttgcccctccacacctgtgggtgtttctcgttaggtggaacgtgagacttggaaaagaaaaagacacagagacaaagtatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaagtgctgtgctttagatatgcatacacataaacatctcaatgcgttagagagcagtattgttgcccgcatgtcccacctccagccctaaggcggttttcccctatctcagtagatggaacatacaatcgggttttataccgagacattccattgcccagggacgggcaggagacagatgccttcctcttgtctcaattgcaagaggcatgccttcctcttatactaatcctcctcagcacagaccctttacgggtgtcgagctgggggacggtcaggtctttctcttcccacgaggccatatttcagactatcacatggggagaaaccttggacaatacctggctttcctaggcagaggtccctgcggccttccgcagtgtttgtgtccctgggtacttgagattagggagtggtgatgactcttaactagcatgctgccttcaagcatctgtttaacaaagcacatcttgcaccgcccttaatccgtttaaccctgagttgacacagcacgtgtttcagagagcacggggttgggggtaaggttatagattaacagcatctcaaggcagaagaatttttctcagtacagaacaaaatggagtctcctatgtctacttctttcgacacagacacagtaacaatctgatctctcttgcttttccccacactttcagtgttctgttttgatggcgctgcgatgggtttaagcgtagatttaaatttgtttatgccaggtgacacttggcatgcattttccttctggaaaatcatctttaattttaggacatttagtgatatctctgtgggttttgcttctctacttatttcttctgttttcttctggaactaactatatttctgtcaacacatttaaaaaaaactctagtaatgtgtctttcatcttttttttttcttttttgagacagggtcttgctctgtcacccaggctgtgcaatgggatgatccatggctcactgcagcctcaacctcctgggctgaagctgtcctcccacttcagcctcctgagtagctgggactacaggcgcatgccaccacacctggctaattttttgtattttttgtagagatggggttttttcatgttacccaagctggtcttgaactcctgggcccaagcagtcctcccatctcaacctcccaaagtgctgggatgtacagatgtgagcaccgcaccttgtcactttcatctatttatgttgtgatctttctgggcttgctctggatgaaatcttcatcttccaaattaaaaatcctctgcataactatatagcctagaatttttcctattctgttattaagcctctatcactattctttgattctaggttttataatccattcttttttataacaacctgttcttgttttacttttccctatttttgttttatacccatctattcttttttaggatctattctccacttttaactttgaggattctaaaatacttactttaaagttatttttaacttgttctatttttgtttttgtcaggagcgaatttgccttttttatttggctgttctaccatgctttttggaattttgttttgtaggcttattttgagttggagttcaatctcattctcagttctctgagctcctcactttctgccagttcagtggctgtctctaccaactattcctggcatccatggcctccagtcaagagctgattcttatacttgaaatacagtacttccatctggtgcaggtgtcaggggtcttgtagatggcacccaatggtgcttagcccagaaccaggcttcagtgttatatctgcttcagttcctttcctaagtaggcaacccagagcttctccacaggcttcatcttggttttgcagcttcacaggtagcaaagtgataccttagcctctggcatcagggaatgagcttggtaccagtcccctgcctcatgcgggacatttatttatttttattttttattattattatactttaagttttagggtacatgtgcacaacgtgcaggtttgttacatatgtatacatgtgccatgttggtgtgctgcacccattaactcgtcatttagcattaggtatatctcctaatgctatccctcccctcttcccccaccccacaacagtccccagtgtgtgatgttccccttcctgtgtccatgtgttctcattgttcaattcccacctatgagtgagaacatgcagtgtttggttttttgtccttgcgatagtttgctgagaatgatagttaacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctctgggtatatacccagtaatgggatgactgggtcaactggtatttctagttctagatccctgaggaatcgccacaatgacttccacaatggttgaactagtttacagtcccaccaacagtgtaaaagtgttcctatttctccacatcctctccagcacctgttgtttcctgactttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccgtttcctgactttttaatgattcatgtgggacatttaaatccctgttattaggaactctcagctgcctctgtctgcttctgcaccctctgcctgcttctgcaccctctgcctgacctaccactttgtgatttggccccacagagacctttatcttgcttctgagtgggactgagtcttttaaattttaacagttcatgctaacactctcacatctgtcattgcatatcattttatgtaaggggaagttgagattcagagagcagaagttaactacttgggcctcgcagttggtaagtaagccagcctgctgtagaagaaaagggctggaaaaggtttctggggaagtgctagaaatttaataagcatgtagagagagaaaaatcattcattatacatcacaaaaattaactgtagatctgctaagtaaaagttgattaaatttctacactctgtgcccaccaataattttctaaatgtgaactctttcctacattaatctcaaatgcttatttttaaagtgccttccccagtgcagacttacattcatcttagccaaaatggccttcacatttggtctgtgggacatatttgatgtagcaaaaggccaagggtaacccttattctaccccctaaaagggaacagaaagagaacttttgcataataaataattatttatgcatttcaaaattgattttaagagtacacaaaccatagaggctttgcgattcttcatgtattttattaatttatcaagcacttcaacagagtgcccgatgctcttctagatgctttacaaatattaactcatttaagcctcacaacaaccacgtgcagtgggttctattgctatcctaacattgcagataagtaaacaaggcacagagaacctcagcaacttgcttgaggtcagtgacagaaagaaagagttaaggctatgattcctaccttggctatttagccccagtgtaccagctcctactatactactatgctgtgctgtgaaaccacgtctcacaattattttattaacaatcaaactgacacactatctttgtcagggacacattttatttcatggaactagttaaaaattagctttaactcacttctggtgacttgttttctttcttaggttcttcctcattatattatgcccatgctattgttatataaagctcactctgctggtatcattcttctggaagatgccataaattcatctaatcatttcatcagatgttaacggaatgtgctcactgtaggcccacagtttgctgagaactataggagcacaaagattgtgatgtgatccttatcctgtagttcctttatcctgcgtcaccctctcacagcagtcatgcccaacactatctattctatagtctctcatggttcttacaactgagtcattttctgtgtgtctcatttaaacccatttcttaatgctttattgacacaggttgtaagcaataaactggtcaccatgtttctaataactaccaatatagcccagttttcccctggggggctcagttatggtggttttctaggtttctgagcaatggaatcctcatttctcttctctgctgtcccctatcgcactgtgacttttttttttttttttttttttttttgagaaagagtcttgctccgttgcccaggctagagtgcagtggcgcgattctggctcgctgcaacctccgcctcccaggttcaagcaattctcctgccttagcctcccgagtagctgggattacaggcacatgccaccacgtccggctaatttttgtatttttagtagagatagggtttcaccatgttggccaggctggtctggaactcctgaccttgtgatccacctgccttggcctcccaaagtgttgggattacaggcgtgagccactgtgcacggcccacactgtgactttaaggaagcactcctgagggggtcaggggaggagcagatgtggattgggaggatgcccaaatgtgctactgtgctaatgggaaaggacaatggaggacaaccaggggttgggctcagggaggcagcttgacagaggatttaagagcatgggcttggggtttcaaatcctatctgcctcttactggctttgtgactttgggcaagttagtctctctgtgcctcaatttcatcatctgtaaaatggggatcatggtagtatccattttcatagggttatgatgattaaatgagtgaagatctctaaagcacttagaatgatgcctggtgccatagtcaaccctcaataacatttagctgttataattatcatcaccacaggcctagtgaaacagaggtggggtctagttggcaaacacagaacagactccagatagctagaaattagttgcaaccagcccagaatgagtgctgaagtggctcgctaaagcacttgcagtcaaagcacattgttaccctcatctgtgacctttcatgggctgtctctctgcctatgtcaggggttggcaaactatagcctacaggccaaatccagatggtcacctgtttctataaataatggaaatgtgaaggagaatcaattggcaagaggcacgcatagcgcatcttcaaccttttccatcggggaacatgagtcttgagaatcctgccatagatcaaaagaatggcaatgagaagaaccagtggacaggtggataggcctccccatcagcctttaaccctcctgctcttatctcaaggatcatatgcccgtgtctgtggtttctgatttttccttgaggacctttgaccgagatgatctgtctttcagactttactagcaaaattctgagcagtatcttttatacaactggcagcttcaaaggcttgcagtgggtaggcctccccaactctgtttcgcaagataattaaaagaagccagactccttcatccttgaaggagaggaagaagaaaacaagcctgtccagagaaaatggggtgaaggaatttttctccccaacttcctcctaaataccctgctctgcccatcaaattttgtaagtatcacccagtggtgtgttggtaaaccttctcccctgcggggtgggggaaagccccaatttgcagccgttgttgctgtctgtgttgtgaatgctcccaccatgctgactgcaagtggagctgggaagagatgtgtaccatcggctcactaacactagcatgctctgtggtagacagcttcccttgcctctgaatccttgtgtcaggattctacgtgccaggcaacaagagctttttttctttatgtatcatgccagtgattttagtctagggcactgttttagcccaatcccagaatgtgctattagaaatggggccatatttttgaagttgctaggggcaaaacttccctcttgtttatgtttaacttgtgccactaggtggcactttaaggacattacaggaaatcggctctactggatttttaaaacttttttttttttgagacggagtctcactctgtcgcccaggctggagtgcagtggcatgatctcagctcactgcaacctccgcttcccgggttcaagcaatttagctcactgcaacctccacttcccgggttcaagtaattttcctgcctcagccttccgagtagctgggactacaggcatgtgccaccacacccagataatttttgtattttagtagagatggggttttgccatgttggccaggctggtctcaaactcctgacctgagttgatctgcccacctcggcctcccaaagtgctaggattacaggcgtgagccactgtgcctggcccaaaacactttttattgaagtataattgcatatagaaaagcaagctgcacatttaatgtgcaactcaattttcacaagcagaacacatgcatataatcagcacccaaatcaagaaacagaatattactagcaccccagaagccctccttgtgctgttttccagtcgctatctcttattcttagggttaccactattctgacttctaacagcataaattagtttgacttgtgttctactttatataagtggaattatgcggtatatactctgtgtctggctttttattaaatgatgtttgtgtgatttattcatactgttgtgtgtaattgagatcattgctgtatagtattccattgtatgtgcaaatataacactgttttctactattgatggacatttttgtacttttcagatttgggcaattatgaatagtgctgctgtgaacactcgtatccaagttgttgagtggatgagtgttttcatttctcttggatatatacctaagagtagaatttctaggtcatggtgtaggcatatgttcagctttagtaggtactgccaaacagttttacgaagtgtttgtactgatttacactccattaatggtgttcccactccagttccatgtcctcatcaatgctgaatttattttatggatggttcctaactcttaacataatttttatagctccctttctggccagctatttctaattgaaaaattttaaagccacattattctgatggacatggctcatgcaggaagggctatgtcaacccaaaaggggacatttatcacagtctaagtgtgaactatcagtaagtcggaaaggatgttactctaatactccatcacactgatacacagagcaaagaaaccaggaaaggaattcagattgtaagtgtgataaaatatcggttcataggccagggctctgaggcattttgaaatttgtatatacatttgttattattgccaggcctatatatgtcagagattggggcccaacagaaagaatttctaaaggcctcataatgaagtgcctttcaattgtgctgctggtgggtgcctgttttactaagggtctctttggtttggcaagaggcatgcatggggcatctttcttcaacctcatccctggggagcgtgagtctctagagaatcctgctttagatcaccttacctgtgaggctcatgttgttgactctgcagatggtgttataatatggctttaggtatgtgatatagagagtacagttcagacttgactcagatttctgttccattactagaaattggacatagaagaacaaaacccaggtcatggtcaaaatatttgtcttttagaccaaaataaagtgctcatagtcctttagttgtaacagtaagtctgtctcatggatgttgtccataatctaatgggttccaagaatccccaaggcattctgccatgtgactcttgaatccagcaactagttgcccattatagtcactggtacccactttcaccaaagttgttcctgagcccctctgtcagtgttttcctgagtgtctccagtgttggattggtctaccgaggggggtgcccaccagagatgttcactgcacactgcctgagatatccatgttaaagcagccgtgaaacatgaaagtctgaccgggcttttatttttaaaattttctccccccaatattagtagcggtaatatccagtggcacagatttagactgtggatagcctgctttgtgggatctgcttatattctaaattggagccagcattttctcagcctaggttttcatctgtttggcaaggaggaaaatgcccttatgttggattggctgctgcttgcagtaggaggaactatgcctgggaaaccaatcataattttaatcctaatgataatagtagctgctgttgtcaaacagttactgtgtaattgtgcttagcacactagacagatattttgcttaatcttcacaatattgtgagttaggtgaattatcccactttgcagatgaagaaattgcagctcagagagactaagcatgtgaccagctcacacaatgagcaactgcaaagcctgggtttgactccagagcctatatcctgtaactgttctgtgctctgtgggtgcagttaccaaggaatgaattactgacctcttctccagtggaacatgaaacagtattgggttcattgctggcttattccacacattgattagaggacctgttgtttgctggcatgcagcttaggtatcaagaaaatgatagggaagcaagacagatcctgccctccaggtgcttaccattcgtttatcatgttctgtctctcacaggtgacttgagtcatggattttggtaatcattcttgctgagaattcagtctcttggaccttcttgaggctctatttacccctctctctgagcctggttggggaatgatggggtggaacagtggtgtgctgggccattggttctacatcttctgtgactgggtttagcaaatggctttctgttgtgttcttgcctagcggagatgggggacaggtgaaaactaggcaccaaatgacatttagaatactgacagaatgctggaaaggccctggaggcagcagcaggattgtcttcttgtctgcctagaatttagctgctgcctttgtgatccccattcttggaatccacctggatccttggatgataaagcctgagttcgtttttctgacctgccaatattgcaaacctaaaaaaaaaaaagttacctattatccacaccttggcaaagttctacagatggacttcttttttttttttttttttgagacagagtcttgctctgtcacccaggctggaatgtggagtgcagtagcgagatttcagctcactgcaacctccgcctcccgggttcaagtgattttcgtgcctcagcctcctgaatagctgggattacaggagcgtgtcactacgcccagctaatttttgtatttttagtagagacggggtttcatcatgttggtaggctggtctcaaactcctggtgtcaagtgatccacctcccaaagtgctgggattactagcgtgagccaccatgcccggccagactattttttaagtgggatttgactttttttttggttgcaaatttgacttttaaacaaaatcttactgctgaagattttgcccagctgcaaatatttatctatagaaccatgtggcatatacccccattccctctatgatgaatggatgagaaaacaattaagaagcctagttagttttgcaagagcacctgtggccttgcccagactagggccttggagacttggttttctcatctcttaaatgaagagtttggaccatcagtggttcccagttgatctgggctggctacataaaaatcacttagggtgcttgttaaaatataagtttctaatgccccatccctaagggattctgatgagggaagtctggaatagcatctacaaatctgaatttataaaaagttccccagataattatcctgctctggttatatttgggagccactgggctagagggtctagaacaaacataattaagttagggagaaacttctgatgtgcttgaagatttggggaatacctatatgcctggagcaggttccatatgggcgaactaacccagttatgttgcagaggtaaattggagccagaggatggaagacctttaactggctgagggattgtgttgtgtgccataggctttggggagccagtgaagggctttgagaaaaagcattttgattagatggtgctttaccagattaatttctcagtggtgtgcagggtggatcagagtgcactagaactgaaggctggaaaaagacccagtgaagtctttgcagtggcccaggtgataagtgtgacgagtacctggactcagatgggaccagtgggacctttgtaaagctaacctgcctcagtggaactggaatctgagacatactgttttaaactccttaaaaaatgcataatttattaatgtcatgttcatctgcctaaactattataattaactatttttattgtgtttttgtccaagaggttttaaaggagccctgtaaataaattcatgcaaagaagtagttggcagcagcaacagctgctaccgcagggagaagggacccccttctggccaggcagcaacctcattctcaccctgtctccatactctaagccaaagcgagaggggaggggagtgcaacaggggcccctggagttggatctgccaaccacagtggagaatgcacctccccaagggttaggtgtggaatatggcgtttggcattaagtcaaatagaatattcttcctttgttcctctaaaatccagtctatagtcaatgtttctcaaagtatgttccacagaacattagttcttcaggatgttaatagaagttacatgagaataaggagatgaaaccaaataaatttgggaactgatgggctacgcaaaggcaagtgacttcctttcagaatttcagagtgtgtaatgttctgtgtgctcagtgaatctccaagagggagatagaccaggcagtgtttcctaagcttatctgtagattcttcttccccctaggccaggggctgacaaattatggctcataggcctcatctatcccaccactttttttttgtaaataaagtttattggaacacagttgtgcccattcatcgtattgtctgtagctgctttagcacaacaggagagttgcagagtggctacagaggtagtctggccctcaaagcctaagatatttactatctgcccattacagaaaggtttgctaatccctgctctagacaattcatggaactggtgcttcctggtaccccctttcagagatgctactagaagaagatatacatgggttgttctagcactgctttatgataaatctgcctcattttattctgtttccatactgccatcattcctgcctcttgctttaaactactttatctctcaaccatttacccattatccaggatccaaacctgggttccatgtgtccttatcttttcttgcactcacaacattccaaaaatggccaagggtgtcttcaatttccagtctgggtagctcttaagtcagcccgaacccattcctaccaacctggcctacatgaccgtcatcttttctttttcagcattcgaattaggttccttttccccagatatgagttacctctagtcctttttactcactgaatctagaataacctttgtaaaatacaaatctagtcagattgattccttacttaaaatccttcagtggtccctgtggccctcaggataagctcagatcctcaggatggatgtgtgtcagtctggttgggcaaacagaaactactcctggtatttcgtactggaagagatttaatttaaggaattagttacttaagaaaaggagtagatatttccaggcttctgcctgctgtggcatagagaagggcatggaaatgggggatggtgttgagtgtttagcaaatgacccagaacaaaccaggtctgggaaaccatgtgttatcccctgctgcccttctccagcttcagctctcccatttttctcctgactcctcacccttcctccaccctgcaagtccccaaattctagatatatcaggatgcctttttgtccccccagaaacttaaaacaactgacatttacgaactcacagtctctttgggtcaggaacttgggagtgacttagctgggtggttcggggttacatcctctcatgaggcttctgtcaagatgtcttccagggctgcagtcatctgaaggcttaactggagctgatgatccacctctaagatggctcactcacagggctgttggcaggaggcctcacttctttgctgtatggaccccttgttaggactgcttgggtgtcctcacaatgtggcagctgactgtctccagaacaagtgatatgagagtgagagatagagatagaaacagagacaacaaggaggagcatactagagtgctttcagtcccctctcctgggagtacgttgcatagtgtctcaggtcagcttccctagaagcagaaccctgagatgaggattcttcaaaagtgatttgttgaaggagtgctctttaggaaaaaacctagaaggaggagagggaagaaaagtagggaaggggaaggagccaagcaatgatatagtctcagataaaatctgaccttggcctgatccacacaggcaggattctggtacataattgcataatagagttaaccctgtttgagacaggggactggccttttatatccttctctaagtcagtcattataggctgctggaggtgggggtgggaggtaggctcccattagttgagaataagtctctagagaagagggtggctgtgagtcctcagtagctaacactcagagcagctgggggatggtgtgccagccagggaaaggtgacccaggtggggccaacacagcacctactacagtgggcctccccgtacccatgtcccaagcacctaccatggtccctgacataccagaggtacgaaaaaaatatctgtgtaattgaataaatgaatgcatagaaatgcttagcctctctggacctgtgtccatttctgggaagtcagctcagcagggatcatattgtcccatcaaccatgggaatggtcgaagacccaggacagtttgccacatcatgagtggcagcactgtctaagtccaggattttcattgcaaaattagagtgaaagtatatttgccatttgtgaataaggaagtattaatattacaatattatatatttttaaaaggaactttagctcacatttcagtgagctctttgctaaaagtacattttcctggtttgtcacatcctgactgggtacatgttgttacacatggaaccgtgagggcagaactgccatttgttatattaattgtaatccatatatctgtttttttcccacaagaatcagtcactggatttcagttcagaaaaccaaaactgtcggacaaagccatattatcgtgttggcagagttgttccccatgaccccaaatacacagaggaggaagagaaccactgaggccccttgttttcttggattatcattcttccaaagttggtaactaagaaaagtctcaagaaatagcaaagaaacctccccaccttattctgctttccacatcccaagcctaacataagcctcaaactatttttatgaaggaaagcttattgtgaagagggtcttttacatgcctaaatctcatctttagtttttcttatcacacagccggttatctttgcccatctcttttcctgggataatgtctggctctgtcaaggctgtgccttattctgggaccttcctaatgcctgtgttccaggtccctcctgagattcgctcctccgaatgcttgatagatggatcaatttaggggattgatggtcagatttagcctgacataacaccatgcagtggtctgttaccagacatagagctggaaaacccaggcccttgcatacaagttcaggaaggtaaatttgcaaatgaaaaacattttaagacacatctcacagctgcttcctcatcccccaccctattgtttgtgtttttagagatgtttaagagaaaaggaggcaataacaaagacgctctgctgtgctttggaatcctcatttatgttgaaaaagggtccatttatcatctccttggatatttccacaaggagactttgctcatctcaccagggaatggagtggtagagcaaacacttctctgtccacctgatgatggaggagaaccaactaactgaaaggcagagagcctgaaattattatcctctctctgcctgcctgctgcaagatattgctgcatacctgtggtccctgcaggaggctgcatgcgtagacttgggccagaacatatattaccttccaagcaatagatttctaggtaaaaggcaagaaggggcctcaggttcaagttgcattcttcagtggggttcacaggaggccctgcattcagggggttactgggccctccttcagctgttaataaaactgacttttggctcatagagcttggagtatgcgtccatttgtatgaacctccagggaaagcagggtgagggcttgtgttccctagactcctggcagtgaatggctcctggacagctttgcttggttgtttcccaggtacttcaaactcaatctgcctaaagatgagttccccctcactcctgcttctcctgtgtttcccatcttggggattgaccttagtgttcttgtggtagccctggctgaaattatggatgttggagcatgggaggccctttgtgaacttacttttgggtctttctcaccattcccacacattgctcttttagcccaggcctcagctgagacatcacctgctcctgagtctttgccgacccatgagactgggtgcttctgtattccccatacttgccctccacagtccactgaagcaagttggctttgtcacttccctgttgctcccactagacttcaagcttctcttaagcaggatctgtatcttgttcatccttgagtgccagtgctagcacagggcctgcctgtagtagctgcttaataaatatgtcttgaatgagtaacactcaggcctgagaatacctgagactgtatggcatagtggttataagcttagctttggaaatcaaggcctgtgttcagactctgctatttgtgtgattttgggtgagttccttaacttcttgatcttcaatttcttcaccaataagatggggataataactacttcctagggctgtgatgatgaattgcaatgatccatgcaaagccctttgatcaatgtatgacacatagtaagtgttgtgtgcatcatagtacctattagtaacaacaacaacaatatagttatcgttaatggaagggagaaagctataagaactagttggaactagaagtcaggaatattgagtgcttgcatagtggatttagaggagatggggaattgcttgggataaaatgtaggaacagatgggattaccctgggagagaatgaacagggagggaaaaatgggtggagcaactaaagacagaaccttgagaaatcctacatttgagggataagaggagtcaaaacaggaaaaagagtgaatgactacagttaggagattgcagcttctcagatgccaggggcaggagtttaaaaaagatagtcaaaggtgctatactgggcagaagatcaatgaggagaagacgagaagaggtagccataacgtgttaaatgggggtatgttagcgcccttgggaactagccatttcagtggagtcagaggaagaagccatgctctgaaggaggttagagaaggccacgttagggatgaagtgggcatactaagtcagtttgttgtgctacaatgtgtgtttctgtaatgaggattatctgtgggtcagtagatgactggtgtcagtatgatgtagaagtcacattggttcatatgtagggttcattctcagcacatgaatgttttggcatcactggctactagtggctgaaagcagactaacacacctgaaggcagaagactgggggaaatgggggacatagagagctgctcatgaggcgcagtcaccctgtgttcttccacttgactgattggcacccactctgtcttgaagtgctttggggacattccttgccaatcttggtgagtttagtcactgattccattccactcagcacccttgacccttctgataactccttcgaccacagtcccccttccttttttaagaagggccatatttactagagtttttttttttttttttcccaaactgtgtccaggtttattaaagatactttttgtgaacagtcatggtatttcaggcaggacatgagcgacaatcattaacagtatacaactttcagactccctccttcaatggacttccaaaatcagaaagccatggtaaaacccaatgaagtcttcatttggtaccctgaagagggaaagttcagagtgagggttgacatttcacattcaacgtgctgtttaacaacttttcatgagctgaccctgactttcaggaaatgaaatgaaaatggcagaatttatctgaagatccacaatctagaaacagagcacgtgtctttcaagggttctcgctggaaagtccagattgccagcctgactggtaaccagttattgggggccagaccccaacaggtatctgggtttgagggagttaagtgtatactgaaggcagagagggagagggggaaataaagaggaatttgtttctccacaccacaaggcctttgtgcgaaggtgactgtgtgtgtcaacgtcagacagtccctctttctgggagccaagaagatgtctttaaaactagaagggaaaggtgttttctccacatcagtccagcttcatagacattctttttcttttttttctttcctgagacgaagtcttgctcttgttgcccaggttggagtgcagtggcacgatcttggctcactgcagcctccgcctcccggcttcaagtgattctcttgcctcagcctcctgagtagctgggattacaggaacccatcatcacgcctggctagtttttgtacttttagtagagacggggtttcgccatgttggtcgggctggtctcaaactcctgacctcaggtgatccgcctgcttcggcctcccaaagtgctgggattacaggcatgagccacggtgcctggcctcagagacattctattagtgacatataccccttctccataaaacaacaatgacgtgttccgtgtgctaacaacatggcttaaaataaaggcataaaaacaattctgcatttttataaaacttaataaaaaaataatacttcaaactgcacagtcaccagaaatacacagttatcaaaaatgcacacacttcccttggcatccccagcgccttcaactttctgtgcctgctctgttttggcctctgcattttctgcagagttattcccctccttgccagcatgggctttttcctttttcccctttaccttctctcccttctttgcaggggcctctttaggcttgggcttcggaggagcaggtttggcagacaaccttgcagatcttctctgtggtttgtccttactttggttttatctcctttagcgtccccttcagcctttctcttgggcatggtggaggcgactgcagtggaatgtaggtgctggatctggggatgcagcagtgcgtgggctttggttggcctgggggatagttcttacctcttcttcttcacactgctcatagagtatttctttattagaaatttaacatttaaaaaattcagtgtttttaatgatgttgattgtttttgttggtgctcaagttaaaatctttgttttcaaccctgtttttccgataagccttgttacttttagagtttgttgttgcgaagcattagttttttagcaatacatatgttcaattacagaagaaattcccatgattccttttcctaaggttgaacaatctgggaaggagggatgggaaggttaatagcagcatctatgggaggtttttcccaaggatcagcagacttaagcattcttggctgcaacttggcctaaatcagttttcccttggtgactatcttcctaagtgctctttattgtatatttaggtgattgtggttttgcatttctgtcctctctctgatctcttgctacagtctgaacaagtgtcggaggccgagttactcccacagctgagcagagccccatcccaggctgcagaaagtagtccagcaaagaaggtaaggtcagcctgaggatgctgtcagatggcgttgcgagtcccaccccgggcttcttatctctattagctgatctattgttttaaggtttctgtgtcctgaaatgaatgtcaatgatccagatttcctagaatgtgggttctttgtgaagattggggtcctgaagattcctgggcttgacccttgatgcattttgtacatgacagtacatactcaacctccttagccccccagctaaacatggtggccttgtttatggcaagagctaaaagggctgtggggagggacagatgtctttagcaaaaccccatccacctgctaagcctctgtgaatacctcttggggtggggtagtctctcctttttggtctttgtaccatggtttcctcttgcatcgtggcattttcacctggcatctgcccagccatgccattgggtcacctgtaatttgctcagtaagtacccctcactcatcatgctctccattcatctcctcaccctcttcttgtccttctcccaggctcttctttcagagagagtgggccttgggctcaggagcacaggtgaggtagagtcctccaaagaagcagaccaactgtgtccttccagaatacactgtggctctttttcttgactttatgtaggaattggggataggagaatgatgagcatatgactaagacctttaaaaacttccaaagcttaggtttttttttgtttttgtttttgtttttttttcctgagacagagtctcgctttgttgcccaggctggagtgcagtggcgcgatctcggctcactgcaagctcccaggttcacgccattctcctgcctcagccttccgagtagctgggactacaggcatcttccagcaggccggctaattttttgtatttttagtagagacggggtttcaccgtgttagccaggatggtctcgatctcctgacctcgtgatccgaccgtctcggcctcccaaagtgctgggattacaggcatgagccactgcgcccggccaaaatttaggtttaaaaggcttcaaagtgaggcaggagcctatcttgtcttcagttaggaaaggccccatggtgtgagatgcacacagggtctgtgtgagtttcaggtgacaagaagtaatagacttcttgaaacatttaaaaagaaaaagaaaaaagggaagaccactggactctgatgcctgtgtccccccagttcttgctgagccatgggtcagtaaatagagtaccctcctgatcttggggttggggctaaaggcatgtgggacactggaaggaagagtggagggaacattgaaatgtttaactttttaatttttattttgttttaaatccacaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagtaagtagaccacataaacaagagtgaggtaggaatctcgctctgagatgtcgacggatatgtaaatgtgttgacatttacgtgcgcaccaacagaaggatttcatggttgtaagtttatcttgctcatctctgtgatgggattcaagtctcccagtcacatagaaggctttataagctataggacttaacctgacctaaaggggcaggcgagtcctaggctgtggtgtttggtttggtttgatttctttcccttcctctcaccttctgttgtttcctactcctcttccttgtgagggcccaaattttcctggcaagatgaaagtattgtaagtggcaattttgcctctctgcctgtgttatctccttttccttcagggcaaatggctagctccttcacccacagacacactttcagtaggtgtggtatgtgattcttttaaaatctccgtaaagagtttctgttgttggtcgcctcagcacagaatggatacatgcagaacttccattatatttatctaaccagctggaacaggtattggagggagggtgaagacacctgtggacatggccagggactgagacaatgatgctctggacaaactatccttctctgtaaaactttggctttgagaagagccatcacttgcttcaatttctttgtagtgaaattgagggaggtgttgaggacagaaacctgctcctgtcacttgactgcaagtgagcctgaccggtcactaacataaatgctcaagacccatcatgaccctgcttttggggtcttgcaggtctcagatgctgctgcagattttcttctgcttacacgttgtagaatgaaaagcagcaggttctgtgggagatgttagcaacttgtctttgaagccaaagtcccattctgaatctctgcagccctctccttcagaagattttctttttttcaaatggacaggtccctggtggtatcagtccataaaggaagtatattttgttcatcacattcaccgagaactttgaccatcttccagcccctgttaagcctggaaggtgaagaatccctatcagggacaaagatggctcaattttcttccatgttctaccccagcactccactttaatttcagctttatgttcattttagtcagcagtggcttaacagtctccagagtagatgtcagggcatctggtggagttcatacagagatcttttctttttctcttttttataacagctttattgcaatataattcacatagcatacagttcatgtttttaaatgtacaattcagtggttcttagtttattcacaaagtcatgcaaccatcaccacaatctaacttttgtcatgcctaaaataatatatatccacgcccattagcaatcactccccattctctccttccccctcagcccctggcaaccacgaatctcctttctgtctccatggctttgcatattcttgtcatttcacataaatggaataatgaaacgtggtcttttgtgactggcttctttcacttagcataatattttcaaggtttatccaagttgtagcataaatctgaacttatctttttatggctgaataatattccattgtatggatagaccacattttattcatccattcatcagtcaatggacattttggttatttctgcttttttggctcttaagagtaatgccactatactgtttgtgtacatgtttttgtgtggacttacattttcatttctcttgggtctgtacctaggagtggaattgctaggtcatgtggtaactctgtctttaatatttcgaagaactaccacacttttcatagtggctgcaccattttatgttcccgttggcaacgtatgagggttccaatttctccattttgtcaacacttatcttttttttttattatagccatcctagtgagtgtgaagtgtgatctcatggttttgatttgcatttcttttgtggctaacgacattgatcatcttttcatgtgcctattggccatttgtttatcttctttggagaaatgtgtattcacaccctttgcccacttttaattggattattaatctttttacttttgagttatgaattctttatatattctggatacaactcccttgttagatatatgagaaaattgagccctctttgtaaatattttctctcattctgtgggctgtcttttcactttctattttttatttttattttttagagacaaagtctcactctgtcacccaggctggggtgcagtagcatgatcatggctcattgtagcctcgaattcctgggctcaagtgatcctttccccctcagcctcctgagtagctggaactacaggcatgagccaccattcccagccaatttcattttattttttatagtgatggagtcttactatgttgcccagtctggtctcaaactcctggcctcaagtgatcatcctgcctcaacctctcaaagtgctgggattacaggcctgagccactgcacccagccaattatcaatattaatcagatctgtacagtggtcacagtccattctagttcagttgctcttttctagaacctatctcccagtaatggcacatatggctgtttttctaggagaacatcagttgctcttttgctctaagaattcggtgtttcttgctgtgggatgaaaggttgtagattatccctgtggtaactgcactgatttatcatcccaaccatggacggttttgaaaagtaaagagagtgctaatgtacttatgctggacagacagttttaaatggagactgtaatgggcgcagtaggatgcgtggtcactctggttatgcgtgttctgtgaatttgttgttaattgggaaatactggtattaaaacgttctgtatttttctcaagagccacagatatatgctggtccatgcacatacacgagtgcacatttatgcacacacacacatatacttaggcattcatgcctaataatacataaggtagaggtaggtagtctggctaagttaatgtagaatttttgctaaaaataatgttcttgtattattttccttcagacttgttcacaggggacacctgcaggtcttctaagtgctattaattcttacacaaaaagggcattccagttaatatggtttgtcaggaagaaatacttattaaaatgtcttggaataaatggaacacaaatgtttgaaaaggcccatttcacagcttttattcaagttataaaatgggaattacttcaggtgtaaataattcatcccaataaatttgtttcatttggtgtctatcttcctgaccgcctgtgaatatgagattttatttttggagccctgtgttgttaaccacttgttagtttaacacctctcatgaatcagagttctgaccctcaagggtccagacctctaagtcctttttcactgaagtgtttgtgcttttctataggcagtcttccaaacagaagaaggccattcaaactgctatccgcaaaaataaagaggcaaacgcagtgctggctcggctgaacagtgagctccagcagcagctcaaggtaaggaatgagtcccagatttggatgaccaggcttttccctggcttttaaaaagcttttttttaatttaataggcatataataattgtacatatttatagggtggggtacatagtgatgtctccatacctatcatgtacagtgatctgatgtgtccattggctgaccatttagttccatccctgttgataagacttgcctcttcgttctcaaaccctttttggaaggtggagaattactgtatttaagtttcatgggttggttcttgcatagtcagaggaagactagtgactttaatatgtaggcttcatattgtgtatgagttaaaaggaaagacaatctattacgaaggctgtttgaagcattctttattatccaaagcttctgggtaagcccttaattatttacatcctctctgaaagaggatgtaaatacttatttcagtagaaggaagtcaccttggtactatcaaagcccagcccctcctctggtgccttgcaaatggttccatttcaccttctcaatgacatcacccctgtttctcttcatcgttactctcccctgtgttagtttctcggggctgctataacaaaatactacaaatgtggtggcttaagataaccaaaaatgattctctcacagctctggaggctagaactctgaaatcaagatattggcagagctatgatctctttgaaggctctagaagatgatccttccttacctcttcccagcttctgatgttgctggcagccctgggcattccttggcttgtagctgcgtcactccaatctctgcctctgttgtcacatggccttcttcctgtatctctctgtgtctgtgtccaaatttctcttcttattgtatcctcttataaggacaccaatcattggattaggacccaccctaatctagcatgacctcatcttaacttgattacatctgcaaagaacctatttgcatataaggtcacatttacagatactgggggttaggacttaaacatatattttgagaggacatgattctacccactatatcccccagttctctactggatcattcgccatccacatgtaaatatgctccagtattgtccattacacttggccaattactgcctcatttctttggtccccttcacagcaaagtttcttaggagtggttttattcattatctttactttcaaaccagtaattttctcttccttccacttcagttggcttcgtcctcctccactcacacccgtcttgtggctaaatccaatagggctgttttaatattattatttttttttcagaagaattctacacaattgatcatttcctcctctgaaatggcttttataactggtttttgacataccatactctcctggttttccttctgcttcactggtgcttcccattttcattctctgctgtctcttccttccctgacttaacttttataccccaaccccatttgccccaatattttagtatgaaaattttcaaacatacaggaaagttgaaagaatcataagtgactgcttgtatagacatcacttcagttctacaataacattttactatacttatttttaatcacatatctacccatttatccttgtgtccatcagttcatcttatttttgacatattttcaaataaattgcagatatctgtatactttccctgaatattttagcatgcgtataattagctagagttcaatatatttttacagttttttcttatgatgtaaaatgtttatacaaaatgcatgcacaaatattattattattattattattattattattattattattattattattatttgagatggagtctcgctctgtcgcccacgctggagtgcggtggcgtgatctctgctcactgcaagctccgcctcctgggttcacaccattcttctggcttagcctcctgagtagctgggactacaggcgcctgccaccacgcccggccaactttttgtatttttagtagaggtggggtttcactgtgttagccaggttggtctcgatttcctgaccttgtgatctgcccgcctaggtctcccagagtgctgggattacaggcgtgagccaccgcgccagcgcacgcacaaaccttaagtgtacatttgctgagtttgtaacaagtacatgtacttacggaatccaaacccccaaaaagatagagaatattaccatcaccccaggaagctccctcatgctttttcctagtcaattcctgccctacccacacagaggcaatcactattctaatttttataccatagttttgcctgttctataactttatataagcggtgtcttacaacttatacttcttgtaaagcttctttcactaagtattatgtttttgagattcatttatattgttgtgtgtatcagtaattcattcatttttattgatgagtagtatcccattgggtgaatatgttacagtttggttatcaattctattgacagacacctgagcggtttccagtttttggcaatttggaataaaactgcattttttaataagtctctgtatggaaatatgttctcatttctcttggattgggattcgtaggtatcatggtaagtgtatgtgattagtttctgagaaactgctagatcattttccaaggtggttgtagcaatctgtactcctaccactaatgtatgagagttccaattgttccgcgtctttgccaacatttggtgttatgattcttattaattttagctagccctgtagtgatatagtttttatcatctccttgctgactaattatgttgtccacttttctttgtgattatttacctttcatatcttactttatgaaatatcttttcaaatgttatttttctccaaagtagtctatagatttattacaaaaccaataaaaatcccagcaggattttttgtgagtatagacaagctaatcccaaaacttatatgtaaaggccaaggagctggaattgcttaaacaaatttgaaaaggaagaacaaagttggaggaatcactttactgtcaagctccagtaatcaagatgctgatgcacaggtcagtggaataggatacagagtcctgaaatagaccacatgaaaacagccatttgatctttgacaaaggtgcaaaatcgattcaatgagaaataatagttttcaacaaattgttttataacaatttgtcatttgcatttaaaaaaataaccttgatctaagcctcacatctatacagagattaacttgaaatgagtcatagatgtaaatgtaaaacatagagctataaaatttttagaagaaaacagaaaaatcttcatgatctggagttagaaataacaccaaaagcacaatctataacagagaaaaactaaaaaaattggacttcatcaaaattaaaaccttttattttgccaagcacagttaagaaaattaagagacaagctgctgagtgggagaaagtatttgcaaaacacgtatttgataaaagacttatatctcaattatataaagaactcttaaaactcaataataagaactctcaaaaccaaagcatctcaatttaaaaatgggcaaaggatttgaacagacacttcactaaagaatatataaagatggcaaataagtacatgagaagatattcaacatcattagccatttgggaaatgcaaatttaaaccacaattacataccactatacacatactagaattgctaaaacaaaaaatgtgacatcaccaagtgctggcaattagaactctcatttattggtggtgggaatgcagaatggtaccaccactctgaaaaatcgttcagcagtttcctatgaagttatacatacactaaccatgtgacccagctgtctctctaccttagtgaaatgaaaatttatgttcgctcaaaaatctatatatgaacttacatagcagttttattcatgatagcccaaacctggaaacaacacaaatgtccttcaaaagatgaatgaataaattgggatacattcatacaatggaatagtactcaacagagaaaagaaatgatacacaacttggatgaaactcagacattatgcagagtgagacaagccagtatcaaaaggttgtgtactgtatgattccttttatttgacattcttgaaaaggtaaaactatagtgatgtgaaacaaatcagtggctatcaggggttatgcatgagatgagagtttgtatgagtagtcccagggaacttttggggttggttgaactgtaatgtgtcttctttgtggtggtggttacacaaatctgtacactaaaagaaaaaaattgttttaccctatgataattttaaaaagttattttttaaatttcaaagttcattctgttttctaaaactttgtatgtgaacttgttttgttttgcattttgtttggttttggttttctcctctctccctctgctttggggtaggccagtttcatccattgttctctacatttggtgggcccttttggaaactgatattccccagttctgaagggttttttattttcatttttgttgtcgttgattatttcctcccccctgccctcacccccatttttttctcattctcccttactgatattcagacattggacttcttagcttagttctctaattttctcatattttctcttctgttttctttcttttctcttcctacattttcttctttatttttgtctatttctggaaacttaattatatattctaaatcttctgttgtttaataaccaataattttttgttctctgtttatttttgacggtatcctattcttgtttcattgttgtgatcttttttttaattatactttaagttctgggaaacatgtgcagaactcgttgtgatctttttttatggtcatttttctttcttcttcctgaatagtttgtgtttgttgtgttgtgttgtatgtgctttatcttagatgctttcctttgatatctgatggcccttctttgctcatatttaaaaggaagatgaaaacactgattagaagttcattgtacgttgtaaggcttgtcaactctgagcttcactgtctggcaatttggctcggctgtatagttggggaacccccaaagggagtatgattagctctttcctcttggtctggttggagtgtccagagtggagactgttttggtcacctacatggagggatagagttggttcagtggagcaagagggctgtaggtctcagcattccaggatattcattcactctccctatttctggcccagtatcttgtcctcaactgtgcttgtttcttgctaatccagatgctctctgttgtaccttttcaagaaataaaccttcagcattctgccctggtggcaggaatgatctggggatctaattgcttctgaaacagattttcagccaacacttattttagccaactcccatctccccttatgtactcccactttaataggtatctggtgttgccaatttgagtctttcaggaattctcctacgtaaaatcaagttggttcttatttttcttcatgttagcctgggactcagctttctttacttgatctgtatgagtggaaaagttctaagtctagtgaacagaagtctgaagaatcattgaaacagaactatagtcatagcccctcaattaattcccaggctaagccagtttatagatccagaacctcttgaatgatgaaggggcatctatgtctccttaaggaaggaccccactgtgcagccaaaaatttacactgcaaatctttctcctagcctttcctaagggggaccctgctgccatttaccagggtgactgtgcattagaggaagggaaataattagacttttggggaattaccagacactggctctgaactcacactaattccaggagatgcaaagtgtcactgtggcccatcagagttggggcttagggagatcaggtgatcaatggagttttagcttatgttcgtctcacagtggacccagtggactcccaaactcaccctatggttatttccctagctctggaatggcatgcttggaatagacatactcagcagctggcagaattcccacatttattttcctggatttcctaagtcatttaccattcaccagtttgccactcagctttcaaattttattgctatcatcttgtcccttttgttttccctgtcttgtgggtccgtgactttgaaaagttgctgtattgttttagtggtgctccaggagggagagagtgtggtacccctggtcagtcttccatctttacctgaaacctctatctatactgttttgctagatgatgttatatggtctcatggctttgaagaccatccataaactaatgaaacctaatttatgtctcaagccctacttctcctttcctctgtgctctagacttgcatatataacttcttactcaatgttttctccttagatatccaatacacatctcagataattaattgccaaccctctccttgaaatactcatttcttatctaatcttctcattctcaatatcactaccagccagctactttcttcatacaaaaatcccaggagtcatcctcagatttttcttctctcctacatcaactttatcagcaagtcctaccagttctagattcaagatttatctagaattcatccacttctcttcatcttcatggcttctaccctgacggaagccattttcatttctcacctgggtccctgcagtaacctcccagttgctcccctgcttccactctcatcctgctataatctactgtctacacagtagccagagtgaaaattttgaattttaagttgggtcatgttccttccctgattagaaacactcaatgccaggccgggtgcagtggcccacgcctgtaatcccagcactttgggaggccgaggtgggcagatcacgaggtcaggagatcgagaccatcctggctaacgtggtgaaaccccgtttctactaaaaatacagaaaattagccgggcgtggtggcgggcgcctgtagtcccagctacttgggaggctgaggcaggagaatggcgtgaacctgggaggcggagcttgcagtgagccgagatcgcgccattgcactccagcctgggcgacagagtgagactctgtctcagaaaaaaaaaaaaaaagaaagaaagaaaccctcaatgccatccccgctacatttccatactatttcctctgcccacaaggccctgtacgatctggctccttgcttaaatctctgacttcatttcctgccaatgtcttccttgttccatctactctggtcacacaggctttttgttcatcaaattcaccaaactcactcgctcctcagggcctttgcagttgcccttttgtctctgtgaatatccttccccccatatcttcatatggctcactcctcatttcattcaagtctttgctcaagtattgctaactctgagaagccttcccagggcactctctctcctttctcccatatccccctctgttactctctattatgttatcttatttccttctggaagtatcttgttcattaactttattatctttctcaagtcatttgaatataagccctattgctctgatctggcatattctttgctgataccatcacagctacagcattacctcacctgtaggagatagaaaccaagagacttccggctgggtggctaggagagcatgtgaataaatacttgtgaagttgtatactgactattagtatgctgattcttctgaatctcacaattcagcctttctacaggattctttcccaccttgactgattctacttgaatacctttatgtgtcccctctcttcctgccaaaaaaatccgttttaggcccgaaagtttgaattcccaaagagcagattgctcagcctcttttctgcctttcacccagatgttgtaccttacaccatatgttgtgcagaaacttggatgagactttggtggaggggcaactagcgtacctttttggccctcagacctaactgagtatggtgcgggattacgagccagagattgcaactagaaatttaagtcctgttggctcactgctcagtattgggagtctgtttttgctttctgctttctcctagtcttttaatttttaatgactctgtctaccagctactgatcttgtcaaaacaggctaaaactagggcagggtggtagaggggagtaggtcagtttcatttcatcacgttcagaaaggagttgagagattacaaattgtgaagccccttttgtctggtcaccagcattaaatctgatacctcccagtcctcctgttcttgagttatacagcacttgtatttgtgggtccagttataagtttccttttaaatctgatgaagtagggatgaattcaagaaatgacccctttgcttttttgtttttcttgtgttttgtacaactcaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttc

SEQ ID NO: 3127 - DNA, 75301 bp, human; identical to SEQ ID NO: 3122

SEQ ID NO: 3128 - DNA, 206410 bp, human; identical to SEQ ID NO: 3123

SEQ ID NO: 3129 - DNA, 73116 bp, human
aaggtgaacaccaaaaagtaaaaagtctgggtaataaaatctacagtagggaaagaaaatgcttctgataacttcagtgaagcttgcagtttcaggtaagcgatgtttatggtctgtttgagcctatcttagtgcccctgtaagcttcacattttttaagaggctagtacaagagagaaagccagtaaggcagagctgtggttgatgtgagactcagaagagaggtgcagaggggaaatacagagacactaatagaattaatccattaaggaagggaaatggtattggtactgtatttcactggtagaactgcagtgtaagataggataacgaggataccatgtgtgtgttttctgttttgctttggctgttagtgacatttttccctcctttgcctactagacacaatcctgaaaaagtaaatttaagtctgatcatattttatatgcttgaaatactgatatttaaggaacctcatctctttgtaagtcaaagagttatcctttagtttatatgtgcattttccaaattggggttttgtttccttgtttatgtaagatacagatatctatatttttatatttatgtgtatttaaaaacaatagagtaattcatttaggtaggaagaaaaggtgtaggcattctttctgtggtcaacacatttactcatcctttgtaaaaggatgaatggatcttttacaaactagtctgtactagttgtgggatatgctttcatagtaggaattgcctttgaattgcagaaatctgttatgtgtactatgttaaccataaatcgaacctcaaagttttagcttctgctgacttcctctctccctgaaagccagtgaaattataaaatctcatagccacacgttctgttattaatgtgtctggctaaattttacatattatcctttcagagattgcgcttttggtctaatttggaggattttattttcattacttctcactgggaagaagagaattgaattgtttttatcctcctttttgaaataataaagttttgtagaaatataagggaaagagggaaaatcaccattttaacaccactgcattcatcattttgttaactccctgcacatttatgttttaattggttgcagcagtcatggttatacaatctcacttattttatattcagtaactttccatatgaagatataaacatacaggttatatatgaaaataaaatgaaaatgaggaatgtgcgctgtgggattgtgtgcttaacagtgtgcacgcatacacattatttacacacacattatttcttttttgagtgaaagatgtcactaaagctatatgtggcatagaaagctcttttcatttctagctagggtctctaattgtcttttttaagtgaagtgttcccatttaagaaccttgtccttccgtatcagttccctttgattcttgttgaaagagccagagcattcttccctgctagtttctgcctgttgctgccttgcctgtcttgccagttatgttacagggaccaccccagaacacgtcacatgccattatggtggctttattaaagttacaaccttgtaagacagacagaaccctcaactaccacaaagaatccttgagaaatttattcaggaaaataaaaactcacaatgtcaaaaacagctctgtcaagaactgaaggggtttaatagtaactgatatattctaacttcataaatgccactctaatagctaagtacgaagaaggttttcagaggttaatttgtctctctaggatgtacctctgactcagaggtcgttttctgctttgacatgaagctagttgagaagctaaataaaacagatgtatacatctacatcttagggccttttcgtgatcatcgtattgggaacccgtccttaaacctattcctaagcagtgtatggagttgaattttatttggaaagtaagtaggtctccaataaatattctagttgctatcaccaaagtattcccccgccaactcataggcagtatgagaacattttaaaaatgggatatagaaacagagattggagtttgaatcgaactgtgtaactttctatctgaccttttgcaagttatttagttcctttttaaaaagatgatattaccagagttacaatctcagaagttgcctagttaattatgccttgctatagattgaggaagaaggttgaaaatgagacttttgctttctcagggaaagacaagctagacccctcaatctgattgatgtgtgttttcctttcccagcttcgtttgtggcatattcccctgaacattgaattcttaccctcagcttatctgtcccaattccacatgagcctgtcatcacatttgcaagtgaacaggagaaaagttctctgatcagtttataccatgaaataccatgaagcccttctgttagaacatggaaatgcctaagctgaggggctccatattattcttattaacaattccaatagaaatggatttgaatttacacaaagttttttttggggggttgattcagatctaaggtataataagaacaaagaggttgaaaagatcccaattcatagttggatttggacaattattgtacatagtggcattcaatgggtaatagaatttatggctgctttggtagctcatcggttctttgtagtcactttgacttcgtgggtattttccatttcaccccaacttcagagagtaaagctttgctatttcgcttctgaccttcccttattttgctacagatcttactctagcacctccatagaagaggccatgaaaaggggcgaggaccctcccaccccgccacctcggccacagaaaacccattccagagcctcctccttggatctgaataaagtcttccagcccagtgtgccaggtgaagtgccccttgccccctgagcccttccatttcctgttggagccagcggatgtgtgtctgccacagtggcctctgtgagtccggagaaagagcagacctggcagtttcgcattccgtgaaggtcttcacgtggctatggtattcttgggagagaaagcaattctagacacatatgtagcacatgtgtctggagccttgcccacacttgttatggatcaagaattaggaaattctctaccaagaggataaaaatgcttcactcccatgcagcctgctgagtgtgtggctggggtcttactctctgcatcattggtaatttgtgaacaagatagatcgctgtctgtcatttcctcagatgcctgtgtggtcttctatgaaagatcttggagattaaggcctagccagaaccttctcctgcattttacacttatggagaagatcctgtgtcctgtaggatttaatgctgaggggactctgaatctgactgatggttgggtggttggtggagggtcctagggcaagggctccttcaggtgggctgctctgggcttctggggatgggatgttcttgagcccgcagttgtgtagtggggctggaggtgggggaggcccagaggggccctgtctgctcccttggcttcctgtgaagtagaagataccctcctaaggaacctaaggaatagaagatgggaggcatgcctttgctttagtgaaggtgataggatacggtgctgtcccaagtgttattttgggagcagcaagggcctttccactgactcatgcaggcaagctataaatacaatgatttcctggaactttttctccatctatgtgcattttaaatcaggccagcctcagatgctagtgatttgcagattattatcttttctgctaaagcaagaaaagactttccttggctcacacattagcatgacctctgtgtctgggcagagctcagcatgttttatttgttctaataaagtattctcctcacagtaaagttatagattgttttttaatatactaaaatctggaactctctatcaaatttaattctgtgccatgagttcatcagacaaaaatttgccttgaatttcctctcatactttgatctgaattctggcataaatttcatagtgactggtatgtagggtgggagtaaccacaggtgatgatgctataaaaatttcacatggctggcggattatgacctggaagattttcctatggatgcgagaaaattaaaacaatctgggaagctatctcagtacctttaccttgcaagaagggaggctggaaatgctcacaggtctctctcaggttgtgtgacccagtaaggagatgccagctgtactggagaattcacatgctgtggtttttacgacactgcatcacatagtggaagagacaaaactgggtttggagctcagctcagctgcttattcactgtttgattttcagcaagtagcttaatgtttatgcatctcagattcctaatctgtacagtagagccaatactccatggagttgtaaggttttggtgagataataaacataatccaaatatgggttgaatattccttatccaaaatacttggggtcacaagtgtttcaggctttggatatttttggattttggaatatttgcattatatgcttaccaattgagcatataataaaaaaatctgaaatgcttcaatgaccatttcctttgagtgtcatgttggcactaaaaagtttagggttttatagcattttggattttggatttttgggattagggatactcaacctgtagtactgtatttggcccacaggccttagtaagcatgtaaggcccatattcccgtggcctgcaagtatcaagaatttaatgcctgaaatggcaagcctccaccgaggaggataacaccccgacttccttgacccctagcagacaattctgtgattcctcctacccagtttctcagaaggctcgcaaaaggactgaaccccagttgcctgccgtagtacaccattcattgatgtactttttcttgttttgcttccctcctgccctgtctcactttcccctcactcgaataatatacctgttctcaagttcatatgtcaggggcttctttagagaaaacctgaattaagacagctttctttgatatctctgtgtcaatgtgacttcaagatgaaaagtattttggtttgataatgccctgacgatctcccttgtggtagggcctgataaatctaagatttagacaaataatagctaggtgggtgatgtctctgttcatagcctaattccattgtcttttcagtacaaatttatacagatgaaattttaatgagcagtttaaatttatcacatgaagaatagaacatttctgcagtatgaaaagcaggtggtataattgcatctactttatttattttcatgttggttaattctcacagaaaagtataagggtctgtctaaattatataaaattttagtgtattgcatattgctagaaattatcgaaatgctgacaaactagaaatgcatgaaatagagcttaaacctaccagaagagtctactcactgagaatcatggtgtacatttaggcatccctttgctgcacttatctttatgtatcactttagataaatgggatcacactatgcttgctgttctgtatcctgatctttccaattaaccatctttctatttcatatagaggattgcaccgttccctttaaggtgtgcatgatatggatataccatggttgactgtgctttgatggagagatctctcccttcttctctctgccttttctcttccccatactttcctcttaagctcacccaccaccccacgaccccagcccccgttcctttctcacccttgcaaacaaacctctctctctctccaccccgacccccgtgtcctcttcatacccctctgtttctctttttgtccttctcccccatcactccttcacaggtatgagcctcccctcactctccccttgccaagctcccccacaccaccaccttgttcttataatataaacgaggcagaggttattaataatttcatgtccgtatctttgtttcatcatctaattattttcttaggttaaatcctgctggttggagttgcagggtcaaaggctgtagatgtttaaagtgtagctatatgttgccaaagggtgaggtggaacacctgtcaacttgctccatcatcaacactgtctgaaagtgtttcctcacaatcttgccaacactgcttcatgttcatctttttaatcattacctgtgtaataggcagtttcatgtccctgattcctagtgaggctgagaatctttttgtattgttattggccataaatattccttctcttatgatttgcctgctcagaaggcttggccagcttctgttgctacatctctctttgcctaaccacggggaccacttctttcttcttcattttgcctacgttctggacctccctcctgtcaggcacttgggaatgtgagggtggccatggggaagcctacctcacctgctgctgtgctgttccttgtccctccagccccgccccccatatcccctccttctgccaactttatcacttaagacagactgcctgggtcaccctgtttatgacaatagaagaataaggaaaggtaaagaaaagaggggaaaataatgtgagatgaagcaagatgtggacttgagttgaaagggaaagataaaatgaagcccttgtttaataaaatgagactcaggattgtgaaaagcagtgattgaagctaaggtgctgatacagagtggcttaaagtggagtgatagtgtggaaaggaaataggatggagagaagatgcaaagaaaaatgaaaggaaaatgaagggaaagatgggatggttgttacataggagtgatgatgtttatccaaaggaataagcaggaaatagaataaaaaattgtagaaccaatggaaggagagtccacagactcttggtgtaggattcaagcagcatttaaaggaatagcttagaagtaggtggcattaatgcctttacatttatgaaaataggtaacatgatatggggaaaaagaacaaagggctgatttagaatgtaaatctataaaaatgaataaggccaactttggaaatatagaacagttggcttcaactttggtgtctgtaaagagagtgtgaatgtgtgatttatagtagcctagatgattccagggctctctaggtactggcatcagacccgaggcatgtgttttcataaggagaagcggatacactatgatcgctgtgtgtaacagggagatcaccatttgtaatagctgacccagttcttggagccattgcctcacagtcccacacagctgctgtgtttgagagatagcaaaaatgtgcaagaaagtctaagtcagtgacaatgcaagtatgcaaaacctagaggcagtcagacctggaatttgctcagtgatgtttggattttatgtctctatatttatagctatgaaacatcttttattactgagattcctgtaagaaaaatcacactaagctggtacctaacctccttttcctcaatgaaacagttattttcatgaggtaatttttttttcataaaaaggggtttcttctgtccacggagtcagtaagaactacccctctcttctactcttgattcagacctgcctcttctcaaagccatgcctgaggtttgtagcctgaggtttccatggtgacagtaaaaagccttagctctgccttgttccagtcattgagcatctgcctggcagaaggggcagagatggtgtggaggagacatagccattcctttaaagtttcagaccgggcattttcatcatttccactcaaatctagctgggggacctaggcccatggatagacctagttgccaggcagctgggaaatgtagtccttggcagggcagccatttcccagaaatacgtttcttactgcaaaaaaggagaaggggatgttgatggtcagttgtttttttttaaaaccacatcccatatggccaaatacattgagattcacacattaaaaccattgtgatggctgaacagaacacatccagggctagtgtctgtccatgggtagctaatttcctatctctgctttagatatactgataataacaactcattccatggttaagagactatggtacatccatcctatggaattgtatgaagctgttaaaaagaacaggcacgtatactacatggagagctatctcggataaattaagtgacaaaagtatgatgcagaatgtgtatgtttataaatgtgtagacaatttcaggatgatgctaaagaaactggtaatgatagttgcttctgggcaaggggaacagtatgactgaggacaggactgggaaacaagcttactttctgttgaatgcctatttgtatctttttaattttggctcatgtacagatgtcacctattataaaaaatttgcttttcactctttagctgcaatgatggtatctgaaagtaccagagatgtctttcctgcctgaggttacctatctcaatcttccctacgattctgtattcagggtatctttatgaccatctgctaccacctcctggaatgcagctgaaatgacagaaatgttccgagcactttttttttttttttttttttttgagatgaagtctcgttctgtcacccaggctggagtgcagtggcgtgatctcagctcactgcaagctccgtctcccgggttcatgcccattctcctgcctcggcctcccaaatagctggggactacaggcacctgccaccacgccctgctaattttttgtatttttagtagagacggggtttcaccgtgttagccaggatggtctcaatctcctgacctcatgatccacccgcctcagcctcccaaagtgctgggattacaggcatgagccactgcgcccagccccgagcactcttttaagctctgatgcgttcttcagattccatttcagtgcctttccaacactgaggagtagttctggaggacctcccaaagattacattgtgagatgtatagttgggtaaaacgtcatggtaagggctctgtcttaacttggaagtggctgtgtttattgagtggcgaattgagaagtctttcctcggttttctataaatgaatatttgtttctgtaacttaagaagtaggtaaactccttgggagtaagagatgttcctaataccaaacttacctttcaggttctctaaaagatgaatttggccacaaaagcagctctgaccttatatatttccttactgtatttttcctgtgagtgctacttgtttcttttaaaatctggtaggactatgggattcctgacccaccccaaacctttgggcccacagtgcacagctatccaagggttcaatttggcagtctgggcagtttttttgttttgttttgtttttttgttttttttaaatgaaagcgttattgagatgtaacccatatactataaaattcacctttttaaagtgcacaattcagtgatatttagtatattcatagtgttatatataactatcagcactatgtaatttcagaatattttcatccccctcaaaagaaaccccatacctattagcaatcattcccattccccccttttcttcctctatcccttggcaaccactaacttactttctgtttctatggatttgcccattccggaattctgtattaatagaatcatataatatgtggtcttttgtgactggcttcattcacttagtataatgttctcaaggttcatccatgttgtagcatgaatcaatacttcattccttttatggctgaataatctttcattgtatggataaaccacattttggatatttgggttgtttccactttttgactattgtgaataactctgctatagacattcatgtccaagtttttgtgtaaacatattttttctttctcttgagtatataggtagggctggaatttctggttcatatggtaactaactctatgttgaacattttgaggagctattgaagtattttccagagcagccaaaccaatttatttcattagcaatttatgaggattccaattgtgtttcttcacgtcctcaaaacacttgttattgcctttttaattttagccatcctagtgggcatgaagtggtattgtgattttgatttgcattttctaatggctaatgatgttatacatcttttcatgtacttattggtcatatttatgttgtctttggagaatgttcagaatctttgctcatttaaaaattgggttgtctttttattgttgatttgtaaatgttctttatatattttgcataaaagttcctttacagatatttgatttacaaatattttccttcgttctgtgggttgtcctttcatctttttgatggtgtcctttgaatcataaaagattttaattttgatgaggtctaatttatgtattttgttgcttgtgcttttgctgtcatatctaaaaaaccattgcttaactcaaggtcacaaacactcctcttttcttctaaaagtcttatagttttaggtcttacatttacgtcttcgttctgttttgagttaatttttttatatggcatgagttaggagtccaaattcatttttctgcatgtggatatacagttgtcccagtaccatttgttgaaaagactattaattatccatttaattttcttggcacctttgttgaaaatcaattaaccataaacataaggatttatttctggactctcagttctgttctgttggtctataggtctatccttatgccagtaccacagtgtcttgataattgtagatttatagtaagttttgaaattgcgaagcgtgagtcctcctgctttattctttttcaggattgttttggttattctgagtcccttgcatttccacatgaaatttatgatcagcttgtcaatttctgtaaaaacaaaaaagccagctgggattttggtatggcttgcattgaatttgtatatcagtttggttagtattgcggttttaataacattaagttgtccaatgcatgaacacaggatgtttttccatttatttagatctttaagtgtctttcaacaatgtttcagtatacaagtcttgcatttcttttgttaaatgtattcctaaaagttttattctttttgatatacattatacattatttcttggagatatccatgtcagtactgataattttgtatttcttttatatatcatctatatgctggctgctctgttaaaaaccgtattatgaaaaatttcaaatttatgcaaaagttgagaacctccacccccatattattttgaagcaaatcccaaatatcatataattgtatatataaactctttgtatatctctctaagagataaggtcttaaaatacttgagcacaatacctttgtcatacataacaaaattaacaataattctttaatatcatttaatatttggccagtgttcctatttcctgaattgtctcaagtttgtctttttatactagtttgttccattcagaattcaatcgagggctacatgcacattgcacttgttttggcatattttaagtctcttaactgataggttcttctctcagtcttttttttcctctttgcttttcatttattcataaaaagtcatctaccttgtagactttttcacattctgtattttgctgattgtttgttcttccatcccatgtatttcctataaactaataggtaggtctaggcttgattagagttagtttagatttttgacaagaatactacctaaagatgctgtgtacttcttactgcaccacattaagagatctctagtgtctaatgcctttatttttgtggtgtttgattgattaatgggtttacgtagtattggcctgatccatgtgttatgataaagatcccagcgacctttcaaataatggttttatcagctattgatcatcattgcctacatccagtggtgtgtcagtgaatgtttaacaaccggccacttgccaatttttatggtgtaaacactcctgccatggctaatttcattcctactgatgtgttactgaatgtggagtttggaacagatgcacacagttggctctcacaagctggcatgagctttttccagcaaaccactgcttagatccattatttcattggtagttgcaaaatggcgatactctattttttctacctttattaattgggactatggtttatttaagcattttcctattgttggacatttaatttgtgactattatgaagcttgtgagctgaaggagatcataaaacataattctcagtacatcagtaaattctttatatacatctgaatttatagaattgtatgaaaactgaaatagacttcagtaatggtgaccagaaaagtgtcttattcaaccagtatttaatgagcatttactgggtacttggcactttggaggatcccaagagggatatggatatgcccccaaactctgctaatcaatgtcacagttgtgtgtgattgttagaagggtttagagtttgggtggttgctaactagaatgatcagtggatttgtgggcagggggtgcacagggctggtgagctaaactttgaaggatatgacttttcagtcaaatcctattcttttttgacatctgtcttgatttacttcttatgactagtttcctgggtgtctactatagtagcctcaaatctggcttgcttgctttgttctttccttcataaagcaacaggattaattttctgcagcacacctatgatcacttccctactcaaaactcttcaggacctactatgtaatcaccaaatttctggtggaactgaacccgaagccatgtgattatattagctcagtaagggacacagtactgtggcctggagtgcctggggaggagtgtattacaggaaggaagtagagactagaagattcaagttggctggctggccaagaaaaatggagactggtggagaaggagtttgtagacggtgtctttgggaagtcttaggagaacatcccattagggtggtagggttaagccagattgcaaaagattgtggcataagcaaggaactttggtgtggagaagttgtcatcacaaagtcattttgaaatgtcgaaggtttagcagttgttctgactgtatgtcacattttaaaaaataatggtagtggccaggtgcagtggctcatgcctgtaatctcagcaccctgggaggccgaggtgggtggatcacctgaggtcaggggttcaaaaccagcctggccaacatggagaaaccccatctctactaaaaatacaaaaattagccaggcgtggtgatgtgtgcctctaatcccagctattcgggaggcttaggcttgagcctgggaggtggaggtttcagtgagccgagatcgtgccactgcactgcagcctgggcaaggacagagtgagactctgtcgatagatagatagatagatagatagatagatagatagatagatagatagatagataaagatacataagatagatagatagaggtagaagagagccagttccaagatgatagactgtttttatagattgccttcctcctaacacacatttgtattctctctctctcccccaccgcattattcagcgctaatgaaagtgtgatggaaacagctgctagtgaatgaatactaactaatcctgaaaaaaagatgtgtacttcttgaaattttagtttgatttacctgaaaacatatacagaaacacaactagtgatttcaaccaaccctagagttttaatagtaaaatgcttaggaggaatgcatttgtgtaaatgtaatatgagagaggaaaccagacacccatctttgaccaagattgaatctcatgcatttttgtcacttaagtctgcccatgtctccatccaggacctagttaacccttattgcgtatcctatggtacaggaaaaatgagttattagtaaacatggataaattttagaatcatgaagtgtcaatgctaaaagagaacttgaatgtcatcttggccaactctcacatattaccaacaaggagactaagatccaggcaatataatggctttgttctccatcagaatctttctttccttttttttttttttttttaagatggagtctctctctgttgcccaggctggagtgcagtggcgtggtctcggctcactgcaagctctgcaggttcacgctgttctcctgcctcagcctcccgagtagctgggactacaggtgcccaccaccacgcctggctaattttttgtatttttagtagagacggggtttcaccatgttagctaggatggtctcaatctcctgacctcgtgatccacctgcctcggcctcccaaaatgcttggattacaggtgtgagccaccacatcctgcccagaatctttcgaagttgggaaatctttgtttagatctttgttgcagcagatttggtatcaaagaaagctatctacattaaattaatttggagggcacaccctactacttttctacgggcaataacactaattaatatctaaagttaaaggatgtattaaagaatgaatatggtaacctttgcaaggcactcttcaatgtgtttttttctgtgtttccttctatgtgatttaaaatgttagtagatttctctgaggtacttcagggagataggaaaggagcttttgccctcatagatacttggaaataatatatctattttctttttttaatttcaaaaatgaaattattattaaaagctctaaatatagcaagaatataagacaaatagtatactgaacatccagcttcaacaattaatcaactgtgtcccatcttgtttcatatctgtcttcccccacattattaattatacttttttctacccttagcttaaaaaaaactttattgaggtatatagatcataaagtttatccattttaagtgtaaaatttaatgatttctagtaaatttatcaaatagtgcaactttcaccataatccagttttaggtcattttcagcactccaataatactgcacatacctgtttacagttaatccccatgcccagccccaggcaaccactaacctattttgtgtttctgcagattttccttttctgaatatttcatataaccgaatatacaatatgaggtcttttctgtctgactttgtttacttagcatgatgtttttgaggttcattcatgttgtatcatgtatcagtacttaattcctttttattgctgaatagtattccattatatagctatatcacattttgtttatccagtcttcagtttgacagacatttgagttgtttctgctttttgtctgttatgaataatgctgccattaatatttgaatacaagtctttgtgtgaacatatgtttcatttctcttagctagatatataggggtggaattgctgggtatgtggtaaatttatgtttaactttttaagaaatggacaaattgttttctaaagtatctgcaccattttacattcacatcagaaatgtatgagggttactatttctttatatcctcacccacacttattattatctttttgattatcctacatcctagtgtgtgtgaagtgatatctcactgtggttttgatttgtattcccctgatgattaatgatgttgagcatcttttcatgtgcttattagttattcctgtattttatttgatgagatattgtgttagtctgttttcacgctgctgataaagacatacccaaaactgggcaatttacaaaagaaaggtttagttggacttacagttccacgtggccggggaagcctcacaatcatggcagaaggctaaaggcatgtctcacatggtggcagacaggagaagagagcttgtacagggaaattcccatttttaaaaccatcagatcttgtgagacccattcactatcacgagaacaccatgggaaagacctgcccccatggttcaatcatctcccactgggtccttcccacaacacatgggaattatgggagatacaagatgagatttgggtggggacacagagccaaaccatgtcagatgtctactcaaatcatgctcattaaaaaattgggtgtttgtcttattgttgagttgtatattctgtaattctttatatattctggatacaaatcctttatcggatagatgatttgcaaatattttccacagtctgtgacttgtctttttgttttcttaatgatatgttttgaagtacagaagttttgagttttgacaaagtgtaatgttaaattttttccttttggattgtgcttttgatgtcatatctgagaagtctgcctaacccaaggtcttgaagattttttcttgttgtaaaatttttatagttttagctcttacgttaagatcttgaatccattttgatttaatttttgtataaggtgtgaggtaaggatctaagttaatctcttcgtatatgaatatccagttatcccagcactatttgtcaaaaaatactctccttttcctgttgccttggcacctttgttgagaatcacttgtctgttaaatataagggcttatttttggacactgcattctgttctgttgatttatatgtttatttttatgctagcactatactgaatgttttttaacacaggggagtcatacataatcttgcaaagaggtaatcccacgactcagaagtctttaagtatttgctacaatggcatattttttagatagtatatagtagcttatttacttcatttgtggtttgtagcatgttcagaaggatcctttgagctccttgaggttgcagtacttctttgctttgaagccttctgtcatgtttattccctgaatgtagaataccctctgtctagctgtttatcctccatctctgcatttttctgctctacctgccctgtaggttcaaaatgtggtactgattactgctcgatagtagccttgtgtccttggcaaggtcattttatttctccaggtcttaattttctcatctgtaaagtgaaagaatcagattttatctcactacttttctaaactctgtcgttaatattttccttgttgaacagttacaaggatgtgtaagttaatctcttttaactggtgaaaaagtatattctgttccatagagaattaaatgagcttgtatttcggggggtggtgtgtggtcatcaggggatagaggcaggtatttctggaaaggtgttcttggcaaacattttgttacatacactggtgtatatgacatacatgtccatcactgtatgctgggtgatcaagagatatgtataaggtcatacatgcttttatgattagaaaggagagaaagaatgaacaatttctgttacaaagaaatagccatttttatgaacttgccaagaagaggaatggtccttactgatgaaatccttaaagctttgcatgtggctctttacttgattgatatttaaaagtataggtcccactgggaggctcctttcaacattttccattccttgagtgtttttcccccctttggtattcgaatgcttttattttcttcacataaaatattcctagttaggggggatgggagcccctttccacagctgaagttattccaagttttgttccccctgaagaatcggctctctgttcctgaagctttcaatggccacatctgctgctttatttccactcaataagttggaatatattttcatttagttattgattaggggctatgtaaaaatctgaaggaaattagtaaatagtaatgtttatgaataacattttacctagaaatttctaagcgtaatgaaataagaggataaaaattgttagaggttggagttttggatgaaggtaccaggaagcagagatccaataaatcagtatcagaatctgcatgtctttcaataaacttaagaaattgttttaaacactaggaattattagtctgtcttctgaatttaggattaaatgacagtttcttttcctgaagtttttaatgtggttttcaggattggggtatttattattttcctttggattacacttataaaaatttttggctggacaaagccttgctgatacctagtatcccactttattaactataacacttgacgaataaacctgcaattgcttgacgaatatggtcactttttaaagtatgtgggaacaacattcttctctcgtcttcttgccttcttttccctcccaggaaagcagttgttactattaacaagtatattgtcatcttttgcaactgcacactagattattcagctattttttttcttttttttttcctttgccttccaccatgcgatcaaagtattttttaaatttcactttgcatgaaggtgtactttttcttttgactgattagggcatactggataaaatatttggatccaattttaagtcaagagcagactgaaaatattgtaagagaagatttttaaaattaaatttaattccaattttcaaccactgtgtgagtacctactaaacataaggcagtgtgtttaggtgctgtgggagacaaaaagatgaattagacagaattgatagaatgtagctagattaatatctcccaccattaaaggaaaggaacacagaattataaatgcaaggaagagatttttcagcagcaaccgaacaaggaaaaatgcatgagttaatgctatatatatatatatatatatatatatatatataattttttttttggaaagagtggcaactgagggaaacctgaggctttgggtgcacttctgactctgcctgcttccttgcagaagctgtgtgtgtgagtaggcaaatcttgagagttctcatcgagaccctaggtctagagcaaagtgaaatgaatgagtactcgtaattttcctttttcttgactaagtggaaatgacttcaggaaagagagttggaaaagtaaataatcatagctgatatcctgatattgtagaggggaaggcccagagcttcatgctgaactggggacaaactgaagtctgagaagttcctccaaggccattgatagaactccaagacttaggagaatgcactctgctgcagggttttaaaatgttgattattttggtatttccttcgtaattctaaatagcatatttgtgtaacttcttgtagacttcaatttttgccatcatcttccctcccccattatctttctcctccacccttccaatatagttatattataattttggttagattaatatttagtgtttatattattattgttatagccatgtaagacatatagtaaattactttttttttttacttgcacaggtttttgtttgccttggagtgaataatcaacttgtttcttttcaaagtacttgcccttgattcaaccacagacgtcttcaattttccagagttcctcttatgaaattctcacacctcaggtgttctgtcagtttcagctttttgaagcaatagaaactgattgtcttcaatgcctggtacatagttttcatcatgggatctctctacactgtcatccaaggattcccttcctctttttcccatgttggatttcttttattactgtatcctgtgtctttctctttctttgtttactttcttgttttggtgaagcacatccttcagcagcttccttagaaagggtgcatggagctcaatttgagaccctgaatgtctaaaaatgtatttaattatatcatcatgcaggctgctagtcttggatatacaatcatcagttggaaataagttttctttagaattttgatggaattgtgccaatggattctagcttctaatgatatatgaagaagtctaaaaccatttggacatctgatcctttgtatatgacttgctctcttctcctatgccctgctgaaaacttgtaaattattttgactctagtactttgaaatatcatgatataccttgtcatgagtctgttttcttccattgtcctggatattcagtgagtcctttaaatttagaaattcatattcttcatttctgggaaattttattgaaccatttaattgattatttttcctgctgttttctctgtttctctttgtggatcttttatttggctactaccctattttctggaagatttcctcagattatttttgacctttctattctctttctgctatcttttaatttccaagtattctttttgttttgttttgttttctgaatgttctttgtaaatagcatcccattatttcatcttagcaaatagcatttcttatgtcttactgagactttctctggtgactctagttaaaatttcatctgtcactctctaccccattgtctcttttctcagtagaatatgagcttcataagggtatagctttttttttccctgtttttcccatggatattttcccaataccttgaacaatacctcccacatagttagtgtttaaatgtttctggaataaacttaatgatcattctgatgatattaataatatatattttaacgttttctcctagtaaaggtctagtctgtttctttgaggtcatttcttcctgtttttattgatccctaccttaggttagaacattttctgcagatatctggtaatacttagtcatccacttatatttaataatgaaggataaaaagttgcttggaatatatgagcaaattgatggaagttgccagctattggcttcatggtagaatggtctggccaggccatcctgttggagatcccttgatatcaactctttagatgtctcttcctggctgatctgattctctggaacacattctcctaatctctagaaggaagcagcagtctgggagcagaagggaagaaggctggaagaatctcagcatccaaagtgcatatttttactgaatctgtctgttttcagcatggccctcatgccttcatctgggcctggtgccttccctgaaaagaaaactatatctagcattttgctggagtgagaaacatgctgaaactgtgcagaatgtgggagaaaaaactgctcctaaactgcttcaatcagtctttttttttttttttaatgaggatggaacataatcctatagattttaagatagtttaaagaactatttgttgatcacttactgtattttgagttatcaggtgagacagatataaggcatagctactacagcagaggggactgtaagagtagggcccctgaagccaaaaacagcatgaagaatagctagaaccagatcctgaagggtcttgtcaaagtatgcccttttcctgaagggtaggaaataaatccactattagttcattgctttaggtttttattgctttcctcattttacccctacattcagaggtgtttgatgccaccaattcctgagaactggggggcttctgtggtacaaatttgttactccctgctttctcagatctgtctagtcagctattagttgctcatctgttttcccagttccaaatttaaacaagagcatttaaacagttctcttcatttttgtgttaatgagttaagagtgagattagttacatgtatttgaactgctgtctatactcaaaagtctttggataggacatttaataaaacgttgggtcatacacaagaaacaaggaattttacacagtatcaagccaagattttagtttaaagtggtcccaggttgatagtaccctcagatttctggcagaagcgatagagggaagaggaattcactttccacatgcctcaaagttttcctgtcggtaaagttccaaggaatttgagtttagagtcacaggttgctaagcacactaggaaatgaagcacaatgagcaagaacaaacaggaaatacaaagccctcagatactgaaattatataaatatgttgaaagaaaagaggaagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtcgtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaagaggaagaaaatgaatggccaagaaattataaaaatgaaaaaaacattttcaaaaaagaccaaatagaacttctagaaaagaacaattctgtaacataaactcgaagactggattttgttagacattaagaacgactaaagagggaattggttacttggacagtagatcgtagaaaattgtctagaacacagtacagttagaaagctcttgaaggagaggggagagaaaaatggtagaaatacaacatttaaagaatcactgagaattgaccaaaattaatgggttgctacatggttcagaaattccagtgaagctcaagcaagtgataaaatgatggtagagaaatacatgtgcagacataggataaagtttgatatttcagagtacccaaaacaaagaggagatcttaaaagcaaccagagagaagatgggccatctaacaaaagagtgatttgactgagagctggcttcttaatagcaatagtagaaaccagaaggcagtggaatgttaccgtcaatgtgctgggagaaaatagctgtcaatttagaattctatacccaattaaatcctctttcaagaggggaaaaatgacttttcaatcaaataaactaagtttgctactaatagacttctcaattaaggaaattctaaaagacatactttagacatcataaaataaactgtaatggaaattaggaagcttttagcactgagtgataatatcacaaataaaaacctatgatattctactaaagaggtacttggaaaaaatttataaccctaaatgcttacattagaaaataaaagctacaaattagtgaactaagcaaccaatttaagatagaaaaagaacaagatatgcccaaagaaagtaaatggaagaagataagcagcattaataaaacagaaagcaaacatacaatacagaggctcaaaaaagttaaaagttggttttttgaaaagagtaacaaaactgacaaatgccagctgagattagtgaaggaaaactggagtatgaggaatgggaaaagacaattacacatgcagagattaaaataataataagaggggggtatggacaccattatgctaataaatttgaaattttaggcaatgaataaatgcctagaaaaatatcatttatcagaatcgacttaagaattagaaagtctgaaaagtcctataacaattcaagaagcagaatcatagtttaaaatcttgtttaaagaaaactccgggctcaggtggctctcctgggaaaatttttatttgatattcaagaaaaaatttccaatcttatacaacctatttaagagtataaacagggcatggtaggggtttgggggtggtgctctccacctgaatgaagcataatagaggaccatatgagaaaggaaatcacttgcaggtctcactcatgaagatagttgcaaaaatcctaaacaaaatatcagctaaccaaatctagcagatataaaaaacttaccaagttgagattatcccaggtctgcaagggtgttttaatattagacaatccagaatgtaatttaccacattaacaaattataaggaaaaaataataccataatctcaatggctagagttacagctctgattaaaatccaacaacaaattatcctgaaaagaagtctcaaaataaggataggaattttcataataatctatttttttcagggattatatatctatagttttattaagacaaaaactgagagtgtggtgtgaagtttacattcaaacaaagttttcaaagaaatctaacacatgcctaaaaagattttacaatgtagctctagatccaagtctagataatatcaagaactgatggatctcatgactcaagacagagcattttgggtatcagttacttcttaggatttgttaaaaaatggttttgtgtgtgtgtgtgtgtgtgtgttttaaagtgaaccactgcccagtatgaaagtttaatctcctgagaccaaggcttttgaaatcactcaactcttgagtcaattcagtgaaacttgtgctgtcagtgactgaactctgccaccaatggtttcagagttcaaagctcaaaagagaatggctccaaaagttgtcccaactaagagcatgggccctttacttccctcctgtcttatctcctctaccaccctctttcccttccccaacacctcagccagtggctaggatgaacaagctgatatttataactttattattggaaaagaaagggtcttctaatttcaggaattagcacctctgaggcagaatgatctgcttgtactgtatactctccaataaaagaccttccttcctcagtcaatttccatctccaaaatggcaactctggtaacttattaactggcttagtcctttgtgagactaagtacattaagtttaggcagggaacaccatggcttatagatttcagacattcacagcttttaaagtctctcacagtccgtatttatggtgccagtgacatttttttcaaaggtaaaatattctggacatagaagcaaatcattagttttctgttctttgcattgcttcaccatgtcccctatcaggccccaaattttaatcaaaatgatgctacccatctccctttccaccctccccattcctccctctcccacataatacaccagtaatagccaaaaactacacatttgctacgctgtaaaaatgtagagttaacactattgggaagaaagttgtgcgttgcggagatgctctttgattatctacagtatttttttgctctcccacacacccagttctgcaagttttgtccttcataaagggccctttgctttttctcagcaaagtgcagaaaaggttgccttgaagcacttatcccccttcccctccactgggacgggtgtgcaaactatacagcttggaatggctttaaaacacttgggctgctgcagggcacagaaacgatactggctcttcaaagggcatcttctcaagctacctctatggtgtcaagacaagtagaacttctttccttcccacctgaaacccacagtcagatgtgatagaggctggtactcaggagagttaattcttgtcatcatcctctttggggtaggaatgccacgtcagcctttcctcatagaaggatatgacaacccgtgggcatttgacattgacttccttggcagggacgaggtcagcctcatcagaatttttccctttcatcaggaacatgagctctccactggagtctgtagctccaataatctgctccggctccaaaccctgagcaaagcctcgtggcttttctgactcttctttcttcttctttggtttgctctcctctcccttatcttcagaatcagaatcagctttgtgcttgcctccctctgatttgtctatctcatgtgctgttttctgtgacggcagaaactcatgaggtcagggcaatccaagttctcttctgactcccatgtgttgtcctcatctgagaatcccttccactttaggaggtactccactttgccctttaccaatcgacggtagagaactttttccaccacatattcctgttcctcctcttctagcacctcctccactttcttcttgttttgttttttctccatagcgtgtgtgtaaagggtgatgctgctcagagcagtgcccaggagccggaaaggaatcggtgctgcgctattggcgcattgggtcggccagggcagtggcgctcagaaaagcagcaagggtagctgcaaaggagccccttgctgaaatggtgtaccgcaggcctcggctaatggccctcctctcagccgaacaaaagagccctgcactctgtgctgcccactgcccactgcctgcaccgccttcataatctattaaagggtatctacaacatacctacagcaaacaccaacaccataccttatggtgagctagtaaatgctcccctttgagatcaagagaagacaagaatgcccattatcaccatttaaattcaacttttacagtagataattctaactaggtaagactggaaaaataaaaaacgtggcaaaggtactgaaaagaggaaacaaagctgctcttagtatttgtttaatatggttgggcacagtggctcatacctgtaatcccaacactttaggaggccgaggtgggaggattgcttgagcccaggagtttgagactgcagtgttaatgatcatgccactgcactccagcctgggcaacagagtgatatcctgtcaagtataatatttttgatataaatgtgggggcttccccccaaaaaatgctctcagaatttaatgaggaaaataacctatgccaactcttgtttttttttctttttctttttctttctttttttttttttttgagatggagtctggctctgtcacccaggctggagtgcagtggtgtgatctcggctcactgaaagctccacctctcgggttcacgccattctcctgcctcagcctcccaaatagctgggactacaggcgcccgccaccatgcctggctaatttttttttgtttttgtatttttagtagagatggggtttcactgtgttagccaggatggtctcgatctcctgacctcatgatctgcccgccttggcctcccaaagtgctgggattacaagcgtgagccatcgcgccaggcctctatgccaactcttacaatgagagattcagaatgaacaacggacacatacctgtgatactgttttgttgcttgaagctcaattgtgagaaattaaaacaattccatattaaatggcctcagtcttttaccctatttcttcttcatatttggggcaatttctgataaaccacaataaatgatgttgtaggtgacatgcttttatctaaaagtgtattcagaaatagacccacacatcatcttttacaagagcagggcatttgtctttaaaaaaaattaaatcatacaaaagaacttaatgagatccgaatcaggatctaaatactgtttctaataactctcaaggcagtgagtagggacagtcagccacagggctcacctggttggttcctctctctcaggggtcactgtcttttgttgcctgattttctagtgccttgaaaactgttgtttcatatttttttttctatgtgtttttggttgttttaaatgggtgggtaaatctctctgttacttcatcttggctggaagcacaagtcaatttaattaaatggctcatcatttcttgtatagtcctcttttttgttaataaggagttgttttaacacacgttaatacaattgcttggcctttcccttaaagtttgcgtagatttattttattttattttatgttatgttatgttatgttatgttatgttatgttatgttatgttatgttattttattttatttatgaatgagacagggtctcactctgttgcctaggctggagtgcagtggcacaatcatggctcacggaagcctcaactcctgggttcaagtgatccttccgtctcagcctcccaagtagctgggactacaggtgtgcactaccacgcctggctagtttttgtattttttgtagataaggggtttatccatgttgcctatgccagtctcaaactcctgagctcaagggatccgcctaccttggcctcccaaagtgctaggactacagcatgaggcaccatgcctggcttgtttcatttgttttgaaagtaactgttaattttaaaggtccaatctgtgaggatctaaagagtaggagccctgagatgaataattcctgaaggctttcagcattctctcctgctgtgtgctttgttattgacagctgttcaaggtctcaccacctctggagttttaacccaccgatgtgtttcataaattttaatgaaagacagatagagagaaatcatagataggccaacatgattgtaccatatccatgcactggctcaaaatgaaaatctctgtgatattaccctgagttacatttgtggaacacaccaaactccgtcttctagcttgtctgatccagctagctaagggaaatcaaaagtaatttgcaaaatcttttatgttcttttatgttcttggtacattgctctgatttattttttaaggcacagaaaattgtccaaatgcatagtacaaatttgcaaataaactacatatagttatttggacgatggtgtttttctaaggagttttgtaaagaatgtggtttaacttgccagtgtgtaatgctaaacttatttcttgtgtgttattatgaactttatttataatttcatagcagctgtttattttcattgctaaggtacaattcagatgttcttggcttaactcagtattctctatctcacaaaatttaaaattagactgatactttgtaaagattcttcagatgtggccagattattttaggaacagctttagttatccctgataataaatattagggagagaaaaagaaattgaggtctttgaagaatccctaaatatcatttcagtctatcactgtcagcctccctcactgctttcagatccattcccaggagcatttacagggtggccaagcttcctcatttgggttccagctctcttagtttctgtagcctactcattgagctaatgagcagtgtagtggctgagagctagggagaaatatgagagaaatcaaagaagaccctttctgacttttgccctagattgtttgaaacgaaataacattagaataatgaggaattgaccacctttcccttgctgcgttttaggtgtcttttctgtaccattttattatgtcgtcttaatcataacagcctacataaatacttgagtttgggttaggatgacaatgaaaaagggattagaaataacgtgtactcttttttcttaagccttcagaaggactgtaaaaacttaaagatgttaaatgcaaatgccattgccattccaagttaacaagcataagagttttttgttgtttatttttggggggtgatccttaatagtatgtgtttttcttttcagctaccaagtcaggattgttacccccaccacctgcgctccctccaagaccttgtccatcacaggtaggagacatatttgatttatgtaaactgttcggtggtagggaagttgtcctatcgctgtgcttctttgcaagggttgatcgccacagatctggtccatgagattcccaagctgataccctgtgaagagagcagagagtggtttaatttattctcatccagccagctccccagcctcatgtggaagagagaaagtttcctcaataagccaccaagcatacatatactagttcactcttggctgtccaggggtgcgtctgttttcatccccagagaagggtagaagaaggggcctctctctaattggaggtggagacatggtttttctgtatagtatgtgcaatctgggtgcctatattttcgtcagtactttaggagctatgttaattctacataaatgaaaaataaatggttatcaacatggggttagtgccgtggttttggcctatggtgctttctgtaggatggtatttttcctcagaacaaaaagctgagatagcaggagggggagaacatgtcaccaagatctgtttcacccctaaattaattctgccttatttacatgtgccactatggccttattcatcaacactttgcagagctgaaaatgagaagcaaacagtggagtgtggtatatggtgctacagatctttccttttgttaattgctgctgaagaaactttctatctttaaagaccctttctgatttttggcagaaaattttgggaaatttctctgtacacagtccctgtttctacttcattgttctgggtggttcagagctatccttccatacggggacatctcaggactcatgagtcactgaaaccacttttaacacatgcttgtccttctttcagtgaatgaaatggtttttagcatccactcaaccttgagatgcaaatactatgagatattggcttcctgctttagtgcgaagggtaataaaaagcccatttcttcctgacctgcatataaaccagcgagaactcctttccaggatgtaacattggccttaagagatattggttgaaccgtcaacaagtatttattgagtccctgctgtatatctaatgccaaaccttagttttgccctaagcctttcattggctgtaatttcttctcattcaaattattagctgtgtctgttgagcatctccaataaatcaggcattgtgctaagtgctttcagtgcattatttaatcctcacaaaacccctctgaggtagatacaggtactaatattatcccttttttttttttaacagataaggaagttgaagtatatgggggctaagcaagttacccaaggtggcatagctagtaaatagtagagccagctcccaaattgcaatctgtctcctaaaggctcctcctgtcaccatcactggagtctgagtgtctatgtgtacagccagacagcagatccattacacttgcaatggaggctttcatcacaggcccctaaggaggaccttgatgagatgaggctcctgctccacaccaacagcaaacctggacttggtcacaacaaaatgagcaggcatttgctagctgctagttcaagcctggggcttgagagccacctggttgaatgcatggaagacctgtctgaattgacttttgtaaccaaccttctagctttctcttcctgcacaaatgccagtagttactacccggtcccaaaatatgctgctgctatcagcagtcttcatctgagctgcttgaggtgggcttcttgcctgcttttggagcttagtcaccaaagatctgactgggggatctgggaattctctagtcactgttaatgaatgagtctgcttctttgtctaccagatttcccatcacaatataaacagtgagcccagtactcagcctatcagctgcctaactatggagatttcagatttcaggaacaggtgtgtaagaaatggaggcagaagatccacattccatttctctcccctattccctcctttcacccactgtaagtgggacacacatattcagatatatgaagtcctgggcaataaacacatggttatatttagtttttgtgccatgtcaagttggtattgaccctatgagcgtcttactaaccactttgtatgggacacctatatattctagtctttcccaaactgcttgtgataaaacagtctctgggagatattaatagggctctgtggtacagatttgcagactgctgcccctctacccctctgggagagtcgctgtgcaagtgagctcactaaaggctttggaggcctacagtaagtaaagctagtaaattttgttaaagccagcaatttcctagcttctgtgaccattgatatctttatttataaaatacctgttaggatacaaaatcagtgtgcaaaaagcacaagcattcctttacaccaagaataggcaagcagagagccaaatcatgaatgaactcccattcacaatcactacaaagagaataaaatacttagaatacagctaacaagggatgtgaaggacctcttcagggagaactacaaaccactgctaaaggaaattagagaggacacaaacaaatggaaaaacattccatccttatggataggaagaatcaatatcgtgaaaatggccatactgcctgaagtaacttttttttttttttttgagacggagtgtcgcactatcgcccaggctggagtgcagtggggtgatctcagctcactgcaagctctgcctcccgggtgcacgccattctcctgtctcagcctcccgagtagctgggactacaggtgcctgccaccacgcccggttaattttctgtattttttagtagagacgggatttaactgtgttagccgggatgatctcgatctcctgacctcgtgatccacctgcctcggccttccaaagtgctgggattacaggcatgagccaccatgcccggctgcccaaagtaatttatagattcaatgatattcccatcaaactaccattgacattcttcacagaattagaaaaaactgttttcaatttcatatggaatcaaagaagaccccatataaccaagacaatcctaagccaaaagaacaaagctggaggcatcatgctacctgacttcaaactatactacaaggctacagtaaccaaaagagcatggtactggtatcaaaatagacatatagactagtggagcataacagagacctcagaaataacaccacacatctacaaccatctgatctttgacaaacctgacaaaaacaagcaatggggaaaggatcaaaggtcaaaataaagggctctattttaaagtgaaatcaggttctgataaatttatcatttgccctagataacattgttttaagtttatcaaggttgaatattcaagtggaatgcttgttttgtgtaatgtatttttcctttgttaactttggcagtaccttttactgtatgttccctagttatagaatcggttcatagattgctcagagctactcatatctctggattcatgtattatgaagaaacaattctgtttcagaccagcttgtgttgattgaatctcaagttttggaagttctcttgtgaggatttcttaaatttgaaaactactattctcaagtagttagggaccataggcacacactaccaaacctggctttccaggttttaagtatgtaagaaaaatgagtttgtacatttgcaatatgcatacagagatatataaagattgtttctacatacaccaaaagcatatattcttttatcaaatgagagagatgaagtataggttttcagcataacatgcagtttagctggctcatacttattcaagcaccactgtgatatgaacatctggattaagttatacaaatggggccctggagttaggaaaaggaataagttaaaagaaacatctttttatttttcatactataggtaagatcaagaagaacctagtgactatatacaaaattaagtagtttgtgtttcacattttcctgtggcaagactagagactagggcatggtcttttggctcagctcagaagaggtgacttttttttgaaaaaagacttatttatagcataaataaccaaaaagcaattaaagtaaactatttcatatagagcagtgcattcttttgtttgtttttgttttgttttcttaagacggtctcgctgtgtcacccagactggagtgcagtggcatgttcagggcttactgcagccttgacctcccaggctcaagtgatcttcccacctcagcctaaagtgttggggattacaggcgtgtgctactgtgcccggcctagagcagtgttaaagtgagagttaaatgtattagcccactgtttgtatcattttaataaatccagtaaattgccatctgtagagtttgtgtttattcttttttttttttttgagatggagtttcgctcttgttgcccaggctggagtgcaatggcgcgatcttggctcaccgcaacctccacctccccggttcaagcgattctcctgcctcagccttccgagtagctgggataacaggcatgcaccaccacgcccggctaattctgtatttttagtagagatgggggtttcaccatgttggccaggctggtctcgaactcctgacctcgtgatctgcccacttcagcctcccaaagtgctgggattacaggcatgagccaccgtgcccggcgagtttgtgtttattctgtaggtcagttctctgccaagggactgtttggtacttcagtagctaagtccttttaatagtgttgatctcatgacagttttcttatggcaattgtgatagagccacagcttcagtgtaactataataaagaaaagattttgggggtgcaagacattatcttttaagttttctattagcaccacatttgataaattggggttccctgcagactaatgtgctcagaattttcctatttctgccactaatttctcaccttatatgtaacaaagttttcctcactagcaatgtaatgagtactaaaaatagcactggaaggtgaaagcactgtgggagaagcatttgatgaatacctttaagcttagagagaccaagaagactcatggaaggggtgagatgaccaatgaaattagttttaaagaaacaacagaactttttttttttttttagctggctaaaagatacagagctttactgcagatttaaaaaaaaaaaaaaaacccaaatgcagagaaacaggcttgcaagaggtcctggtatgtttgaggagctgcctgagatttggaaagccagattgtagggaaaatggctgtagtgttctggaagtggccatggggagcaagcctcctgctcacttccagttccagttctggtagggatgtgggagagaaacagcccctaccaaaggagttctgtctggggagcagaaactgacgggaggacagggttttagcctagtggttctcacccttggctgcacagtggaatcatctgggggagctttgaacgtgctgaggcctggagcccctcccagagattttggcatggggtgctgaggtccggccactgggaggtttaaaaacctctccaggtgattctgaagtgcagccagagttgagaagcactgaattagggcaagaggaaggaatgctcagagaagaggttgagaatatagggaattttattgatgagttcttatagggcacaatgaaaggggttctggagttggggaggcatgaggtcagcttaggggatgtactcagaccctatggggacaagaactcagatcacaaggggcctgggagtcaagggattcttgtggtgactgatgtgaacagggctagaggatgtgacaggaaggtcctgctggaagaactagtcactgtgtgcctcaggtcctgtgtgtactactgtgagaggctagccatgaacacagatggcctcaagaggaaaccagaacaactgtggtccattgagttaattcttcatctaacttcataatctggctagaatcaggtcctgaaagtgatattgaacccaataggaatatggcagtcatgctactctttttcaaagactaattttttagacacaactttttataaaatactacatttgttttatttggaagtaaaaactgcagctcacttaaacttaaatggcagttcgtaggccctgaatttgtgaaatattcaacaccattttaaatactctatccttttaattaatatcctgtcatttaaattattctttccacaagttaatacacagttggtgattcaaaatagtaaattcttctgggagaaattaagagttttagaccacacatacttttttggggcaggggaaggaattcctggtgattatgtaagtctcttacagggctatctaatccatttttaagtgttaattttattaaagcataacatacatactgaatctatttttaatacatactaaatcaatttttaagatagtaaaatgaagtataggttgagtaccctttgtctgaagtgcttgggaccagaagtggtttagatttcacttttttttttttttttttgggaatatctacgttacacttacctagttgaccatctcaaatctgaaaatccaaaatcctaaatgctccagtgagcatttcctttgagtgtcatgttggtactcaaaaagttttgggaggccgaggtgggtggatcacctgaggtcagaagttcgagaccagcctggccaacatggtgaaacctcatctctactcaaaaaaaaaaaaacaaaaattagccgggcggggtggcaggcgcctgtagtcccagctactcaggaggctgaggcaggagaatctcttgaacctgcaaggcggaggttgcagtgagccaagaccacgacattgcactccagcctgggcaacaagagtgaaactctgtctcaaacaaacaaacaaacaaacaaacaataaaaaaagaagaggccaggcttagtggctcacgcctgtaatcccaacactttgggaggctgaagtgggcagatcacctaaggtcaggagttcgagaccagcctgaccaacatggtgaaaccccatctctactaaaaatacaaaaattagcctggcgtgatggtacgtgcctgtaatcccagctactcgggaggctgaggcaggagaattgcttgaacccaggaggttgaggttgcagggagccgagattgagccactgcactccagcgtgggtgacagagcaagactctgtctcaacaacaacaacagaagttttgggttttggagcattttggattttgtattttcggattttggatacttaacctgtattatattgttgtcagctttcaaatatctataagaaaatagcaagaaacattatttaatgtgaacaatagagaaatgtcactgcttttaaaattgcatgttttttttatcaaattaaaactccgtgaataaacaccaaacatcatgaaatctcttgctgtaatatattcaaatgacctcatgtaatatataagtcattgaatcaccttaagatactgcctgttaaagcatatttatgaactttcaaaggtatatacaacatcctaatttttactcatcaaaatacgaatttaatatgtatcaagatagtttctattcatgcatgtattagaaaatcagaaattattccaaagtgaatttataaacgtatatcacttaagatgccaccttcattttcttccaaagtgttactttgttctgtcctacagtgtatgctgtagattagctgaaaatcacaacatgttaatgagtatttcagtgattaaggaaagaagatataaaccaaggctgtaccttcatttgtgatgatgaaagaacatactgaaagctgtaccacactgtgctgaatgtagtaatatgaatgtgtctgtctgtggtcttatccttagtcctgctactgtgtagctctctggctttgtgggaattaagtaagttagtctcatggacctatcgccccttctataaagtaagaagattggactagagggatcctactagtgctaagatgtctgattctattttgtattctctgttcaagaattttttttgtaatatagataaaacttcatgaaacacagttgagggacaagataggttggactaattttctctgctcctccctgctaagtacaactaaaacccccagaaatactataatggaaagaggattttttttttttgagacagggtctcgctctgttgtccaggctggagtgcagtggtgtgatcatggcttactgcaccctcaacctcctgggctgaagggactcagcctcctgggtagctgggactataggtccttgctgccacaccgagctaatgtttttattttttgtagagacagggtcttcctatattgcccaggctggtctcaaattcctgagctcaagtaatcctcccacctcagcctcccaaagccttgggattacaggtgtgagccatcatgcctggccagaacagactttgaaaggtttaaagaggaaagaggactggcatgacagtgaactagagacttcaagtagacagaagaccaataaggaaatagaaagcttgaacaataccatggttcaacttgatataacataactatagaacacccagcatcagcacaatagacatttttctcaagtgcacttggaatattcttcaggatagaccatatgttaggccacaaaacaagtctcaataaatttcaaaagattgaaattatattaaacatcttctctgatgtcaatggaatgaaactagaaatcaataacagaagtaaaatggaagattcactaatatgtagaaattaacatactcttaaaaacacaaagaagaaattataagtgaaattagaaaataccttgagatgagcgaaaacaaaatcatatcaaaacctatgggatgcagtgatagcagtactcggcgggaaagttttagctataaacacttaacattaaaaaagaagagatccaaaatcaacagttagctttacaccttaagaaactggaagaaggctgggcacagtggctcacgcctgtaatcccagcactttgggaaaccaagacgggtggatcacgaggtcaggagatcaagaccatcctggctaacacgggaaactccgtctctactaaaaatacaaaaaaaatgttattctgggcatggtggcgggcgcctgtagtcccagttactcgggaggctgaggcaggagaatggtgtgaacccaggaggcggagcttgcagtgagccaagattgcaccactgcactccagcccgggcgacagagcaagactctgtctcaaaaaaaaaaaaaaaaaaaaaaaaagaaactggaagaaaaagagcacactagatccaaagctagcaggacagaaataataaagagtagagtggagataaacaaaatagagaacagaaaaacaacagagaaaatagttgaaaagttgattttttgcaaagatcaacgaaattgacaaaactttagctagactgaccaagagtataattaagcatgtgttaacctctggtcaaaataaagggctctattttaaagtgaaatcaggttctgataaatttatcatttgccctagataacattgttttaaatttatcgaggttgaatattcaagtggaatgcttgttttgtgtaatgtatttttcctttgttaactttggcagtaccttttactgtatgttccctagttgtagaatcggttcatagattgctcagagctactcatatctctagattcatgtatcatgaagaaacaattctgtttcggaccaacctgtgttgattgaatctcaagagttttggaagttctcttatgaggatttcttaaatttgaaaactattctcaaatagttcgcactgaatgacaaattcaaaaggcaaaggaaatggccatagtgataagtgcaaggagaagagagggtgagaattagtaatgaaataccagcattggaatggaggagaaaagtgtaagcctgtcccccttccttctttttgaaagaagtactcagcattttgctctttatcaataagtgtctttagaattaatcctagtaactaattcaaaagaaaggaaaagttctatgatgacatttattttagtattataaaaataagaacaatacagaccaccttaatatctaggaagaaggcactggtcaagggtaatgtatatctgcctgattagaatattaggcatctattaaaatgattacatgacaaaacagtagaaaagaggggtaacagctgaatacagaggtgtttcctgattgtaccacataagtatatggtagacctttgatggtaaggttttctcatctctgaggatgaccttgaaggtccatggtgcatggtaattggcccctttccagtggtcggatttcgaattacttttacattagccactgttccctccccagtagggttttgagattcttagctgcttagtgaatttctactaactctttttaggggtctaaagggatcgcttaggtgactcatttataatttacctatcttgtcttataacttgtttttataagtttttatattttgggagatgatgtatgtgtagtatttatgtgaattgggatatctgtgaaggtctccagatggttcagtcctaaatgtcaagtgcctactgttaaatacttggagaagactgctaagtaattggtagaagtttaaatggctgttttggtggggaagttatgcagtttttcttttaaaaattttgtcttaaaattaaggattggggaaaagaaaaaaaagtcctctgatatgacaactagaataaaaagtcatttgaagatttaccagaataaaatgacctttggaaactacttttagagaccagctctcagaaatagtgataagacatatattgcataattacattgttacgatgactctagcaattgtgaggttcaaagaaatagtgtactgaagtattatcatctagtcattttttaaatctatgttctttggatagtaaactcttattgccctcactcttaaatagtaattctgctgtgtacagaattttagactgaaagtaatttttcctcagtattttgaatgcattacctcctcttctagcatttattgctgccactgctccggattgtactgtcaatctattttttattcctttggtgcagctttgtctttcctctgggattgcttttaaaagtttatttttactttctgaaggggtgggttgcccctccacacctgtgggtgtttctcgttaggtggaacgtgagacttggaaaagaaaaagacacagagacaaagtatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaagtgctgtgctttagatatgcatacacataaacatctcaatgcgttagagagcagtattgttgcccgcatgtcccacctccagccctaaggcggttttcccctatctcagtagatggaacatacaatcgggttttataccgagacattccattgcccagggacgggcaggagacagatgccttcctcttgtctcaattgcaagaggcatgccttcctcttatactaatcctcctcagcacagaccctttacgggtgtcgagctgggggacggtcaggtctttctcttcccacgaggccatatttcagactatcacatggggagaaaccttggacaatacctggctttcctaggcagaggtccctgcggccttccgcagtgtttgtgtccctgggtacttgagattagggagtggtgatgactcttaactagcatgctgccttcaagcatctgtttaacaaagcacatcttgcaccgcccttaatccgtttaaccctgagttgacacagcacgtgtttcagagagcacggggttgggggtaaggttatagattaacagcatctcaaggcagaagaatttttctcagtacagaacaaaatggagtctcctatgtctacttctttcgacacagacacagtaacaatctgatctctcttgcttttccccacactttcagtgttctgttttgatggcgctgcgatgggtttaagcgtagatttaaatttgtttatgccaggtgacacttggcatgcattttccttctggaaaatcatctttaattttaggacatttagtgatatctctgtgggttttgcttctctacttatttcttctgttttcttctggaactaactatatttctgtcaacacatttaaaaaaaactctagtaatgtgtctttcatcttttttttttcttttttgagacagggtcttgctctgtcacccaggctgtgcaatgggatgatccatggctcactgcagcctcaacctcctgggctgaagctgtcctcccacttcagcctcctgagtagctgggactacaggcgcatgccaccacacctggctaattttttgtattttttgtagagatggggttttttcatgttacccaagctggtcttgaactcctgggcccaagcagtcctcccatctcaacctcccaaagtgctgggatgtacagatgtgagcaccgcaccttgtcactttcatctatttatgttgtgatctttctgggcttgctctggatgaaatcttcatcttccaaattaaaaatcctctgcataactatatagcctagaatttttcctattctgttattaagcctctatcactattctttgattctaggttttataatccattcttttttataacaacctgttcttgttttacttttccctatttttgttttatacccatctattcttttttaggatctattctccacttttaactttgaggattctaaaatacttactttaaagttatttttaacttgttctatttttgtttttgtcaggagcgaatttgccttttttatttggctgttctaccatgctttttggaattttgttttgtaggcttattttgagttggagttcaatctcattctcagttctctgagctcctcactttctgccagttcagtggctgtctctaccaactattcctggcatccatggcctccagtcaagagctgattcttatacttgaaatacagtacttccatctggtgcaggtgtcaggggtcttgtagatggcacccaatggtgcttagcccagaaccaggcttcagtgttatatctgcttcagttcctttcctaagtaggcaacccagagcttctccacaggcttcatcttggttttgcagcttcacaggtagcaaagtgataccttagcctctggcatcagggaatgagcttggtaccagtcccctgcctcatgcgggacatttatttatttttattttttattattattatactttaagttttagggtacatgtgcacaacgtgcaggtttgttacatatgtatacatgtgccatgttggtgtgctgcacccattaactcgtcatttagcattaggtatatctcctaatgctatccctcccctcttcccccaccccacaacagtccccagtgtgtgatgttccccttcctgtgtccatgtgttctcattgttcaattcccacctatgagtgagaacatgcagtgtttggttttttgtccttgcgatagtttgctgagaatgatagttaacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctctgggtatatacccagtaatgggatgactgggtcaactggtatttctagttctagatccctgaggaatcgccacaatgacttccacaatggttgaactagtttacagtcccaccaacagtgtaaaagtgttcctatttctccacatcctctccagcacctgttgtttcctgactttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccgtttcctgactttttaatgattcatgtgggacatttaaatccctgttattaggaactctcagctgcctctgtctgcttctgcaccctctgcctgcttctgcaccctctgcctgacctaccactttgtgatttggccccacagagacctttatcttgcttctgagtgggactgagtcttttaaattttaacagttcatgctaacactctcacatctgtcattgcatatcattttatgtaaggggaagttgagattcagagagcagaagttaactacttgggcctcgcagttggtaagtaagccagcctgctgtagaagaaaagggctggaaaaggtttctggggaagtgctagaaatttaataagcatgtagagagagaaaaatcattcattatacatcacaaaaattaactgtagatctgctaagtaaaagttgattaaatttctacactctgtgcccaccaataattttctaaatgtgaactctttcctacattaatctcaaatgcttatttttaaagtgccttccccagtgcagacttacattcatcttagccaaaatggccttcacatttggtctgtgggacatatttgatgtagcaaaaggccaagggtaacccttattctaccccctaaaagggaacagaaagagaacttttgcataataaataattatttatgcatttcaaaattgattttaagagtacacaaaccatagaggctttgcgattcttcatgtattttattaatttatcaagcacttcaacagagtgcccgatgctcttctagatgctttacaaatattaactcatttaagcctcacaacaaccacgtgcagtgggttctattgctatcctaacattgcagataagtaaacaaggcacagagaacctcagcaacttgcttgaggtcagtgacagaaagaaagagttaaggctatgattcctaccttggctatttagccccagtgtaccagctcctactatactactatgctgtgctgtgaaaccacgtctcacaattattttattaacaatcaaactgacacactatctttgtcagggacacattttatttcatggaactagttaaaaattagctttaactcacttctggtgacttgttttctttcttaggttcttcctcattatattatgcccatgctattgttatataaagctcactctgctggtatcattcttctggaagatgccataaattcatctaatcatttcatcagatgttaacggaatgtgctcactgtaggcccacagtttgctgagaactataggagcacaaagattgtgatgtgatccttatcctgtagttcctttatcctgcgtcaccctctcacagcagtcatgcccaacactatctattctatagtctctcatggttcttacaactgagtcattttctgtgtgtctcatttaaacccatttcttaatgctttattgacacaggttgtaagcaataaactggtcaccatgtttctaataactaccaatatagcccagttttcccctggggggctcagttatggtggttttctaggtttctgagcaatggaatcctcatttctcttctctgctgtcccctatcgcactgtgacttttttttttttttttttttttttttgagaaagagtcttgctccgttgcccaggctagagtgcagtggcgcgattctggctcgctgcaacctccgcctcccaggttcaagcaattctcctgccttagcctcccgagtagctgggattacaggcacatgccaccacgtccggctaatttttgtatttttagtagagatagggtttcaccatgttggccaggctggtctggaactcctgaccttgtgatccacctgccttggcctcccaaagtgttgggattacaggcgtgagccactgtgcacggcccacactgtgactttaaggaagcactcctgagggggtcaggggaggagcagatgtggattgggaggatgcccaaatgtgctactgtgctaatgggaaaggacaatggaggacaaccaggggttgggctcagggaggcagcttgacagaggatttaagagcatgggcttggggtttcaaatcctatctgcctcttactggctttgtgactttgggcaagttagtctctctgtgcctcaatttcatcatctgtaaaatggggatcatggtagtatccattttcatagggttatgatgattaaatgagtgaagatctctaaagcacttagaatgatgcctggtgccatagtcaaccctcaataacatttagctgttataattatcatcaccacaggcctagtgaaacagaggtggggtctagttggcaaacacagaacagactccagatagctagaaattagttgcaaccagcccagaatgagtgctgaagtggctcgctaaagcacttgcagtcaaagcacattgttaccctcatctgtgacctttcatgggctgtctctctgcctatgtcaggggttggcaaactatagcctacaggccaaatccagatggtcacctgtttctataaataatggaaatgtgaaggagaatcaattggcaagaggcacgcatagcgcatcttcaaccttttccatcggggaacatgagtcttgagaatcctgccatagatcaaaagaatggcaatgagaagaaccagtggacaggtggataggcctccccatcagcctttaaccctcctgctcttatctcaaggatcatatgcccgtgtctgtggtttctgatttttccttgaggacctttgaccgagatgatctgtctttcagactttactagcaaaattctgagcagtatcttttatacaactggcagcttcaaaggcttgcagtgggtaggcctccccaactctgtttcgcaagataattaaaagaagccagactccttcatccttgaaggagaggaagaagaaaacaagcctgtccagagaaaatggggtgaaggaatttttctccccaacttcctcctaaataccctgctctgcccatcaaattttgtaagtatcacccagtggtgtgttggtaaaccttctcccctgcggggtgggggaaagccccaatttgcagccgttgttgctgtctgtgttgtgaatgctcccaccatgctgactgcaagtggagctgggaagagatgtgtaccatcggctcactaacactagcatgctctgtggtagacagcttcccttgcctctgaatccttgtgtcaggattctacgtgccaggcaacaagagctttttttctttatgtatcatgccagtgattttagtctagggcactgttttagcccaatcccagaatgtgctattagaaatggggccatatttttgaagttgctaggggcaaaacttccctcttgtttatgtttaacttgtgccactaggtggcactttaaggacattacaggaaatcggctctactggatttttaaaacttttttttttttgagacggagtctcactctgtcgcccaggctggagtgcagtggcatgatctcagctcactgcaacctccgcttcccgggttcaagcaatttagctcactgcaacctccacttcccgggttcaagtaattttcctgcctcagccttccgagtagctgggactacaggcatgtgccaccacacccagataatttttgtattttagtagagatggggttttgccatgttggccaggctggtctcaaactcctgacctgagttgatctgcccacctcggcctcccaaagtgctaggattacaggcgtgagccactgtgcctggcccaaaacactttttattgaagtataattgcatatagaaaagcaagctgcacatttaatgtgcaactcaattttcacaagcagaacacatgcatataatcagcacccaaatcaagaaacagaatattactagcaccccagaagccctccttgtgctgttttccagtcgctatctcttattcttagggttaccactattctgacttctaacagcataaattagtttgacttgtgttctactttatataagtggaattatgcggtatatactctgtgtctggctttttattaaatgatgtttgtgtgatttattcatactgttgtgtgtaattgagatcattgctgtatagtattccattgtatgtgcaaatataacactgttttctactattgatggacatttttgtacttttcagatttgggcaattatgaatagtgctgctgtgaacactcgtatccaagttgttgagtggatgagtgttttcatttctcttggatatatacctaagagtagaatttctaggtcatggtgtaggcatatgttcagctttagtaggtactgccaaacagttttacgaagtgtttgtactgatttacactccattaatggtgttcccactccagttccatgtcctcatcaatgctgaatttattttatggatggttcctaactcttaacataatttttatagctccctttctggccagctatttctaattgaaaaattttaaagccacattattctgatggacatggctcatgcaggaagggctatgtcaacccaaaaggggacatttatcacagtctaagtgtgaactatcagtaagtcggaaaggatgttactctaatactccatcacactgatacacagagcaaagaaaccaggaaaggaattcagattgtaagtgtgataaaatatcggttcataggccagggctctgaggcattttgaaatttgtatatacatttgttattattgccaggcctatatatgtcagagattggggcccaacagaaagaatttctaaaggcctcataatgaagtgcctttcaattgtgctgctggtgggtgcctgttttactaagggtctctttggtttggcaagaggcatgcatggggcatctttcttcaacctcatccctggggagcgtgagtctctagagaatcctgctttagatcaccttacctgtgaggctcatgttgttgactctgcagatggtgttataatatggctttaggtatgtgatatagagagtacagttcagacttgactcagatttctgttccattactagaaattggacatagaagaacaaaacccaggtcatggtcaaaatatttgtcttttagaccaaaataaagtgctcatagtcctttagttgtaacagtaagtctgtctcatggatgttgtccataatctaatgggttccaagaatccccaaggcattctgccatgtgactcttgaatccagcaactagttgcccattatagtcactggtacccactttcaccaaagttgttcctgagcccctctgtcagtgttttcctgagtgtctccagtgttggattggtctaccgaggggggtgcccaccagagatgttcactgcacactgcctgagatatccatgttaaagcagccgtgaaacatgaaagtctgaccgggcttttatttttaaaattttctccccccaatattagtagcggtaatatccagtggcacagatttagactgtggatagcctgctttgtgggatctgcttatattctaaattggagccagcattttctcagcctaggttttcatctgtttggcaaggaggaaaatgcccttatgttggattggctgctgcttgcagtaggaggaactatgcctgggaaaccaatcataattttaatcctaatgataatagtagctgctgttgtcaaacagttactgtgtaattgtgcttagcacactagacagatattttgcttaatcttcacaatattgtgagttaggtgaattatcccactttgcagatgaagaaattgcagctcagagagactaagcatgtgaccagctcacacaatgagcaactgcaaagcctgggtttgactccagagcctatatcctgtaactgttctgtgctctgtgggtgcagttaccaaggaatgaattactgacctcttctccagtggaacatgaaacagtattgggttcattgctggcttattccacacattgattagaggacctgttgtttgctggcatgcagcttaggtatcaagaaaatgatagggaagcaagacagatcctgccctccaggtgcttaccattcgtttatcatgttctgtctctcacaggtgacttgagtcatggattttggtaatcattcttgctgagaattcagtctcttggaccttcttgaggctctatttacccctctctctgagcctggttggggaatgatggggtggaacagtggtgtgctgggccattggttctacatcttctgtgactgggtttagcaaatggctttctgttgtgttcttgcctagcggagatgggggacaggtgaaaactaggcaccaaatgacatttagaatactgacagaatgctggaaaggccctggaggcagcagcaggattgtcttcttgtctgcctagaatttagctgctgcctttgtgatccccattcttggaatccacctggatccttggatgataaagcctgagttcgtttttctgacctgccaatattgcaaacctaaaaaaaaaaaagttacctattatccacaccttggcaaagttctacagatggacttcttttttttttttttttttgagacagagtcttgctctgtcacccaggctggaatgtggagtgcagtagcgagatttcagctcactgcaacctccgcctcccgggttcaagtgattttcgtgcctcagcctcctgaatagctgggattacaggagcgtgtcactacgcccagctaatttttgtatttttagtagagacggggtttcatcatgttggtaggctggtctcaaactcctggtgtcaagtgatccacctcccaaagtgctgggattactagcgtgagccaccatgcccggccagactattttttaagtgggatttgactttttttttggttgcaaatttgacttttaaacaaaatcttactgctgaagattttgcccagctgcaaatatttatctatagaaccatgtggcatatacccccattccctctatgatgaatggatgagaaaacaattaagaagcctagttagttttgcaagagcacctgtggccttgcccagactagggccttggagacttggttttctcatctcttaaatgaagagtttggaccatcagtggttcccagttgatctgggctggctacataaaaatcacttagggtgcttgttaaaatataagtttctaatgccccatccctaagggattctgatgagggaagtctggaatagcatctacaaatctgaatttataaaaagttccccagataattatcctgctctggttatatttgggagccactgggctagagggtctagaacaaacataattaagttagggagaaacttctgatgtgcttgaagatttggggaatacctatatgcctggagcaggttccatatgggcgaactaacccagttatgttgcagaggtaaattggagccagaggatggaagacctttaactggctgagggattgtgttgtgtgccataggctttggggagccagtgaagggctttgagaaaaagcattttgattagatggtgctttaccagattaatttctcagtggtgtgcagggtggatcagagtgcactagaactgaaggctggaaaaagacccagtgaagtctttgcagtggcccaggtgataagtgtgacgagtacctggactcagatgggaccagtgggacctttgtaaagctaacctgcctcagtggaactggaatctgagacatactgttttaaactccttaaaaaatgcataatttattaatgtcatgttcatctgcctaaactattataattaactatttttattgtgtttttgtccaagaggttttaaaggagccctgtaaataaattcatgcaaagaagtagttggcagcagcaacagctgctaccgcagggagaagggacccccttctggccaggcagcaacctcattctcaccctgtctccatactctaagccaaagcgagaggggaggggagtgcaacaggggcccctggagttggatctgccaaccacagtggagaatgcacctccccaagggttaggtgtggaatatggcgtttggcattaagtcaaatagaatattcttcctttgttcctctaaaatccagtctatagtcaatgtttctcaaagtatgttccacagaacattagttcttcaggatgttaatagaagttacatgagaataaggagatgaaaccaaataaatttgggaactgatgggctacgcaaaggcaagtgacttcctttcagaatttcagagtgtgtaatgttctgtgtgctcagtgaatctccaagagggagatagaccaggcagtgtttcctaagcttatctgtagattcttcttccccctaggccaggggctgacaaattatggctcataggcctcatctatcccaccactttttttttgtaaataaagtttattggaacacagttgtgcccattcatcgtattgtctgtagctgctttagcacaacaggagagttgcagagtggctacagaggtagtctggccctcaaagcctaagatatttactatctgcccattacagaaaggtttgctaatccctgctctagacaattcatggaactggtgcttcctggtaccccctttcagagatgctactagaagaagatatacatgggttgttctagcactgctttatgataaatctgcctcattttattctgtttccatactgccatcattcctgcctcttgctttaaactactttatctctcaaccatttacccattatccaggatccaaacctgggttccatgtgtccttatcttttcttgcactcacaacattccaaaaatggccaagggtgtcttcaatttccagtctgggtagctcttaagtcagcccgaacccattcctaccaacctggcctacatgaccgtcatcttttctttttcagcattcgaattaggttccttttccccagatatgagttacctctagtcctttttactcactgaatctagaataacctttgtaaaatacaaatctagtcagattgattccttacttaaaatccttcagtggtccctgtggccctcaggataagctcagatcctcaggatggatgtgtgtcagtctggttgggcaaacagaaactactcctggtatttcgtactggaagagatttaatttaaggaattagttacttaagaaaaggagtagatatttccaggcttctgcctgctgtggcatagagaagggcatggaaatgggggatggtgttgagtgtttagcaaatgacccagaacaaaccaggtctgggaaaccatgtgttatcccctgctgcccttctccagcttcagctctcccatttttctcctgactcctcacccttcctccaccctgcaagtccccaaattctagatatatcaggatgcctttttgtccccccagaaacttaaaacaactgacatttacgaactcacagtctctttgggtcaggaacttgggagtgacttagctgggtggttcggggttacatcctctcatgaggcttctgtcaagatgtcttccagggctgcagtcatctgaaggcttaactggagctgatgatccacctctaagatggctcactcacagggctgttggcaggaggcctcacttctttgctgtatggaccccttgttaggactgcttgggtgtcctcacaatgtggcagctgactgtctccagaacaagtgatatgagagtgagagatagagatagaaacagagacaacaaggaggagcatactagagtgctttcagtcccctctcctgggagtacgttgcatagtgtctcaggtcagcttccctagaagcagaaccctgagatgaggattcttcaaaagtgatttgttgaaggagtgctctttaggaaaaaacctagaaggaggagagggaagaaaagtagggaaggggaaggagccaagcaatgatatagtctcagataaaatctgaccttggcctgatccacacaggcaggattctggtacataattgcataatagagttaaccctgtttgagacaggggactggccttttatatccttctctaagtcagtcattataggctgctggaggtgggggtgggaggtaggctcccattagttgagaataagtctctagagaagagggtggctgtgagtcctcagtagctaacactcagagcagctgggggatggtgtgccagccagggaaaggtgacccaggtggggccaacacagcacctactacagtgggcctccccgtacccatgtcccaagcacctaccatggtccctgacataccagaggtacgaaaaaaatatctgtgtaattgaataaatgaatgcatagaaatgcttagcctctctggacctgtgtccatttctgggaagtcagctcagcagggatcatattgtcccatcaaccatgggaatggtcgaagacccaggacagtttgccacatcatgagtggcagcactgtctaagtccaggattttcattgcaaaattagagtgaaagtatatttgccatttgtgaataaggaagtattaatattacaatattatatatttttaaaaggaactttagctcacatttcagtgagctctttgctaaaagtacattttcctggtttgtcacatcctgactgggtacatgttgttacacatggaaccgtgagggcagaactgccatttgttatattaattgtaatccatatatctgtttttttcccacaagaatcagtcactggatttcagttcagaaaaccaaaactgtcggacaaagccatattatcgtgttggcagagttgttccccatgaccccaaatacacagaggaggaagagaaccactgaggccccttgttttcttggattatcattcttccaaagttggtaactaagaaaagtctcaagaaatagcaaagaaacctccccaccttattctgctttccacatcccaagcctaacataagcctcaaactatttttatgaaggaaagcttattgtgaagagggtcttttacatgcctaaatctcatctttagtttttcttatcacacagccggttatctttgcccatctcttttcctgggataatgtctggctctgtcaaggctgtgccttattctgggaccttcctaatgcctgtgttccaggtccctcctgagattcgctcctccgaatgcttgatagatggatcaatttaggggattgatggtcagatttagcctgacataacaccatgcagtggtctgttaccagacatagagctggaaaacccaggcccttgcatacaagttcaggaaggtaaatttgcaaatgaaaaacattttaagacacatctcacagctgcttcctcatcccccaccctattgtttgtgtttttagagatgtttaagagaaaaggaggcaataacaaagacgctctgctgtgctttggaatcctcatttatgttgaaaaagggtccatttatcatctccttggatatttccacaaggagactttgctcatctcaccagggaatggagtggtagagcaaacacttctctgtccacctgatgatggaggagaaccaactaactgaaaggcagagagcctgaaattattatcctctctctgcctgcctgctgcaagatattgctgcatacctgtggtccctgcaggaggctgcatgcgtagacttgggccagaacatatattaccttccaagcaatagatttctaggtaaaaggcaagaaggggcctcaggttcaagttgcattcttcagtggggttcacaggaggccctgcattcagggggttactgggccctccttcagctgttaataaaactgacttttggctcatagagcttggagtatgcgtccatttgtatgaacctccagggaaagcagggtgagggcttgtgttccctagactcctggcagtgaatggctcctggacagctttgcttggttgtttcccaggtacttcaaactcaatctgcctaaagatgagttccccctcactcctgcttctcctgtgtttcccatcttggggattgaccttagtgttcttgtggtagccctggctgaaattatggatgttggagcatgggaggccctttgtgaacttacttttgggtctttctcaccattcccacacattgctcttttagcccaggcctcagctgagacatcacctgctcctgagtctttgccgacccatgagactgggtgcttctgtattccccatacttgccctccacagtccactgaagcaagttggctttgtcacttccctgttgctcccactagacttcaagcttctcttaagcaggatctgtatcttgttcatccttgagtgccagtgctagcacagggcctgcctgtagtagctgcttaataaatatgtcttgaatgagtaacactcaggcctgagaatacctgagactgtatggcatagtggttataagcttagctttggaaatcaaggcctgtgttcagactctgctatttgtgtgattttgggtgagttccttaacttcttgatcttcaatttcttcaccaataagatggggataataactacttcctagggctgtgatgatgaattgcaatgatccatgcaaagccctttgatcaatgtatgacacatagtaagtgttgtgtgcatcatagtacctattagtaacaacaacaacaatatagttatcgttaatggaagggagaaagctataagaactagttggaactagaagtcaggaatattgagtgcttgcatagtggatttagaggagatggggaattgcttgggataaaatgtaggaacagatgggattaccctgggagagaatgaacagggagggaaaaatgggtggagcaactaaagacagaaccttgagaaatcctacatttgagggataagaggagtcaaaacaggaaaaagagtgaatgactacagttaggagattgcagcttctcagatgccaggggcaggagtttaaaaaagatagtcaaaggtgctatactgggcagaagatcaatgaggagaagacgagaagaggtagccataacgtgttaaatgggggtatgttagcgcccttgggaactagccatttcagtggagtcagaggaagaagccatgctctgaaggaggttagagaaggccacgttagggatgaagtgggcatactaagtcagtttgttgtgctacaatgtgtgtttctgtaatgaggattatctgtgggtcagtagatgactggtgtcagtatgatgtagaagtcacattggttcatatgtagggttcattctcagcacatgaatgttttggcatcactggctactagtggctgaaagcagactaacacacctgaaggcagaagactgggggaaatgggggacatagagagctgctcatgaggcgcagtcaccctgtgttcttccacttgactgattggcacccactctgtcttgaagtgctttggggacattccttgccaatcttggtgagtttagtcactgattccattccactcagcacccttgacccttctgataactccttcgaccacagtcccccttccttttttaagaagggccatatttactagagtttttttttttttttttcccaaactgtgtccaggtttattaaagatactttttgtgaacagtcatggtatttcaggcaggacatgagcgacaatcattaacagtatacaactttcagactccctccttcaatggacttccaaaatcagaaagccatggtaaaacccaatgaagtcttcatttggtaccctgaagagggaaagttcagagtgagggttgacatttcacattcaacgtgctgtttaacaacttttcatgagctgaccctgactttcaggaaatgaaatgaaaatggcagaatttatctgaagatccacaatctagaaacagagcacgtgtctttcaagggttctcgctggaaagtccagattgccagcctgactggtaaccagttattgggggccagaccccaacaggtatctgggtttgagggagttaagtgtatactgaaggcagagagggagagggggaaataaagaggaatttgtttctccacaccacaaggcctttgtgcgaaggtgactgtgtgtgtcaacgtcagacagtccctctttctgggagccaagaagatgtctttaaaactagaagggaaaggtgttttctccacatcagtccagcttcatagacattctttttcttttttttctttcctgagacgaagtcttgctcttgttgcccaggttggagtgcagtggcacgatcttggctcactgcagcctccgcctcccggcttcaagtgattctcttgcctcagcctcctgagtagctgggattacaggaacccatcatcacgcctggctagtttttgtacttttagtagagacggggtttcgccatgttggtcgggctggtctcaaactcctgacctcaggtgatccgcctgcttcggcctcccaaagtgctgggattacaggcatgagccacggtgcctggcctcagagacattctattagtgacatataccccttctccataaaacaacaatgacgtgttccgtgtgctaacaacatggcttaaaataaaggcataaaaacaattctgcatttttataaaacttaataaaaaaataatacttcaaactgcacagtcaccagaaatacacagttatcaaaaatgcacacacttcccttggcatccccagcgccttcaactttctgtgcctgctctgttttggcctctgcattttctgcagagttattcccctccttgccagcatgggctttttcctttttcccctttaccttctctcccttctttgcaggggcctctttaggcttgggcttcggaggagcaggtttggcagacaaccttgcagatcttctctgtggtttgtccttactttggttttatctcctttagcgtccccttcagcctttctcttgggcatggtggaggcgactgcagtggaatgtaggtgctggatctggggatgcagcagtgcgtgggctttggttggcctgggggatagttcttacctcttcttcttcacactgctcatagagtatttctttattagaaatttaacatttaaaaaattcagtgtttttaatgatgttgattgtttttgttggtgctcaagttaaaatctttgttttcaaccctgtttttccgataagccttgttacttttagagtttgttgttgcgaagcattagttttttagcaatacatatgttcaattacagaagaaattcccatgattccttttcctaaggttgaacaatctgggaaggagggatgggaaggttaatagcagcatctatgggaggtttttcccaaggatcagcagacttaagcattcttggctgcaacttggcctaaatcagttttcccttggtgactatcttcctaagtgctctttattgtatatttaggtgattgtggttttgcatttctgtcctctctctgatctcttgctacagtctgaacaagtgtcggaggccgagttactcccacagctgagcagagccccatcccaggctgcagaaagtagtccagcaaagaaggtaaggtcagcctgaggatgctgtcagatggcgttgcgagtcccaccccgggcttcttatctctattagctgatctattgttttaaggtttctgtgtcctgaaatgaatgtcaatgatccagatttcctagaatgtgggttctttgtgaagattggggtcctgaagattcctgggcttgacccttgatgcattttgtacatgacagtacatactcaacctccttagccccccagctaaacatggtggccttgtttatggcaagagctaaaagggctgtggggagggacagatgtctttagcaaaaccccatccacctgctaagcctctgtgaatacctcttggggtggggtagtctctcctttttggtctttgtaccatggtttcctcttgcatcgtggcattttcacctggcatctgcccagccatgccattgggtcacctgtaatttgctcagtaagtacccctcactcatcatgctctccattcatctcctcaccctcttcttgtccttctcccaggctcttctttcagagagagtgggccttgggctcaggagcacaggtgaggtagagtcctccaaagaagcagaccaactgtgtccttccagaatacactgtggctctttttcttgactttatgtaggaattggggataggagaatgatgagcatatgactaagacctttaaaaacttccaaagcttaggtttttttttgtttttgtttttgtttttttttcctgagacagagtctcgctttgttgcccaggctggagtgcagtggcgcgatctcggctcactgcaagctcccaggttcacgccattctcctgcctcagccttccgagtagctgggactacaggcatcttccagcaggccggctaattttttgtatttttagtagagacggggtttcaccgtgttagccaggatggtctcgatctcctgacctcgtgatccgaccgtctcggcctcccaaagtgctgggattacaggcatgagccactgcgcccggccaaaatttaggtttaaaaggcttcaaagtgaggcaggagcctatcttgtcttcagttaggaaaggccccatggtgtgagatgcacacagggtctgtgtgagtttcaggtgacaagaagtaatagacttcttgaaacatttaaaaagaaaaagaaaaaagggaagaccactggactctgatgcctgtgtccccccagttcttgctgagccatgggtcagtaaatagagtaccctcctgatcttggggttggggctaaaggcatgtgggacactggaaggaagagtggagggaacattgaaatgtttaactttttaatttttattttgttttaaatccacaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagtaagtagaccacataaacaagagtgaggtaggaatctcgctctgagatgtcgacggatatgtaaatgtgttgacatttacgtgcgcaccaacagaaggatttcatggttgtaagtttatcttgctcatctctgtgatgggattcaagtctcccagtcacatagaaggctttataagctataggacttaacctgacctaaaggggcaggcgagtcctaggctgtggtgtttggtttggtttgatttctttcccttcctctcaccttctgttgtttcctactcctcttccttgtgagggcccaaattttcctggcaagatgaaagtattgtaagtggcaattttgcctctctgcctgtgttatctccttttccttcagggcaaatggctagctccttcacccacagacacactttcagtaggtgtggtatgtgattcttttaaaatctccgtaaagagtttctgttgttggtcgcctcagcacagaatggatacatgcagaacttccattatatttatctaaccagctggaacaggtattggagggagggtgaagacacctgtggacatggccagggactgagacaatgatgctctggacaaactatccttctctgtaaaactttggctttgagaagagccatcacttgcttcaatttctttgtagtgaaattgagggaggtgttgaggacagaaacctgctcctgtcacttgactgcaagtgagcctgaccggtcactaacataaatgctcaagacccatcatgaccctgcttttggggtcttgcaggtctcagatgctgctgcagattttcttctgcttacacgttgtagaatgaaaagcagcaggttctgtgggagatgttagcaacttgtctttgaagccaaagtcccattctgaatctctgcagccctctccttcagaagattttctttttttcaaatggacaggtccctggtggtatcagtccataaaggaagtatattttgttcatcacattcaccgagaactttgaccatcttccagcccctgttaagcctggaaggtgaagaatccctatcagggacaaagatggctcaattttcttccatgttctaccccagcactccactttaatttcagctttatgttcattttagtcagcagtggcttaacagtctccagagtagatgtcagggcatctggtggagttcatacagagatcttttctttttctcttttttataacagctttattgcaatataattcacatagcatacagttcatgtttttaaatgtacaattcagtggttcttagtttattcacaaagtcatgcaaccatcaccacaatctaacttttgtcatgcctaaaataatatatatccacgcccattagcaatcactccccattctctccttccccctcagcccctggcaaccacgaatctcctttctgtctccatggctttgcatattcttgtcatttcacataaatggaataatgaaacgtggtcttttgtgactggcttctttcacttagcataatattttcaaggtttatccaagttgtagcataaatctgaacttatctttttatggctgaataatattccattgtatggatagaccacattttattcatccattcatcagtcaatggacattttggttatttctgcttttttggctcttaagagtaatgccactatactgtttgtgtacatgtttttgtgtggacttacattttcatttctcttgggtctgtacctaggagtggaattgctaggtcatgtggtaactctgtctttaatatttcgaagaactaccacacttttcatagtggctgcaccattttatgttcccgttggcaacgtatgagggttccaatttctccattttgtcaacacttatcttttttttttattatagccatcctagtgagtgtgaagtgtgatctcatggttttgatttgcatttcttttgtggctaacgacattgatcatcttttcatgtgcctattggccatttgtttatcttctttggagaaatgtgtattcacaccctttgcccacttttaattggattattaatctttttacttttgagttatgaattctttatatattctggatacaactcccttgttagatatatgagaaaattgagccctctttgtaaatattttctctcattctgtgggctgtcttttcactttctattttttatttttattttttagagacaaagtctcactctgtcacccaggctggggtgcagtagcatgatcatggctcattgtagcctcgaattcctgggctcaagtgatcctttccccctcagcctcctgagtagctggaactacaggcatgagccaccattcccagccaatttcattttattttttatagtgatggagtcttactatgttgcccagtctggtctcaaactcctggcctcaagtgatcatcctgcctcaacctctcaaagtgctgggattacaggcctgagccactgcacccagccaattatcaatattaatcagatctgtacagtggtcacagtccattctagttcagttgctcttttctagaacctatctcccagtaatggcacatatggctgtttttctaggagaacatcagttgctcttttgctctaagaattcggtgtttcttgctgtgggatgaaaggttgtagattatccctgtggtaactgcactgatttatcatcccaaccatggacggttttgaaaagtaaagagagtgctaatgtacttatgctggacagacagttttaaatggagactgtaatgggcgcagtaggatgcgtggtcactctggttatgcgtgttctgtgaatttgttgttaattgggaaatactggtattaaaacgttctgtatttttctcaagagccacagatatatgctggtccatgcacatacacgagtgcacatttatgcacacacacacatatacttaggcattcatgcctaataatacataaggtagaggtaggtagtctggctaagttaatgtagaatttttgctaaaaataatgttcttgtattattttccttcagacttgttcacaggggacacctgcaggtcttctaagtgctattaattcttacacaaaaagggcattccagttaatatggtttgtcaggaagaaatacttattaaaatgtcttggaataaatggaacacaaatgtttgaaaaggcccatttcacagcttttattcaagttataaaatgggaattacttcaggtgtaaataattcatcccaataaatttgtttcatttggtgtctatcttcctgaccgcctgtgaatatgagattttatttttggagccctgtgttgttaaccacttgttagtttaacacctctcatgaatcagagttctgaccctcaagggtccagacctctaagtcctttttcactgaagtgtttgtgcttttctataggcagtcttccaaacagaagaaggccattcaaactgctatccgcaaaaataaagaggcaaacgcagtgctggctcggctgaacagtgagctccagcagcagctcaaggtaaggaatgagtcccagatttggatgaccaggcttttccctggcttttaaaaagcttttttttaatttaataggcatataataattgtacatatttatagggtggggtacatagtgatgtctccatacctatcatgtacagtgatctgatgtgtccattggctgaccatttagttccatccctgttgataagacttgcctcttcgttctcaaaccctttttggaaggtggagaattactgtatttaagtttcatgggttggttcttgcatagtcagaggaagactagtgactttaatatgtaggcttcatattgtgtatgagttaaaaggaaagacaatctattacgaaggctgtttgaagcattctttattatccaaagcttctgggtaagcccttaattatttacatcctctctgaaagaggatgtaaatacttatttcagtagaaggaagtcaccttggtactatcaaagcccagcccctcctctggtgccttgcaaatggttccatttcaccttctcaatgacatcacccctgtttctcttcatcgttactctcccctgtgttagtttctcggggctgctataacaaaatactacaaatgtggtggcttaagataaccaaaaatgattctctcacagctctggaggctagaactctgaaatcaagatattggcagagctatgatctctttgaaggctctagaagatgatccttccttacctcttcccagcttctgatgttgctggcagccctgggcattccttggcttgtagctgcgtcactccaatctctgcctctgttgtcacatggccttcttcctgtatctctctgtgtctgtgtccaaatttctcttcttattgtatcctcttataaggacaccaatcattggattaggacccaccctaatctagcatgacctcatcttaacttgattacatctgcaaagaacctatttgcatataaggtcacatttacagatactgggggttaggacttaaacatatattttgagaggacatgattctacccactatatcccccagttctctactggatcattcgccatccacatgtaaatatgctccagtattgtccattacacttggccaattactgcctcatttctttggtccccttcacagcaaagtttcttaggagtggttttattcattatctttactttcaaaccagtaattttctcttccttccacttcagttggcttcgtcctcctccactcacacccgtcttgtggctaaatccaatagggctgttttaatattattatttttttttcagaagaattctacacaattgatcatttcctcctctgaaatggcttttataactggtttttgacataccatactctcctggttttccttctgcttcactggtgcttcccattttcattctctgctgtctcttccttccctgacttaacttttataccccaaccccatttgccccaatattttagtatgaaaattttcaaacatacaggaaagttgaaagaatcataagtgactgcttgtatagacatcacttcagttctacaataacattttactatacttatttttaatcacatatctacccatttatccttgtgtccatcagttcatcttatttttgacatattttcaaataaattgcagatatctgtatactttccctgaatattttagcatgcgtataattagctagagttcaatatatttttacagttttttcttatgatgtaaaatgtttatacaaaatgcatgcacaaatattattattattattattattattattattattattattattattattatttgagatggagtctcgctctgtcgcccacgctggagtgcggtggcgtgatctctgctcactgcaagctccgcctcctgggttcacaccattcttctggcttagcctcctgagtagctgggactacaggcgcctgccaccacgcccggccaactttttgtatttttagtagaggtggggtttcactgtgttagccaggttggtctcgatttcctgaccttgtgatctgcccgcctaggtctcccagagtgctgggattacaggcgtgagccaccgcgccagcgcacgcacaaaccttaagtgtacatttgctgagtttgtaacaagtacatgtacttacggaatccaaacccccaaaaagatagagaatattaccatcaccccaggaagctccctcatgctttttcctagtcaattcctgccctacccacacagaggcaatcactattctaatttttataccatagttttgcctgttctataactttatataagcggtgtcttacaacttatacttcttgtaaagcttctttcactaagtattatgtttttgagattcatttatattgttgtgtgtatcagtaattcattcatttttattgatgagtagtatcccattgggtgaatatgttacagtttggttatcaattctattgacagacacctgagcggtttccagtttttggcaatttggaataaaactgcattttttaataagtctctgtatggaaatatgttctcatttctcttggattgggattcgtaggtatcatggtaagtgtatgtgattagtttctgagaaactgctagatcattttccaaggtggttgtagcaatctgtactcctaccactaatgtatgagagttccaattgttccgcgtctttgccaacatttggtgttatgattcttattaattttagctagccctgtagtgatatagtttttatcatctccttgctgactaattatgttgtccacttttctttgtgattatttacctttcatatcttactttatgaaatatcttttcaaatgttatttttctccaaagtagtctatagatttattacaaaaccaataaaaatcccagcaggattttttgtgagtatagacaagctaatcccaaaacttatatgtaaaggccaaggagctggaattgcttaaacaaatttgaaaaggaagaacaaagttggaggaatcactttactgtcaagctccagtaatcaagatgctgatgcacaggtcagtggaataggatacagagtcctgaaatagaccacatgaaaacagccatttgatctttgacaaaggtgcaaaatcgattcaatgagaaataatagttttcaacaaattgttttataacaatttgtcatttgcatttaaaaaaataaccttgatctaagcctcacatctatacagagattaacttgaaatgagtcatagatgtaaatgtaaaacatagagctataaaatttttagaagaaaacagaaaaatcttcatgatctggagttagaaataacaccaaaagcacaatctataacagagaaaaactaaaaaaattggacttcatcaaaattaaaaccttttattttgccaagcacagttaagaaaattaagagacaagctgctgagtgggagaaagtatttgcaaaacacgtatttgataaaagacttatatctcaattatataaagaactcttaaaactcaataataagaactctcaaaaccaaagcatctcaatttaaaaatgggcaaaggatttgaacagacacttcactaaagaatatataaagatggcaaataagtacatgagaagatattcaacatcattagccatttgggaaatgcaaatttaaaccacaattacataccactatacacatactagaattgctaaaacaaaaaatgtgacatcaccaagtgctggcaattagaactctcatttattggtggtgggaatgcagaatggtaccaccactctgaaaaatcgttcagcagtttcctatgaagttatacatacactaaccatgtgacccagctgtctctctaccttagtgaaatgaaaatttatgttcgctcaaaaatctatatatgaacttacatagcagttttattcatgatagcccaaacctggaaacaacacaaatgtccttcaaaagatgaatgaataaattgggatacattcatacaatggaatagtactcaacagagaaaagaaatgatacacaacttggatgaaactcagacattatgcagagtgagacaagccagtatcaaaaggttgtgtactgtatgattccttttatttgacattcttgaaaaggtaaaactatagtgatgtgaaacaaatcagtggctatcaggggttatgcatgagatgagagtttgtatgagtagtcccagggaacttttggggttggttgaactgtaatgtgtcttctttgtggtggtggttacacaaatctgtacactaaaagaaaaaaattgttttaccctatgataattttaaaaagttattttttaaatttcaaagttcattctgttttctaaaactttgtatgtgaacttgttttgttttgcattttgtttggttttggttttctcctctctccctctgctttggggtaggccagtttcatccattgttctctacatttggtgggcccttttggaaactgatattccccagttctgaagggttttttattttcatttttgttgtcgttgattatttcctcccccctgccctcacccccatttttttctcattctcccttactgatattcagacattggacttcttagcttagttctctaattttctcatattttctcttctgttttctttcttttctcttcctacattttcttctttatttttgtctatttctggaaacttaattatatattctaaatcttctgttgtttaataaccaataattttttgttctctgtttatttttgacggtatcctattcttgtttcattgttgtgatcttttttttaattatactttaagttctgggaaacatgtgcagaactcgttgtgatctttttttatggtcatttttctttcttcttcctgaatagtttgtgtttgttgtgttgtgttgtatgtgctttatcttagatgctttcctttgatatctgatggcccttctttgctcatatttaaaaggaagatgaaaacactgattagaagttcattgtacgttgtaaggcttgtcaactctgagcttcactgtctggcaatttggctcggctgtatagttggggaacccccaaagggagtatgattagctctttcctcttggtctggttggagtgtccagagtggagactgttttggtcacctacatggagggatagagttggttcagtggagcaagagggctgtaggtctcagcattccaggatattcattcactctccctatttctggcccagtatcttgtcctcaactgtgcttgtttcttgctaatccagatgctctctgttgtaccttttcaagaaataaaccttcagcattctgccctggtggcaggaatgatctggggatctaattgcttctgaaacagattttcagccaacacttattttagccaactcccatctccccttatgtactcccactttaataggtatctggtgttgccaatttgagtctttcaggaattctcctacgtaaaatcaagttggttcttatttttcttcatgttagcctgggactcagctttctttacttgatctgtatgagtggaaaagttctaagtctagtgaacagaagtctgaagaatcattgaaacagaactatagtcatagcccctcaattaattcccaggctaagccagtttatagatccagaacctcttgaatgatgaaggggcatctatgtctccttaaggaaggaccccactgtgcagccaaaaatttacactgcaaatctttctcctagcctttcctaagggggaccctgctgccatttaccagggtgactgtgcattagaggaagggaaataattagacttttggggaattaccagacactggctctgaactcacactaattccaggagatgcaaagtgtcactgtggcccatcagagttggggcttagggagatcaggtgatcaatggagttttagcttatgttcgtctcacagtggacccagtggactcccaaactcaccctatggttatttccctagctctggaatggcatgcttggaatagacatactcagcagctggcagaattcccacatttattttcctggatttcctaagtcatttaccattcaccagtttgccactcagctttcaaattttattgctatcatcttgtcccttttgttttccctgtcttgtgggtccgtgactttgaaaagttgctgtattgttttagtggtgctccaggagggagagagtgtggtacccctggtcagtcttccatctttacctgaaacctctatctatactgttttgctagatgatgttatatggtctcatggctttgaagaccatccataaactaatgaaacctaatttatgtctcaagccctacttctcctttcctctgtgctctagacttgcatatataacttcttactcaatgttttctccttagatatccaatacacatctcagataattaattgccaaccctctccttgaaatactcatttcttatctaatcttctcattctcaatatcactaccagccagctactttcttcatacaaaaatcccaggagtcatcctcagatttttcttctctcctacatcaactttatcagcaagtcctaccagttctagattcaagatttatctagaattcatccacttctcttcatcttcatggcttctaccctgacggaagccattttcatttctcacctgggtccctgcagtaacctcccagttgctcccctgcttccactctcatcctgctataatctactgtctacacagtagccagagtgaaaattttgaattttaagttgggtcatgttccttccctgattagaaacactcaatgccaggccgggtgcagtggcccacgcctgtaatcccagcactttgggaggccgaggtgggcagatcacgaggtcaggagatcgagaccatcctggctaacgtggtgaaaccccgtttctactaaaaatacagaaaattagccgggcgtggtggcgggcgcctgtagtcccagctacttgggaggctgaggcaggagaatggcgtgaacctgggaggcggagcttgcagtgagccgagatcgcgccattgcactccagcctgggcgacagagtgagactctgtctcagaaaaaaaaaaaaaaagaaagaaagaaaccctcaatgccatccccgctacatttccatactatttcctctgcccacaaggccctgtacgatctggctccttgcttaaatctctgacttcatttcctgccaatgtcttccttgttccatctactctggtcacacaggctttttgttcatcaaattcaccaaactcactcgctcctcagggcctttgcagttgcccttttgtctctgtgaatatccttccccccatatcttcatatggctcactcctcatttcattcaagtctttgctcaagtattgctaactctgagaagccttcccagggcactctctctcctttctcccatatccccctctgttactctctattatgttatcttatttccttctggaagtatcttgttcattaactttattatctttctcaagtcatttgaatataagccctattgctctgatctggcatattctttgctgataccatcacagctacagcattacctcacctgtaggagatagaaaccaagagacttccggctgggtggctaggagagcatgtgaataaatacttgtgaagttgtatactgactattagtatgctgattcttctgaatctcacaattcagcctttctacaggattctttcccaccttgactgattctacttgaatacctttatgtgtcccctctcttcctgccaaaaaaatccgttttaggcccgaaagtttgaattcccaaagagcagattgctcagcctcttttctgcctttcacccagatgttgtaccttacaccatatgttgtgcagaaacttggatgagactttggtggaggggcaactagcgtacctttttggccctcagacctaactgagtatggtgcgggattacgagccagagattgcaactagaaatttaagtcctgttggctcactgctcagtattgggagtctgtttttgctttctgctttctcctagtcttttaatttttaatgactctgtctaccagctactgatcttgtcaaaacaggctaaaactagggcagggtggtagaggggagtaggtcagtttcatttcatcacgttcagaaaggagttgagagattacaaattgtgaagccccttttgtctggtcaccagcattaaatctgatacctcccagtcctcctgttcttgagttatacagcacttgtatttgtgggtccagttataagtttccttttaaatctgatgaagtagggatgaattcaagaaatgacccctttgcttttttgtttttcttgtgttttgtacaactcaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgca

SEQ ID NO: 3130 - DNA, 206581 bp, human; identical to SEQ ID NO: 3120

SEQ ID NO: 3131 - DNA, 202322 bp, human; identical to SEQ ID NO: 3121

SEQ ID NO: 3132 - DNA, 169078 bp, human; identical to SEQ ID NO: 3126

SEQ ID NO: 3133 - DNA, 206410 bp, human; identical to SEQ ID NO: 3123

SEQ ID NO: 3134 - DNA, 48279 bp, human
tggacaacgccctgtttcttgtcttgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagaggtgacagatcctgggcttgggggcttttgcgggagacaactcggaggttgtcccatccaggtgtcctctgtcccatcagccccaacacacccccttattatagcaagtactttgaaatgctcccgtttctaccctgaaatgaaatccatgggtaatatgcccaacccatacacataagaaaaaataatattatggtctaaatatgataataaagagaaattaaaaggaaattattgataataatatctatttcaatatgcaaatgctcaggcatgacctcactagaagacatcatgaagcagtcagatgtctgcacttgtcaaaagcaagtctggattaagtacagaccttcagaaactattccgaggggcaggagggcatgaccataaaaactggtacattcagtatatattagatatgggcaaaaaataaatactttggattagaatgaaaagggaatttggcttgactcataaataggcactaggtttttcccctataagagattctgatggaacatttaaaattgtgtgagacctgggacacattttcattgaccatcctctgcattatgggatggctgtcatctttggctcccatccaatcattgtaacaattagaatgatcccctagagggctcttctgcttctcttgagaaccagtgatcggtctaatgcccccattctttagtgggacacgcggaggcctagaaaggtgaggaaacttgctcagggtcacacatagcaggttaggtgtggtaccaggacccaacctaagcctctgaaatgcctgccagagctcttttcctccttgccatacactgtgtctcatggaaataggtactgatgtttacatgtctctcacagtcctgagaaagctagagataggctcatagcagtcaaaataggaatacagttttttcttacactggttgcttttcagtgccttaaaaccattctaattaggacaaggggaataaaaagtagcttcattgttttagagccccctaaattgggtatcagaaggggacatgtcagctttttttggcctttagattcttgctatggagatagatggtgtctacacattcaatgtctttcttccaaattccctacactcttttaagaaatggcattttgcaaaagtattaaaatgcaagtaaaatattttaatgtcattatcaaagtggagaaacaaaatggtgatattgttttcatcttatttattccacatttgtataactcctgccttttccccatccttatcttcaatagtttgttgccttcaattatcatcttttttccctcctcatcttttttcccttcctcatctttttttccttttaatgaaagagctaacctcctaatatccctaaagcaattgtttctaaaaattttccttggttattaggggaagacattgtgacacttacaatgaagagtgatgatcagtatcctgtagaagcatctttggcatacttaccattcacttcaattttatagttggctaagaagttcttttttaacttaagccaccttctgaaaatctttctttccacacttgccattcctttgcagcctggattaggcacccttcccataatatcctgtgcatcctcccatcctgccacttagaatcttataatcaaccactatgggcctgttttaccaaccaaccactaataagccattaatctatgagcaactcaagggcaaggatgatatcttattaatttattttattcaaagcacttagcatgaagctgacatatagtaggtcctcaatgaacatttgtggaactgaatcaagttttgcaaaaaactggttgaacattgagggcacaggatgactataaaggaatctgatcgttctcaccaaatcctttctcaggtcccatcattagaaatcttgggtaacattagccctttaggtataattatttttatccctttattttattaataagtcatccctgattaggattttatggattccaccagataacaccaagctgctcgtaaactatcacatttcactgctttgtcaggtttagacttaaagcagaactgaagaacagcaagtgccgatatcaattttctctgaacttcctcctgtggggcggtgagagagggatgtggggcctcctggggtttggaaggaagactgtggagatgcgttttaccctccacagactggcttgttttgcggttggctcaatagcatatcttgggtgtagtagttttaatagcactgcagagagccataaacaagaattatagccatcatggaattaaaaacatgcagtgtagaattaaaattagaaagtgactttttttttaaccttgtccaagaaacacaatagcatactgctgtattcatcagcataatctgcttctgccatctggtggccatgaataatactgacctatcagacaactgccatgctcagcaaatgctgcagtgagcatccctgtaggttctctatttggacagctggaatagccttgcttccaccatgagggagtggataatgaaacacagacaaatgaggctgtggtgacagcagctctgtgcttcttttggaggtgagactgtaaggagagagctggaggaccaagattaaaacctagaaattggctgccttcaagatctgcttgatagcaaaccccccaacaaattttattgaaggcaagggagtgttgtagaacctaagagtcaaaaagcaataacgtatgctgcccacaaggaatccctggtctagtggagagacagacaagtaaccaggtaatttcaatacagtgatagggaggctaagaagaaatgtaccaagtcatttcatagagcttcagggagggttttgtggaggatgtagcatctacatgtatttcaagttatttaggctctgattactttttttcccccttagtaattctttaatgctcagagccagtaatggctttatgtgatgctatcatttatgttcataaatcatggagagagagattcataagcaactataaatagataattatattttatatttcctttcctttcaagttggaggctgcagcataagtttcattggtctaagggaataaggagcaagattccactgcagtttcaggctgtagtggactaatgttctccctacctcagcaccagaaaaaggtattattagggagccattaatctagcctgcctactcccagcctagagcaaagaaagatatatgtttaagattgtgtaggaggggagcgattgaatggaaaattgagttgatgtctcccttccaactactcccctcctttcacttcttcctaaccagtaacacctgtaagtgactcttctgtacggatttaagaatgtaaacacttttccttgtgttacccatttagaaaagcccactgtttgcttgcataatgatggtggcattggaggtgggcactttaacaaggaagacatttatcttaaacagccttcggataaacattgactttggaggcagtttagcaaagactacctacatggttttgaagactttgctctgattgcttatgggagccaacatttgtcagaagaatcccaagcaaagggagatggggaatactatcacatcttctagacacagacactacgttcaggcagcgaggcacacggacagccaagtcagacatggatagaatcagaaagttcaagagtgctcagttcctagtttagggggcagcacattgaatggggcaaagaaaatggagccagcattgggcaggcctgtcagaaacaagtaacaggacctagaaaagcgcatggcagtaaaggcacccaccacagcccattcgaaatacagagaaatgtaatacattctaattttaaaagactagactttaatggaagcataaattcactctcagtcactcagcaaacatgtgatgtaaatactcccaacatgagttatttccaggtaccaacagttgaaaaatggactcacacaaattcctgaatatgtagcaatcagctcccctgagccagtgacagccagctcccgtacccagtgggtgggccgggcagctctgttttgtctgtgcctactttccactccagtactgatggcagcaaatcttccactatgttctcaacttttgttgttgttgttgttgttgcttatgttgttttgaaataagtcacactgaactcagaagtgagccctcttgtacagattatgagatggatccactgaaatgtatgcatccaatttcatattaatagtaagtgaaagttcaattaaaaaccattctgaaaatcttatttggtattcaaattagctaaagtaatgaaaactcacttttttttttttttacagccttttgctaacactcccaaggggaaaagagaaattgaaaatgccaagtgtatttcagtattactgctttttctccttctcagaacaccggagccggagcgatcgccgagagcaaagagcagctgcccccctttccattgcagctcctccactgccagcctaccctccagctcacagccagaggaggcgtgagtttaaggaccgtcactttttaacggtaagtttggtggccacctgcagccctatgcttgctgctgaggaaacatcagtttgtctgggagtcagtttcctgcctcccagtgagagaggctgggctggctaagagctcaaatcatgggcatttgggaacaaattaatttcccttcctttcattcctgaaagaaacgcctcttttttggaatacagacatattttttagttaactggtagcacaatgcagtaaagcaagaataattacagactaaaatcaggaaaaaaaatacatacttcaaacctcggttcttctgcttgcaagctgaaggattcaggataggttacttatgttctttgccctcagttccctcatctgtaatatagggatattaatagtacctggtttatagggctagaggattaaatgagataaggcatgtaaagtgcttagcccaatgactgactgatacagagtaagacctcaagaaatgttaaccacagctgccactactgttattactggtaaagtgacagcatggctgacttggtggggtgaactggtaaagaacttaagtgatacgaaaaattaccatttgaagagtaatcatgtcatcatttcatgctttcccattctccaaaggaggctagttctccagggtaacttaataccatggtgacgtcatcgcctctggggctttcagccctgaccagatggatgtggctgtaactcagcccaagccctcaagcatgggtcacagatgatgaagctgagcccatctcaaaacacctgcaaatactatcagcagccactacaaacacatcaccgcagatgtgccttctggggcctcagtggggacaactgagcactttgtgcctctgagcaggcatcattgaagtgagggactatggcttttgtgaccaaatcagcccacactgcctgtctgaatgtctgcattcctgctgtcttgtcattctggttcaagacccaaagtctaaagaagttacaatagtgtgggtacgagttaaggtttttattagaaattaaaattgcgtgtatgactctaaattgtgcactcttacggcttttacaatatgcaagagagatgcaaaatatttgggtcacatggtgccaaatatccagccaaaaacagactttatctaaatgaacccacatgatataacatccagataagaccttgagtgataatggacaaaatataaaaacatttttcctatttgtagctggactgcaggcaggtccttcagtgctcatcaagtgcacactgagcgccgtgttgcacttactacattgctgcactgcagcccaaggataagaaaaggagacaagggcctcttagggctttctagttcttcagatagagcagtttcacatgctagtgatttgtcataaagcagaagttcttaagcagctcaaatctgcttgctgaggcatttgcttttaatgaggcattttctgcataaaaatgctaaaatattttcccattcattataacatgttttatggctaattaagttggttttcttggaagggggaggtgaaagagaagaattttgagcatttacagaaattacataaaaatataaccctttctcatgatctgcataatttttaataatgtctaaatactaaagtaagactataggaaaaggcttaaaatgacgaatagcaacgagagtacatcatttacttacccaacaaacatcaataagagaagactatggattacacttaggtaaacttcagtaagtttgtccatcccaaatgataatacttagtatttctaagtaattttaactgttttatttgttcaagagtttgggtcactacaaggattagaagattttcatttgagttatatcccttaggcctggatagaacatagttcaagctcacaagactgtatattgctgaaagacaaatggctgcaggtatagagacaggaaatttgtagtcaaattgctggatagacacattttcttagacaactctcctttcatgtttgagatttggtgaaggcatgcttttcttcctttaagaaagcattcataatgagattgacatacagtcttctgcaactctgcaggctattgtactgtaccttggtcattaatggcatggaccatgaagctaaactgcctgactttgaataccagctctaccacttgcgagctgtatgaccctggcaagttagtcatttcagtgtcttggggatagaagtagatagtacctcatagccttggcatgagaattgaacgtggtaatacatgtaaacagtacctcatacataagcactacataaacatcagatgttattattattattagccaatcaattccctgaagtatctataatatggtgataagatcataggtccaaccgtgtttaaatcccagcactacaactttttggatgtgtgacttggaaaaagctattgtatctttctgactcccagtctctttatctgtaaaatggggataatatcaactttacaaggttgttaaggaggctaaatatgatgttttagaaataagattaaactatgtatatgtatttgtgcaagtgcctagcacagtgcctaaaatacctgaatgtgagtctatattcaaaatcgtttacaataaaattcttaccatcaaatgaaaagcctataacatatactcacatataagactagaggaagtataaattgttacactctttctagagggcaaaactctaaatattcataactttgatccagcaattttacatctaggaattcaccccaaggcaataatcagtgtatgcaaagatttattcactagggtgttcatcaaagcactgtttacaatgggaaagttaatcacaaatatcccaaatgtctaacaatagggacttagtttaatgaatactaatataactataggatagaatacaatatcaaaaatagtgttagagaagaatatttaatgacatgggaaaatgtatattttattatcagggatttttacatagtttataaatttgtgtatagtataatctcaaaaaatgtcaacgagtgtatatgtatgtgtacatatacatacgcatagggggaaaaggctggaaggttgtatatctgtgattcccaaactgtgtgctgaggtgccttagggcactgcagtgaactcctaagggtgccgtgggatattttaaaatttcaagggacaaagtgtcatctgtctggtggcatctggtgatggctccaaagtaacctcataactcctacaagtgagaagagaggatgcttggtttcttgacatttaatttgtaccaaaagttctccagggggaactcacaggaaacaggacaagccaatttagcataaaaccctaaaccctttgttagctgaaaattcaaggagtatctctaattaaagcccatctaagagtccttacttatcaagggtggcaaaggaggtcatttcagggaaaagcttccttaaaaaaaaaaaaaaagggggggggtatctattccatcctgctggattttgaaattctatagccagagattagtttaagatcatttatttgggacatgaagttactgtggacctgagctacagagaagagatcgaaacaaacgtcacgaaatcaacacttgcacatagcatctcaaccttttctttaatgcaccacagaaactacagctttaggctggtaaaggatctgaagagttatctgggcctagctaggaaccaaatgtaaaaagtttgtagtaaaaatgttcccaagggcaatatgaaagagaaattgcctgggatcaacttctgtccacatgaactcttggctgcagactgacttgttaagtgtcagaatactgattatttagggaaaggtagggagaggaaagggttcccggagaggtgtgtttgtgtactaaacaaaaacccagttactgaaagtcatttgcctccaggcagaatttctgggtaatttttctaccttgtctaggctgtggtcaaattgagaatggcaaatgtgtatcaaaacaggagcgtttgccagagctgtaacaggtagcctgttccctgcaaatccaaccatgtgttttcactcttggtactaaccattagaagtagtctacacagcctttctttggtaagaaacaatacttttatgtgctcaaaaactattagacttagacttacagtgctgatggctggaaagtagcctgtttgaggcaattgaatacataggttttttggtggatcgaaatatacactgagactcccaggtagctgactataatggtgataccctaggtccccatctcccattatttcctccaaaaatgatatagaacaagaagggaaaaataaaactacacagaaaaacacaccatcagcataacttgaggacagagaattcccaaacatcaaattgactgttaagtaaaagagagaaaacaccaagtctcagcatatttcctcctgttacaaggtgagggagggcagattcagaaagccacatggaagaaatgaactagcagtgggtcctaagattgatctaaaaccaccaccagaaaaattgtctgccctaagtctgaaaaatactacagattttttcagatagacacaaactacaaaaaagggcctaaaagtatgcatattttacaggagcagttttctctatataaagcttctgggggagacaaaagacaaacaggaagggaaatctgcccttcagcaattgggagtgaagaagaaaagaggcaaaaaggaaatttctaggaccctgcaagacaaaataaaaccaaaaaattcaaggacacgcaggagttgtatgtgtccttcaactcctgcctcaccaccaaaacaaacaaatacactaaaatatttgaacttcaacaaactgacagaagatggtgccattaaactagggatcttgtgaaacacaccaaagccacacaaatgagtaagagatagattagcagatccacatagagtgattgcaaaaggtcaatgaaagaatatatgaagcaagggttttatgtccaaccatgctgttcatcaagtatagaaaagcaattttcaacatacaggaacttagagaattttgcacccatgagtcctttatgaggcatctaccacaggacaagcttcatccaaccaagggataattggggaaatgtcagcaaaaggatgggtagcatacattttaatacatgtaaatgtagatctaaaactaaaagtacagtggagatgaagatagaaaactaaggtgcaattttaaatgttgtgacaacagagaatgatacaactaaaaatgagagaagggagaggtaaagaagaaaatagaataagctaattgatcactgtctaggcaataagtggctgttaaaggataccaataagaactagttaaccagatagtaaaggcttgaataataaaacagaggactaaggacattaaaatggtataagaaaaaagaagactactagcaaaaaaaaaaaaaatacaaatcttcctaaataccaaaaaattgttttatataaacagagaagacaacacatcttacagaggaagaaacataacaaatataacaaaatacacataattataacatttatcagagtttagtcatatcaatgaatatgagtgagcttaatttgcctatttaaaaacttttcaatttggctcacaaagcaaatccaactatatgctctatacattaaacacacacaagatttttatttattaattaggtcctgattatttgaaaaaacatgaccaagaaaaagagagagaaaacacaaataaaataagcaatgacaggaaaaaataccactgaaacaaaagaaattttaaaaattataagagactattttgcagacctctgtgcaaataaatttgaaaacctagatgaaatggataatttcctagaagagtaaaaattgccagaattggcgtcattagaattggtaagcttaaacagactgatttccatgggagaaccagaagaagttattaaggagccatgccactaaaaaacatcaggcctagatggtttcccagaggaattctactaaaccttcaaagtccagatgttcccaatgctctataaattgtttacaaacattgaaaatgaagcaaaacttccctattatttcttttatggagcaagtataacattgacacctgaactgataaagacagtcagaccaatatcactcatgattattgattcaaaaatactaaattcaacattagcaaacagaatataacatcatattatattaggagattaatatactgtgaccaatgggatttattctaggaatggaaggttggttcaatattaggaaatctattagtatcatatatcatattaacagatctaggaggggaaaacccatatggttagctccttggatactggctaagccttaaacaaaattcaatatctatttttaattagaaatgcccctaatgtttccatacatatgtatatatgtatgtatatatatctaatgttagagaaaaccccatttacagcaataacaaagaagaccaaatacttaggaattaatttaccagaaatgtgtaaaacttatatgagaaaaactttaaagcactccttaaagacacaacattagactttttcaaatagaaagacatcccctgttcttggatagaatgattcaacactacaaacaaatcagttctctctaagttacttaataagtttaacacaatttcaataaaaataccaataagctttattttatggagttagatacttatgggaaaacaaacatataagactagccaggaaaacactgaaaaaggaaacctagccctaccagacattaagatatagttaaagcctctataattacaatattgtggtattggcacatgaatagacagatatatcagtagaataaaacacaaagtccagaaagagaccagagtatatataaaaacattcaataaaggcaacatcacaaataactgaggcaagagatggagttttttaatgatgctggaacaactgcatagccatttggtgaaaggaaaaatttgatcagtgtttctcaacctcagcactgttgacattttgggccaaacaattttttgttgtggggaccatcttgtgcattgtgcaatgtttgccagcatccttagcccctcccctcacttgtgacaactcaaaatgtctccagacactgcactatgttccctgaggggataaaatcacctctagttaaaaatcatttaatgggatgcatactaccatacacaacagtaaactccaaatggatcagggacctaaacctaaaaaatgaaaccacacaagtactagaagaaaatatgcatgaactattctttgacctcagtccagggaaacactttctaactttggctaaaaatacagaggaaagaaaagaaaaaagaaaagattgatgcatttaaacagtaaacatttttgcatgcccaaacaccgtaaaggaaatcaaaagacaactgaaaaactgggagaagatatgtgcaacagaaaaagggctaatacctctaattgataaatacctcttaaaaactgagggataaagaaaagagcaaaaccttggaagaaaaattgaggaaaagatgtgaacagacaattcagaaaaaaatataggcatgtttcttcaactgaagaaaaattgttcaagctcactctcaattagaaatgcaggccagagcattatgcagcctgtaatcccagcattttgggaggctcaggtgggaggatcacttgagcccaggagtttgagaccagcctgggtaacatggtgaaaccccgtctctacaaaaaaatacaaaaattagctgggcctgatggtgcatgcctgtagtcccagctactcaggaggctgaggtgggaggatcacttgagcttggggaggttgaggctgcagtgagctgtgatcacaccactgcactccagcctgggtgacagaggagactgtctcaaaaaaaaaaaaagaaaagaaaaaaaagaaatgcaaacaacactgaaattccacatattacctatgagactggcaaaaattaaacaatgtaacaatgtattctgttagtgaaactggagaaacaagcactctcatacattgctggtggaaattcaaacgtggtccaacctaactgagggcaatttggcaatatctaaccaaactacatacgcacttaccttttgcttctgcaattctactacagatacacctccagtaatagaaaaaggttatttttttcagcattgctaacaattacaagatgttggaaacaacccaaatacctatacatagaagagtgatggagtaaaagaagcaggaagacctttatgaactgataaggagtgatttctaaggcatactcttaactgaaaaaggcaaagcccaaaaaagtgcctacagtatgctacccttcatgttagaaagaagggtatatagtcatatagcacataataatgtttctgtcaacaacagactgcatatagtctgctgggcccataaaattataatgtcatatttttgctgtaccttttctatgtttacctgtgtttagatatacaaatacttcacattgttttacaattacctactgtattcagtacagtaacatgccacacagatttgtagcctaggagcaataggctctaccatatagcctaggtatgtagtaggctgtaccttctaggtttgtgtaaatacactctaagatgtttgcacaagaaaattgcctgaggacgtatttctcagaatgtatcccagtcataagtgatctataactatataagaaaatatacaagtagccacttatttgcataaaagaaagagtccattctgctgtgacacaacatatgcatccctaaaaatctccacactgtacaaaattgcacaataaaaaacaaagggcttatggagaaaatgggagttaggggcacaacattcaaaaatttcttccaatgacaacacacacagacacacacacacacaaataggaacctaataaaatacaatagcacagttatacacattgtgaatggttaaaaaatacacaaatactgcaataaattggcacttcacccagaaaaagtcctgggggtgcctagggattgggcaacagaagggccacagcttgtgagttactgggaaggactggaaggaaggttacctgaaaccggagggaaggtcataacaccaggtgtgggcaggtgtggctcctaatatgtggagtgaactgaggtggctggtagatatttgatatgtgtgtgtgttatgtactcttatgcagctcagttcagctgtgtgcagttgctgtgttcatctagagagtctcaggttatgctcaaatgtgaatacctaagatatcttaggtattcaagtgatacctaaggtatcaatcacattggaacaatcaatcacattggaacaaatttgaatcaatatcagtcacattgatatcgatcacagtggaacaaacttgaattttcaaaacatgcgttataatgaaattgactgtacaggaaggaaaaaccagaaataaatgagatggatttccctacgggggatgagtgggagtggggtagaaagaatgggaggatgggatggtggtggcaggttcaagggggatggcatttctctgagtatattttttgggttatagctcaggtaatgttttatatatccccccataaataaataattatcatcaaccaggatgtgaggagaaccccaaatggaaaacaaacagcaccaaataaacctaactacattacaaatgaataacaaccaccctgaaagaggtggggaagaaaatagctaacctttaataactttggaaagcagtatttttgtttcattttaaccacaaatatttattgatagattaatgagtataattttaaatggaacagtaaggcataactgtggattaaaacaccttgcttcatgcctgtaatcccagcactttaggaggccaaggcaggcggatcacttgaggtcaggagtttgttcgagaccagcctggccaacacggtgaaaccccatcgctatgaaaaatacaaaattagccaggtgtggtggcaggtgcccattaatcccagctacttaggaggctgaggcaggagaatcgctggaacctgggaagcagaggttgcagtgagccgagattgcaccactgcactccagcctaggtgacagagtgagactgtctcaaaacgaaaacaaaaacatcttgctatacaaccaaaaggggaaagtcatacacttaggaattttaaatatgcaagtcaaagagcctttgaggtaccccacagatgactatcagataattcttcccttttatacaattcctatattacatcacttgatcacaaagttaaaattttactttaaaaggaatccctcattcattcacacttgagtcatcccacctggccactcccctgcttcccaccccttccccatccctttaaggtggtattctttagccattcccttcctgaataattgtgtgggtcaggcacggtggctcatacctgtaatcccaacactttgagaggctgaggctggtggatcacttgagctcaggagtttgagaccagcctgggcaacattgtgagacctctgtctataagaaaaataaaaaaagaaagaaagaaaggaaagaaaagaaaaaatagtcaggcatagtggcgcacacctgtagtcccagctactcgggaggctgaggtggaaggatcacttgagcccaggaggcaaaggctgcagtgagctgagatcctgccactgcactccagcctgggtgatagagcaaaactgtgtctcaaaaacataataaaaagaagaattgtgtgtccgttttccttcttaagcaaggaagcaagcaaacaagtaagcaatgagtcagagaaagtccaccaagggcagatttatgaatgaagagacttacacagacagatgttaggatgacagcaacctgattacttgattcagtgaagtctaaactaagctgactctagcaaagaagctgcactggcttgctcagaggcctatcattccacctcagattggccacaaatgcgagactccatgtttctaagggattaacagtggtctacatgagaagccaggaagccaatataaccaggcagctgatgctacaatacatttgatgctttagatctccattaggagctgactatagcttccagcataatcatttgccacatgtaaaatccttcaagatactgaggacaatctttaaatctcagataggatcaattaggaatttccttaacagtaatctatttgaaaatgtgaagtggaaagcattccagtgcacataacattgaggcataaaccatgctgcagaggtgtgaatgcaggaggctcaatagagtgcccagcctccttgttcaaaaagccatgagaaagcccccaggcatattgtcagagcagccattgtggtggcaatggtgtccccaaactaagcaaatcagcaggcatatggctattttctgaagaaccaacactgcactaacaagagtagccatgtagatatgtgtgtggagaatcacaggccagagagagagaatgacctgggcaagccacctagaacacttggttgtacacctcgtgcctttcaagaagagcatctccactaggtgcagtggcacgtgcctgcagtcccagctacttgggaggctgatgcaggaggatcgcttgagcccaggagttggaggctgcagtgagccatgatggcaccattgcactccagcctgggtgacagagtgagactctatctctaaaaaaaatttaaaaattaaaaaaaaatttttttttgagatggagtctcactctgtcacccaggctggatggagtgcagtggtgcgatctcaacttactgcaagctctgcctcccgggttcatgccattctcctgcctcagcctcccgagtagctgggattacagttacgcgccaccacgcctggctaattttttgtatttttagtagatggggtttcaccattttaaccaggctggtctcaatctcctgacctcgtgatccacccgcctcagcctcccaaaatgctgggattacaggcgtgagccgccacgcccggccaaaattttttaaaagaaaagcatctccatcaagcagacctttgatgactgactgggcagaatggaggggactaagagatggtcacattcttctgagagaagtgttggttcctgaaaagctcccagagagacaacatcccagaggcccatttatgagtgaacgtaaataaaaacttccagaccacagaactttcttgccaagtcagaaatatattcaataggcacagcttggggtgccacgtggaacagagggaatttggggggttaataaaaatcagggaggctaaaagaccaagtgcagttgctgcattcacacccctgttgggtgacagaagcaggaagcaaaggacatatggacaagattgaaggagcatgcggaagcctacagtctagtccagtgaaagagcttggcctggttccccctctcactttctcagactggatggatatgtggcgtcagcagcagaagagtggagataacatttagaaatggagaaccagtgaattcaggctgaagagaaatagactgggtgtactattctgtaatgccctgtttgcatcaaaggcaggcttgtgttgaccgagcacatctggagtcgtcatgcatcaatagtagcattttgggagacggggcatgatggggtagaggtggggctgttggacaggaggactctcaagttccagttgttaaatactaaagagcatggaacagtttagtctcagttcttcagtcaagaaatcagatgttcattttctgttctatgtccaccttctccaaaaacttaaaacatcctgtgaaagatattgcatcatccccatcccagttagcctcctggatggttctgtctgtgatgatgcccagtcgctcatctgagttattccctctgaccattatgcatagctcctgtaacagctcactgcaggagatgttgtctaacatctatccaaatcatataattaaaaaccaaagtgaagtttgctgcttcagctgtcaagtggttctggtccattcacatctttgctcctttcgtaatcatcaatgggtcagaaatgagccaaggttcttatgaatccacagaagttcagctggtcctccccatcttaaccaagtgaccaaagttaatatcaccagtaagagaacacacctgtacatggacctcctgatgtgatgcattgagataacacttctgtgagagacccttgtcaaaaaatatgttgcctcaatctaatcatgagaaaacatctgacaaaccccaattgaaggacattctataaaataattgaccagtactctttgaaaatgttaaggtcatgaaaaacaaagactcacgcctgtaatcccaacactttgggaggctgaagtgggaagattggctgagctcaggaatttgagaccagcctgggcaacatagcaagacctcactctacaaaaaaaaatttttttaattagccaggtgtggtggtgcatgcctgcggtcccacctacttaggaggtggaggtgggaggattgcttcagactgggaggtcgaggctacagtgagccatgattgcaccactgcacttccgcctggatgacagggcaagactgtctcaaaaacaaaacaaaacaaacaaaacaaattgaaggggattgaggaaatttgacaactgaatgcaatgtgcaatcctggattggatcctggttgaggaaaaaggcatcaatgggaaaactgacaaaatttaaataaggtcaatagattagttaatagtatttatcaatgctaatgacctggtttcaacagatatactatggctatgtaagcttttccattaggaaaagatgggtaatgagtaatgggaacactgtgctatttttacaacttttctttaagtctaaattatttcaaaatagaaacacacacacacacacacacacacacacacacacagttggcgccatggacatttcacagtttctgggttggcacttacaccgctagtgcttctgatggatatatgacttcaggtgaaggtgagttcacgcaagaaatgcttagtgcagagcttctttagtttatataacaaaatctagaagatcacagagaatctgatataaggtgattaaaagctgtcacggtattgagcactttggctccacgcacactgtcatagcatagattcccatttcagactatggagtcagttagccatagcagttcaccctcacccgctgctgaatggaatgttcagctcattggttctcatcagtcatgtctctcagtccaggcctggatctgcaaatacttgggacatgcacttgctcttctctttcgcaagcctaaggcagacattcctattcaattacagcactgttttccactgagtccacacagccactactcaccagggttagcacttgagttgaaacatctcctttttctgctttcaccctgcagtagagtccatgaggacccttgaagcccaagtccttgcttagattctgatatctggacagataggcaaggaggtcacccttccttaaatgtagtgggatgccagcagtctcaacaagttttcctctccaagcctcatcagaatgatcgaggggtgggatatctgatggtctctatggcagtggatgaagatacttggtatgagacggagcccctatggcaaaagttgatttggttccagaggaacactaagacctaaatcctcatcatcaggatcaacagtgaattcatttcaacatattgcctttacagttgtattgtttgccagacttgataaaattagccaggagcaaaatatcagggattctttgtcatttcacagcctgataatccagggattttaaaataaaagactgatgtcaaaacaaacctttctttttaccaaggatgtgtctttgaagggcaggggacattccaactgccttattgggaaagaaatgaaggaagtcactcaaactaggacccagaccatcttagtcttagtcatagttcagagctataaacaatgaccatgtttactctcccattttctatcaggaagaaaaaaacgggtcttatgagaaagcagcttctgagaaaaatcaaagtaacttacagaggagctagccaggagagaagatcaaagactagagctggcaggaagggtgtttcaatagtacttgaccaagagtacaagagtactataaagaccttctcactgccttgttttctttcccatccccagccccgtcttctcttgttcatcctcttccatccttccctttctctgtgggttcatttaagattttcagttttccattggtttacaatagagttgggattgagaaacgctgatcaagcctcgcctttgctatacaagagttagacatatccagacttgtcctagacaagtctattttacctttataaattgtcttcatagttttacaagctctctcagacgtattctgttgttttattaacttctgtctaaaatagttctgtccatccaaattaagtctttcttgctttggcttaggtgttctctgtatctcagataatttgctcctttaaaccagttaaggaaaatactaaccttgctatgcgaatctctgacatacaaattattctgtgatcccaaaccttcagctcctccattctgcccaaagaaataagttcaaatccttagcccaactctccagactttctacaattgggtcctaacttacctttcgagatagatttcccacaaatcctttgcacggaccatagacctcagccaacccaaactacacatgcttctccagaaaacctcctgtactctcgaaacaatatctccacttgaaatgccctttctcccattgtcttctcattgactccttcattttgaaaaaaattaactgaatgcctactattaataagtactagaaggatacaaacacgaatgagacataatctgtttcatccagagtacatggagactagaggcaattctattgtattgacttgaaggtgtgaatacctaactggtgtatggtgttggaatggggtggggtggcaggattaaacttcatgggaaacatagtatttgagaaggccttggaggatggggtagaattttgatatgaacactgggaggaaaaggattatagactgaggaaactatgagaggcaggagatggagtgtatacacatgagttcaaatactttgctttggctggtaagaaaaggggtgtgtcaatagagggcactggctataatgcttcagtaggccagatattgaaggatcttgaatgccagactagaaagtttgaatttatgccataagcctagcaaattattgaagggttttgggcacaaaaataacagtgacctgaaggagctatgctttatgacaatatcagggtatgtgtgtataggattaatttcctcaatctctagagattgctttttggtttagtagagagaggagcgtttgatgttagtgtcaggtataagattgcagaagtggtgatgcctatatacctcccatttaactcacctgtttggtctttggagaagagagatggatcttggagactggctataaatagctggtgactttagttgtatctgctgttcacatgtggtatttttcttgaagtaaatcagcacaacacctggcctatggaatgatacagctattgaccacaataaattcttttcccctctatacccattttcaaggctcaccagaagcagtttgcttttgagatcatgtcagctctcctctctgccataacataagctgcagagatcattgtcatcttgacaccccacatcacgctggttcatattgtcctgattggactcagaacaggaagcagcaaggaccttagataccttagtcaagagcaagccagagggtaaaagcctggttccatgtgctttatcagtcaggctccagtcaggaaaacagaaaccaagccagctattttcacaaagggaatttaacataggtacattattattacaagactgacagggcaaatgggaaactgaggtgacactgagatagtaacagcagcaagaagctaacattcccagggctggaggaatggaaggaaggggttggagttattggagcagcctgcggtactagaactcagacctctggagagtaaccgtggcctggctggtgctggtgcctcaggagctctggagctcagaagcttctgaggaactgggacccagacctccgagtatggggtgctgcctgccaggtgctaatgcatcagaagctccaaagaaggaccacacacagctggaatctagaaaggggtactggacggctgggtctgactagcatctctgacaggggccataatgaggctggttctgggagtgaggaaacagatgagggctgaaaccaattgccatagctgggggcaaaggaccactgctgggacaatgctaacagaaacagtgagtgccaagaagtaagtcccttcttcctcttccagccttctaatctccctcttgcgctcccactggaagaacctaacagggaggagctggcaagaaagaaatgtttgcaaagtcccagcagggcacagaataggttcagaactgagaaacaatagcttaatagccagcacaatagctaatgaaaacattagccaatgagtctggttcatattaaatactgtgagaaatagagaaaactccttagttttggaattctttctttctcttttaaatattggcctggctgtggaactgtcaataaaagtacttgtgtatacacatcattacagaatattctcaggttgacattctgttgcatgcctgagacttttttcactgttcaaaatataggcagacaatggaacaccactcacaataaaaaggaatgaattattgataaacacaacaacttggatggattgcaaaggcattattctgggtgaaagaaaccagtctcaaatggttacctagtgtataattccattcatataacattttcaaaaagacaaaaccatagagatggagaacagattagtggctgacaggggtaggggttgggggaggttgtgactataacagaataccacaggggagttttgggggagtaatagaacagttctatgtcctgattgtggtcatggttacaagagtctatacatgtgctaacattaatagatctgtactcaaaacaaataaaaaggggaaaacagtaaaggcagaatgtgcatggtttgtgtgtgaggtcttacattttttgctttttaaaaatttgcagtgatgaggtcaattatggctctgctgagctttagccacagctggcctgagttagcagtgcaaaggttcccttggagtgggcctgagtgtgtgacatttctgcagttaccacacgcctctgacttccccagctgagggccatggaggagtgctgctgtcacttctgggctgttctgttgactcacatttccagcttctctgatatgggtgagggtatttgcactgtttgtagcagttcaaagattctttcttccctgcacttcaaagcctggcctgccttttccttactcatgtcttttatttggttctagcaacctttgagggttgatggaactgagtggcccttggcagtggctccactaattggcaaagctgaccacaggggatgaataagatactggcatcaacatcacagtgatcatggtccagtgggccctgttttgtgttcttgacagtacagagcaattcctgggaataaatgactgtgctgaccagccagcaggaagcattctccatcctgggctccctatagccctcttttccattcatgtggggactattttccacaaatgttccaaaacataattggttatgctttgcacatttaaaatgcttcattaataggatgtgattaaacaaagtgttcttgaactttaaaatatataaaattattttgcattccattaccctaagaatttttgttccattccagctgagatcaaaaggagagagagagatgctttgcagtcacacattctctttcagaaagcctctttttgggtgaaaactgcaccattgtcatcgccattcaagctttgctcactagggacagttgtcacaccccaaacatctaccaacaggataggatttaaaagtgaatgagcatgtactcttttggtgtcttggctgcttatgctacatatacttttttgagattgatgttattgtgtagttttccattgtatgaatataagattgcacaatctgtttatccattctgctgttgggagatagtcaggttgtttctagttgtggggtattgtttgtttgttgacttttatgaataaagctgctataaactttataagtattttataagtatttttgtgcaagttttttgtggacatattcatttttcttaagtctatatacctgagatggaattaaagggtatacatatgtttaagattagatactgccaaatagtctccaaagctacaccattttacactcccaccagcatttatgagcattccagtcactctacatctttatcaacattaagtgttattaatctttttcatcttagcccctctagtccacagtgtggtttccttttgaattttcctgacgagtaatgatgtcaagcaccttaatatatgcttattggccttttgtgtgtgtgtatatatatatatatatatatatatatatatatatatacacacacacacacacacacatatatatatgtaaggtcttattcttgttttcaaatgtaacacatttgtatacacacacacacacacacacacacacacacacatatatatatatatatatattgcaaagtgcccctcaggagaatcaagaaagtggtgatagctatatctctcagggaaaggaagtaaaggtatgatttggaaaagcagacttatcaataagaggatattccccaggcctgaataacaatgcttttttgtgttttaaataaatattaatgtatatggtggttaaagaaataactcagtaggcacctgttcccaaatatccctctccacaaccattacccagaacttcgccacggtgattggaataaatcactgtggattgggtttttcatgatttgttgtcagcaccctaataagggtgcattttgggcttctttctaaccttgaagctggctgaaaggttagcgtgaagggtttaggcacttggggttaaggatggcatgccaggtgggagtgctgcattcaggtactttgggtaagcatgaaggctctgactgctgaggagagagtggtgacaaaggtcaaacccagaaagggaagaagccttaaaacagagaaagcataggatgtgccttaaacttctgcctacctcttcattgtgtttacccatgattgttcaccttgatgaatgtcggagttgaggagaggggaagagggaagcacagggtgaatgtagaatgatgttactaaacatgttgggaagacaagagcacaatgccaacctttgggagattttgagacagtctcaagggaataaaaaagtactacataattgtagcaacaagaatgacatgtgaagaaggcattgtcaggcttcttgaagcctttgagaaagatcaaaggagttcatatttatatatgatacatccacaaacactcctgcacaggaaaagctgaggccaataggacacagtatgtgcacaaatgcaaggatttggtttaaggacaaacgagccccatggtagagtgaaaataaaagcccatatcacctcactagaaacccagtgtggtttgcaatggacatctttgctgtaaggtcttattcttgttttcaaatgtaacacagcatccagcctccagtaaatatttttcatgtttaagacagcatgatagcaataaatcagctctgaaagtcaactgctataagtgccatgtggtatcagttagatcacaaaccaaagccaatttttcaaaacatttcctgctggaatacccacaacattttaacagatgtattttgggctgtttcgaaagaaaataagcccccatcagcatataaaatataactcaaaagaaagtaaaatatggagtggagggattattttttcttttggtagtaagagaaagattggggatcatcttgaaacccttggggaagtgcttgttcatagccacgaaaggggagaaattaacttttctcacacacatacctcaagaaagactggagtttgaaaaatcttccttcattatataccaaagacatttatttggctgcttttgagcataatgtttgttatttcttattctgaacactggtcataagtataattctggcttttgttgaagcaactcatgggaagctagggaaaggatttgaggatatgactgatgaggccagcagggacagagatgaagtgaaggcatcaaaagaatcatcttttgtcagggacaagatgggcatggctggtagttgctgattataaaatgctgcaagttggagtctgaagcttttcaaaatcagtggtagaagggccagaataggagtctggaaaaggaggaggaaattactcttttttttttttttgtatttttcttcaacagtatattatgaaaaatctcaaaggtacagagaagttgaaagacttgtacagtgaatatgcatatatatacccatgagggagaaattatttttaaactgacggtttgtttccactggggccaattttgatccacatcaaataaatgatcttgaatgaatgaatgaatgcctaacacacctcctaccacacttattctggggaaaccaaagttgttcactgccactcttgtactgagtgatgattccacaatcaggagtcccctgtggatctgcttccattatctgttgttttggatgcttcctgctcatgctgtcttatctcctcctgtgctttgctgtctttgaccttgtactggatgttgtactgaaaaattatatgtgggtggcaataatttgatgttatttctctagaagagaatttttgtttgcttatgccaggcacgtgagcatgttagctgtacaacacatatttattgagcgctattgaggcagtaaaaatagagttatgaacaagaaatggttagtctttctctgaataagcaacgagattcatttaaacagttgtggaagaataatttagttcatataagtttgatcagcatccagctttccctaaccttatccatcagcacccattaaggcgtggcaggctgagccatgcagagatgccctgaggtagcagttctcttgcagttgtatttcttagataatttagaaaaaatatatactgtgaactgattattgcattcattatataaaagtgtaatcagaaatactcagaacaatcttacttcttttgactaaacatccaggaaagaggatgctttattttatttttaaggtttttaaaaaaatatttcaatggtttttagatacaggtggtttttgattacatgagtgagttctttagtggtgaattctgaaattttagtgcacccattcacccaagcagtgtacactgttacccaatatatagtctttcatccctgaccttgctcccaaagtcccctgccccaagtccccaaactccattatatcactctgtatgtttttgcatcttcatagcttagctcccacttataaattagaacatatggtgtttggttttccattcctgagttacttcacttagaataatggcctccagttccatccaagttgctgcaaaggacattatttcattccgtttaatggctgagtagtattccatggtgtatatttaacacattttctttatccaatcgttggttgatgagcatttaggttggttccatatttttgcaattgcaaattgtgctgctataagcatgcatgtgcaagtgtctttttcatacatgacttcgtttcctttggatagatacctggtagtgggattgctagatcaaatgatagttctacttttagttgttttcaaattttatttaacttttattttaagttcagggttacatgtgcaggtttgttatatgggtaaacttgtgtcatgggggtttgttgtacagattattttgtcacccaggtatgaagtctagtacccattagttatttttcctaatcttctccctcttcccccctctaccctcccatagaacccagtgtgtgttgttcccctctatgcggagggccctctaaaatactagactaaggcagttactaattaatggcagaaatataactgtatatttatatacttatagctcattttaatattataaacttaaatactctgaatctgcagaccatctgcagggactctagagcttgtgtctaagtggaggaaccaaagaacacaatccctccacatccaagctccagagtacctagtttcaaccctcacaagctggaggttggagctactatcaatatagtggagagaccaattagctgaggaggaatctgctatggagtgtaacccaaggagaccttaactctccatcacaatgaccacaactgaaaagtctgtgctttctctgaacttgccatccttagtcattgtcaggtgtgacctcatgcttatttaatggggtgggtgggtttctcaaacagatgaaaaatgaagtccactcctcacccctcactactggaaaaaatattcaacaggagagctgacttaggagatttaagacaaactaccataatttatgtattaacattaatatcattctgcagtttctgacggtgtgattttttgaaaatactttcatgagacaccaaagcttttggtttctttgaagtaggttcctttcccatgtaggctttgctatcaggctaccttttttcctacttaacatgagttttctctctcatttacacaccctggtttcttacttgagacttccacatcattgtctgtggctgatttttaggagagaaccaggttagtgtctgaactcggaccacatatatcacatctgtcaaaatggtcactttcagcaagggagccatagaccctacaaaatcattagtcttaaataagatctagatcaaaattaactgggcccgaggaggagacatttgctttgcttaaacattaatgagcaactctttcagttaaaacttagaaaaatagaacagaattagacaccaagctttccccacaaaaacgcatgtctgccataggcttaagaataactaggcccagcatccatccttgcttccatcagaggaagcaaggatcactggcagtttcctctacttgtttccacctgtttgcatgaagatggtaagtcccttggattctgaggaatttacttcctcctgagatcttgagcattccccttactctttttttttttttttttccctccgagacagagtcttgctctgtcacccaggctggagtgcagtggtgcaatctcggctcactgcaacctctgcctcccaggttcaagcaattctcctgcctcagcctcccgagtagctgggattacaggcatgcgccaccacgcctggctaattttgtatttttagtagagataaggttccaccatattggccaggctagtctcgaactcctgacctcaagtgatccgcctgccttgggctcccaaagtgctggaattacaggcatgggccactgtgcctggctgccccttactttctttggggttcccatcactgctaaaacacacagagacaatatcattcaggtgcacaaatattttgatgagttcttacagtgatgcatcatggaagactgaaaggcaaatcaaatgtggcctctgacctccaggaatttgcaatctaacaaatgaaatagacacatccagggccaattcctgttccattaaagccatgctgtaggataagtgctataatagaggcccagctgaatctaaagctgatatggcttagagttttaaaagtttcagtggccttctcagtagatcctgaagaggggattctggttaccagattattctccagataggactggctatataatttctggggtccagtgaaaagtgaaaatgaagaatcctttattcaagaatttcaaaacagtgacagcacaacctgaaaccaagtatgggggccttctgagtgcagggccctatgggactgctacacagatcacacactcatgaaattggccctgtctccaaatgtggtctatgaataggagaaagaagtaaattttgagcagtctagagaaggaaattacacatagagaattttcttccaagtagttcacaaataaataaataaataaaatcactccaacgaaagcaaataattcaatcttctccaaattagcaagtggtgttggaatctaaaacataacaaagttacagtttgcaaagacattttcacagatatttcacagctacaaggtaagtacattaataataataattgttgtagtagtagctggcactaatgtacagcatttattaagtgccacgattcttctaagtctattacatatactttactcatttaatcctcaaaacagccctggagggaaaattctattatttctctatcttactacagatgaggaaactgaccttggggaggttgaggaattgcccctggccacacagaaaataagtggtggaggcaggatttgaattcagacagtctagcttcagagtctgtgctcttaaccactatttatgctacctctgaaaaaataaagataggaaggaaaggaaggagggagggagggtggtgggagggaggaaaggaagaaaggaagagagggaagaagaaggaaggaagggaaggaaaaaggaaggagagaaggaagaaaggaaggaaggagagaaggaagaaaggaaagaaggagagaaggaagaaaggaaggaagggagggaaggaaaaaggaagaagggaaggaagggagggaaggaaaaaaggaaggagggaaggaagaaaggaaggaaggagggaaagaagaaacggagggaggaaagaaagaaggaaggaagaaattaggaaggagggaaggaaaaaaggaaggaagaaggaaggaagggaagtaggaaaggaagaaggaaagcaaaaaggaagaaggaagggagggaggcaaggagggagagagggaaggaagaaggaaggaaagagggagggaagaaggaagaaaggaaagaaggaaggaaggagggaaagaaggaaggaagggggaaggagggaaggtaggaagggaaagaagaaaggaaggagggaaggaagaaaggaaggtaggaaagaaggaaggaggaagtaaggaaggaaagaaggaagaggaaaggaaggaagaaaggaaggaaagaggaaggaaggaagaaggagggaaggaaggagggaaggaagaaaggatggagggaaggaagaaggaatggaagaagaaaggaaggaagaaaaaaggaaagaaggagggagggaaggaaggaagggaaggaagaagggaggaaggaaggagggaagaaaaggaaagagggaaggaaggaaagaaggaagaaataaggagaagaaaggaaggaataataaggagaaggaaggaataatgagaaggaaggaggaagggaaagaaggaatgaaggaggaaggagggaaggaaggaaggaaggaagttatcccagtatattattttattaatatcatagatttggcctaaccagtatacactgtgttgtgtgcacgtttttaattttttctttttttgcatttcatgttcatagtttaacagcacccgttcgccctcccccactgaatgttgccacatgaccccgtggagtagaaaggtattggttctgagaacattccttcacggccctatcccactctgtccagacactcttccttttttccctcttttaactttatggaaaactttcttgtttctaactaacggtttttctttaaaatcaatttaaaaagtggtattttcctaacttgaattaaatagaatataacttagacagtcatgccatttgcctttttcccccattcactgccccccactctgcaaactgcatcacctaacactactcttggactttgtagtctggcagaggaaccttttcctatatttaatttatcagaactgtaaatgttcagcttctcaaatcaaaaaggagaacaagacaaaaggattctctggcagccaatcgtcctgtcaccattaaataaaaagtgcttttggctgctggtcagagcttgtagtcaggtcactatcctgtcgacactttgcagtccattgttattcaaggaaggaatcgcctacaaaatgaagcctctggtggtggggggtttctctttattgctcattctctctctttgtctccctctttctctctctctctctcaatcagtttctctctctctctctctctgtatgcaccaaactttttttctttttggaagttacctaggaaacaaagtcttttgttctcgaactttatttgagctattcgcttcgctgggaatctgcacaaaagctgaagagagaaagaaggttgcaatattttactaaaacgttcatgacgaacatatttttcccaaggggggagtcatatcctgttgggtgtgttggggggatttgcagaaacctctgacaaggtaagtaaatgctgggggtgagtttagacaagtggcattggaatcagctctttaaggggacttgagaacagttcatttgacaataggtgaaatcctctgagtcaacagggcatgatatttccaaatgtaaagatgggaaaattttttttgatgatcctaattttagggcagaatattattaaagtcttactgggataacagcaaaagatatttattttatacagatacccaccttcctccaaattgtgtaaaaaataaataaaactaggttgagtggtgaaaactgagtcttttaatcatctagtttagaaacccaaccctgaaatcaaaactgggatggagctttttaaataatctgggctaggagcccaaccctgaaataaaagttagacaatattgatatttatcaaaagtttggatggagaattttccaatgtcatgtagaaatcaaagcccctaactatacagctggaggaaaagtctcgcaccacaaagctgaaaagaaagtaaactaggactctttcacctttcctaatttgaaaaataaactcactggaatatttccccccagtaacagcatgtgtattttccgctatcgttggtagggggaaattcttcacttttgcttttccatgtgcatacaagtgttcatgaaactgaatttttaaaatgttattaaaaaatgccgtagtcctggagtgaaattaactcctcatgttttaatgtggcttctcagattaggttggcttgtccttcaggtgatgggttctggaatgtctcctgactccaggttttctgaaccttttcataggtgtctaactcatcttcttcctttgatcctagtcatctagagatctcaaaacttttgatagaaatttatggtgagatagcttgaaagtggatctgtctttcattggagtaaagactcaattttctttggtgtaaagtttggggatttctggctaccttgtctctcctgttaattccatttaacctgagaagcatgtttatttagcccatttctttccttttgtgttgcttgactattgaaataatacttgtaattagttgtgcttactaactatttctaggaattcttcctttgtcctaagggcctatttctgacctcattttttcttctctaaactaggaaattccttatatgtgtgcttatgtataaactatgatggctgaacctgattgtactttgtttgcagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggtatcgttctggttttttcttaggggcagtcgggtcagaatattctgtgtattaaatatgttcaaaatctgtgctgctaagaataccattttgtaaacaagtaatgcctttttgtcatcaaaatacaaacccagaggatgttcgatatgcttttgtcaggttttgaacatcaatttacatgttttccgcgggccacttgttatgtaaattatggacagtttctttttgaaaaaaatcaccaaatagctctttggccatagctgactgaaataatggagaaagcggcagtgattaatcatatgataatgatgtgtggcactgcaagaaagaaaacagcaaacccaggcttctcaaactgcaagtaatggtcctgtaggccaactagaaaatctgttttcatgcttccttggatgaaggtaggctttttaaaaaagactgttaagacttctgtattgatttgggggatttttgacctaaaaatatatggatacagagatgaaggctgaattctattttaaaaccagcaaggctgtcttcctttcactctctttttttctcctcctgtgtactgagagtgtgaatattagtctagatagaatggaagcatagccagacctttctgaaaaatttattggcagcagttataaattccacaattggatctagtaatcttagtcgtaagtaaaataatgttataaaatattctaactttcaaagacataaatggtctatccattgggctttcttacatctctaatagttacattttaacttatttgtatattgaaaatttcaaaacagccatgttatgactgattttcatattggtaccatgtgactaaagattgcatgtcacttgagatgcatgttgcacacagctatcattaaccccactcagatttctctcaaataaagtggggaagcaaatggaccagatatctgggacagatattatttttttcctgagaaaaaaggagtcctagttcatgggtctgtggtgagttgggagttaattttcctgatgacctattcaacttgtaagataaattattctaaagatgtgcccctatctgatctccacaatctaaatgggatgtattaggggagttcagctgccaaaatggatcattttggcaccctcttaagctaattttcatttctggaaacctctgattattagcagcacgtgcttttttcatggcactgtaagtaaaatctcattttcaaatttagtgctatgattatgggccattattttatgattgagggaaagggacactttttccttctgctttatttcaggaactctctgattaaaacttagatcagatgttgatttcaagagctttaatgagaacattgttaatgatgtccacataacacaaaatgtctgcgtctatatataatgcattctataattactaagatcagaatgaaggattttaattttgggttggaactaagaaaaattccattagtaagaattctccaataatattgtaattattcatcatatgatatctcatacagatttttcaaagtgagttctagaaactgttggcactgtgacgttaaacagaactcaactctttcattatacagctgaaccaagacttgacacaccacccagccccatgcttaacaatcaggataaatgatgaggtgaccaaattccaaagcacggcattgtgactttctgaggcaaagctcactttgaaaaatccatggtgcagacaagagtttgagttcctcacctcccctctcatcattctagttgtgatgggactgcatgtaatgttgataatgtgattatggagagagaaactaacaagcaccatggtttgccctctgtgtttacaaaaacaaacctatgggataaagactggcaattccagctttacagttggtatagaaggtggatccatttaagtgcagaactggggactgccttgtatgtttattttatattgaaaagacatctcatgctaaaccagaaagcattcagtttagtaaatagaagaaagtagacagagttgggtgatgatttaaaaaaacaaatccttagactgttgagtttcctcacagcaaaagaggtgtgtgtgtgtgtgtgtgtgtgtgtgtgtgtgtgtgtgtgtgtgcgcgcgcgtgcgcgcatggggaatgcaagaaggtttggaccataagagatggagggaacaaaacctcacaaagacggcttttaatgaagaaatgggtcaggatatgttagctgagctaattcaggttatcatcctggctgctgatttactatgcaaaggtatcagcttcagagagcccagaaatagatcagtaaatagtagtaactaaaggttataaatccttaaggagccatttctatgtgagagggattttttggatgtctttttctcttctctttcttttgatttttcttctttgcttgtttttgttggcagtgcaaactgttgtggagagctgcatttagaagtaaagcttaatgtactgcagcataatttaaataagagctgaataacagctcccttatatttgttcacaggcttaacccaaactctttccttacttcccgtcaaaaatatcactgtgttccaagtaaatgaaaatttgtttgccatttctaaagctaatgagacctatttgtgggttgcaggagttggctttgacagagaggctagtatacgctgctctctggttcattcacaatcggtactacagcggagacgaaaattgaggaggaggaaaaccatctcgggtatccccagaagagttcaacaagaaataggtgtgatatcaaaaaatgttaatggttaacattcctccgcctagtacagatgatagggagatgaaatagaaaaatgattaaacattttaacttgtagaggttttaaaatggtgtctatttgttttgtattcagcaagccaggtggtattactttttaactctttattcttgactgtgaagatttgaccttatagatttaggcatatacattcaggtcttacggctgaaatgtaatacttagctgatttttgaaagttttattaaggtagaaattgtgaataaaaagtagcaggagtcaatgaaagttttctttttggaaaattgtaacttaatttaagagagatatactttcatgtcattaattattttaaaaggtaaattccaggcatatgcaatgaaatattgaatattgataatatgatacctttggtgacaatgtttctgtttagtggatttaaaatatctctgcctatgatttttaaaaaattattagggtatcatctcttgcaaataagatttttatttctaataatgagacctatgatttttatttcatcatgtttatattacaaaataaaaatgaagagtagtggccaaaaagataaaatgtactttagtttttaaaagtagtcacttattgtggcaaattaacgtgatagtgaagagagggataattcacaaaagacataaaagcatatcttctcttggtatgtatatatacatatatgagggggacgtgtatatacaccctaaagcattttaactctcacctaattctatatattgattttttttctgttaaagaaaaaaaaaaacagctctaacctgccagcccacagatctacagacatagctcagaatgtctgttggtctgctgatatagaaaatatctcactgtgctttccatgtgccctagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaaggtcagtcactgataactttgtcataaaggaaatgtgtctcatggcacttcctggaattttttcttatgttcccaataatacggtacagccctgggtgttggtttccctccactatttctttgcacttattaaaacaattgagataaaagcttttgttactgggtgagtaagctttgacaggtatctctctcatttttaaaaaatggcagcaaggtaatttctgtttgtttgtttgtttgtttgtttgttccctgagtcagtgaagtacagtagcgtgctgggtaacttcctcttaaagattcttctgttcttattttaagaatcatcaccgagtgatgactccatcatttcaccacttagtgaagactcccaagctgaagcagagggtgtgttcgtgtctccaaacaaacctcgaacaactgaggatttatttgcagtcattcacaggtgaggcaacattaccaagtcccccaaaacaaaaggtacaacaaaggttttgccccttcaggtacttctcacaaatgcaaatacaggaaagctttttgtaattgtaatacattcagcaaaaacaaaagcaagcaaagaataatttttccaaatcaagttgatagactgatatgcaagttgggaaataggatctttatatagagtttgatagacctcgattgagagacttttgtaagagtggctttatttttccccaggaaaagacattctggaacaagtttttatgtgaaaacaatctgtggttaagtgacttggagtgaaagctcaaactctagtgtaatctctgacttttgaatactttcttgaacctaaaaaatatgatcaaagctgtagtcatacaccagcagagacaaacagaagttgattcaccatggatgcaccaaaatctcagaaatcaccactaaagaacttattcatgtaaccaaataccacctcttcccccaaaacttattgaaataaaaaataaaaaactcacattgtaccctataactatatacaattatttgtcagcttaaaataaaataaaacttagagaacacacacacacacaaagttgatcacaaaacagtctcaagtttgagaaaagacaatacgtgttcctgtccattttatagctcagaacaagtaataatttctctgtttttctttcttcttagaacttaaatttctttaatagtactggccttcatccccaaaattaatgcccatattccatgaatacaggtcttttgggttgcttttccaggacagtgttgtgtccatgctgcaaaggcatatttcctcatctgcccccatgagcccttgtgatccatggtccatatttgcaaaaattattccttatagctaatgaccaaagaacagaacaggaactagcccttggacacctaatctacatataactgagctagccaatcatgatttgccatgcctcctcctttcacaaacacaactgtcttcttagacctcgggaacctagatggaactcccaagagatacaacttggggattgtcttttctacctcataaagttatcatttttgaaacaaattcatcgtaagcagcttacaatctttttctcctggaattctactttttataggaatttctgttttctgttgatgtggttctctcataaagaaggagtactgctgttcaacaattgttttaaaaggagccaatcagaaacaccttctatgtataccttagcaggcatacttctctactcagagggtgaagaaccattagtttcttttccttcacccctgtgcctagtctaagctctgattatatttccctcacccccacagtttatcttcaatcccaggaaaaattactaaactgctatgtaagttaaaaagttactcccaaaggaccaaatgctagtgtatggaatagtggacaggacgtaaatagtggggtcagaaagacctggatttgaatcccaactctgccacttcctatgcagtcttgagtaagttaaaacctctggacctactcccttattgcacatgggaatgcctatagctcacgtatttgattttgatgataacattttttgtgtttagaatatggtaggtgctaaaagccattgttagtttgaaagccctaacttagtggagtgccagacactgccatatacaagatatcaaccacagaggtttctgtgaaccaaaatcaagcatatctacacttgtgaagttcacattttctctaccatatgaatctttaagttgatgaaagtgcatgctgcctatcaatgaactgagtcatactgaagatccaccaaatttatgcctgctgatttaccaaagaaaatcaataatatgatgatgggagtcaaggttcaatagatgtattgagtttggtaatcttagacttgcatttgtgcagggtttacttatttatctatttacttgtttatttacatcacagcaaaaagaattattttgttttcttgcgagcttacagtatacaaagctttaagagctccagagatggtctgggatttcaattccccacagagagctggcttactgcttaatatgctcttgatgctcttaggaagctataggaaatgatacttgcagcccaagatgaattgacttaaaacgtcatttaattatgtttttatatggagggattttaaaaggtagaatagtataatgtctgctgacatatccatcatccaggattatcaactgtcaaactagggccaatcctgtcccacccacacctccatccacttgctttctctggtattatttggaagccaatcccagacatcagatcatttcatctgtattgcagagacagagttaataagaaaaagttatagtctttcaccccctggaaccagaagtatagtttagttagcagtatagtttcttccttttttttttttttttttttttttttttgaggcagagtcttgctctgtcgcccaggctgctggagtgcaatggcgtgatctcagctcactgcaacctccgcctcccgggttcaagtgattctcctgcctcagcttcctgagtagctgggactacaggcatgctccatcatgcccggctaatttttgtatttttagtagagacggggtttcaccatgttggccaggatggtctcgaactcctgacctcaagtgatctgcctatctcggcctaccaaagtgctgggattacaggtgtgagccactgcgcctggctgttagcagtatagtttcttaaacttttacaaagtatcctctagaacctctagcctccacattagccattatctgaaatgatcatctctagaacctaatttgtgtcctggttatcagagaatttctctcagactgtgggtgctacaaggacaaggaacatatcttacttttcatctctatagccctaatgcttagtatcccatcatataggacaggctcaaaatgcactttagacagatgtgtgaatgcgactgaatacttcagtttcataaaaacgtgaactgagtgagatgtttgccccattttctccttttctcaaagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtcttaaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaatt

SEQ ID NO: 3135 - DNA, 100685 bp, human
tgatttgccattcaagtgaaccctggagggattagcagccagcctagcacttgggtgagaccatctccccctccaggggggagtcctagatgcagcacagaggttctgtgaaaatctgccatcctccttgcagaaggttgccctctctcgccctccatcccccccgccgtgcttgctgacttaagcagatcagctttcagctctctggcattcagagacgtctttgcataaaagaaaaggcccttccttaaggagcagagcgggaatccaagcatggctctggcctgctgcatgcccaagaatgcaggtatttggggtttgcagcatttcttggcaagacaaaggggagggggaggctgggtctaacgaagaggggcttgtgctgtagccacttcctattctgggagagaagataactatgtttcccaatgaaagtgagccctttcacaggaacagctgtgaggaggggaatctgcacttgaccctcactcaaggctgactttgacatttagggtcagtggctcctaagctttgaggaccttgcattgttcatactggctggccaacgttttcgcctttgctctccttctgaggcatcaaactacccaagacaaagaggacaaccctttcttccttctcctcttctgctccgacatttgaacgtcttaaagaagggccagagggtagctccagtagagattccagggcaggattccggggctctagctcaggacttctgggaaggggccccatcctgcatgggcttgcaccaggccctatgttgctttcttctcctccagcactgccccctccagtcttcttggaattcttcagtatcttaccttcatcctgagattacagagaaagacttgtttatctcccagtgtccccaaaacagccctaaactgagagtccccagacccaaatcccccaacctctcgtttctgttacatcttcaatggccttacacaaatctgttaaaccactgtggggcctgtcttgatttctttagccctctaagccctccttcactatacttctttatcacataagtttggccatgcaattgaaccctatttgaaaagcattgaactttttacagtattcttccaacactggggttattagtccttcagttgtaactcaggctccttaatgtcaaggacagtgccttactttcatttcttgctatgcgctattaggttgttctgcaggaggtggccagtgtgacagttgacgctggccactctccttgcctcagctaaaccccttcactgcacatttgcctccactgcctctgcggaggctgacacagggccaagtttcaagggtctcctattagcccaacagctaccaacaccgtgtatgcagcctttcttaatgaagggtttgtcctacctgctgtctgagaacactctctctgagctgcctttccaggccatgatgatggggaagcactgttgtgtgcagctttgttacttaagatcgctcaggagaagaaggaagcattcctgtgaaccaggcagcttccaatgggtgtcatggagcctctatcagtttgttcaggacattgtggtttctgaattttatggcagagaagttgttcaaatgcaagtccctaatatcatatatatttatgataaataaccattatttgatgggcaggccaattataacaattaaacacctcagaccaatcaaatcagaatctctgggagtgggtcccgataacagtgcatgtttttaaaactccccaggtggattccaatgtgcagccgtaagaagtaagaactgcacttccacccaaacccccaattcccctcagggaaccaaggaagacaactaagggcctacattcatacattttcatacagatcagtggattcaggagagagcgtccaacagccagatagtctttatttattaggcctgaagaactaagtaatgggagagtaccaaagaaataaggccctgccagaagtttcagtttaggctcaataagaaagatgagaaagcctttagaatagctcgacccagttttccctcaagacttgaagatccaaggcctatacgtggctgacagaccaggaagggactgggcgggggtggtggtggtgacagggctacttgacagagggctcaacttttttgaagctgctggcgtgtcatgagtttggctatctttgggcattagtctcagcaatgtcatggtactcctgccaactctggatggttcacaagtgggaagactaggcccttaatcaaagatgccttcaagtaggacttggcagatactgcattcagcacaataaaagctgaagggaaaatgactgcttttaccttaacgcaaattttattaccaccaggtttcattataaaaatgttacaggtttgggtgtgtgtttattacataaacgatggagttactctgatcttcaccagctttcaaactggaatctcaaagggagttctatttgctagatttaaagctgtggaaccattgtttctcatgactgccttataagcataggaataaaatgcagggaaaaacaaactctctgttttctttccttctcgacccctgccaaatttccccaatctggaggaaggcacagccacgtgctggatgttgtagctgatagactatatttgggctaggcttaccagggataggatggtcttcaggaaaagtgggaatgtgactcaaatttcaggctcctgttgcgtctagcttagaaaggtgtcctggaggcttggacaggtgtgagaatcacttaagctgatcaggcaaactctcagaaacacagacccttatgccaacccatagtcagtggtcacaaagtacaacagctactgtcattatgtgttcccagatctctgggcatttgtctttcccagaagcaaagctttcatgtcattatcagtgtcatcttaggtcccttagttcattcctgggaaccctgcattcagagggagcaaggcataggctgccactgtcttatggcaaagaccattttgtcaattttactgatgttctgtattttaaaattaatgtacctgattttatattctttacttgagattttaaattattaaaaatatttcttaaattgaatgtttcaataaaaaatgtgagaattgaaaactacaaatttacctcagagtatagctttggtaatttccattggtttttctatgtgggcttattgttattggtttcatcctctgaatagttagttttgggcaagacagcatggtgtgaggaaaatgggctttggtgtctgccagatctggatgtgaatctttactctgccctttatcagttgtgtgactaagttataggatcacaacttccttatttctaaaatggagataataatatctgcttgttgtattctttaaacgatgatgaaatgaaagaatgcaggcaaaggacttagcatggtgcacctagtagatgctcaatccatggttgctatggataataatagcaaaaataatacatcactggcacaggcaaaagctttgtggctgggaagtgctctccatttgcatgtcttgggcagagggccaggacagtgggtatcctttctggatcaaactacttatcctaatgtcctccagagacactggcagatgggacatgaaataccaacagtgtgcctaggggagggcatgcagccaaatgttacactgaattgagcacgccaaggcaatccaggaaaaaactcagcacaaaaactcaccattcagaaattcccctgaactgtcttgatctcattttctcttgtgggatgttcctcaatgaactgagcttccctaccccagatctggcttctttcctggctacccagctgggttgctttcccctctgtagggttttgactgcacattatagccagagccttgagggaagtgagcatttggggagcaaaactttatggagcagcatctctgtgctgggaattaggcttggctctgagcatcaaacatgactaagtcacagttctgttcttgaggacttccaagtcaggtgccttagtccattttctgttgctataacagaataccacagactgggtaatttataaagaaaataaatgtattacttacagttctagaggctgagaagtccaagatcaagtggttgcatctggttggcttctggtgagggcttcatgctgtgtcataacattgtggaaggcatcccagggtaataggggggttgcaccgagagccaaactggctcttataacatatctactcttgtgataaccaccccattcatgtgataacccatttaatccattaacccattaatctattaatccatttaatccattaacccattaatctgttaattcattaatctgtttatccattgggttatggaaagagccctcataacccaatcacttcttaaagaccccatctcttaatactgttaaattggagattatgtttcaacatgagtttctgaggggacaaacattcaaaccatagcatcaggagaatactgacccatgaacatcagaaaggctaaacacagtgcctttaggcccatccacaggaaggaggaaccaactctttcttgtggagtggcatgggaagccaagtgaggctgatggaggagaggacttttgaactgactttgtcaggataaataggttaagatgtatcaagttttcggtaagtttttaaaaatacctatttgcctttggttgattcttgccttctctgagtctgaggggcataggaggtgatggaggagatggtaaggtttaggaagagataaggctgcaggaagctataagcaactgtaatctgctatccacactctctccatcctgcagaactccactgtatatagaggtaaactgaagtggaagttacttatctgtgttcaaagcagaatcttctagttttctctgaagcccaccctgtacttctgaatactttggtgggtagcatggctctttctctcctagtctttttggctcagcaagaataccggaaactccactctcctgaagggtattacttttcatggccttgcatgtggctataactcattgatcttgaatgtagctgcacccccggctcctgaaatggcagaaaggacatacagaagggaattaatctcagccatatccattcacaactgaaacacagaactggttcttcagcatccagaggccaaatgtcaagctccaataagaggaaagatgcaaatgcttcctcagcttcaaggaactgaggcctcccaggaatgttgtctttgctcctttcttgatcccacctttgcaattgagtgaggaggaagttttcatttattcttcaagatagagtaaatcactcttctctcaccaccttgtctttgtgttaatgcttgccatggatgacatttggccattaacagctaagctccctcttccatctaagtttttatccctggaaacattcacaggcaagtaagagctggatgattaattttcgaataaggatgtgtttgagaacaggccaggggcacacatcaacagccacatagccgttggcttaaatggatgataaattctgcatcccaactaatacaggcccatagtccctgctttgaaaaccaggggtgatgacaggggccatgggtttctagtgctttccacacctgtctcagaaagcaagcaaaataaccacttgggagaattaagataattgtgtgttgagtgtttttccctaagaaagagttgatctgttgcttcttttgattaggcttttatttttgccctttccctctctccactgagtttctagttgcttcttttttattttattttattttatttttttacacaaaagacatcatgggtaagaagaggagattttattttgaagaacaatgaccacattaacaaggtgacaacagataagctaaaagtcactccattttctgccagggaaaaatgtcctttgctgccaaatcacattctgcttctctttgtctactctccttttataggagggtggcaggcccagccactgatggactcagaagaaatatctgggagataagatacacccttgattcatatgagaaaagaagcttttgagttcaatgataaaaaataacttcctttcctgttccacaacattcttgtggctggagccctctgtaggacaacgacatttctctccccttggtccaacatatcacgctgaaaataactatgaatttggaaacttggtaaagggcaaaaatccaatttcttgcatttaatagatatctaggcttagattagattctgtaggtatagaatctgccctacatcctgctctatatttggggcaaagctgagaacctctctatctttaaagtgtcacagctgcatttagagacccaacccattcagcattctgtgaaagaacagtagaaccaaatatccatgtgtgattatattcccaagtgtgtctatttaaaaaaaaaaaaagaaaagaaaaaaacaaacttcaaaatgattggagaaagaaaaactggatgtgggatggaggaggtgacaagggaaagggaaggaagcttctaaggaagtgagatttgagctaggctttgatgaattggtagaaatgtattagccagagaaacattttagggtatatctttttgttgttgttgttgttgttgttggagtcttgctctgtcactgaggctggagtgcaatggcacaatatcggctcactgcaacctccgcctcctgggttcaagcgattctcctgcctcagcttcccgagtagctaggattacaggcgcaggccaccaggcctggctaatttttttgtatttttggtagagaaggagtttcaccatgttagccaggatggtctcgatctcctgacctcgtgatccgccctcctcggcttcccaaagtgctgggattacaggcgtgagccgccacgctcgacctagggtatatctttctaagttttggtttcttctataaaatctcataggcttgttgtgaagatttaatggcataattaaaatagtgcacatggcacactgcttgggacataaggactgaataagtggttgtagttgttgtcattgctactgttattatcattgcaattaggaggtggtattggaagtatgtgaaaagaaccttcgtagggacatgatgctattaccacaggtaattaaacccctttttcctgacccctttttctctgatcttatcccgttctttctgagactgtcatcttttatattttggcatactttggttaatattagttcgcttctggcaagatgaaagcagacccaaccaagtatcaaaagattttttttaaccccgctccatttcccaatataacatcttatacactgatttacaatttcagtagtgggtggatattcgagtgaagatgtaaatataaaaccaatagcttatgctataatttctccaggggtctttgtttttagcaacttattttagcaatttcaaaaaatattcactccggttattttgattttcttctaatctgtttatcttccagtgatttcattcaagtcacaaaggaaaggtgtttctggaaataagcaatgaaacatttcttttttaagtttagtagttaatatggcagtatttttgcctcataagtgatggatataatgtgtttgagaggggcttgtccattgatgttagggactgaggagattgtcacatgcagtggttgggggaaaccaggatggtaatgttaaaagtaatttaatgactcatgtgctcaggaggattatgctaattgcttggtcatagcttatcctcatcacaatcctctgatgcaggtacagttattcttctccttccatagatgaagaaaatgaggcttagaatatttacataacaacttgcccaagattacagcttagttgttgcagagccagaatttagactcagttctctctggctccaaaacctatgttttgtgtgtgtttttctttctttctttctttctttttttttcccagtaggttatactgtctgcagggatttaaaaataatgatcccaaactaaacatgggagtgatgtttttaggttatcatacagtgccttggggaaagtgggagctctcaatgaggttaagggttaaaagatgtgctatggcctgtgctacaatctctgtttagttcgtccaaagtagaaggaatttagttctgatctgaaggtgtaaaaactgatcagaagaaatggcctcaatcaaaatacaagactgtgaactgagaagtggtgtcacttggacaagggacagagccaatagtgtcctgtgtcttgaaaaaagggaggggcatggtaggtaaagcctgttaccttcacttttggtttctttaatgacactagaactttttgctaattaacttgattgcctgcaactgatatatttattactaagcattgtttatcaatgacatattgttcaaatatttgtttcccaggagaaggctgtaaatgtcctctgggatcataaaaggtgatggattaacaagtgctggtagttgtggtaggtcaagaagttacaatgcagaatttcccatactgttgtttggatatgttggcaggtcagcatgaagagatggtgtttttccatgatgagaaagatgatagtttgtcctctaatttcttagctttagcatccggtgaagttgcttgcagggactatattttatcttatctcattcaaagtctctgaatgaaataacaagtagcaaatatgattacaactctttctgtagttacaaaaacctatttttaaatgtctcccatctacaattggctatcttcataccaccatctgctttctcaaatttcccaaggccatttgctgtggataaccacaaagctgcccggggccaaaaatgccacctgttgactggaacagagaactcttggattcaatatctttttcccctccacctcctttcttgcaccttggaatgataatgcatgtgtctctgaagttccccacactagccagatgttccagtcatacaaaaaaattgcttgcaatttctcatcacatcatgctctctcacacacctacaggtctgtgtacactaaaacctctgaatgcttttatgacctattttacctggctatttcttcagtttagaagccttaagcatcacttttttgggggaagccttccctgaaattgcccagggtgatttagatatctccctttccatagcctatatgtaaaggaaagatagttgtgcctgtctatcttttagtggatggtagtgcttccaagggaagagggtgaaccagtacccctataaggacctgagccagtggtggagatagggagggataaagtcaggcatggctccaaacagtcttttatatcatcatttgaatttttttttcatagttgcatgcctcatcctaaacattcttataaaattagcactattatctatgttatgtaatataaaataatctctcctcaatcattgagtaaagctagtggtccaggaagatccttctatatttatcctgtggcttcctgaactgccaggcacgctacagtgtatctcgggagtatgcataagtccctctgaaaaccaggtataaaatagcgtctctcaaggcagccattcaatggtctccttcagagtaggccctaggtctttcatctctgctatagtattgtctagtggattttagatactcaagaaatattattttttggaatgagttaatctttcaagtgatatcagacataataaagaatcagtgtcattaatcttcaaaaagacagataattcatttgtagaccccaaagtctccatcaatctactactctttctctaattattcttgcattttatgaggtactggcatttaaaattaatttttaaaactatcttcttgagttatgttaacattggttactcactaccatgataccagtattattttccactcttcattgcaaatacatgttttccagcaatattatgggggaaataagccttgatggaaaaacctggaactctaaacaccatctgtagtttcttttccatgggaaaatatgtcctgaattaaaagggaaaactgacttagaaatgagcttcggaacacttcaaggctgaagaagactgcattcaagcatcagacccctgcatcctacagctccaatttatacagcttactgcccgaagcctgggggcctaagggagggagcctaaatccagagacacaaaatgacatcctagaactgctgaagtgggcagggaggacctcagtgtggtcccccgctgggctatttcagagttctatcagcatcatcactaggccatcttggatacatattgaccatcccagaaagccagaaaacttctttcttacaaatcctactgagatttacatctctgtgatcccaaaactgttccctcttgagacaagaaatatccgaatcatctgttttctctgttttaaaaagtcaatttttaaaaatattgtttgttaagaaatatttatgagagaaggagctcctgtgtgcaaagcaactttctaacacatggtccatttattatgaaattattctgcagaaacttcctgttgctttgtctttctccttttatgtatatatgtatgtatatatgtatgtatgtatctctttagagataggttcttgctcttctgacatccaggctggagtgcagtaccgtgatcacggctcactgcagcctcgaactcctgggcggaagcaatcctcccaccccagcctcccaagtagctgggattagccaccatgcccagctaattttttattttctgtaggaacagagtctcactattttgcccaggctggtctcaaacttctggcctcaaataattctcctgcctcagcctcccaaagcgctgggattacaggcatgagccaccatgcccagttccctttctccttttagaagtgaattactctgaaccaaaaccttacaagagcaagccaaactgtgccttgattctctttcatgtcaaagtctaggtggtaaaacatggataaggggcttttgacaagaacaggagacttctttacctggcttctctagtaaagcttctagtatctcagaggggccattgattctccatacctggtcatttctccatacctggtcatttctctttcctgctattccactcaaccctatcctcaaacaaggaaaccttccctcccaattgagtacatgatacttttatgtctcctctgctctggaaatgtcatttctgattctgctgggaaggcaaccaatggaggtctcagcctagagccttaatccactgtcctaggcatgttctcagactggaaaaaactgttgggaaacaagttcagaacctgaactaggtgagactgcaaatactggtatagacaggtttgttttaatttataaggttgctcagcaaaacatccccttttctggaacataattagtatgtttttaactgcagatgtagaaaaaattgtttagggtacagaccaatatattttcttatgtttataaggaaggtttccttctctctgtttctcctttatctactctttacgaaaccttgcaagagtagactaaaagggacctcctttcattacacatcttttttcctaagaagcaaaatgaactaaattagttcattcactcagtactgtaaataccaaataaaaaagtcatagacgtatagatataaatactgcttctgtaatgatttttttgtgtgtgtttgtataactagagggcactgggagaaagagaaaagaaattattcaaagttcaaaggctccaagatttactaagaaaataagaaaagggaaaaaaaagcccaagcattcacatgctaagatagctgaaggatcaagtaatatgttaccccagcattttcttcaaaagaaacggcttttgtagaaactggtggaaagtccaaatctgaacattttttctgattataataaataaagctagtaatccctgtagagattaagaatgcaggctttggagttgctttcactgtgctgaaattccaacatacagtcaaggttgagaacactgctttaagtacttagttgtaacttcctttctcagatagttcaatttggccctaatttggtttataattacagcattctttccttccttttgagagtctccatctgtacatttcccaagtgtgtggaaagggagggtggacatctctttccctctctcccacctgtgtctttgcataccttatcttcttaggaagacagcatgactattgttgttaaatacaaaactgaccccatattctaacaaatcatagttcttcttggcccacagcattactttttaatttcagtgatggatttctaggggtcatgcattggcattagcagtctttaaacacatcatctctttttctcttccttccatccactgattgtttcttgagggaggctctgagccattcaccttggtgattctttcccccaaaccatatcacccaaaatcaagctgccaagcccaggattggaggaggaaaggtggtcttctggaactgtatccataggaatcctttccgaactggcactttcatggggcatattgaagtattgtgaagaccttgagcagcgacagtatttggagccatcagaaaggatttaccttttttttttttaagtctttagtttatgatccttgtgctcaaaccaataatctttaaccattagtacctgttttgacatatggccagaaatttattttaaagaacggcattagttagccttttctgcataaaaagtcacccagtacttagtggcttaaaatttagtgggtggttctggtctgggatggctcagttaagctctgtggagtttgcttatgtgtctatagtcagctggggctgaatgacctagagtggccttattcatgtctggtgattagcagaccaagatgggggtaggggacaactgggccacctgtacctcatcatccaacaggatgggccaggcttcttcatgagcagcagtaagcagggcaggtgccaagatcagcagaagcagaagttgcaaggcttcttgaggcccaggctcagacatgtacaatgtcacttccaccgcattcttctggccaaatcaggtcataaggcctgctcagattcaaggtggagaaatagactccatatcttgctgggaagagctgaaaagcaccatggctattttttgaaatctaccgtaataacgaagcacctgtatttgcaaatttttatacacataaattaaaatggatttgaagttcttccaatagtagggtaactctccttgtattcaaataaatgggagaaaagggggtgggaatttcccatggttatgataatgagtggttcatgtaaatatcatgggtcatgaaagaaaaaggttttgaacagctgcccaagagacagtgtagtgaggtggaaagagcatgaatcttaaaatcagacagacctgtgttcaaactccatctctccaacttgttagttggatggccttgggcaagttatttaacctgtctgaacatcaatttcctcaccataaaacaggaataataatacctaaggcacatatctgttgtgaggattaaataagattatggggtaatgcccagaacctagtaaagagccatttcatggtgctagtttccttccttgaccccttaattttgtgaaatcggtgtgtagtgggcatagtgattctttcattcagaatcaaagctgtcccacccctttcccttccagataccagcctgtcttttttcacatattgcatatctttgagagatgacttcaatacaatatttttcaacctgggatctttgcaatgtttgcaaacataaacttacagttaaaaattccaagacaattattagctttggtgctatagattattcacatttttgagttgtgcatagcttgctttttctttatggtctggatatactgtgcaattttggaaacccaccatcagaaaaggaggctttgaaatagtagaagttgggcagcaatgtatgggaaccatgttttttcagaaaggatgcatttacattggataaggttttcaaacatatccaggaattctatgtagtgaggttagtctttgggggctagaggaggccaggttgggcaaaacctttgcttaatcttctcctctgatgcattctatagggctccattttggctaaatcatcataattcccaccaagacagcacagaatgataatggttttatttattattttatattcattgccggtatatgcaaagttttatagcttgctataaatcgagagggattatcacagctgttacttattttaacaggtcacaatagagtagtttatgccagatggtttggagaattttgagggagaaattttatacaggcagccatatagatactagcttgggtagtcacaccctgaaattaatttacatttgttatgatataaaatatatatgaataaacacatagttccttatgaatgagtgatccattttatagcagctatttcttctggaagtcaagggagtccctttgtgagcagtggtggggcaggagcaatagtaatgtgctgctactgggataggtgagaagtaaagctccaccacatgcatagctctggaggggacattcaacttgctccagggaagtaagccttggagacaaaattgagttttcataattgggtctcagcacgtatttgagtcaaagagaataaagcaggaaactcgccctaggtaaacataaggagagaatgggtatggtataaatacagtagagctagaattgggatcctcgaggtcaccctcaaggtcagtctgggaccaaaaggttatccagccctgggcaaatcacagaacatattacttcccttgcagatgctgaagtttatgggttgaatggccaattctggatgctcagcagaaacaggaagataaaataagtactgatgatcagaaatcattttagaaggtatttttggttccaagtctcatagaaaaattgacttacacaatgaaagacgtagagaaaattttacagatctctaccctccttattttatagatgaagaaacagaccaagaggatcatttaaatatgatcatcttagttttttcagtaaagaagtaaaatcagactgtcaaagtatttgggctccattggcttcctccaatctttctccccttgatccagccccacgagttcctctcctgtatcccacctcatgatgggaaaggaccacattcccacctatcagaataatccaaagaccaggtctaaagcacacctggattttcttggtaaattgtctgaggcataaagttaatataccacctcttgaactgaattaaaactatttagccttgtagagtcaattcttccagctcctgtaaaataggagtcaattaagatctgtttgtgtcaacaaaatagtaaattaaccagcaaaggtaaatttaaaatgggagatttggagcatataacagctaaaatctatatgtacaaaatcaggaaatgacagtattttgacaattgaatagtccatgcatgttgaaggacagaactggaatctgtatcgtggagtcccccaagatggctagtagaagaatgaaagctttgaaaatttgtaagctcagcaatacagaaatacccccactcttctcagggctgctgaacttccaataacttcagctttcaggaatacagcaccaaacctggaagtaagtgaaaagagtttcccaaggctacaaataattgtcagcaagcccacatgtatccttttggctcttgctggagaattggtaactcttctttaatggacagatgtttcccagccatgggtgtctgttatccccagctcactggagacttaaactctggggaaaggagctagaagaaggttgagaaaggaatgataatggagaactaaataccaaggaaagagcatggaaatccacaaaggagtcttagaaatgtgttaccatagagaccaataataagctttcttaataaagaccctaagtaatcaacaaaacattaaattgtgttttgtagcatctgattaaagagacaggaaagtgaattactcaaggtaggctaattctggtaataaacccccaatatttcagtgtcttacctctcactttccttgcagtttaatgctggttagcttgcaggtgggtacctaggctcttcccatcttaggaatccaccatcccatagagcctctgtgttcagccagcagggaagacaagaaagtgtgtgtaggaataggtaagagtttttatgtgccaaggctggaggcacacgtaacttctgcccacattccattggccaggactcagttagagggctgtacctaactgcaagggaggctgggaaatgtagtttagctgtaggagaaaggagacagtttggtggacaactaattagccagtttcttctaaagaaagtataaaatatgctcagaacaataaggggcttcagaaaattgttcttggttggataaactttagttatatggaaaattacctgtgtagactttaccatttcctggcaataccagttaaaggaaatagttatttcctgagccacactgtagatcagaggttggcaaattatggcccatgggccaaatcccacacactctctatttttgtgcagaaggttctattgaaacacagccacatccatctatatatgcaccatccatggctgcttttgagctacaacagcagagtagagtagttgcaacagagactacatagccagcaaagcctaaaatactttctacctggccctttacagaaaaagtttgttggcccctgctatagatcatcactgtcctaaaaaaggacacatttgcaaaattgtctgtgagacctggtatccttggctttcagtaaaaacatcagtatgtcgaagagacatctgcactcccatgtttattgcagcactaattgcaatagccaagatatgaaatcaacttatgtccattgacagatgaatggataaagaatatgtggcttgtatacacaacagaatactattcaaccataaaaaaagaatacaatcctatcatttgcagcaacatggatgaaactggaggacattatgttaagtgaaataagctaggcacagaaagacaaacatggcatgttctcactcatatgtgagagctaaaaaaaagatcacatagagagtagaatagtggttaccagaggctggggatggtggtgtggggataaggagagtctggttaatgaatttaaaaaattacagctagataggtggaatacgttctagtggtatatagcactacagggtgactatagttaacaagaatttattgtatattttgaaatagctagaatagaggattttgaatatttccaacacaaagaaatgataaatgctttagatgatcaatttgctaattatcctattttgatcatttcacattgtacacatgtattgaaatatcatactgtatgccgaaaatatgtataattattatgtatcaattaaaataataatttaaaatatatatcagaaaagtaggatacctatatggactgggatgtaaactcagtccttagaatgtcagctccaactgggcccagactctgctgtatccccacaagcacccagcacagtacctggcatctgagagatactcaataagggcttatatttgaacctttgatccataggaagcttcaggtaccctaaccaccatacaggggatagggggacctaaaaaaatgcaatatgagcattatgtgtgaagacctcaaacacaggtaggaaggaaccatctttgttgagcttttattacgtgctgggcactatcattgtgctttattgttttatttactcttttaagcaactctataaattaggtattcttattttcattttacaaatgagaaactgattcaaagaaggttcaagattcagagagtcaaataattttcccaaggccacacttgttaagaactggaggagctaggattcaaacacaggtctttctgggtacaaagcctatgtggttttcttttcttttctttttcttttttttttttttaacctctctgccatgggacttgctaaaatctcattcaaatttaagcaatctagttatatcattatttttgccatcactgttaacaaccacctcattattgtaaagatcaatacaaaggagaaaagacagggccattttcattgctttgtggaattctgcagacttcattgtcaaggctctcccgtgatagagcagacctgaaaacctggagcaatgcagttcatttccttgggctgtgtgattagtgacttggccactagctacccatgcacttgccagggattgctgtcgagggcagccattttgctcaccctaatgtaaattctcatgtcaagacctgagaggtttgagtctgtacatggtgaggcttcctgtttgaagttgatctgagagcttgttaacatacagatggccaggcctcaccccagagtctgattcagcaggtctgggaaggcctgagaaggtgtatctctaccaaacccccaggggctgccggtcctttgagaagcaaggctaagggaaggacttccctttacctttgagaagctctgactggtattcccacccacttcacatctcccatcagtagccaatccatcaagccttcccaaagccttaggggtccaggtctgcccttggcagcagaactcctcccactgacccctcggtgacatttgacattataaatcacccagccttcttaaaactctttcgtccatccccctgtttctgagatggggcccttccccccttccatcctggtctcctgcttctctgagtaatgtctcttcctctctgatgaccttttcctttacccacccaccccttaaaccttggggtgcatggctgtcttctcaccttcactgggggagtggccatgccatctcctcccacctcatccttcctgtcccagccacactctgtcttccgggggacttccaccagattctctgtcgttgccagcagctggcagccctccaaggaggctagtggagaacagctaacccagactgacttgggttctaggtgatacttcatgtgaccacaatcattaattcacagtaatgccaattaggaaatattctttatttcacacacaggcaaaccccaagatttcttatgaccttggcaagtggagtgtttcacaattgtgaattctggagaagttacaggcctggtggatatagtattgcccacacatgcaaatctgcccagcgcctaaacatccctagttgaaaataggcaacccagtcagaaaagagtcaagttttccctaaataggtttcaaagacatattaccaaaaacaacatcccacaagtcatctttggataatttcattcactgggtttcttcttgttatgtatggtattaggatatatcccataagtgttgtctttgaagtggccctaaatggctctctgccttctgcattaggtcgctatatggagagcctaccaacttaagctatgggcacacactgccatggtttttaatcctggttcaacctcagatctggtttagtaaatcgccgctccctggagattaatacatggctgcaaaggcattgtccttgcagtgtttttcagcctgggcagggtgagatgtgtctaggatgcgaggtttcagcatccggagatgaatggggggaggggacgcaatgtcacatttttcgggtgctctagtcctgttatatgcgggcacatgctctacgccagtctctgtccaccctcttgcccgggctggaggggttggcacggtcggcgtttctgattccttcctctgctgttggccatagactagggataagggaggtgagaagagagccacgggggtgcggtgctgagcagctgcggtcggtccagcctgttggtgatgtgcggagcccgccgccactctgggcatgggtaacgcgcagccccagcggtcgcgctacgggagaaggaaacacagaggtacaagaaatccggatccgggatcctccgcagcctccggcttgtctaagctcacaggccgggctttgtggctggctcccgcgcgccaccgagtttggggctggggactgagtcctgcagctcactgcggctggcagcaggggacggattatttttagcaggttccctttagcccggtggagctgggagatactcgcagagccaggcggctgtccgtggagcattggtgcagccgtgccttgctgccccggaggtttggctgccgcagtcctctccattcactgagctgtaaatcgaagctgtctacaccgacaaggctctcgatcccagcgtggccccagggctacgtcccgcccaggtctcccggcacctgatttcccagtggtcaattaggtgtctcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcgaggccagccgcgcgctagcccgagaggagatcccccttggtcgagatctgagagctgggtccccttggcagagctgagcgagggtgagctgacagtccaggtggaccgcgcatagctcgcaggggcaaagggaacagcgctggctttcaggggtcttttattatttttaaaagcatattgcagctgcagcttttaagtttgccgcctcctccctaccctgatcccgggttctggggcggggcggcactttcccacgctgcctaccctctgggtggaggggtctgcaggggctgcagcgcctggtgttgggtttcctgcagggggaatgaggattcgacggctctgtgagtggaagggcgccctgaggtttggccttttgagggcttctaagggctggggagaagtcgaggatcccgcttggtgccctctcctgttttcctgccctgccacttggtgttggatgacattttgcctgtgcaggggtttcactgtcaaggagctgtgatgctgtaaggcaaatggactgttaggatgagctggaagagaggggagtgagctggagcttttccttttgtggcagtgttaaccccatcgcccccacctctctggcgcacctgtcccctggggtcaccatctgtgcgcatgagtggggcagcctgacccactggccattccagggacagtgagccaaagctggacttgctcagggcatgctaggccaggaatgtgtgggcagtgaaagagcaacacccttcctcacccccctgcggggaagactcagcaggccccgccatgatggtgcacagtgttttgccatactgtggtatgctctggagttttggagctcttgttttatgaggcttttattttacagtttcttgcctcttggtgaccagtttgtttttcacagctgcttgtgagcaaggcaaagataacgagcatctaaaaatagccctgcagttggaggtacagcttggcttgaccccgctattagaggggtggggtctccgttaccagctccctgagggtgggccaaacttgggcccccagacagcctcagaccaggtccacacatccttcagagcaattcaccttcaggtctcaaggcaaggcagggatgctgagtgctggtccatgtgagaagggcagcagctctgagaagcctcatccattcccgggtgaggcccaaagccactgggctgcaaggctggaggatgggagcctggacaggggtccctcttttgcccccagccatggatatccatccctggctttacatcccctggttggatccagccatatgtatggggcttcctcctttgcactttaaagccaacaagcaactccctcacagtggagttcgttccagaatacagagggacaaaaggggccaggtggcactcaaaccatgccaacttcctactgtgttcatagcagctgggctactactctttcctttccaggtggaaacccctggacagttgggtgaggagcctcttcctggtcagcaggagggtggcgccagcctgtctgaagggggccgcctccagctgatggtgaagaggccgcctggaatggagataggaagggactgaggactttgcagtgattgcagtggaagcaggaagtgcaggtcttctgtgggtcctagattctgtgagcctgctaggctcccctcattatttattttcaaaagccttcatttcttccctgttcactttttctttcgtggtgatggtggtaaagtccagcttgaagaaaaaaggccccctctgttcttgatttggttggatgataggatttttattttttttggcaagaatgcattagcaattgctgaaaaatgtaaatgcctatttttttctccagtgaaataaatgaactaaacagcaagggaatgtaagggcaagcattctctgttcaagatggaatctaccaagtgattttctcctctctttcaaaatgaattttgattgaaaatttttacctttattttctgtatgtcataactataatcactgggcaactattaagatagagatcgtgactggggggaaggaagagaccaggaaacagcacctttgagatatccatcattcctctagtcttctagtggagacttgcacacagttgctagtttatctttaaaatttccaccatctttgtgttccccatggaagacaaaggattaatgatgatgaaatgtagtataaggccagtgcaacagtggccaagtttggccagcttagaagagtagatatgggaagaccacgggttgagatttcagttttttaagaacatcattggcttggctcgacctgtaccaaataagatatcaatgatcccttggtcttaaatagaaagggctgcttcctcttgaagatcagaacctaaaccagcaattgactagagacccacagtgagcatattggtcagggaaggataaacaccataataggtgagccccaaatttcagggtttaacacaatagcagtttatgtcttacataatgtcaaaccagctttttgtcttgtgattataaggaacctagtctcttctcttcttatgaatctaccattccctagggccttgaagcccctgctgggtcttctgcatccagaagggaaaacaagaacatggaagattatcctggaagcagcacctctcactcccacccacattccatggccagaactcaatcacatggccacatctaactgcaaggggactgggaaatctagtctgtgtgcagtttgtgctatggcagtacactctctggcatggaggggccctttttaagctctactttgagattggactttggctctggacaagtcatatggcaaatacagatctccatcttaaaaatggtggtaattccacctcctctttcctgtctcaaagggatttggaaagatgtagcaacataaaaggctcctacagggaccatctggtccaacctctgtaggcaaggtcattatcattttcctcaatttatagagaactttccccatataacacagctggtttatggcagggctgaaatcatacctagatccccttctcttggcttagtgctccttctaccatgctatgttgaccctggcatcttatgaaaacagttatataggatattgtttctgaaagctgacatgctttcataatgtgtagtcattaaaagtgacttcatatgatttaaaatccaagtatgatcttcttctggttcttactgtataatcacttataatcaggcaaagaataaccagacactaatctatgccctgcacacatatagctcatttaatcctcacaataagcctaggaggtagaggttattattatccccattttacagatgaagaaactgaggcacagagagaataaataacttgcccaaggttttacggcaaacaagtgacaaatttgggattcgatcctgggcactatggctccagaatccaaccctggactattttaccatactacctttctgatctggtagactccttctccagccctttctgagatgtccaattgggacatttttaatttcctttttaagtgagtgaccttgaagatccatgaggggagtcatttgtaaatttgctgaggcatgtctttgagcctcaagcatataaaatggatacacaggattgagctactcagctagtgaagaagctcagctcccaacctccagctccaacagcccaatgaagctttttttttctttcaagatttttgggatagacactactgtgtagtccgttaccactgtgaagtaataaaaatgtctgtttctttgtgaaaagcagccgtggtcaaccataacctttggtgcaagattaagaggcagttgacttggtaggggcaggcaaggccatcatagtcacttaactctggaagaaattgctttttgtggttgtttatctattgttgcaggagaaaccacccccaaaatttactggcttaagatacaagccaatctattggttcaaaattctgcaatctgggaaaagctcaacttgacagctctgctagtcttgctggtggttggtcagatggtatgtcacctgcaggcaaggttcagctgggtcactgggctggctgtgcttatgtctctttctgggtagtctcagggattctccctctccacatagtctttcccagtggtctttccatgtgatcactccagcagggtaactggatttcttacctggcaactcagagtgcccaagggtgcaaaggcaggagcttccaggttttcttaggttgggcctgtgtcttgttttaccaacagaatgaggcaagtcacaggcccagcccaaacctcaggtaagggaattgaccaagggcataaataacaggagacctggaagtagacatccacaaaggtaaagtctgaagcttctgtatttacaaagttgaggattcccaaagatctcaggaggagttgatggtacattaaaatgtaggttagataaaatccattccttttgctccaatggagcaagactattatattaatagatgcttgattctttcttcatcctgaaactaacgaatcatttatgccctacggaagcatcaaggctgtagatgtgactgcccaaagagaaggggaacagaagtgtgtgacttctgctctcttgccgctgccatactgtctcaaaggtatccattttttaaaaggtatcaatacctatcctcagacataaactaaggatagtttctgaaaaggcaggagcataccaattggatgagaagacaagaatatttattttttctttttattatacttttaagttctgggatacatgtgcagaacgtgcaggtttgttacataggcatacatgtgccatggtggtttgctgcacccatcaacccatcatctaggtggtaagccccgcatacattaggtatttctcctaatgctatccctctccccttgccccccaccccctgacaggccccggtgtgtgatgttcccctctcgaagacaggaatatttctaatctccatttacttttctctggcaagtcacacattccgaggggattcagcatgcacaacaggagtccctgcctgcctcaggaggtagagctgctctcctgcagaaacaggctagtgggttcaatccattgggactccatttcagattattttccccaggcttctgagtcactgtagtcagtgagggtgcagtggctactttgattcactgtctacccctcttcatcagggctcaagcacttattccccaagcactcatttgccagggctaggcgcggtggctgacagctcacagctgcatccctctttgggaattgtccttccctgaagaaagtcaccccgtctaaggtcacattccttccaagggcagcactcatctgatgaatggtcaatacggtagtataaaggcccactcaccttgcctcaactcaggacaattctacagggccatcccagctctagagctccccatgggatgggctgagcctttgttgtgactctcctagcccaacttctcgctctgcccagccctgcttaatccatttcctccacaggtgttgccccagagaacatttcctgatatgcttcccacaccccaatttctgtctcaaagcttacttccagggaactttcctggaggtcaagtgaaggaggggttatagattgggctacttcctactacaggctgggccactgtgggcacacacagaagtgggacgtgcagcctgggccttccccaaacttccaattgagaagacatgacaagcacttaagtgacagcatgagaagttaagcaaacataatgtaccagagtcacaagtaagtctgatgcctcaaggattttcccctcctcatactaccccttacaacatcccccaaagttgtattttgtgtttttttaggggatggatgattcatgacattgattatatggttaacaattgtgcctaagtgctctcccacctgattatttcttcctttgggcatggcactggcaatcaaaatttatctttcaaattaaggctataattatattttgataaagatctagcaattcaatgagaatgaaattttgagggttgccaggatacggatgactctgggttatagagaagggtttgcatgcagaatactaataggtggttcagcgctcttatctagacctttccaatagcgtctgataatgcaggcccatcaagtactgtttctctgctattattctagcagaataaaagtgatgaaagatataagcagggttttatgaatgaaaaggtgattcatcagatgtcttttggtctatctcaccacagttaagaaatacagtaataataatgtggtgttacctcaaaatctaggagacaaaaagctttctcttatttccttgcctcctcttttattgtaaatagaagcaaaatgtcttagatattgggttattgtttttcattgggaatagggacctgtgtttgcaatggtgttgactcccaggaaaatagaaacagtagaaattggtatgatgttatattttgacttttctttacttttcctttccattttactctgattattattcattcattcattcaacaaatgtggactccctagtattgtgcaggctctgcttgaggaatctaagaaagtttaaaatggataaccatgcatggaaataataaataatgacacaacacagtagcatccaacatgtcatttcgtggcatggaggggagagggaaggagtaatattttttgttaagtgagatgtaatttacatacagttgagttatgcataagtcttaagtgttaagttcaatgagctttgacatatacatccatgtaacaacctcccaaaacaagatataatgcatttccatcatcccaaaatgtcttcagtactcctttccagtctctctcccacaccttttggcaaccattattctgatttctatcatatagattagattcacctgttcaagagcttatataaattgaatcataagtatgactttaaaaaatgtccagcctttttcattcagcatagtatttttgaaatttatccatgctgttgtatgtatcagtagtttattctttttattgctaagcagtaatccattgtaagaatataccatactttattcattgacttaggctgtttccagtttggggatattatgaataaagcttctaagaatattcttgtacaaatctttgtggatttacattttttgtttctttttggtaaatatctaggagtgaaattgcttagttatagggtaaatgtatgtttagttttataagaaactggcagagattcttcaaaaattgtatcagtttgcactctcatcaccagcatatcagggttctagttgttctgcatcctcatcaatacttggtatgtcaggagccattctaatggatatgaaatggtatctcattgtggttttcatttgcatttctgtgatgacaaataatgctgaacaccttttcacgtgcttagtagacattcatatatcttgtgaggtgtctaattaagcctttttctcatttttaattctttgtctttttattattgatattttttatttgtagtagctcttcatatacactgagtaaaagttctttgttagatatttgtattgcaaatatttactcccagtccttacctgccctgttttttaatagtgttctcttgataagcagaaatttttaattttgacaaagtccaattatcaatgttttcttttatgactagcctcttttgggcacggtcagaacaatctgcttccctcaagttcatgaatattatttcatacattttcttctaggagttttatggttctagcttttatgtttaggtctatggtccttccctaattaccggttgtgtatggagtaaggtagggtcaaaattcatttttccccatatgtatatttagttgttccagaaccatttgtaaaaagaaaaccagaaaactccttcctttctcccatggaattgacttaacgcctttttcaaacaatcagttcaactgtgtatgtgtgggtctatttctgaattctctgtgctgcttcattgatctataatgtctactttcttgccaaaaccacactgtcttgacctctgtagatttatagtaagtcttgaaatcagatagtaaaaatcctccaaatttgttctctgtcaagattgttttagctattctagaacctgtgcattttcatatacattttagaatcagcttgtcaatttcttcaaaaaagcatggtatgattttgattggcattcatttgaatatatggatggatttggagagcatggacatttttaacaatgttgtatcttcaggccctggatatgctatagcttttgatcatataggtcttctttaatttctcttagcaaagtttgcagattttagtgtagaggacttgtatattttctgttagatttgtttgtcctttgtatttgatatttgtgatgctatcataaatggtattcttttcatttcattctctaatttttcattactagtttatatataataatacataaataatatataatcaattatatttatatgtatgtatatataaatgcaattgatttttatatattgacctttttgtatccagcgacttttctaaattcactctttagttctagcagttttttgtagattccatagggtttttaacctacacaatcatgttgtctaaataatgacagtattcttcttttttatcttttgtcttattacactggtgagagtgttttttaaaattcttcccaatcttaagggaaatcaacatttcaccattaagtatattacctatagattttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagcagagacggggtttcaccgtgttagccaggatggtctcgatctcctgacctcgtgatccacccgcctcggcctcccaaagtgctgggattacaggcgtgagtacctatagatttttcagagatgcctgtcatcaggtttccatattaggattatatagacttcatacaatgagttgggaagtgttctctcctcctctattttctagaaaaatttatgtaaattggtattatttcttccctaaatgttggatggaattcactggtgaagccatctgggtctggaattttccttgtggtttttattaagaattccatttctttagaatttacaggactacttgtattttctgtttctcctgtgtcccttgctaagtttttcaaggaattttctgtttcatctaagttgttaaatgtatcaatactgtaggctagagtaggcagaaaaaccaaacatatcacctgaagtaggactttgaagagaagagattggctagacaaggaggggagtcctggggaaagaatggtgtgagaaaagacatggggtgtgggattaccaatggtgtgggttgtttaatatggattatccccatctggttgtagtggaagttttgggtaaagaagaagtggaaaatgatgatagaaagataccttggagccagatcaatgacaaattgtggagtttagatcttatgtaggaaatgaaaaacccctatattattttcaaacaggggcacggcctgcagaaatggtattgagggaaatgatttagaatgatggattggtgaaaggagaagggtagaggtaaatgcaactcttttagaatggtgcagtatgcagtggtaagcactgcctaggtgaaacaaatttgataaagaatggagctaggaccaagtagggaaaggcctctgagtatttctctgtacacaacgtggtgttatgcacctagtacaaacttatcacactcttaatattttctctgttcccatatccatctcctcacctggacatccagctcctctgggaaaagaccccaaggtttatctatgctaaagtactagtgccagcatgcagtacacacttagttaataccaagtgaatgaatgaaagctgaaaatatgaatgagcaactggatgaatgaatgagtgaatgaatgaatgaatgaatgagcaggcaggataaaaaactggattcatcaggataggataggctatgctatgataacagataagccaacaaagctcagtgctttaacacaataaaagttctcttccttccttacacaaagtctggtgtaagtcatgtaccctcctagcagcacgcgaaaagagagaacaaaggctcttgggaagtttggttaaggatccagcctggaagtggtgtacatcacttctgcctacatctccttagccaacactgagtcatttggcccccatagaactgctgagaaagctgggaaatatggatgtggaatggaaatttggtaaacactaaggacacttagaaaggagcaaaagggagctctaaaacctatttgttattgcttccagcctgagagaaagctaagtcctagagatgttaagggacttattgaggactccccatacggattacagattacttctgccaatagagctcagactctctggcctgcctttcaggctttaatatttataatctcgtggctcacttattgctaactaatttttagaagccaactcctccaagaggaactgtgagcagaacgaagcactaatagactctgccgttggttacgtggtagctccagccagaagcacaaatggagagaggcaggatatgggttaaggcagggagttttgaggataaacctcccaggagtcagcaaagcagtcctgctttgggaggcatctgtgctaagctcatgccagctgcctaaagagaactccacatcgtctgtgatctggagtctcctgttcaggatcaaactagctgcctccacagggcctggaatgcacggcgagggctctgtggctttggaaaatgctgccgaggtgtctcaggtggagccaaagatgtgaggggaagcacctcatctgccgcaggagggtaaactagatggaaggaggttgtgttcctcagccagatgtaggtattgtttggttttcagagtggtgtgagcatcacagatgatgaaggccaagcacatgggatgaagcttggcctaaggcgagttctcaggagaaggtgttggcaataggaggataaccatggagcaggagaaaagaagcctctcatctttcttagatttggcaaggagagggggcatcaatgacaatgcatagagcctgctgccttcccctggaggcagcttccctaagcggggtcatggacagtctcccagctcccctgcaccaatcagtggttccacatcagacttttctgcctcacatttttttttcctttttaaaggtacagttaagggccaggcatggtggctcatgcctataatcctaaccctttgggagacaaggcaggcaaatcatttgagcccaggagtttgagaccagccctggcaacatggcaaaaccccatctctctaaaaaaaaaaaaaaaaaaaaaaattagccaggggtgttggcacacacctatagtcccagctactcaggaggctaaggcgggaggactgcttgggcccaagaggtcaaggctgtagtgagctatgatcacgtcactgcactctagcctgggtgacatagtgagaccttgtctcacacacacacccacacacaaaagtacagttaaatagagtgaaattaagaatacaaaaaaaaatgacagaactctcagaaaatgagccatcagagaaatgagaagtgagcatattggaggaaatcatgaaagaaaggattaaaggagatactgtaactgtgaaatgaggaaagtaagacctgttctaatgccctttgcctcactccttctgttcctgcattctggctttgctgttcctcaaacattcaaacaagatctgaccttgggtcctctgcacttgctgttctttctgcttggaattctcttaccacacattttcacacagctcaccccttcactggatcaggagcctgctcaaatgtcacctttgcagagatgccttgcctaactactatcttagtttgaattcccccagaagtagaccctgagacaaggattcaagtacaagtagtctatcagagagatgaacccaagtaacacagcaggggagtggggaagtgagagggagaagggaaaggatctaagaaaggtatgctatcaagcagccaccgtgtgggtagctgtgcctcagtcctgctgaggaactctgggagatagtgtagaacacacttcagagttatcttgaccacagaggagggcatctgttactgctccagtgcgtgccctgtgtgtgggccaagcattctcccattgtcagaggggaaaaaatcacccttaggcagagggtcttggggaatcatgagaagcagccttctgactgttgaagtgaatgctgaaggcacattggcaaggcaagaagcatctgccacaacatcctctctaaaatagcaaccccatcacgctttatcaccttgttccactttctgacttcacagaatttacgccacctgacagtacatctgtatgcttatttgtcatctatctctcccagtagacagcaagttccaggaagacagagaactcatatgtctttcagtgcctcagacggagatagtgggtgtttggtaattatttgttgagtgaatgactattcagagaaagactgaaactcgttgacatcaatattatcctcagcacatgaaagagtgagagaagcagggcagaaatcagttgcaggaacgaacgtaagcattggacaatgagggccatagtagggtcttcaatatgaatggataagaacgttattccagtttcctggtctgatgtttctggggacttaaagatttcatctttgccatggccataacagctattattttttgacctatataccaaatggaaacaacaacaacaacaagagtttctttgcaggctgggaaatttaatatatccaaaagagggcaccctagtcttgatccactagagggctcaggccaaggacaacagggaaagaaatgtgaacgggacaaaggaaggaagtagggagagagagtgatggagaaagtgcggttcagggaagcaggtggcaaaggaagggcctaacaaccttggagtcctcactaaaaatggaatattcaactgggattttattaactttgagatgagcttttggggacctattcaagtaaacacaacccaccccaaagccccaaatcctcacttgttactgtaaaggcctgttagtcccatagttcaggccctgaatgctctgctccaggcccctggcttgaattcaccccaggaagaagaaacttctgcagtatgttgttgctgaaaaggcagcttgcctgggcagccccagtagatcctgctctctgtggcttcgcagaaaaccccatcacaaaggacactggcatttctagaatggacttgagcccatagctactattgaaagaagactcagaagtacacaatgggaagctgacacaatggtgaaagggatgggaatctgggcatctctgtgtgccacttgtccccagtggcttttgttctggaaagaacagacttttctgtgggtggataaaaggcaaataaatgttgtattcaccaaacctattggtttgacagcttttaaaagcaagttacaaaaagtcagaagagtggccaaagctcattcttaaataaaatgagattcccaagttgtgtttaggttccaattgccttctcttcaatacctttatcttttcatgtaaacattcttgccctgatatttaattcctcacagaactgacagaagaagcctcataaccacccactaacaggggtctgtgctatgtctacacaggactgaatccgcacatttaattgaattcactggcaacttttgggaaacatccagttagaggactggtttatgggttgtgtaagtgtaatgaaataattaatggttctcatttgttactggaatgaccagattagccagctgtttttgcaatgtcaaattctgtcaaaaatgcttgtgtctggagttgaagatccattgttagaacagtcagtgtgaccctacatgtggtttgggccattgcttgggttcaaaacagacctttagtctgatgacactgactcattccattcggtttgcaggttggtgtcatctgcaatttcacctctattccaattgctgcatgggtttgagggcttaaaaaaataacacacaaaaaagtacttccttactctttgaggttatggagtagcccgttccttttctgatcatgatctttggccaagttggtctggcctggatgtctctgagtgagtgaactctgcaacgaaagtcactctctggggctgaagggtgcccgaaggccagaggtggtgttgggttgggtgacttcctgagagggtgctgggaaggcatctgagcatgggctgggccacaggcactcccagttcctaatgcactgcctgaggatcctccctgaagagaaatcaaactcaccctttgggccaaccaggtgcttgcagctttcactggcaagtcttggcaaggggtgtgttagaacaaagagttactccacctgcagattccaagagctaatttgaaggttgagttagagaagaaaaagcaaaagaggggagaaaaaaagccagcactcagcagagctgcagcagaaaagcagagccccatttagtgtaccctcctgcacaatcttcatttctgtggatgccccaaagcaactcctaattcagcctgactcctatgcatcaggctttcaaggaaaagcttttgttaatactgactgtaaattgagggggtggctttagcaatgttttctgaagaacaaaaactttggcagattatttctgtagcacactggtgtatttaacaacattagacaaccttattagttcatagaggaagcatttatgcagtacctactatgtgtccaacactgtgcttgatgctgaaatatagagaataaatactccttgccctgaaaaagcatctagtttgacagggaaacaagcaattaaaacagtgtatgggtggtcctgtcttgttaacccaggtccccgattcagaactgatcaccatttagggaggggctgtgataggattacatttgtataatagtagtctagaaatcatgtcttctcagcaaactaaaagaggaaaagatgaaaacattggtcttccccttacctaaaagttccaatgacttaaagggacataaaagcatccattgacatgatagagcagtgaaagcagaagcccacttctggtaagagctggtaagataccaaagcactggaagggcgagcctctaactgcactcttgccatctgagttgagagggatgggacatacaggaaggaaaaactaaagaaaagcacataatcaaacaatgatacaatagaagccatgtcctaggctaaatagggaccaaatgagtactcatagcaatgatatagcgagttcattgaattagtgtaccattagctgctgtaacaaaccccaacatctcagtggcttaataaaattcaggtttattcctcacttgcatagtgtccaaaatgggttttgcctcattggtgggtagctcttctcctagctggaattgaaggatgcagattccttccatcttaggaatctactgtcttcagtagatgacttctaaggtctctgtactcatcttcatcaagaacatgaaaggggatgtgtgggaggtttcaatgggccaggctggaagtggtgtgtgtcacttctgctcacattctaccaggtggacctcaccatatggcacacccaactgcaaggaaggctgggaaatatagtttagctttgtgcccagaaagaagaggaaacggctttggtgaccagtgaagccagatggccactctgagctacaggaagaggtcattccactagctttcagctccatgtggacagggaccctcactccctctccttggtgtctctgatgcctacacttgagaatctcaggccttcctggtcagtaggtcgccattgtcatttcctcaatgccgcacctcccactattcttactctctttcacatctccctgttttagttcatcagagtgcttatcactaccaatgacattcttccttattaatcaatttacttactggcttttgtcctacctggaagtaagttccataaggacaaggacaatggcgcatgtcatgtccaccattctattgcagtgcctagcacagtggttggcacatgggaagtccttaataactcattgatcaatggatgaatgaaccaactgggccttgggaggtcttggatggcttcacaaaggaggtgcaactcgagcttggtattgagtagaatttgtctgggaggagagatcaagtaaagaaaggacagattaaaaggagacaaaaaggaccacaagatatacagattgaaccatttatggaattgagccagatccattcaactcacgtttgagcacctattacacacaggtcagtgttctagaccattgcttagctggaagatgaaacacacacacacacacacacacacacacacacacacacacacacacacacacacacacacaagaaagctcgtctgagccagggactaagacacttccctttacataagagggttaggcttcagctccacatcccggccaccaaggccctccactgaaccacttcagtcttcctttctggggtgaacatggtctccccacaccaatatctgctcctttgtggggaagtgatgtggggcagaaagatcttgggccttggaatcagatgtatgtgcttccagtcctgcctctatggccctcgagcaagcaacttaacctttctgtgcctatacagtaagttggagataatgaaatgttcatcctgggtttatcatgggaaccaaataagattagctatattgagggcctaacctgctgtgtggttcatggacatgctcactaagtcatcttcatcttcttcctaagcagctccctacctgcgcctctctgattcacatgactcctggccaagccacagtgaactactcctgggacctatatcaacagactcattctaaccttcatattaggttggatcacaggaaattgctaatattaaaaaatttttgcctcaaaagggaaattccaaatggtttaacctaacgctttagcatatgctgatctctcccagcatttgctgatcctatccagcccttaaccctcctcctacttcaatgttacctcttccctgcaccccttccctaaccagagagcatgtcttttgaacttgtgtggcagcccacttgatcctaccttggattatcacctaatttgtctaatatggctaccaggttataaactgcttgacggcactgacggtgttcctttctctttaaagcacctctgcacagtcccttggacataataagaggtgacatgtttcctttcccagacccaagtgtgattagctggggcctccagtacactcggagggattggggtcaagctttgctgatgatcctccgcaccatgccagccagcaccggggcccaaggcacttattctccaatgcgaccctctagaatcagttgcctgttataactttgctctctcttctcccctcatctctgtctgcctcaaaccaaccggagaagagaagcacaaaatgccttgaacttgggagggggaaatagggtgtcatttatctggcttgagcgattattgagtttttggctcttcatttgcttacttaagagttgtaacgttgaaccacatgaaattgccaatattcaactattttgacctacaaaaatgtcaatttcatagggttcaacctagtttttagtatttggactcaggcacaatcactcaggggtgaagctgtctgatccctgtgtgtggtctactcaccaactccttggtagagagatccccatggaggctactcatagcttctgatgggcctgtggcctttagtagattctgtcattgcttgtggagtttccatcataggctctggattcaaaaagggctagttcatatttcccttttccctgcaggtgccaacatatgtgtttgatctctgggataaatgccaagacctccagacttgagttttcaagtcttctggagatcaaaggctctcctcatcactgtgtgggcttctctgtgctgttactcaacaaagcaaggccagctcctgcaagggccagtggcagagttcacgagtcaaggaaggaaggggaggagctcctagttttcgaaatactgcaacatgtggagcagatgaatgtgaagggaaggaaggctttatgtttttctcaaataaactggaaacttaaaatgcaggaactttacatgaattttagttatttattaactagatccacctgaatgggatggccaggagcctttcatagttttctcattttatgtacccaaaggaatacacaggaccttagcaatcattgcactcaacaccttcagtcatttcatgtgacttccaaacaaagtaccctttactgtacattgctagtagaaaatatcctaatgacaaatgaaaaacaaaaagaaatctaaaactgaattaagttgtcttattgtagtcattttgcaactattcaaataagtaattatgccattaggaatcaagattttcagcacaagagaaaatagatcaattataaaatcaaggaagttaaattaaaatctgtaatcttagatttgaattggcaataatgttttaaactcatgatttattttcaccttctgaaacttacatattttctagtcctgtctactgaagaagtctagaaccaatgacaacctagcaacgatgaatacccctaccatgcagaatgtggtctctaaagtctgtttcctctgagaggagtcagggcttcttcaagaaagggctgattctaggtctgaggcagcaaatgtgcaagatgaacgtaggacacctcccttgacaccactgcacactcagctagactcaagctaattgagtctcacaagagaacccatctcttctgacaccagaatgaatccattatgggttaagtatttgccactcatctagctatgtctattatagagagcacataactcattacaaatacctaggcttttgggatggaaatgtccttggaaaagaatgtcttttggcttgcaggctcatgtatttatatcttctttgttggcccaataaagagcatcacttctctgctacctgcaaagatactaattagcaagtagtgattctaagtaagtgtagtggaggtggtatgtggggccttttgtaagtattttaaaattttccatcatcacttatgctctctaagtagattttaagagactaacctccacctaggagaagggatttattagcatatataattggatgtcatgtgctaattaccttactgcttcacaatctaaccaagccaagggcatctgtccaagaggacagaagaggctccatgcgccatattggaaaatagaaccctttttttcttatatccagtggctgagtgcagtggttcttgaataaaatggcgattttcacatgctttttctgacctgcctgtcccactccagctccattttctttcctgggatgtcagaggcacccatgtttatgatacctcatcttagtttgaacaggagtgaagcgattttaacatgtcatactcatcttcatgggtgcattgcctcctttcttctctatttttcccatggagagagcctgctctcaagaaactatgagtactaaaggatgatactcacggtcttccctgtaatcagcctcacctggttcatctcaaataatggaaacagatttgtgtcattcaccaaggagttttatttttaacccttgttaaacccataactatttgtttcgctctcctgaaagagcaaattccttatttccgatcagtattatctttctatacttttacttgtttgcaaacttgcaacactgacagtgtctcttcagggggtgtggggctgatgaagtaaggattgggtcaagcccccatttctcctaccctggtttaagctcaggcgtggaagccttgaaaactggcacaaatgtttcatgacttggtgatgggctggtcattttcagtacaggttgctgaaaagcaagcactttactgctatctaagagcacagtggcccttctggtaaagctaaccttggagttgaactaattattagattgaactattgagatagttttttaaggtcaagatggttgaatatcaccaatttaatatgcttcaatctaatacctaccttgttacctggcctctgtggtccactgactggcaacatcagcatccccctgggacttgttagaaatgcagattctcagatcccatccgagacctacagcatcaagatttctggcagtagaatctgttttaacaaagtctccaggtgattcctatgcatactggagtttgggaagctccattttaatctattatgttaatatttaagtctgcctttgagggcagccttcttagttccccaatggtgtggtttgtatccatacagcctcacatacaatgatggttcctggttaagaacaaatatttccatcagcattgttgaggcaggatggtacattttgacaagaacaattatgaatcctctgcctattgtgtgctctgtggaatggtagcttaaacagtacaatttctagctttgccaagcgactgccaccttagtgtctggtgtttttaaaaggatgtaccttgctgatatatatatatatcaaacactaggccatgtgtacatctaagatgccagtctgctccccatcctttgattagggagctggactctggggttagctgtgtcttgatagcctctgttcaaactggccaaggaaaggacagcccagttcatgctaaggagagcaaaatctccagtctggcccatagcatactcacaatcacatggagaatgtggcctcgacaggggtttttaaagagagatgctccttgcggtctgtgttataactgggagctaatccaaatccaatgctgggagaatgggtaaataaactacagtgcacccacctggtagaacattatacagctgttaataagtattgaggttgattcacaaaggaaaattctttcatttcgttttatttttgagacagggtctcaccctgccacccaagctagaatgcagtagcacaatctcagctcactgcagcctccacctcccaggctcaagagatcctcccgcctcagagtacctgggattacaggcgcatgccaccacaccaagctaatttttgaggttttgttgttgttgttgttgttgttgtttgtagagatggggttctgctgtgttgcccaagctggtcttgaactcctgggttcaagtgatctgcctgccttggccactgcgtttggccaaattcttttatttttaaaaagcagtatacaatagagtatatatgctatatctcaactatttagaaacgtacttgaaaaaattgcttggaaacatgctagcatgctaacagtggcctttggtgacaggattaagagtggctttttgttgttcttttagacttttttgaatgactgtgggtgtgtgtgtgtgtgtgtgtgtgagagagagagagagagagagagacagagaattagtctgttctcacactgctataaagaaatacctgagactgggtaatttataaagagaagaggtttaattggctcatggttctgcaggccgtacaggaagcgtggcagcatctgttcctggggaggcctcagggagcttttactcctagtggaaagcaaagcggaagcaggcttcttacatggcaggagctggactgagaggggttggggagaggtgccacacacttttaaagaaccagatctcatgagaactcactattgcgacggcagcagcaatgggggtggtgataaaccatgagaaaccacccctgtgatccaatcacctcccaccaggccccacctccaacactggggattgcatttcaacatgagatttgggtagggacacacatccaaaccatatcaaagagagagagagagagctgtattttaatctttgtagccctttcactactacataatagacatttaataaatgcttgaaagaaataaagaataaatgaatactacctcataagcacttggagtgacagggatcctgtcttagccatctgtgtgtcccctagttcctagcccagaactttgcaaaagtagctgctcaatacaagtgagtgggtttgaatgaaggcccagactcccagagctgctggacatgtcaactttatctaatacatttttcctgctgaaaaaccaagtttgtactgcacctgagtcagtgctttctataaatcagagactcttctaaaatatcatcaggccctagaatgtgtactatctctctaaggttgtgccctcccccactcactttccccacccctgcaatttttctttgttttaccacattcccctctctaccccttctctctaacctcttttgataatgccatccatcccctctctagacccctgtgaatgagaatttcttctttgtattgaatctaaatgtcttctattgcaatcctgtggataaatgaaacccatagttggtgcaaaaccccacttgagctatttgtgccaatttcatttccctgccaaagtatacagggagtcattaacaagtaacaaaagcaatcaaacacatttccttcaagaatttacatgggacaatgcctggcattgtcagggatctcaagaagtataagctgtggctcctcttgtcagaggcataaggatgtggctgcagatgtgtatggcaatctaagatagtctgtgaggagtgcaaatgagaggtgggaaacagtgagtggcccagcagcttgggagtgggaagtagaaggcttttgttgaagatgaggcttggagggtagatagatggcaaacagtgcaggcattctaggtatacaagccaaccaaggtaaccaagttgggctctcctttttccctgatccaatcctcttatgagttatttgctctggaaaactcagaatgcaaaagagacagaacacagggaaggaaaggagttcagatatttcatatactgaatacctgagtacactgaatacccagctatctatctttaaccagaatgaagaaagggggggggggtgtgcgtttccactgctgtagcaaaggttttccatcaatgtcatctttccctgatgatatgtatactctaagtctcaaagtggcttatagttgttactggtaaatgggcagggccctctcttgcagccatagtctcctcagagcagctcttggcgggtgtgtccttctgtaaataaacacaaggcaaaccctggcttctgtggctggttcatctcaacaactgctctctgagctgaagtgcacctggaattttaaaataaaaatggatggaatgtgtactatccacaggtgagaagtgttttttttcccctcctaaagacaacctgataaatgtgaaaggtagaaaataatgactgagagatatgaagggtgcagaagctaggctgattatccccatgggaggaagaggctgctgagggaagtgcatgggcctgggctcagaagacattggctttggtttttgcctctgccaaaaatcagctctgtgatctagggtcaaatattttaatctcagttttctcatcagcacatgaaaggagtggcctaaacagtggctttcacagtgttttgactgctattcagagtaagaaacacatttttacatcacaacccagcatacacacacacaaacacacacgtgtgtgcacatgcacatgtgtgacacaagtgatagcttcacaaaacaacactgcatgcagtgctcttgggtattttccagtctgctctattttatttcattgtttctgtttgtttgttttttaattatactttaagttctggggtacacgtgcagaacgtgcagttttaaaatgctagtcttgacctgctaaatggatttcacaatccactaatgtgccatgctcttgcagcttgaaaaaaaaaatacagaagtccaaatttctgaggtcccttccattagtagaatccaatgactctgctagatgcctaaaggaattttcttaaaacaatagctgagctgtgacagatgactatgtgcttacattctggaggaggtgtctggtatagaacatggcagcagaatgacctgaagataaacaagtaaattacaaactgctgctaagaagaatgtctaggactgcaactctgccactggctcagagagttaggatcgctgagtcattacactaaatgctgtccaagtcaatagatggcagagacttggggacattgaacctgtcagagaggtcacaggctccccagttgtgggcagtcttctttccagtttccagaaatgagaccctcaaagagtgatctttagtagcctcatctttgtttatacttcactcaacaagaagacaggcaaaataaagcaaaaagaaccttggagagctccagactttcctcttgtgaatttggaccctgatcctggcctcccaatcttcttttgttttcagcccaggaaagggaactaatatttattaagcagtgacacatgccaaggatgttgttacttaattggagcctgaaccactgcatgaaggctctgtgattcccctttcatagaagacttgctctggatcacactgatgctgtgatccatctttccatccaagagcccaagctctttccaccagcccatcctgccatagcttaactacagagtctgggtggattttggtgactggcatcaaatggagggcaggacaggacagggcagcacatcactcagagatcaaaaagttcaaacccctcctttgtaaagatggggaacttgaatccaggaaaggttcaacgacttgcacaatgtcacatggtgtcagaactgcaactagaacccaggcttctactggtctttccacaggatgttggacattaaaacaaccatggtaacagcaataattaaacagtcttcctggtatgaagcatcgttttgttttagaagctgggaaaactatttctaggggaaaaattgttctagatccttttagcgtacaaataaacacacagatatgttctcctgttctgtaagtgttggaatgtttcaagatgctggaatttgttaagagacctagatctttctgatgctgagaggtgaacatgagacacctcatccatagtggggaacaaatctgaattattatggttctacagaacaggaagcccagcaaggaaagactctgggaaactggctctggctttgggctgctctgcaggtgacaggagccttggtggtccttgctctccttgtactttaccctgttccttcctccaaactgccaagcagagtgggcaaggggatggttaccgaggaagaaagggcaggcaggaataaatgggttcacttggtgaaatccccttcccatcctcccaatagatctgagcactcaggcagcagcaacagacaccttagggaaatttcccattttgcctaccaagctgatggctcctgaggattggcttcagcatagcagggacctggagaacaaactggctatgtatctgtgacactgacaatttcaggtgcttattaattgattgatatgccaacacactcctccctgtcatggggcaccagaacggatggtttgtggagggatgtgttcctgcccacaaagctatgtgttgggggtggctgtggtggtagaagggcaggaagaagattagcaagatgtgggtgggtaaatgtgtctgcaggcactctgagaacgtttaaaaatttttcttccctcccttgaaggggtacaaattccatttctgagtcattttgtgcatttttctgaaaatttcaccacatgtagcagtcaaactttgatctcagctgtcacctcccccttcttaaggaagaaggagtagcaggggagaaagccagtgtggggtggggatgtgaggtaaggaggctttctaggaagggaggccaagaataagcattttgcactgctcccgggggcataaagctgtaaggcaatgggatgctcacaaggctaggaaagagagaatcaaatgagtagcacccctaacagggcaggggagatggggttagagaggctggggcaagactaagtttgcccctgatttttaccccttcccagtcgttcataaaaccaagcttcctcctgctcttagaaacgggcctagtctttccaagagagtggcagccactagttttccttaatgtctaagttagctcatttcagaggaccccagtgaccatatccatccttccaatacattactatgaatcaagatcttgacaattccattatctccagtgtttgacaggggaatgaactaagatcagtctataaagacttttcattgccctgtggacatttcctgcgatggcattttctttcagcagtttgcttttgtggttatctgtttgtggtgttgtctttctgatataatagaacacatcttcccaacctcctgctaggcactttctggaagagtcactcagttcttggttatacctgatgctatggatgatacagagagtagcagttctgaatctttgttctttattttgaaaagcactagatcctttttatgtggcagatggcccattctcactcccctaccccatcacccttagcttagggaaacttatttcaatattggtttgggaaagagtggcagcttagaagccaaacagagatggtttctgatcccaggtcttctacttaccaggtggatgacttagcaaatttacttactttctctgagttcccatttccttatctataaaataggggcaatattttcctctttgagttgtgtgcgggtaccatgatattattaatataatgcacctggcttagaacttggcatatggttggagcttcccacaagagcttgtagtcttagatgagggaaatgatacatccaaaaaacctttttcctgttgtggaggataaaaatgacacatagagccttatttcctgttgtaacccttgtcattatcttcccctttcttggggagcagtaacagaggggaggaattgacaagacaaagcaagtgactgactctagagaagtagataaagtagtgggagtgtgcattagtgatatggtttggctatgtccccacccaaatctcatcttgaattgcacctcccataattcccagtgtcatgggagggacctagtgggaggcaattgaatcatgggggctggtttttccaatgttgttcttgtggtagtgaataaatctcgtgagatctgatggttttataaaggggagttcccctgcatatgctctctttgcctgccaccatataagacgtgactttgctcctcttttgccttctgccatgattgtgaggcctccccaaccatgtggaactgtgagcccattaaacctctttcctttataaattacccagtcatgggtatgtctttattagcagcatgagaatggacagactaatacaattagttttctattattatttctattattgcatagcaaatcattgcaaacttagcaccttaaaacaacacctatttattatctttcaatttccatgggtcaggagtctgggtatgagttgactgggtcctctgctcagggttaactgggctgaaatcaaggtgtcagctgggctcatcccatctcatctcatctcatcttaggcccagagttctctttcaagttcattggttgatggcagaattcagtttcttgaagttgtaggagtgaggccctcagctcctagaggccacctgccattccctgccacatgtccctctccacaacacgacagtttgcttcttcaaggccaataggagagcatctctgttgctttttgtctcttttaagtattaactcaggattatactctctcttttgattaactcaagtcgattgagtacagaccgtaaaacccttttcgacttgtaatgtaactaagtcacaggttcttcccacactcaagggaaggggattatacagggtatgtgcacaagaaggcaggaatcttgggaatcatcctaaaattctgcctatcacacagtggcccctggacgtatgcaaataaacagaggaaaaaccttcttgctttgctttgttccatttttatgagaacaaacattcctagggcactaagcctgctatcttgcataacttagccatggtgagattgttaaaaagggaggaaaagggagcatggtgaacccgaagatgcagggcagccttacaatggcagtggagcagctcacgaatgaatggattcaactgtggttgaactgttacttaggaaaaggaatagattttttaaagaaggaaaagggggacagttttccctggaagagctccattagtggctgtctgcctgcctctagtggacacgtaatactagttaatgctctgtgaccaaatgacgtcactgagagcaaaggcattaaagagttttcctcctttccctgtctaagagatagacaggatggtggcaactgatgagtgaaatgttcacctgctaatgtgtggcagaaatccgatatagcttctcaatggagaaagaaaaagattttggaaagaaaaaggtgatgatccctggccctgcaggttgtcattgtgagggttggttcttcccaggagccatgactaggctgcccatgctggaactcatgcattactctttgtatctgtgaattcacagtcccaagcagcaggcagagtttagcagcccaggaactcagcactggcttgcccaacaagcacagtagaaatgtgtttagggtatcagcaaagcatgggcaccaaaaaatgctttttttttcaggtaacttgatatttaatatttaataatgagggaagagaatttgctgaacatctttacactaattttatgatatgccaattgattctgaaatttgggatcacctgctgcagaaaggtggacgtggaggagtgaggactataacctttttggcgttcaaggcctctagagtcttgatgcctgagaccatccctagggaactgtataataccaaaataggaaaagtcttccagtgtcattgctcccaaactatttcatccaggcagaatcacagttaaaccattttgcacaaagccagagaacaaatgctttatgagggtcgggattcctgtgtgttttgttctgtgctgtgttccaacacctagcaccatgcctgagactaagagctacttgggaatgttccatgggtggatggatgtttccattttcagcagcgtcttcccttccctcatgttgcccaactcctttcactcctacaagatcccaaggcatcatcagaagacattttgtgtttctcaaacctgcctgatgataaaaataacttttcatgtaatatagattaccaggcctttcttttggaaattctgattcaaagtctaggttgatgcccaggaatctgtgtttttgacaagcacttctgatgagccttttcttcagatgaacattaagataaataggaggggctcaggttttccccacacaagaattaaagagccatggccacttgacctggtttctgaggggctgtcaaaagttaccaccctaagcctctggtcagcagtgctgagggaatgagggactagaagagtcttctggtctacctcttagtcaccttggcccagccctgtatcctggctcccaccttcctgaaaagacgagcctaagggaaggggtgctcagaagcccctctacttctaggactgcccacctggcttcttgcccattctttccacagacatgctttctgttctgtcccttctcccagctgtcatgagcacatgaattcatggtcctctctgttgggtttggtaacgacctctgccccattgggtaggagttgacttttgcatgcagggagagcctgatttctcagtcaatcccccattactgaaccagagtggaaagagatgagactgggaggtggggggagcagggtgggcccaggacaggagtctggatctggatagtgtgtctggagggtaaagcagactgggccagttcatgccattcccgaggctgacaggctacccaggtgcttgtgaggtcctctttgcagccatttcttagtaaaaatcctcctggttcctaacatctgcttccagcagaatttctgtttaactcatggagagttccatcctaggatccctgtgtacatgaagaagatgagagtgagttaaatgctgtgtttgggggaaggaagccttccttccttgatctcttggatgagttgcaaaaactcatcttgcatctgcagtttccctcccttaatactcattacctctatgatggtttctttaatgcgtatgctcacccctgggtgaaaccaaggaagagcaatgctttgaaagatgacaggcaatggagccggtaggtgtagggcatgataaggataccttggggacgggaccacaagggacagaggcagggcaaggtataggccgaagttcaggtggacagcaggggcggcgtgcagaactacagctctgaggccctgcggccagaaggctggagctgaggcagcctttccattcatctctgaggctttcctccacatttttcagaaacaggacccccatctccacccccaagcaggctagccaggggcttgtcagtgttgatgagcgactgtgccaagggtgaggaatgaaggtacggagaggaaattagctagtcataggtagacggttggtgtcttggagcctcccgtgcctcggctcaggggcaaaagttgtccctatcagtatcataaatgccaaacctttctccggccttgagttagttcttaatgtgaatgcagtagtctggacttccactccacccagactttactcctgtcctcttccccaccccagggttggccaaaagcacaacttaaagccactgatggacaacgccctgtttcttgtcttgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagaggtgacagatcctgggcttgggggcttttgcgggagacaactcggaggttgtcccatccaggtgtcctctgtcccatcagccccaacacacccccttattatagcaagtactttgaaatgctcccgtttctaccctgaaatgaaatccatgggtaatatgcccaacccatacacataagaaaaaataatattatggtctaaatatgataataaagagaaattaaaaggaaattattgataataatatctatttcaatatgcaaatgctcaggcatgacctcactagaagacatcatgaagcagtcagatgtctgcacttgtcaaaagcaagtctggattaagtacagaccttcagaaactattccgaggggcaggagggcatgaccataaaaactggtacattcagtatatattagatatgggcaaaaaataaatactttggattagaatgaaaagggaatttggcttgactcataaataggcactaggtttttcccctataagagattctgatggaacatttaaaattgtgtgagacctgggacacattttcattgaccatcctctgcattatgggatggctgtcatctttggctcccatccaatcattgtaacaattagaatgatcccctagagggctcttctgcttctcttgagaaccagtgatcggtctaatgcccccattctttagtgggacacgcggaggcctagaaaggtgaggaaacttgctcagggtcacacatagcaggttaggtgtggtaccaggacccaacctaagcctctgaaatgcctgccagagctcttttcctccttgccatacactgtgtctcatggaaataggtactgatgtttacatgtctctcacagtcctgagaaagctagagataggctcatagcagtcaaaataggaatacagttttttcttacactggttgcttttcagtgccttaaaaccattctaattaggacaaggggaataaaaagtagcttcattgttttagagccccctaaattgggtatcagaaggggacatgtcagctttttttggcctttagattcttgctatggagatagatggtgtctacacattcaatgtctttcttccaaattccctacactcttttaagaaatggcattttgcaaaagtattaaaatgcaagtaaaatattttaatgtcattatcaaagtggagaaacaaaatggtgatattgttttcatcttatttattccacatttgtataactcctgccttttccccatccttatcttcaatagtttgttgccttcaattatcatcttttttccctcctcatcttttttcccttcctcatctttttttccttttaatgaaagagctaacctcctaatatccctaaagcaattgtttctaaaaattttccttggttattaggggaagacattgtgacacttacaatgaagagtgatgatcagtatcctgtagaagcatctttggcatacttaccattcacttcaattttatagttggctaagaagttcttttttaacttaagccaccttctgaaaatctttctttccacacttgccattcctttgcagcctggattaggcacccttcccataatatcctgtgcatcctcccatcctgccacttagaatcttataatcaaccactatgggcctgttttaccaaccaaccactaataagccattaatctatgagcaactcaagggcaaggatgatatcttattaatttattttattcaaagcacttagcatgaagctgacatatagtaggtcctcaatgaacatttgtggaactgaatcaagttttgcaaaaaactggttgaacattgagggcacaggatgactataaaggaatctgatcgttctcaccaaatcctttctcaggtcccatcattagaaatcttgggtaacattagccctttaggtataattatttttatccctttattttattaataagtcatccctgattaggattttatggattccaccagataacaccaagctgctcgtaaactatcacatttcactgctttgtcaggtttagacttaaagcagaactgaagaacagcaagtgccgatatcaattttctctgaacttcctcctgtggggcggtgagagagggatgtggggcctcctggggtttggaaggaagactgtggagatgcgttttaccctccacagactggcttgttttgcggttggctcaatagcatatcttgggtgtagtagttttaatagcactgcagagagccataaacaagaattatagccatcatggaattaaaaacatgcagtgtagaattaaaattagaaagtgactttttttttaaccttgtccaagaaacacaatagcatactgctgtattcatcagcataatctgcttctgccatctggtggccatgaataatactgacctatcagacaactgccatgctcagcaaatgctgcagtgagcatccctgtaggttctctatttggacagctggaatagccttgcttccaccatgagggagtggataatgaaacacagacaaatgaggctgtggtgacagcagctctgtgcttcttttggaggtgagactgtaaggagagagctggaggaccaagattaaaacctagaaattggctgccttcaagatctgcttgatagcaaaccccccaacaaattttattgaaggcaagggagtgttgtagaacctaagagtcaaaaagcaataacgtatgctgcccacaaggaatccctggtctagtggagagacagacaagtaaccaggtaatttcaatacagtgatagggaggctaagaagaaatgtaccaagtcatttcatagagcttcagggagggttttgtggaggatgtagcatctacatgtatttcaagttatttaggctctgattactttttttcccccttagtaattctttaatgctcagagccagtaatggctttatgtgatgctatcatttatgttcataaatcatggagagagagattcataagcaactataaatagataattatattttatatttcctttcctttcaagttggaggctgcagcataagtttcattggtctaagggaataaggagcaagattccactgcagtttcaggctgtagtggactaatgttctccctacctcagcaccagaaaaaggtattattagggagccattaatctagcctgcctactcccagcctagagcaaagaaagatatatgtttaagattgtgtaggaggggagcgattgaatggaaaattgagttgatgtctcccttccaactactcccctcctttcacttcttcctaaccagtaacacctgtaagtgactcttctgtacggatttaagaatgtaaacacttttccttgtgttacccatttagaaaagcccactgtttgcttgcataatgatggtggcattggaggtgggcactttaacaaggaagacatttatcttaaacagccttcggataaacattgactttggaggcagtttagcaaagactacctacatggttttgaagactttgctctgattgcttatgggagccaacatttgtcagaagaatcccaagcaaagggagatggggaatactatcacatcttctagacacagacactacgttcaggcagcgaggcacacggacagccaagtcagacatggatagaatcagaaagttcaagagtgctcagttcctagtttagggggcagcacattgaatggggcaaagaaaatggagccagcattgggcaggcctgtcagaaacaagtaacaggacctagaaaagcgcatggcagtaaaggcacccaccacagcccattcgaaatacagagaaatgtaatacattctaattttaaaagactagactttaatggaagcataaattcactctcagtcactcagcaaacatgtgatgtaaatactcccaacatgagttatttccaggtaccaacagttgaaaaatggactcacacaaattcctgaatatgtagcaatcagctcccctgagccagtgacagccagctcccgtacccagtgggtgggccgggcagctctgttttgtctgtgcctactttccactccagtactgatggcagcaaatcttccactatgttctcaacttttgttgttgttgttgttgttgcttatgttgttttgaaataagtcacactgaactcagaagtgagccctcttgtacagattatgagatggatccactgaaatgtatgcatccaatttcatattaatagtaagtgaaagttcaattaaaaaccattctgaaaatcttatttggtattcaaattagctaaagtaatgaaaactcacttttttttttttttacagccttttgctaacactcccaaggggaaaagagaaattgaaaatgccaagtgtatttcagtattactgctttttctccttctcagaacaccggagccggagcgatcgccgagagcaaagagcagctgcccccctttccattgcagctcctccactgccagcctaccctccagctcacagccagaggaggcgtgagtttaaggaccgtcactttttaacggtaagtttggtggccacctgcagccctatgcttgctgctgaggaaacatcagtttgtctgggagtcagtttcctgcctcccagtgagagaggctgggctggctaagagctcaaatcatgggcatttgggaacaaattaatttcccttcctttcattcctgaaagaaacgcctcttttttggaatacagacatattttttagttaactggtagcacaatgcagtaaagcaagaataattacagactaaaatcaggaaaaaaaatacatacttcaaacctcggttcttctgcttgcaagctgaaggattcaggataggttacttatgttctttgccctcagttccctcatctgtaatatagggatattaatagtacctggtttatagggctagaggattaaatgagataaggcatgtaaagtgcttagcccaatgactgactgatacagagtaagacctcaagaaatgttaaccacagctgccactactgttattactggtaaagtgacagcatggctgacttggtggggtgaactggtaaagaacttaagtgatacgaaaaattaccatttgaagagtaatcatgtcatcatttcatgctttcccattctccaaaggaggctagttctccagggtaacttaataccatggtgacgtcatcgcctctggggctttcagccctgaccagatggatgtggctgtaactcagcccaagccctcaagcatgggtcacagatgatgaagctgagcccatctcaaaacacctgcaaatactatcagcagccactacaaacacatcaccgcagatgtgccttctggggcctcagtggggacaactgagcactttgtgcctctgagcaggcatcattgaagtgagggactatggcttttgtgaccaaatcagcccacactgcctgtctgaatgtctgcattcctgctgtcttgtcattctggttcaagacccaaagtctaaagaagttacaatagtgtgggtacgagttaaggtttttattagaaattaaaattgcgtgtatgactctaaattgtgcactcttacggcttttacaatatgcaagagagatgcaaaatatttgggtcacatggtgccaaatatccagccaaaaacagactttatctaaatgaacccacatgatataacatccagataagaccttgagtgataatggacaaaatataaaaacatttttcctatttgtagctggactgcaggcaggtccttcagtgctcatcaagtgcacactgagcgccgtgttgcacttactacattgctgcactgcagcccaaggataagaaaaggagacaagggcctcttagggctttctagttcttcagatagagcagtttcacatgctagtgatttgtcataaagcagaagttcttaagcagctcaaatctgcttgctgaggcatttgcttttaatgaggcattttctgcataaaaatgctaaaatattttcccattcattataacatgttttatggctaattaagttggttttcttggaagggggaggtgaaagagaagaattttgagcatttacagaaattacataaaaatataaccctttctcatgatctgcataatttttaataatgtctaaatactaaagtaagactataggaaaaggcttaaaatgacgaatagcaacgagagtacatcatttacttacccaacaaacatcaataagagaagactatggattacacttaggtaaacttcagtaagtttgtccatcccaaatgataatacttagtatttctaagtaattttaactgttttatttgttcaagagtttgggtcactacaaggattagaagattttcatttgagttatatcccttaggcctggatagaacatagttcaagctcacaagactgtatattgctgaaagacaaatggctgcaggtatagagacaggaaatttgtagtcaaattgctggatagacacattttcttagacaactctcctttcatgtttgagatttggtgaaggcatgcttttcttcctttaagaaagcattcataatgagattgacatacagtcttctgcaactctgcaggctattgtactgtaccttggtcattaatggcatggaccatgaagctaaactgcctgactttgaataccagctctaccacttgcgagctgtatgaccctggcaagttagtcatttcagtgtcttggggatagaagtagatagtacctcatagccttggcatgagaattgaacgtggtaatacatgtaaacagtacctcatacataagcactacataaacatcagatgttattattattattagccaatcaattccctgaagtatctataatatggtgataagatcataggtccaaccgtgtttaaatcccagcactacaactttttggatgtgtgacttggaaaaagctattgtatctttctgactcccagtctctttatctgtaaaatggggataatatcaactttacaaggttgttaaggaggctaaatatgatgttttagaaataagattaaactatgtatatgtatttgtgcaagtgcctagcacagtgcctaaaatacctgaatgtgagtctatattcaaaatcgtttacaataaaattcttaccatcaaatgaaaagcctataacatatactcacatataagactagaggaagtataaattgttacactctttctagagggcaaaactctaaatattcataactttgatccagcaattttacatctaggaattcaccccaaggcaataatcagtgtatgcaaagatttattcactagggtgttcatcaaagcactgtttacaatgggaaagttaatcacaaatatcccaaatgtctaacaatagggacttagtttaatgaatactaatataactataggatagaatacaatatcaaaaatagtgttagagaagaatatttaatgacatgggaaaatgtatattttattatcagggatttttacatagtttataaatttgtgtatagtataatctcaaaaaatgtcaacgagtgtatatgtatgtgtacatatacatacgcatagggggaaaaggctggaaggttgtatatctgtgattcccaaactgtgtgctgaggtgccttagggcactgcagtgaactcctaagggtgccgtgggatattttaaaatttcaagggacaaagtgtcatctgtctggtggcatctggtgatggctccaaagtaacctcataactcctacaagtgagaagagaggatgcttggtttcttgacatttaatttgtaccaaaagttctccagggggaactcacaggaaacaggacaagccaatttagcataaaaccctaaaccctttgttagctgaaaattcaaggagtatctctaattaaagcccatctaagagtccttacttatcaagggtggcaaaggaggtcatttcagggaaaagcttccttaaaaaaaaaaaaaaagggggggggtatctattccatcctgctggattttgaaattctatagccagagattagtttaagatcatttatttgggacatgaagttactgtggacctgagctacagagaagagatcgaaacaaacgtcacgaaatcaacacttgcacatagcatctcaaccttttctttaatgcaccacagaaactacagctttaggctggtaaaggatctgaagagttatctgggcctagctaggaaccaaatgtaaaaagtttgtagtaaaaatgttcccaagggcaatatgaaagagaaattgcctgggatcaacttctgtccacatgaactcttggctgcagactgacttgttaagtgtcagaatactgattatttagggaaaggtagggagaggaaagggttcccggagaggtgtgtttgtgtactaaacaaaaacccagttactgaaagtcatttgcctccaggcagaatttctgggtaatttttctaccttgtctaggctgtggtcaaattgagaatggcaaatgtgtatcaaaacaggagcgtttgccagagctgtaacaggtagcctgttccctgcaaatccaaccatgtgttttcactcttggtactaaccattagaagtagtctacacagcctttctttggtaagaaacaatacttttatgtgctcaaaaactattagacttagacttacagtgctgatggctggaaagtagcctgtttgaggcaattgaatacataggttttttggtggatcgaaatatacactgagactcccaggtagctgactataatggtgataccctaggtccccatctcccattatttcctccaaaaatgatatagaacaagaagggaaaaataaaactacacagaaaaacacaccatcagcataacttgaggacagagaattcccaaacatcaaattgactgttaagtaaaagagagaaaacaccaagtctcagcatatttcctcctgttacaaggtgagggagggcagattcagaaagccacatggaagaaatgaactagcagtgggtcctaagattgatctaaaaccaccaccagaaaaattgtctgccctaagtctgaaaaatactacagattttttcagatagacacaaactacaaaaaagggcctaaaagtatgcatattttacaggagcagttttctctatataaagcttctgggggagacaaaagacaaacaggaagggaaatctgcccttcagcaattgggagtgaagaagaaaagaggcaaaaaggaaatttctaggaccctgcaagacaaaataaaaccaaaaaattcaaggacacgcaggagttgtatgtgtccttcaactcctgcctcaccaccaaaacaaacaaatacactaaaatatttgaacttcaacaaactgacagaagatggtgccattaaactagggatcttgtgaaacacaccaaagccacacaaatgagtaagagatagattagcagatccacatagagtgattgcaaaaggtcaatgaaagaatatatgaagcaagggttttatgtccaaccatgctgttcatcaagtatagaaaagcaattttcaacatacaggaacttagagaattttgcacccatgagtcctttatgaggcatctaccacaggacaagcttcatccaaccaagggataattggggaaatgtcagcaaaaggatgggtagcatacattttaatacatgtaaatgtagatctaaaactaaaagtacagtggagatgaagatagaaaactaaggtgcaattttaaatgttgtgacaacagagaatgatacaactaaaaatgagagaagggagaggtaaagaagaaaatagaataagctaattgatcactgtctaggcaataagtggctgttaaaggataccaataagaactagttaaccagatagtaaaggcttgaataataaaacagaggactaaggacattaaaatggtataagaaaaaagaagactactagcaaaaaaaaaaaaaatacaaatcttcctaaataccaaaaaattgttttatataaacagagaagacaacacatcttacagaggaagaaacataacaaatataacaaaatacacataattataacatttatcagagtttagtcatatcaatgaatatgagtgagcttaatttgcctatttaaaaacttttcaatttggctcacaaagcaaatccaactatatgctctatacattaaacacacacaagatttttatttattaattaggtcctgattatttgaaaaaacatgaccaagaaaaagagagagaaaacacaaataaaataagcaatgacaggaaaaaataccactgaaacaaaagaaattttaaaaattataagagactattttgcagacctctgtgcaaataaatttgaaaacctagatgaaatggataatttcctagaagagtaaaaattgccagaattggcgtcattagaattggtaagcttaaacagactgatttccatgggagaaccagaagaagttattaaggagccatgccactaaaaaacatcaggcctagatggtttcccagaggaattctactaaaccttcaaagtccagatgttcccaatgctctataaattgtttacaaacattgaaaatgaagcaaaacttccctattatttcttttatggagcaagtataacattgacacctgaactgataaagacagtcagaccaatatcactcatgattattgattcaaaaatactaaattcaacattagcaaacagaatataacatcatattatattaggagattaatatactgtgaccaatgggatttattctaggaatggaaggttggttcaatattaggaaatctattagtatcatatatcatattaacagatctaggaggggaaaacccatatggttagctccttggatactggctaagccttaaacaaaattcaatatctatttttaattagaaatgcccctaatgtttccatacatatgtatatatgtatgtatatatatctaatgttagagaaaaccccatttacagcaataacaaagaagaccaaatacttaggaattaatttaccagaaatgtgtaaaacttatatgagaaaaactttaaagcactccttaaagacacaacattagactttttcaaatagaaagacatcccctgttcttggatagaatgattcaacactacaaacaaatcagttctctctaagttacttaataagtttaacacaatttcaataaaaataccaataagctttattttatggagttagatacttatgggaaaacaaacatataagactagccaggaaaacactgaaaaaggaaacctagccctaccagacattaagatatagttaaagcctctataattacaatattgtggtattggcacatgaatagacagatatatcagtagaataaaacacaaagtccagaaagagaccagagtatatataaaaacattcaataaaggcaacatcacaaataactgaggcaagagatggagttttttaatgatgctggaacaactgcatagccatttggtgaaaggaaaaatttgatcagtgtttctcaacctcagcactgttgacattttgggccaaacaattttttgttgtggggaccatcttgtgcattgtgcaatgtttgccagcatccttagcccctcccctcacttgtgacaactcaaaatgtctccagacactgcactatgttccctgaggggataaaatcacctctagttaaaaatcatttaatgggatgcatactaccatacacaacagtaaactccaaatggatcagggacctaaacctaaaaaatgaaaccacacaagtactagaagaaaatatgcatgaactattctttgacctcagtccagggaaacactttctaactttggctaaaaatacagaggaaagaaaagaaaaaagaaaagattgatgcatttaaacagtaaacatttttgcatgcccaaacaccgtaaaggaaatcaaaagacaactgaaaaactgggagaagatatgtgcaacagaaaaagggctaatacctctaattgataaatacctcttaaaaactgagggataaagaaaagagcaaaaccttggaagaaaaattgaggaaaagatgtgaacagacaattcagaaaaaaatataggcatgtttcttcaactgaagaaaaattgttcaagctcactctcaattagaaatgcaggccagagcattatgcagcctgtaatcccagcattttgggaggctcaggtgggaggatcacttgagcccaggagtttgagaccagcctgggtaacatggtgaaaccccgtctctacaaaaaaatacaaaaattagctgggcctgatggtgcatgcctgtagtcccagctactcaggaggctgaggtgggaggatcacttgagcttggggaggttgaggctgcagtgagctgtgatcacaccactgcactccagcctgggtgacagaggagactgtctcaaaaaaaaaaaaagaaaagaaaaaaaagaaatgcaaacaacactgaaattccacatattacctatgagactggcaaaaattaaacaatgtaacaatgtattctgttagtgaaactggagaaacaagcactctcatacattgctggtggaaattcaaacgtggtccaacctaactgagggcaatttggcaatatctaaccaaactacatacgcacttaccttttgcttctgcaattctactacagatacacctccagtaatagaaaaaggttatttttttcagcattgctaacaattacaagatgttggaaacaacccaaatacctatacatagaagagtgatggagtaaaagaagcaggaagacctttatgaactgataaggagtgatttctaaggcatactcttaactgaaaaaggcaaagcccaaaaaagtgcctacagtatgctacccttcatgttagaaagaagggtatatagtcatatagcacataataatgtttctgtcaacaacagactgcatatagtctgctgggcccataaaattataatgtcatatttttgctgtaccttttctatgtttacctgtgtttagatatacaaatacttcacattgttttacaattacctactgtattcagtacagtaacatgccacacagatttgtagcctaggagcaataggctctaccatatagcctaggtatgtagtaggctgtaccttctaggtttgtgtaaatacactctaagatgtttgcacaagaaaattgcctgaggacgtatttctcagaatgtatcccagtcataagtgatctataactatataagaaaatatacaagtagccacttatttgcataaaagaaagagtccattctgctgtgacacaacatatgcatccctaaaaatctccacactgtacaaaattgcacaataaaaaacaaagggcttatggagaaaatgggagttaggggcacaacattcaaaaatttcttccaatgacaacacacacagacacacacacacacaaataggaacctaataaaatacaatagcacagttatacacattgtgaatggttaaaaaatacacaaatactgcaataaattggcacttcacccagaaaaagtcctgggggtgcctagggattgggcaacagaagggccacagcttgtgagttactgggaaggactggaaggaaggttacctgaaaccggagggaaggtcataacaccaggtgtgggcaggtgtggctcctaatatgtggagtgaactgaggtggctggtagatatttgatatgtgtgtgtgttatgtactcttatgcagctcagttcagctgtgtgcagttgctgtgttcatctagagagtctcaggttatgctcaaatgtgaatacctaagatatcttaggtattcaagtgatacctaaggtatcaatcacattggaacaatcaatcacattggaacaaatttgaatcaatatcagtcacattgatatcgatcacagtggaacaaacttgaattttcaaaacatgcgttataatgaaattgactgtacaggaaggaaaaaccagaaataaatgagatggatttccctacgggggatgagtgggagtggggtagaaagaatgggaggatgggatggtggtggcaggttcaagggggatggcatttctctgagtatattttttgggttatagctcaggtaatgttttatatatccccccataaataaataattatcatcaaccaggatgtgaggagaaccccaaatggaaaacaaacagcaccaaataaacctaactacattacaaatgaataacaaccaccctgaaagaggtggggaagaaaatagctaacctttaataactttggaaagcagtatttttgtttcattttaaccacaaatatttattgatagattaatgagtataattttaaatggaacagtaaggcataactgtggattaaaacaccttgcttcatgcctgtaatcccagcactttaggaggccaaggcaggcggatcacttgaggtcaggagtttgttcgagaccagcctggccaacacggtgaaaccccatcgctatgaaaaatacaaaattagccaggtgtggtggcaggtgcccattaatcccagctacttaggaggctgaggcaggagaatcgctggaacctgggaagcagaggttgcagtgagccgagattgcaccactgcactccagcctaggtgacagagtgagactgtctcaaaacgaaaacaaaaacatcttgctatacaaccaaaaggggaaagtcatacacttaggaattttaaatatgcaagtcaaagagcctttgaggtaccccacagatgactatcagataattcttcccttttatacaattcctatattacatcacttgatcacaaagttaaaattttactttaaaaggaatccctcattcattcacacttgagtcatcccacctggccactcccctgcttcccaccccttccccatccctttaaggtggtattctttagccattcccttcctgaataattgtgtgggtcaggcacggtggctcatacctgtaatcccaacactttgagaggctgaggctggtggatcacttgagctcaggagtttgagaccagcctgggcaacattgtgagacctctgtctataagaaaaataaaaaaagaaagaaagaaaggaaagaaaagaaaaaatagtcaggcatagtggcgcacacctgtagtcccagctactcgggaggctgaggtggaaggatcacttgagcccaggaggcaaaggctgcagtgagctgagatcctgccactgcactccagcctgggtgatagagcaaaactgtgtctcaaaaacataataaaaagaagaattgtgtgtccgttttccttcttaagcaaggaagcaagcaaacaagtaagcaatgagtcagagaaagtccaccaagggcagatttatgaatgaagagacttacacagacagatgttaggatgacagcaacctgattacttgattcagtgaagtctaaactaagctgactctagcaaagaagctgcactggcttgctcagaggcctatcattccacctcagattggccacaaatgcgagactccatgtttctaagggattaacagtggtctacatgagaagccaggaagccaatataaccaggcagctgatgctacaatacatttgatgctttagatctccattaggagctgactatagcttccagcataatcatttgccacatgtaaaatccttcaagatactgaggacaatctttaaatctcagataggatcaattaggaatttccttaacagtaatctatttgaaaatgtgaagtggaaagcattccagtgcacataacattgaggcataaaccatgctgcagaggtgtgaatgcaggaggctcaatagagtgcccagcctccttgttcaaaaagccatgagaaagcccccaggcatattgtcagagcagccattgtggtggcaatggtgtccccaaactaagcaaatcagcaggcatatggctattttctgaagaaccaacactgcactaacaagagtagccatgtagatatgtgtgtggagaatcacaggccagagagagagaatgacctgggcaagccacctagaacacttggttgtacacctcgtgcctttcaagaagagcatctccactaggtgcagtggcacgtgcctgcagtcccagctacttgggaggctgatgcaggaggatcgcttgagcccaggagttggaggctgcagtgagccatgatggcaccattgcactccagcctgggtgacagagtgagactctatctctaaaaaaaatttaaaaattaaaaaaaaatttttttttgagatggagtctcactctgtcacccaggctggatggagtgcagtggtgcgatctcaacttactgcaagctctgcctcccgggttcatgccattctcctgcctcagcctcccgagtagctgggattacagttacgcgccaccacgcctggctaattttttgtatttttagtagatggggtttcaccattttaaccaggctggtctcaatctcctgacctcgtgatccacccgcctcagcctcccaaaatgctgggattacaggcgtgagccgccacgcccggccaaaattttttaaaagaaaagcatctccatcaagcagacctttgatgactgactgggcagaatggaggggactaagagatggtcacattcttctgagagaagtgttggttcctgaaaagctcccagagagacaacatcccagaggcccatttatgagtgaacgtaaataaaaacttccagaccacagaactttcttgccaagtcagaaatatattcaataggcacagcttggggtgccacgtggaacagagggaatttggggggttaataaaaatcagggaggctaaaagaccaagtgcagttgctgcattcacacccctgttgggtgacagaagcaggaagcaaaggacatatggacaagattgaaggagcatgcggaagcctacagtctagtccagtgaaagagcttggcctggttccccctctcactttctcagactggatggatatgtggcgtcagcagcagaagagtggagataacatttagaaatggagaaccagtgaattcaggctgaagagaaatagactgggtgtactattctgtaatgccctgtttgcatcaaaggcaggcttgtgttgaccgagcacatctggagtcgtcatgcatcaatagtagcattttgggagacggggcatgatggggtagaggtggggctgttggacaggaggactctcaagttccagttgttaaatactaaagagcatggaacagtttagtctcagttcttcagtcaagaaatcagatgttcattttctgttctatgtccaccttctccaaaaacttaaaacatcctgtgaaagatattgcatcatccccatcccagttagcctcctggatggttctgtctgtgatgatgcccagtcgctcatctgagttattccctctgaccattatgcatagctcctgtaacagctcactgcaggagatgttgtctaacatctatccaaatcatataattaaaaaccaaagtgaagtttgctgcttcagctgtcaagtggttctggtccattcacatctttgctcctttcgtaatcatcaatgggtcagaaatgagccaaggttcttatgaatccacagaagttcagctggtcctccccatcttaaccaagtgaccaaagttaatatcaccagtaagagaacacacctgtacatggacctcctgatgtgatgcattgagataacacttctgtgagagacccttgtcaaaaaatatgttgcctcaatctaatcatgagaaaacatctgacaaaccccaattgaaggacattctataaaataattgaccagtactctttgaaaatgttaaggtcatgaaaaacaaagactcacgcctgtaatcccaacactttgggaggctgaagtgggaagattggctgagctcaggaatttgagaccagcctgggcaacatagcaagacctcactctacaaaaaaaaatttttttaattagccaggtgtggtggtgcatgcctgcggtcccacctacttaggaggtggaggtgggaggattgcttcagactgggaggtcgaggctacagtgagccatgattgcaccactgcacttccgcctggatgacagggcaagactgtctcaaaaacaaaacaaaacaaacaaaacaaattgaaggggattgaggaaatttgacaactgaatgcaatgtgcaatcctggattggatcctggttgaggaaaaaggcatcaatgggaaaactgacaaaatttaaataaggtcaatagattagttaatagtatttatcaatgctaatgacctggtttcaacagatatactatggctatgtaagcttttccattaggaaaagatgggtaatgagtaatgggaacactgtgctatttttacaacttttctttaagtctaaattatttcaaaatagaaacacacacacacacacacacacacacacacacacagttggcgccatggacatttcacagtttctgggttggcacttacaccgctagtgcttctgatggatatatgacttcaggtgaaggtgagttcacgcaagaaatgcttagtgcagagcttctttagtttatataacaaaatctagaagatcacagagaatctgatataaggtgattaaaagctgtcacggtattgagcactttggctccacgcacactgtcatagcatagattcccatttcagactatggagtcagttagccatagcagttcaccctcacccgctgctgaatggaatgttcagctcattggttctcatcagtcatgtctctcagtccaggcctggatctgcaaatacttgggacatgcacttgctcttctctttcgcaagcctaaggcagacattcctattcaattacagcactgttttccactgagtccacacagccactactcaccagggttagcacttgagttgaaacatctcctttttctgctttcaccctgcagtagagtccatgaggacccttgaagcccaagtccttgcttagattctgatatctggacagataggcaaggaggtcacccttccttaaatgtagtgggatgccagcagtctcaacaagttttcctctccaagcctcatcagaatgatcgaggggtgggatatctgatggtctctatggcagtggatgaagatacttggtatgagacggagcccctatggcaaaagttgatttggttccagaggaacactaagacctaaatcctcatcatcaggatcaacagtgaattcatttcaacatattgcctttacagttgtattgtttgccagacttgataaaattagccaggagcaaaatatcagggattctttgtcatttcacagcctgataatccagggattttaaaataaaagactgatgtcaaaacaaacctttctttttaccaaggatgtgtctttgaagggcaggggacattccaactgccttattgggaaagaaatgaaggaagtcactcaaactaggacccagaccatcttagtcttagtcatagttcagagctataaacaatgaccatgtttactctcccattttctatcaggaagaaaaaaacgggtcttatgagaaagcagcttctgagaaaaatcaaagtaacttacagaggagctagccaggagagaagatcaaagactagagctggcaggaagggtgtttcaatagtacttgaccaagagtacaagagtactataaagaccttctcactgccttgttttctttcccatccccagccccgtcttctcttgttcatcctcttccatccttccctttctctgtgggttcatttaagattttcagttttccattggtttacaatagagttgggattgagaaacgctgatcaagcctcgcctttgctatacaagagttagacatatccagacttgtcctagacaagtctattttacctttataaattgtcttcatagttttacaagctctctcagacgtattctgttgttttattaacttctgtctaaaatagttctgtccatccaaattaagtctttcttgctttggcttaggtgttctctgtatctcagataatttgctcctttaaaccagttaaggaaaatactaaccttgctatgcgaatctctgacatacaaattattctgtgatcccaaaccttcagctcctccattctgcccaaagaaataagttcaaatccttagcccaactctccagactttctacaattgggtcctaacttacctttcgagatagatttcccacaaatcctttgcacggaccatagacctcagccaacccaaactacacatgcttctccagaaaacctcctgtactctcgaaacaatatctccacttgaaatgccctttctcccattgtcttctcattgactccttcattttgaaaaaaattaactgaatgcctactattaataagtactagaaggatacaaacacgaatgagacataatctgtttcatccagagtacatggagactagaggcaattctattgtattgacttgaaggtgtgaatacctaactggtgtatggtgttggaatggggtggggtggcaggattaaacttcatgggaaacatagtatttgagaaggccttggaggatggggtagaattttgatatgaacactgggaggaaaaggattatagactgaggaaactatgagaggcaggagatggagtgtatacacatgagttcaaatactttgctttggctggtaagaaaaggggtgtgtcaatagagggcactggctataatgcttcagtaggccagatattgaaggatcttgaatgccagactagaaagtttgaatttatgccataagcctagcaaattattgaagggttttgggcacaaaaataacagtgacctgaaggagctatgctttatgacaatatcagggtatgtgtgtataggattaatttcctcaatctctagagattgctttttggtttagtagagagaggagcgtttgatgttagtgtcaggtataagattgcagaagtggtgatgcctatatacctcccatttaactcacctgtttggtctttggagaagagagatggatcttggagactggctataaatagctggtgactttagttgtatctgctgttcacatgtggtatttttcttgaagtaaatcagcacaacacctggcctatggaatgatacagctattgaccacaataaattcttttcccctctatacccattttcaaggctcaccagaagcagtttgcttttgagatcatgtcagctctcctctctgccataacataagctgcagagatcattgtcatcttgacaccccacatcacgctggttcatattgtcctgattggactcagaacaggaagcagcaaggaccttagataccttagtcaagagcaagccagagggtaaaagcctggttccatgtgctttatcagtcaggctccagtcaggaaaacagaaaccaagccagctattttcacaaagggaatttaacataggtacattattattacaagactgacagggcaaatgggaaactgaggtgacactgagatagtaacagcagcaagaagctaacattcccagggctggaggaatggaaggaaggggttggagttattggagcagcctgcggtactagaactcagacctctggagagtaaccgtggcctggctggtgctggtgcctcaggagctctggagctcagaagcttctgaggaactgggacccagacctccgagtatggggtgctgcctgccaggtgctaatgcatcagaagctccaaagaaggaccacacacagctggaatctagaaaggggtactggacggctgggtctgactagcatctctgacaggggccataatgaggctggttctgggagtgaggaaacagatgagggctgaaaccaattgccatagctgggggcaaaggaccactgctgggacaatgctaacagaaacagtgagtgccaagaagtaagtcccttcttcctcttccagccttctaatctccctcttgcgctcccactggaagaacctaacagggaggagctggcaagaaagaaatgtttgcaaagtcccagcagggcacagaataggttcagaactgagaaacaatagcttaatagccagcacaatagctaatgaaaacattagccaatgagtctggttcatattaaatactgtgagaaatagagaaaactccttagttttggaattctttctttctcttttaaatattggcctggctgtggaactgtcaataaaagtacttgtgtatacacatcattacagaatattctcaggttgacattctgttgcatgcctgagacttttttcactgttcaaaatataggcagacaatggaacaccactcacaataaaaaggaatgaattattgataaacacaacaacttggatggattgcaaaggcattattctgggtgaaagaaaccagtctcaaatggttacctagtgtataattccattcatataacattttcaaaaagacaaaaccatagagatggagaacagattagtggctgacaggggtaggggttgggggaggttgtgactataacagaataccacaggggagttttgggggagtaatagaacagttctatgtcctgattgtggtcatggttacaagagtctatacatgtgctaacattaatagatctgtactcaaaacaaataaaaaggggaaaacagtaaaggcagaatgtgcatggtttgtgtgtgaggtcttacattttttgctttttaaaaatttgcagtgatgaggtcaattatggctctgctgagctttagccacagctggcctgagttagcagtgcaaaggttcccttggagtgggcctgagtgtgtgacatttctgcagttaccacacgcctctgacttccccagctgagggccatggaggagtgctgctgtcacttctgggctgttctgttgactcacatttccagcttctctgatatgggtgagggtatttgcactgtttgtagcagttcaaagattctttcttccctgcacttcaaagcctggcctgccttttccttactcatgtcttttatttggttctagcaacctttgagggttgatggaactgagtggcccttggcagtggctccactaattggcaaagctgaccacaggggatgaataagatactggcatcaacatcacagtgatcatggtccagtgggccctgttttgtgttcttgacagtacagagcaattcctgggaataaatgactgtgctgaccagccagcaggaagcattctccatcctgggctccctatagccctcttttccattcatgtggggactattttccacaaatgttccaaaacataattggttatgctttgcacatttaaaatgcttcattaataggatgtgattaaacaaagtgttcttgaactttaaaatatataaaattattttgcattccattaccctaagaatttttgttccattccagctgagatcaaaaggagagagagagatgctttgcagtcacacattctctttcagaaagcctctttttgggtgaaaactgcaccattgtcatcgccattcaagctttgctcactagggacagttgtcacaccccaaacatctaccaacaggataggatttaaaagtgaatgagcatgtactcttttggtgtcttggctgcttatgctacatatacttttttgagattgatgttattgtgtagttttccattgtatgaatataagattgcacaatctgtttatccattctgctgttgggagatagtcaggttgtttctagttgtggggtattgtttgtttgttgacttttatgaataaagctgctataaactttataagtattttataagtatttttgtgcaagttttttgtggacatattcatttttcttaagtctatatacctgagatggaattaaagggtatacatatgtttaagattagatactgccaaatagtctccaaagctacaccattttacactcccaccagcatttatgagcattccagtcactctacatctttatcaacattaagtgttattaatctttttcatcttagcccctctagtccacagtgtggtttccttttgaattttcctgacgagtaatgatgtcaagcaccttaatatatgcttattggccttttgtgtgtgtgtatatatatatatatatatatatatatatatatatatacacacacacacacacacacatatatatatgtaaggtcttattcttgttttcaaatgtaacacatttgtatacacacacacacacacacacacacacacacacatatatatatatatatatattgcaaagtgcccctcaggagaatcaagaaagtggtgatagctatatctctcagggaaaggaagtaaaggtatgatttggaaaagcagacttatcaataagaggatattccccaggcctgaataacaatgcttttttgtgttttaaataaatattaatgtatatggtggttaaagaaataactcagtaggcacctgttcccaaatatccctctccacaaccattacccagaacttcgccacggtgattggaataaatcactgtggattgggtttttcatgatttgttgtcagcaccctaataagggtgcattttgggcttctttctaaccttgaagctggctgaaaggttagcgtgaagggtttaggcacttggggttaaggatggcatgccaggtgggagtgctgcattcaggtactttgggtaagcatgaaggctctgactgctgaggagagagtggtgacaaaggtcaaacccagaaagggaagaagccttaaaacagagaaagcataggatgtgccttaaacttctgcctacctcttcattgtgtttacccatgattgttcaccttgatgaatgtcggagttgaggagaggggaagagggaagcacagggtgaatgtagaatgatgttactaaacatgttgggaagacaagagcacaatgccaacctttgggagattttgagacagtctcaagggaataaaaaagtactacataattgtagcaacaagaatgacatgtgaagaaggcattgtcaggcttcttgaagcctttgagaaagatcaaaggagttcatatttatatatgatacatccacaaacactcctgcacaggaaaagctgaggccaataggacacagtatgtgcacaaatgcaaggatttggtttaaggacaaacgagccccatggtagagtgaaaataaaagcccatatcacctcactagaaacccagtgtggtttgcaatggacatctttgctgtaaggtcttattcttgttttcaaatgtaacacagcatccagcctccagtaaatatttttcatgtttaagacagcatgatagcaataaatcagctctgaaagtcaactgctataagtgccatgtggtatcagttagatcacaaaccaaagccaatttttcaaaacatttcctgctggaatacccacaacattttaacagatgtattttgggctgtttcgaaagaaaataagcccccatcagcatataaaatataactcaaaagaaagtaaaatatggagtggagggattattttttcttttggtagtaagagaaagattggggatcatcttgaaacccttggggaagtgcttgttcatagccacgaaaggggagaaattaacttttctcacacacatacctcaagaaagactggagtttgaaaaatcttccttcattatataccaaagacatttatttggctgcttttgagcataatgtttgttatttcttattctgaacactggtcataagtataattctggcttttgttgaagcaactcatgggaagctagggaaaggatttgaggatatgactgatgaggccagcagggacagagatgaagtgaaggcatcaaaagaatcatcttttgtcagggacaagatgggcatggctggtagttgctgattataaaatgctgcaagttggagtctgaagcttttcaaaatcagtggtagaagggccagaataggagtctggaaaaggaggaggaaattactcttttttttttttttgtatttttcttcaacagtatattatgaaaaatctcaaaggtacagagaagttgaaagacttgtacagtgaatatgcatatatatacccatgagggagaaattatttttaaactgacggtttgtttccactggggccaattttgatccacatcaaataaatgatcttgaatgaatgaatgaatgcctaacacacctcctaccacacttattctggggaaaccaaagttgttcactgccactcttgtactgagtgatgattccacaatcaggagtcccctgtggatctgcttccattatctgttgttttggatgcttcctgctcatgctgtcttatctcctcctgtgctttgctgtctttgaccttgtactggatgttgtactgaaaaattatatgtgggtggcaataatttgatgttatttctctagaagagaatttttgtttgcttatgccaggcacgtgagcatgttagctgtacaacacatatttattgagcgctattgaggcagtaaaaatagagttatgaacaagaaatggttagtctttctctgaataagcaacgagattcatttaaacagttgtggaagaataatttagttcatataagtttgatcagcatccagctttccctaaccttatccatcagcacccattaaggcgtggcaggctgagccatgcagagatgccctgaggtagcagttctcttgcagttgtatttcttagataatttagaaaaaatatatactgtgaactgattattgcattcattatataaaagtgtaatcagaaatactcagaacaatcttacttcttttgactaaacatccaggaaagaggatgctttattttatttttaaggtttttaaaaaaatatttcaatggtttttagatacaggtggtttttgattacatgagtgagttctttagtggtgaattctgaaattttagtgcacccattcacccaagcagtgtacactgttacccaatatatagtctttcatccctgaccttgctcccaaagtcccctgccccaagtccccaaactccattatatcactctgtatgtttttgcatcttcatagcttagctcccacttataaattagaacatatggtgtttggttttccattcctgagttacttcacttagaataatggcctccagttccatccaagttgctgcaaaggacattatttcattccgtttaatggctgagtagtattccatggtgtatatttaacacattttctttatccaatcgttggttgatgagcatttaggttggttccatatttttgcaattgcaaattgtgctgctataagcatgcatgtgcaagtgtctttttcatacatgacttcgtttcctttggatagatacctggtagtgggattgctagatcaaatgatagttctacttttagttgttttcaaattttatttaacttttattttaagttcagggttacatgtgcaggtttgttatatgggtaaacttgtgtcatgggggtttgttgtacagattattttgtcacccaggtatgaagtctagtacccattagttatttttcctaatcttctccctcttcccccctctaccctcccatagaacccagtgtgtgttgttcccctctatgcggagggccctctaaaatactagactaaggcagttactaattaatggcagaaatataactgtatatttatatacttatagctcattttaatattataaacttaaatactctgaatctgcagaccatctgcagggactctagagcttgtgtctaagtggaggaaccaaagaacacaatccctccacatccaagctccagagtacctagtttcaaccctcacaagctggaggttggagctactatcaatatagtggagagaccaattagctgaggaggaatctgctatggagtgtaacccaaggagaccttaactctccatcacaatgaccacaactgaaaagtctgtgctttctctgaacttgccatccttagtcattgtcaggtgtgacctcatgcttatttaatggggtgggtgggtttctcaaacagatgaaaaatgaagtccactcctcacccctcactactggaaaaaatattcaacaggagagctgacttaggagatttaagacaaactaccataatttatgtattaacattaatatcattctgcagtttctgacggtgtgattttttgaaaatactttcatgagacaccaaagcttttggtttctttgaagtaggttcctttcccatgtaggctttgctatcaggctaccttttttcctacttaacatgagttttctctctcatttacacaccctggtttcttacttgagacttccacatcattgtctgtggctgatttttaggagagaaccaggttagtgtctgaactcggaccacatatatcacatctgtcaaaatggtcactttcagcaagggagccatagaccctacaaaatcattagtcttaaataagatctagatcaaaattaactgggcccgaggaggagacatttgctttgcttaaacattaatgagcaactctttcagttaaaacttagaaaaatagaacagaattagacaccaagctttccccacaaaaacgcatgtctgccataggcttaagaataactaggcccagcatccatccttgcttccatcagaggaagcaaggatcactggcagtttcctctacttgtttccacctgtttgcatgaagatggtaagtcccttggattctgaggaatttacttcctcctgagatcttgagcattccccttactctttttttttttttttttccctccgagacagagtcttgctctgtcacccaggctggagtgcagtggtgcaatctcggctcactgcaacctctgcctcccaggttcaagcaattctcctgcctcagcctcccgagtagctgggattacaggcatgcgccaccacgcctggctaattttgtatttttagtagagataaggttccaccatattggccaggctagtctcgaactcctgacctcaagtgatccgcctgccttgggctcccaaagtgctggaattacaggcatgggccactgtgcctggctgccccttactttctttggggttcccatcactgctaaaacacacagagacaatatcattcaggtgcacaaatattttgatgagttcttacagtgatgcatcatggaagactgaaaggcaaatcaaatgtggcctctgacctccaggaatttgcaatctaacaaatgaaatagacacatccagggccaattcctgttccattaaagccatgctgtaggataagtgctataatagaggcccagctgaatctaaagctgatatggcttagagttttaaaagtttcagtggccttctcagtagatcctgaagaggggattctggttaccagattattctccagataggactggctatataatttctggggtccagtgaaaagtgaaaatgaagaatcctttattcaagaatttcaaaacagtgacagcacaacctgaaaccaagtatgggggccttctgagtgcagggccctatgggactgctacacagatcacacactcatgaaattggccctgtctccaaatgtggtctatgaataggagaaagaagtaaattttgagcagtctagagaaggaaattacacatagagaattttcttccaagtagttcacaaataaataaataaataaaatcactccaacgaaagcaaataattcaatcttctccaaattagcaagtggtgttggaatctaaaacataacaaagttacagtttgcaaagacattttcacagatatttcacagctacaaggtaagtacattaataataataattgttgtagtagtagctggcactaatgtacagcatttattaagtgccacgattcttctaagtctattacatatactttactcatttaatcctcaaaacagccctggagggaaaattctattatttctctatcttactacagatgaggaaactgaccttggggaggttgaggaattgcccctggccacacagaaaataagtggtggaggcaggatttgaattcagacagtctagcttcagagtctgtgctcttaaccactatttatgctacctctgaaaaaataaagataggaaggaaaggaaggagggagggagggtggtgggagggaggaaaggaagaaaggaagagagggaagaagaaggaaggaagggaaggaaaaaggaaggagagaaggaagaaaggaaggaaggagagaaggaagaaaggaaagaaggagagaaggaagaaaggaaggaagggagggaaggaaaaaggaagaagggaaggaagggagggaaggaaaaaaggaaggagggaaggaagaaaggaaggaaggagggaaagaagaaacggagggaggaaagaaagaaggaaggaagaaattaggaaggagggaaggaaaaaaggaaggaagaaggaaggaagggaagtaggaaaggaagaaggaaagcaaaaaggaagaaggaagggagggaggcaaggagggagagagggaaggaagaaggaaggaaagagggagggaagaaggaagaaaggaaagaaggaaggaaggagggaaagaaggaaggaagggggaaggagggaaggtaggaagggaaagaagaaaggaaggagggaaggaagaaaggaaggtaggaaagaaggaaggaggaagtaaggaaggaaagaaggaagaggaaaggaaggaagaaaggaaggaaagaggaaggaaggaagaaggagggaaggaaggagggaaggaagaaaggatggagggaaggaagaaggaatggaagaagaaaggaaggaagaaaaaaggaaagaaggagggagggaaggaaggaagggaaggaagaagggaggaaggaaggagggaagaaaaggaaagagggaaggaaggaaagaaggaagaaataaggagaagaaaggaaggaataataaggagaaggaaggaataatgagaaggaaggaggaagggaaagaaggaatgaaggaggaaggagggaaggaaggaaggaaggaagttatcccagtatattattttattaatatcatagatttggcctaaccagtatacactgtgttgtgtgcacgtttttaattttttctttttttgcatttcatgttcatagtttaacagcacccgttcgccctcccccactgaatgttgccacatgaccccgtggagtagaaaggtattggttctgagaacattccttcacggccctatcccactctgtccagacactcttccttttttccctcttttaactttatggaaaactttcttgtttctaactaacggtttttctttaaaatcaatttaaaaagtggtattttcctaacttgaattaaatagaatataacttagacagtcatgccatttgcctttttcccccattcactgccccccactctgcaaactgcatcacctaacactactcttggactttgtagtctggcagaggaaccttttcctatatttaatttatcagaactgtaaatgttcagcttctcaaatcaaaaaggagaacaagacaaaaggattctctggcagccaatcgtcctgtcaccattaaataaaaagtgcttttggctgctggtcagagcttgtagtcaggtcactatcctgtcgacactttgcagtccattgttattcaaggaaggaatcgcctacaaaatgaagcctctggtggtggggggtttctctttattgctcattctctctctttgtctccctctttctctctctctctctcaatcagtttctctctctctctctctctgtatgcaccaaactttttttctttttggaagttacctaggaaacaaagtcttttgttctcgaactttatttgagctattcgcttcgctgggaatctgcacaaaagctgaagagagaaagaaggttgcaatattttactaaaacgttcatgacgaacatatttttcccaaggggggagtcatatcctgttgggtgtgttggggggatttgcagaaacctctgacaaggtaagtaaatgctgggggtgagtttagacaagtggcattggaatcagctctttaaggggacttgagaacagttcatttgacaataggtgaaatcctctgagtcaacagggcatgatatttccaaatgtaaagatgggaaaattttttttgatgatcctaattttagggcagaatattattaaagtcttactgggataacagcaaaagatatttattttatacagatacccaccttcctccaaattgtgtaaaaaataaataaaactaggttgagtggtgaaaactgagtcttttaatcatctagtttagaaacccaaccctgaaatcaaaactgggatggagctttttaaataatctgggctaggagcccaaccctgaaataaaagttagacaatattgatatttatcaaaagtttggatggagaattttccaatgtcatgtagaaatcaaagcccctaactatacagctggaggaaaagtctcgcaccacaaagctgaaaagaaagtaaactaggactctttcacctttcctaatttgaaaaataaactcactggaatatttccccccagtaacagcatgtgtattttccgctatcgttggtagggggaaattcttcacttttgcttttccatgtgcatacaagtgttcatgaaactgaatttttaaaatgttattaaaaaatgccgtagtcctggagtgaaattaactcctcatgttttaatgtggcttctcagattaggttggcttgtccttcaggtgatgggttctggaatgtctcctgactccaggttttctgaaccttttcataggtgtctaactcatcttcttcctttgatcctagtcatctagagatctcaaaacttttgatagaaatttatggtgagatagcttgaaagtggatctgtctttcattggagtaaagactcaattttctttggtgtaaagtttggggatttctggctaccttgtctctcctgttaattccatttaacctgagaagcatgtttatttagcccatttctttccttttgtgttgcttgactattgaaataatacttgtaattagttgtgcttactaactatttctaggaattcttcctttgtcctaagggcctatttctgacctcattttttcttctctaaactaggaaattccttatatgtgtgcttatgtataaactatgatggctgaacctgattgtactttgtttgcagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggtatcgttctggttttttcttaggggcagtcgggtcagaatattctgtgtattaaatatgttcaaaatctgtgctgctaagaataccattttgtaaacaagtaatgcctttttgtcatcaaaatacaaacccagaggatgttcgatatgcttttgtcaggttttgaacatcaatttacatgttttccgcgggccacttgttatgtaaattatggacagtttctttttgaaaaaaatcaccaaatagctctttggccatagctgactgaaataatggagaaagcggcagtgattaatcatatgataatgatgtgtggcactgcaagaaagaaaacagcaaacccaggcttctcaaactgcaagtaatggtcctgtaggccaactagaaaatctgttttcatgcttccttggatgaaggtaggctttttaaaaaagactgttaagacttctgtattgatttgggggatttttgacctaaaaatatatggatacagagatgaaggctgaattctattttaaaaccagcaaggctgtcttcctttcactctctttttttctcctcctgtgtactgagagtgtgaatattagtctagatagaatggaagcatagccagacctttctgaaaaatttattggcagcagttataaattccacaattggatctagtaatcttagtcgtaagtaaaataatgttataaaatattctaactttcaaagacataaatggtctatccattgggctttcttacatctctaatagttacattttaacttatttgtatattgaaaatttcaaaacagccatgttatgactgattttcatattggtaccatgtgactaaagattgcatgtcacttgagatgcatgttgcacacagctatcattaaccccactcagatttctctcaaataaagtggggaagcaaatggaccagatatctgggacagatattatttttttcctgagaaaaaaggagtcctagttcatgggtctgtggtgagttgggagttaattttcctgatgacctattcaacttgtaagataaattattctaaagatgtgcccctatctgatctccacaatctaaatgggatgtattaggggagttcagctgccaaaatggatcattttggcaccctcttaagctaattttcatttctggaaacctctgattattagcagcacgtgcttttttcatggcactgtaagtaaaatctcattttcaaatttagtgctatgattatgggccattattttatgattgagggaaagggacactttttccttctgctttatttcaggaactctctgattaaaacttagatcagatgttgatttcaagagctttaatgagaacattgttaatgatgtccacataacacaaaatgtctgcgtctatatataatgcattctataattactaagatcagaatgaaggattttaattttgggttggaactaagaaaaattccattagtaagaattctccaataatattgtaattattcatcatatgatatctcatacagatttttcaaagtgagttctagaaactgttggcactgtgacgttaaacagaactcaactctttcattatacagctgaaccaagacttgacacaccacccagccccatgcttaacaatcaggataaatgatgaggtgaccaaattccaaagcacggcattgtgactttctgaggcaaagctcactttgaaaaatccatggtgcagacaagagtttgagttcctcacctcccctctcatcattctagttgtgatgggactgcatgtaatgttgataatgtgattatggagagagaaactaacaagcaccatggtttgccctctgtgtttacaaaaacaaacctatgggataaagactggcaattccagctttacagttggtatagaaggtggatccatttaagtgcagaactggggactgccttgtatgtttattttatattgaaaagacatctcatgctaaaccagaaagcattcagtttagtaaatagaagaaagtagacagagttgggtgatgatttaaaaaaacaaatccttagactgttgagtttcctcacagcaaaagaggtgtgtgtgtgtgtgtgtgtgtgtgtgtgtgtgtgtgtgtgtgtgcgcgcgcgtgcgcgcatggggaatgcaagaaggtttggaccataagagatggagggaacaaaacctcacaaagacggcttttaatgaagaaatgggtcaggatatgttagctgagctaattcaggttatcatcctggctgctgatttactatgcaaaggtatcagcttcagagagcccagaaatagatcagtaaatagtagtaactaaaggttataaatccttaaggagccatttctatgtgagagggattttttggatgtctttttctcttctctttcttttgatttttcttctttgcttgtttttgttggcagtgcaaactgttgtggagagctgcatttagaagtaaagcttaatgtactgcagcataatttaaataagagctgaataacagctcccttatatttgttcacaggcttaacccaaactctttccttacttcccgtcaaaaatatcactgtgttccaagtaaatgaaaatttgtttgccatttctaaagctaatgagacctatttgtgggttgcaggagttggctttgacagagaggctagtatacgctgctctctggttcattcacaatcggtactacagcggagacgaaaattgaggaggaggaaaaccatctcgggtatccccagaagagttcaacaagaaataggtgtgatatcaaaaaatgttaatggttaacattcctccgcctagtacagatgatagggagatgaaatagaaaaatgattaaacattttaacttgtagaggttttaaaatggtgtctatttgttttgtattcagcaagccaggtggtattactttttaactctttattcttgactgtgaagatttgaccttatagatttaggcatatacattcaggtcttacggctgaaatgtaatacttagctgatttttgaaagttttattaaggtagaaattgtgaataaaaagtagcaggagtcaatgaaagttttctttttggaaaattgtaacttaatttaagagagatatactttcatgtcattaattattttaaaaggtaaattccaggcatatgcaatgaaatattgaatattgataatatgatacctttggtgacaatgtttctgtttagtggatttaaaatatctctgcctatgatttttaaaaaattattagggtatcatctcttgcaaataagatttttatttctaataatgagacctatgatttttatttcatcatgtttatattacaaaataaaaatgaagagtagtggccaaaaagataaaatgtactttagtttttaaaagtagtcacttattgtggcaaattaacgtgatagtgaagagagggataattcacaaaagacataaaagcatatcttctcttggtatgtatatatacatatatgagggggacgtgtatatacaccctaaagcattttaactctcacctaattctatatattgattttttttctgttaaagaaaaaaaaaaacagctctaacctgccagcccacagatctacagacatagctcagaatgtctgttggtctgctgatatagaaaatatctcactgtgctttccatgtgccctagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaaggtcagtcactgataactttgtcataaaggaaatgtgtctcatggcacttcctggaattttttcttatgttcccaataatacggtacagccctgggtgttggtttccctccactatttctttgcacttattaaaacaattgagataaaagcttttgttactgggtgagtaagctttgacaggtatctctctcatttttaaaaaatggcagcaaggtaatttctgtttgtttgtttgtttgtttgtttgttccctgagtcagtgaagtacagtagcgtgctgggtaacttcctcttaaagattcttctgttcttattttaagaatcatcaccgagtgatgactccatcatttcaccacttagtgaagactcccaagctgaagcagagggtgtgttcgtgtctccaaacaaacctcgaacaactgaggatttatttgcagtcattcacaggtgaggcaacattaccaagtcccccaaaacaaaaggtacaacaaaggttttgccccttcaggtacttctcacaaatgcaaatacaggaaagctttttgtaattgtaatacattcagcaaaaacaaaagcaagcaaagaataatttttccaaatcaagttgatagactgatatgcaagttgggaaataggatctttatatagagtttgatagacctcgattgagagacttttgtaagagtggctttatttttccccaggaaaagacattctggaacaagtttttatgtgaaaacaatctgtggttaagtgacttggagtgaaagctcaaactctagtgtaatctctgacttttgaatactttcttgaacctaaaaaatatgatcaaagctgtagtcatacaccagcagagacaaacagaagttgattcaccatggatgcaccaaaatctcagaaatcaccactaaagaacttattcatgtaaccaaataccacctcttcccccaaaacttattgaaataaaaaataaaaaactcacattgtaccctataactatatacaattatttgtcagcttaaaataaaataaaacttagagaacacacacacacacaaagttgatcacaaaacagtctcaagtttgagaaaagacaatacgtgttcctgtccattttatagctcagaacaagtaataatttctctgtttttctttcttcttagaacttaaatttctttaatagtactggccttcatccccaaaattaatgcccatattccatgaatacaggtcttttgggttgcttttccaggacagtgttgtgtccatgctgcaaaggcatatttcctcatctgcccccatgagcccttgtgatccatggtccatatttgcaaaaattattccttatagctaatgaccaaagaacagaacaggaactagcccttggacacctaatctacatataactgagctagccaatcatgatttgccatgcctcctcctttcacaaacacaactgtcttcttagacctcgggaacctagatggaactcccaagagatacaacttggggattgtcttttctacctcataaagttatcatttttgaaacaaattcatcgtaagcagcttacaatctttttctcctggaattctactttttataggaatttctgttttctgttgatgtggttctctcataaagaaggagtactgctgttcaacaattgttttaaaaggagccaatcagaaacaccttctatgtataccttagcaggcatacttctctactcagagggtgaagaaccattagtttcttttccttcacccctgtgcctagtctaagctctgattatatttccctcacccccacagtttatcttcaatcccaggaaaaattactaaactgctatgtaagttaaaaagttactcccaaaggaccaaatgctagtgtatggaatagtggacaggacgtaaatagtggggtcagaaagacctggatttgaatcccaactctgccacttcctatgcagtcttgagtaagttaaaacctctggacctactcccttattgcacatgggaatgcctatagctcacgtatttgattttgatgataacattttttgtgtttagaatatggtaggtgctaaaagccattgttagtttgaaagccctaacttagtggagtgccagacactgccatatacaagatatcaaccacagaggtttctgtgaaccaaaatcaagcatatctacacttgtgaagttcacattttctctaccatatgaatctttaagttgatgaaagtgcatgctgcctatcaatgaactgagtcatactgaagatccaccaaatttatgcctgctgatttaccaaagaaaatcaataatatgatgatgggagtcaaggttcaatagatgtattgagtttggtaatcttagacttgcatttgtgcagggtttacttatttatctatttacttgtttatttacatcacagcaaaaagaattattttgttttcttgcgagcttacagtatacaaagctttaagagctccagagatggtctgggatttcaattccccacagagagctggcttactgcttaatatgctcttgatgctcttaggaagctataggaaatgatacttgcagcccaagatgaattgacttaaaacgtcatttaattatgtttttatatggagggattttaaaaggtagaatagtataatgtctgctgacatatccatcatccaggattatcaactgtcaaactagggccaatcctgtcccacccacacctccatccacttgctttctctggtattatttggaagccaatcccagacatcagatcatttcatctgtattgcagagacagagttaataagaaaaagttatagtctttcaccccctggaaccagaagtatagtttagttagcagtatagtttcttccttttttttttttttttttttttttttttgaggcagagtcttgctctgtcgcccaggctgctggagtgcaatggcgtgatctcagctcactgcaacctccgcctcccgggttcaagtgattctcctgcctcagcttcctgagtagctgggactacaggcatgctccatcatgcccggctaatttttgtatttttagtagagacggggtttcaccatgttggccaggatggtctcgaactcctgacctcaagtgatctgcctatctcggcctaccaaagtgctgggattacaggtgtgagccactgcgcctggctgttagcagtatagtttcttaaacttttacaaagtatcctctagaacctctagcctccacattagccattatctgaaatgatcatctctagaacctaatttgtgtcctggttatcagagaatttctctcagactgtgggtgctacaaggacaaggaacatatcttacttttcatctctatagccctaatgcttagtatcccatcatataggacaggctcaaaatgcactttagacagatgtgtgaatgcgactgaatacttcagtttcataaaaacgtgaactgagtgagatgtttgccccattttctccttttctcaaagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtcttaaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaa

SEQ ID NO: 3136 - DNA, 360571 bp, human
gtggcgacggcgagcacagaaacgatggagttgagccagtcgaccctggttggaagcaagtgagaagagaccaggcgcacccctaaatttctgtgcggagcgcttgtcatcctccccagggaacggtgcacccaaaggaggactggctggactgatttgctagggagagggcggggaagaggaggcaaggtgagcagagaagccccctgcgtatccggactgccagatcgcgcttttgccggactcctgccccctccctgctcaggtgggcgcgcccggtctccagctcacaggggcgcttggaggagaccagaaagtcgccgcctggctgcgcgggatgcctttcgccaagcggatcgtggagccgcaatggctgtgcaggcagcggcgccctgcgcccggcccagcagtggacgcgagcggaggcagcgctgagccgccgccgcccttgcagccgccgggccggagggacctggacgaggtcgaggcgccagggccagaggagccagcccgcgccgtccctgcaccttcagggctgccaccgccgccgccgccactgcccgcgccggccgaccagactcagccgccgcacggagaggcgtccgtggctggcgaggagagcacggcggggatcccggaggcggcgcccgcagccggcgaggcgtcctcggcggcggcggcggcggccgtgctgctcatgctggacctatgcgcggtcagcaacgccgctctggcccgtgtcctccggcagctctcggacgtggcccggcacgcttgcagcctcttccaggagctcgagagcgacatccagctcacccaccgccgcgtctgggcgctgcagggcaagctcggcggcgtgcagcgcgtcctcagcacgcttgaccctaagcaggaggcagtgcgtgagtacccgcgccgtccgcccgccaggctatgggtttctgcgccgcaccctcgcgccctccccagcagcggcaatcccagccccgcggcgccgctccggttgcagcttgcaccttactactctcgccttcccacccttcccatcccctgggacccaccccaatcctcctggggctgagtggctgggctggaccccgattcagtgatgcagacgtggacggtggaaagttaaaagggcgacctctgaagtcgcaggcagcgtgggctgagaaggagcagaaagggagcgtttatggggagcacaggaggcagagagggtctgtccttcaccaccggggctcgcctttcacgtccttcacggggcgtagggaggagggttgcaactcctgtggtttccagaagcccagccctgagccctgtagcccacaccatgcatgttcagggttgggggttccaggagtagtgagtgttcttttgagactgctgcagcaccgcggctgtttcgtcactcgctgtgacctcaggtgctgccccgagctccgaacttgtgccttgccctcgtgtgcgacgtagcgtggcgctgctcgcctcctagactgaacttcgtagtgcttctgccgaaaacccttgtggcccggaggggccgcggggagggtcagggagagatgagggtgggagtgtcaggggccccggggagatggaggagacccctgggcatcttttctgctctgaacagcccagggttcctactaaatggctctgtgccatctgcccgcagaggatcccacagactatcttcctcctccccggtgcactgtcgcccaaatttactggcacgtggacttaggtatgaactagtctgctaggcgggctgcagggaaacgacgaggaaggaagtctgggagacccctgggcgtctttgctgtccgttgacttcgcttttacgacacccaagggctcccaataaatagtcattctatgtcatctcccttccaagggcggtccccttggctccggatcgtccaaatctggcgacggcagaatcatttaggaacgacccaggaggtagacaggggcgctgggttggcgcgacggtcctttggcgcctagtcaggctgcgacgctcgcggcgaaggtgatgtcagcggctctgacttacgtaagaagcttcctaggttgctgccgcagctgcgccggtgcgcagtggcctaggagcgcgcggggcggaggcgctttggaggcatccttccctggggatttccgggcacctctgccccacagcccagctcagcctcccagcggtccctgcccgcccgcgtgttctctccctcttcccctcctcctccgaaaaaccctttgaaccccgtcccgggaattcactgcttttctgcaataacaatagtaataagcgtaatgaataaatgatgtgctcgatcggttttcgcagctataaaagacccggagttgggttaatgactggttgtttaaaagggcaattccggggatgagttctggaaagaattaggactgccgtaggccaagtcgtattttacttttgggacttgaaatgagcgctttaatcctgcctcctttttaccccaaaccacacagcagggacaggcccttcactttcaacagcgcaggtatctggggagtgcggttgtgggagtggtgatttcacttcaaaagaactggagggaagttttgcagactgttgagtggtgcatacatttcccgtgtgtgtgtgtgtgtgtgtgtgtgtgagacacacctctccttaagttagatttcacgcgaatgaaactcactgccagagcagaatgtgcccacttctttctctctttagatgcagcagtgggcagttatgtacctggaacgtgtcagagttctttcaagtccttttaactgtttggggtacaaactaatagttagtagagataagagaggatcttgagtgtgtgcatatagttggtgaatatatactctatacatatttgtacatgaataataaagatggggctgatttctacctgggatagatttaaaatctcatattattttaaattttattttctaaaatgctatctccacactttatgtccagatctctctcttctcttgttcatttaaatttgggatggcattgtttttgtttgatgtcataaaaggcattacctttgggagaaaaaacacactattatgtgtcttggtttaggtttcctagaatgcagagcctgagacaaggatttcgatgcaattaacttatttgggaagggttccctggaagcacagagagggggtagggaagtgagacaggaaagggaggaaagaggaaagccagtacaccatgtaagctggttagccctgtgggcaactggggttcaatccagctggcgaccctctgagcacacacctcaaatgtgttccactaatgattaaagaagctggagtatttatgcaccagcttcttcttcccacagatggaaggtagcacctggagcatgaactccatggcttctgggtcttgccccacatgtagtcccagcatgcacccagggccaggtagagagatgcaaaaagcctatgatgtgcacaggaatgttgacagaggtcctctggggagggcaaagtagctgtgggtcggtcactagcggcatcagctgcattatgcatctatctccctttagtattgctcaggcctaggggagtttgaaagggagaggaagcctaaaagtaaaacttactcttttttctcttcctttgagagtgccttcacaccacctgtatatccttgtcacctgatcctcattcccctgcgtaatctgcttgctatttcatccttggacagctgcttcctgttgccctgagacaggctggggggcttcttgcaggggcaacatgatctgatgtacactttggaagagtcactctggaagcaagtctggtggctagtaaaccagttagacactgtgactggtgatggtggctaggactagggaggtagctgtagagacggtgagaagtggttagattctgaatgcattttggaaataggattgccaagacttaactgatttgattgggtacaggttgtggaaaaaaaaaataatttaggatgactcctagtttgttgtttttgcttgaaaagcttaaataacttgtagactgtggctgggcacggtggctcacgcctgtaatcccagcactttgggaggccgaggcgggcagatcgcctgaggtcaggagttcgagaccagcctggccaacatggtgaaaccccgtctctactaaaaatacaaaaattagccaggcgtggtggcaggcgcctgtaatcccagctacttgggaggctgaggcaggagaaatgcttggatccgggaggcagaggttgcagttagccaagatcgcgccattgcactccagcgtgggcaacaagagtgagacttcatctcaaaataatagtaataataataactggtagaatgtattaccatttgtagaaatggggaaggctagtgggagagtgaatattttcttgtggagggaatggaatcaatagttttatatttgagccatgttaagtttgagatacctgatgtgtcttacataattacatgtgtgagttgagaggtccaggctggagatgtgaatgtgagacctaagcgtagagacagtttgtgaagccttggagctagacacagtgaagctagtaaagaaaaggaggccaggacttagcccagggcagtccaactttgaaagcttcacagggaaggagaaaggctgagaaaggacagccagaaagctagaaggagaatcagaagagtgtagtatggtgcaagccaggagatgtttccagaactggggagaagtcaacttggtcaagtgcttctgagaggaagataagcactgagaagaggctattgagtttggttacttgtaattaattagtggccttgagaggtgccatttcattggaggggtggagatgaacgccaaatcagaggtgttggagaaagaataggagaggtggagaggaaatagcaactacagagagctttttttttttttttcactctatcacccagactgggtacagtgacttgatcatgactcactgcagccttgaccgccccaggctcccatctcggccccccaagtagctaggactacaggtgtgcaccactacgctaggctaattttgttttttttcatagagacagggtttcgccatgttacccggggtggtctcgaactcttgcgctgaagcagtcctcacgcctcccaaagtgctgggattacaggcgtgagccaccgcacccagctctacagacaactcttgtaaggcgtttcactctgaaggggagtggagaaatggagcagtggctggaagggaatacagtatcaaggaaaaatgtcttaaaaggtattgatattttaggcatgttcagattccaagagaagggtgaattgatgatcctgggggagagaactgaataattatggatatcattgagaagccgagaggggatgagatgagagcaccatttcatccatggccgctggagggaagctgaaggatacgagcagggaggcaggtgggctggtgaactgctggtggtgggatggggtattcttctataaggggatctattttctctgtaaagtatggggtgaggtcatcagctgagagtgttggcaatgtgaggagagaagggagggtgttaataagttgtctcagggagggaacgtgaaggcattaaggaagtatattgggatgatcttactgtgttgagagccttctgagactgatggtcatcaatttgaagagtccaacttttcagtcactgaaacctgagactttggaaatacttcatgggctttgactccaggatgttcatctttagacattttaatgttgctggcattttggttgccgttgatttatttagttactgagttttaaaataaattttatattaaagtttaacattcccacagaaaagcgcacagaccataagtgttcgtcttggttgattttcacaaagtgaacagctcatgtaaacaccactcagatcaagaaataaaatgttactccacctgaaacatcctcccctcccttcaagccaccttcagtcaatatcccccttcccaaaagtaacaactctcccaatttctacccttatcaattagatgttcttgtttttgaagtttatataagtgaaatcatatatacttctttctagcattattcacttaacattatgtatgtaagattctttcatcttattgcatatatagctgattgttcattctcattgctgaataaaattccattgtgtgtacataccacaatttcttgatccattctcctgatgatggacatttgggttgtttccatttgggagctattgcgtgaacaattttttctacatgcttcttgatgaacttatgtatacacagttatttggtatgtatctaaaagaggaattgctggatcaaaggggatgatttgtttggctgaacagttttctacactggttgtaccaatttataaccctggaagtatatgaaagttctggttgctccacatcctcactgatattggtattgatgtttaaattgtagccactttggtggatgtgtaatgaaatctcatactggttttgatttgcatttctctaatggcttgtgagactgaacaccattttatataatttttaactacctagatattctcctttgtggattacttgttcaagatgtttgctcatttttatttctcttttctctctcttttttaacttttattttaggttcaggggtacatgtgcgggcttgatatataggtaaatcatgtgtcgtggtggtttggtatacaaattatttcatcgcccaggtaattgctcatttttcagtaaggttctttgcaccttttcttactgtcttacagatgtcttttatgtattttgaatatgagtcatttgtcagctgtatgtatttccaataccttctcttactctgtggcttgccttttcaatctcttagtgttatattttgagggcagaagttcttatttttgtatagtccagtttatcaatccttttctttatggttagtgtgtttttgtgttctcttctgtttgttcttaaacaaattcttcaccaacctcgaggtcatgaagatatctcaaaagttctagaaatttttcattttgcctttgtcatttagatccatgtttcatatggaattgatatttgcaaatggtgtgaggtagggctcaagattacttttttcccaaatatggatgcacaattggcctactgccacttattgaaaagaccatcatttccccattgtactgcagtgacacttttgttacctcccccacctatgacttttctagaactctgtgctaacctttatcttagcttttctcattctgtacagtagacattgttggtgccctgtctatattccatctctcatgctgaaggctacttactgcaaactcctgtaactctgcctggaacttttgttttgtactggcttatggaccatgcttggccttgcttgttgggaaggccagaggtgccagcaggttaatgcctcagaagcagcactcaaccaaatatggacagggagttggtggatgaatgcaccagtgccattactccttggataggagaactctgcagcattttctccaccatttctcagaattctcaagtaggactgagctccagttacccacagtgatgacttatttgatgacacatcctatctttgctgtcttcctttctccatctcacttcttcactcacctatgggtgtttctggagtcacctcccacataaactacttgcactcaaacctgtacttgcagtcatagggtctacttatgggggaactgcaaccaagacaatctatttaatctttaaactgtgaaggcaaagacctagggctgggggtatggtagagatgaagtttctcactctttttccttaaactatttagcccaggattattatattagccacacgcccagcccctcccagaacactctatagtgtgtgtattagtctgttctctcactgctataaaaaaactacctgagactgggtaatttataaagaaaagaggtttaattgactcacagttttgcaggctgtacaggagccatggccaggaaggcctaaggaaacttacaatcatggcaaaaggaaaagggaaagcaagcacatcttcacatggtggcaggagagagagcaagagtgaagggggaagtgctacacacgtttaaacaaccagctctcaagagaacttactcactgtcactagaacagcaagtggggaatctgcccccatgatccagtcacctcccaccgtgtccctcctcttacattggggattataattcaacatgagatatgggtggggatacagagccaaaccatatcagtgggtctggaaatagctgttactaccattagtggatgcacagtttgaatccctgtcttggcatgggagagcttcagtgcttcagcagtgagaagggtaacaaaaggaactcaaatctatgataatgaagacataccccctaaatttctccatgttctattgacaagcctttgagagtgttgtttattgccctttggaatgcataagtgacagccccaggagatccaaactacctatttgagaaggataattttcagccagagcagacacagaaactgctaacctctgaaaggaaccaggaggtaatacattgggtgaattgatcattttgggttggtgtggcaacactgatcatgggctcattctggttttggaaggatggtcctgcttttccttccctttctgttcagtctaccacttgtaaaaaaccttcacagtttggttagtgtgttctcttggatgtttctgtaattgtggttaagtttcttttcctcctggccctgctcagtgagcttctgtgaggcattatgagatcctaacagcttcattgaaagctgctttgaaacccatcacagaagagctgagaagaacacaatctttcaagggtttaataattcatggttgtaatttcctcataaccagtaacagcatcacatttctttctagacttttcttgttatactggattgggcttttaaatcaaaactcctgaattactttatctaagaaatccttgagattctgttggactgatattactaagatgataatgataaagatttctttcttcctgtgtgtggaggccttttctacacaatgccatcaggacagtgtaaagtccacataaactctcagaaacgtcttcagtctcagcacttctagtctagttttaatgggcattacttttaaaaggcaatgacatgtaaaaatctctcctattgtcccatgttagtcccagagtcttgaagattcactgattttgtatgacattttgaaattttagggtcaaggacaattttaaatatagttggaattttatttgatagttcagcttaatttctttttgctttattaaaaattgtggggcacaagattttgagggacattctattaaaaaatcataggaggagtaagactggaacaaacaatcacaaaaattcctgaacgtttttcttgcatcaagaattcttcatgaatcctatcttaataataagtggaaataaaaataatgaggtaggaatggttcctgaatgtaaggatctcattctggggttgaaatttgttgaaacaaagttttggagagcccacccaccagactaagcccagagggcagggaaactgtctactttatttttgtgaatgactaaaagagatatggtcaagttttgtttctgacatctctcaatccattaatgtacatgaggtttggctgtattgaatgagtaatctgaggacctgggcattcatgtgctaaaaaattgcttaattctgggaggccaaggtgggaggattgcttgaacccaggagttcgagactagactgggcaacatggtgaaaccccatctctacaaaaaatacaaaaattggccgggcatgatggtatgtgcccgtagtcccatctactcaggagtctgagatgggagggtcgcttaaatcaaggaggtggaggttgcagtaagccaagatcatgccactgcataccaacctgggtggcagagtaagactatatccagaaaaaatttttacttaattattattattttttattttgttttcattttttgtgtgttctaagcttaattggtgacacatgtgacatctcaaatcatgagattgctcctcagtttttaaaaacactacataatattcccctgcacaaacgtgctcaaagcatttaaccaccttttacccatatggtagcattttcttggttttagttattataaacaaatctcatacaaacagtttccatatatatatttgcttatatgtatgaatttttaagaatggtttcttaaaagtgtaattgctggatctaaagatatctgtgcctacatccttcaaagtgaaattaaccaagaataaagttaatttaacaagagtcctagaatcttggaatcatagagttgggaaagaccttagtacccatagaatcaaacttctcacccagagtgggaatcttttttaagatgtcccaaatggcagctcatctggtttccatgccctctgagactccagggagtgggaagtggccacccctgccccaactgtattgctggatagctcccattctcaaacagtccttatctacattgagagtgaatctgtctttttgtaatgcaagccttttcatctttgttctggtgtctcatgtcatacggaatctacctataactgcttttctagaacatcttttaagggtctggaggtcactgttatggcactgtctaagctttcttcatcccaggtaaaacaacttcaattccttcaaccaggcttcctaatgccaagtttccaggccattcccactctggttgtcctctaccacaggtgcagggcacaaatggacccattcctgtctttataagaatgtcccaggccaggcgtagtggctcatgcctctaatcccagcactttgggaggctgaagcaggtggatcacttgaggtcaggagttcaagaccagcctgaccaacatggtgaaaacccgtctctactaaaaaatacaaaaattagctgggcgtggtggcatgcgcctgtaatcccggctacttgggaggctgagacaggagaatcactttgaacccaggaggcggaggttgcagtgagccgagattgcaccattgcacgccagcctgggcagcaagagcaaaactctgtctcaaaaaaaaaaaaaaaaaaaaagaaaaagaaaaaaaagaatgtccctaatgtggtccttgttttaaccattgcatgacactgttggtgtaaaaatgctcttatggcccagcaaactcccttcctttatagtggcagtttttaacatgaggttttctttattccatgtgtgcagttggtgttttgaacttaaatttcacaagagtctcccattgtctctgttaaactgaatcttgcttgctttgctctttcatttccaatcagtggtgatggtttaaaatcttgattcaatgtgtcagctactgctcacagtattttgctctctgcatacaccatgaacaagattctatgctgtcacccacatcttcgataaaattattgttcagacggattcaaggccagagcccactggcaggcagtactagcaatgtttctccaagttgagatctattaatcaacattctttgggtatcattgttgcagcagccacaggtgcactcccctaccttcctgttcaaatcacatttctccaccttactcacaatatctatcatcacgagcaactgttaagtggtttgctgaaatcaagataccatatgtctgtagcattcttttgatctcccggtgtaattaccctactcaaaagggaaatgaggttaatctggctcaaactggactcaattccagcaatcagaggggccattttaattttcttatatataatgggtaaggagtttatttgggggaaatctgctttggcatgttggtcacagaataactgtaacgttggactacaaggggactctatgggtcttagagttcatttctctgactctagagtgtcagaatgcttttcccttcctttcttttaaggtacatggatgtccttgttctctgttccttaaggaaaggttgaaattcatgaccttttggcatttgctgaggctcagtttgagtaacattggcaagtgtctggtttaactaattgttgagaagcaagagaatatgtggttaagagagtagactctgaagctggactacatgggttcaaatcccagctccactccttcaaagctgtatgactctggacaatttattgaattttcttttcttcatctgctatggagtggagataaaagcagtactgattgcatcaggttgttgacaaaactaagaaagtcaaggtgtgcaggcactgagaactgtgctttgcacatggttagcctctgataattattggctattattggctattttattgatactataattggatcagagtaggaggtatgtgttaatttctttcaagtaggtgaaaacctgtgcctgaatctgtgaagtgctgggtcagggtaaagtatacagctgaccaagcaatgctgtgtgtctctgcatggtcaaagatgtctattaaggttcttttgttgttgttgttgttgttgtggcttctttttgttatgcagaaaagtagagaaaaaattgaccaataatcttattatccagattcattcatttattacacagcagtcactattctaggcccttgagtttcatcagtaaacaaaaagttaccaggaccttatgtttcaatggagagagacaaatcctaaataataaacacaatacatttgacgaaattacaaaacatgttaggaggtagtaagtgctgtgggcaaaaagaaactagagcaaggtgaaggtgatccagagatttggggcggggttactattttaaatggggtggtcaggtgggcctcactgaggaagtggcatttgagcaaagattggaaagaggtaagggtaaattacatagactgctggaggaagagtgttccagtggagagaaacagagctagtgcaaaggccctgaggtgagagcatgcctggtgtgatccggggatggcaaggaggccagggtggtggatgaggagttagcaaggaggagagtaggaggataagaggccagcaaggagaaatggcagtggggcggatcacctagggtctagtaggccattgtgaggactttgccttttgctccgagtggagtgggtagtcattgaaggcttttaagcccaggagaaacatgattgatttagagtttaaaaggatcactttgggtattgtggcaagaagagactgcgggagaggcaagaggggtagaagccaggagaccaagtaggaggcttttgcagtaatcctggtgagagacagtggtggtctggtaaaagtattgagaagtagagctgttgatggttgtttcatgtctggggctaggcatgcaactcatacagaagggtacaacattgaaaagaacaagaaagccctcctctccgctctcactctgccagacttgctccagacttttgcaaaaccattgaatgttgaggaagtaggcacttctcctacggtcttgttgattaatctgctgtcttggaaaaatttaaaaagtgtcctaactaatactctttttaaaaaatcaagatataatttacatgcagtgaaatgtacagatcttgatgagttttaacagctgtatccacctgcataacatacaaccctattaagatagagaacattctcctcacaccaggcaggtaatactactttcaggtaggaaagcagtatttgaactctgatagcctagcactatcccctaccaaggttgttgtgtgaacatgggcacagaagaagataattccatggggggcttctgggctttcgaccaagactaagaattagtgattccatttataagatatccaagacaaattgaaatagtggagtttcctcacttttggtctgatggtgttgggctgtttatgacatcatcgtgctggattttagggagaatcaggtttttgacaaggataaaaatctagcctcagaggtgccaggggtaacttagaagtaggagccttttattttcttatttatttatttatttatttatttattttttgagacagagtctcgccctgtcatccaggctggagtacagtggtgcaatctcagctcactgcaacctctgcccaccgggttcaagcaattctcctgtgtcagcctcccaagtagctgaaattatgggtgcctgccaccacgcccagctcatttttgtagttttagtagagatggggttttgccatgttggccaggctggtctcgaactcctgacctcaagtgatctgcccgcctcggcctcccaaagtgctgggattacaggcgtgagccaccgcacctggccagtaggagccttttctacgataaagctaaaataacatttttaaaaaaaatgaaaaaaaaaaaagaccttgatactctctggtacatttctaagtagcaggaaatactgatttgcaaactgtgttttcagctcatgctgatgcttgaagcctggatggaggacaaaattgcttagaattggatttatgactgtcctatctaagtgcattcagatgtgtgaaataagaagccctattctagagttcagttactcttgatttttcctactagaaatctaagggaaggaagaggtagtagctgtgaggacaaatgacagcccatgagatctaatgttcattagaatataacatcaatatttatgtttctctccagtctacatctggactctgttccttgagcctgtatttatattttaataatgcgaggaaagctttattttccttttaaattttgtgtcagagttctgctacctcagcccaccccctccccacccctgaagtgattcatttacaagatggcgcatgtttattgagagtttgattctagagattaacttcaagaagtgcatcatgaagtgcagcaggaataaataccacagaaatccttttccatgtgagaagtcatagggctttctgctgcataaacaggagagacggaggcttcaaagtttgcggcaatgtgggggagaagtgggaaaacctagaagagacattgggaagggttccctggaagattttcaaacagtatcacttgtgttaaatgcctttggtatgagaaaagagatgttggaaccctgctcaggtatcagatgtcacccagtactcatctggcaaacttttagcctttgctaattaaaactaatccaattgcatgaagaaaaatatattgcgtaagcttgcctcttgtgtggctttattttaaccctttgccccatatcctaataccagcgaatctcaggctggttatagggtagaagacgataatgagaaatggggttcacttacaaataaatttcagtcaagacaatgagtggagcaggctgttaagaatattggcttgtaaatgtaaaattgaagcccttctgggttttcttgattgatttgtcaattcaaaggttttagtggctgttgagtgggaaggaaaattaaaacaaacaaacaaacagacagacagacaccctcttttaattatcaatttatgctttgctgtctttccaagttgctttgtgtgcttctctgtggcccggccagcctggttggatcaagctttgcatttttaaatcttaggttcaaggtttgttctctgagggactggagttttgtcatgatcacatgcttgtgttcctaacctgaatgaactttctagttaagagtatatctcagtctttgattctctcagttccaccacttaccagctgtgtgaccttggacaaattcttacctcagtttgcatatctgtgaaatggagatactattggtactcattttatagagttgtgtagattaagtgattaatccatggacagtgccagcagtgtatggcatatacacagtatacatactatgggctaatacatgtaagccattgatagtactacttttgttgttgttttatcattattattatcaagaggcttgggtaaaggatgtaggtataaaaatggataaaacccagccctgtgacttctgaaccagtgtaaacgttttggtcagctggatccatggtgaaatgggaagagaagaatgctgcccattttctgacttggctcgtctaactcatgttgtgaagcactgcaagaacaatttagcatctggctgccatgacactctcattcttggggagtgtgtacttctgctgatgggtggaggaggtctggatgtgaatatttgccatcatggaagtggtggtgtagaaatgcaagcacccatgcgtttgctttgtgagactgtctgtatcttttcctataatgacgatatcctctcctataatgacatgtcttctctttgtagtcagatatcaggcatggaacagctagcagaggggagattatggatctggcatggcagagaatgcctaggtgttcaccaactccttcccttttgctcctgggtgcatggctagactacatttcccagcctcccttgcagttagttgcaactttgtgacagagttctgtccaatggaatgtggaagtaataattgctccaattgtaggaaggccatataaaagctcctaagcaaccctctgtagtttgtttctgtagtttgtttcttccccactctgctggctgcatgcagagggttcaacagatgattccgaggccctaagggatggtagggccaccgtatggaaagagcctgggttcctgaatcaccacatgaaaggctatctgccaacacttgatttgatttcatgtgaggaacaagtaaacttttattgtgagatttaggggatatttgttacagcagttagccaaccatgactaacacagaggtacagtgctgggagcaaaaaggaccagttttcctgaaaatgcgcagatgacaaagttactccaaagtatttgatgttccttctctgaataaaggatgtactaaactgcagagttttcttttttgagagatacagaattcctatgtgtgaccggaagccatgtaacagctttccttgagtaagcaaatggaaataaaaacttgttagcagagttccagtttctagagaaatgttgctaccaaaagaattcattctgcctctctccctttctctctctcttcatatataagtgatatagattgatttgtgacatgcttaaaacctaattataatgcaaataacgaatgtgcacaaatcatgtgtgtacagcctcaatgaatttttgcaaactgaacacagatttaaaactagtacctgggacaagatacagaacattttcagccctctagaaatcctgccaatgttctcttctgatcctgccttcccaagggtagccatcatcctgacctctgacagcatagattacattggcctgttttggaatcatatagtatgtgccttttctatatctagatttctatatgtaaattatatttcatgatccattcatgttgttgcatgtagttgtagttcatttattttcattgctgtatagtattcctttgtatgagtataccatggtatgggcatctggataatttccattgtgggctattttgaataatgctgctgtgaatattctagttcctgtcttttgctgaatatacctacacatttctgttgggttaaaaacttctttccttgaagttttacaaaactttgttcctcaataagacatttcaaggctgtgacaatgactgttcttattccttgctgtacctagactttctgatctacaccaagcaaaagctttgatctgtttttctgtaatgtaaaagattatcactgatgtttaataacaaagttctggtgcctaaaatagcgaaaacccgatctacttaaaaggaatccccccagctttaaaaaaacattggagcatagttgtggggccttttgattcacagacagtggctcctcacaaagccatgtttcaaatcacttgcaaactctgtgtaattggcgtttgacattggaatctttattggcactgcttcagctcttcctctgtgaggagaatcctcttggattttcaaattgcatcctttccttggggaaacagtggaggaggaagagtgatgagttctctaatcacttggttggattagccttagagttatcgggagttgccttctgtaagtgcccctactatcaaggtttcatggaaaatctaggcaaggcagaacttcctcagaaggacaagagacaaagaagtggggaggccctcctatccatagctgagagggtttattcttgtggttctgctgtcagagccttggatgtctgatctgagatggagcaaccccagctagacagaactttgtagatttgggggtttaaaaggcctcaagcaaattctaaaactttctttgaaccccctggcataggctcagtttccctgactccgttgctgagtttgaaatactggactcaatgaatagtacgacattccgcccccccaccgcaccctcagccccacagggtccctcactgtttggtttgaaatgaccatgattggagaattgaggggtgaatgttttagtctgagcctttcccttcaagcatatcaggaatatctgaaacatctttgaggccaaagcagaccgaaggctgccttgtgttttgattgaacgtttagttcactttgggcttgaggtgtgtgatgcctttacagttaagtctgaaaaaatggtcgtgaaaagcccctgggggacctggctgctgagtgacacacagctgggcctttgaaagtgggcttttatgataaatttgaacatggttttagaccttactataagtgcttcaatttttttcccctaactacagaataagtgagctgatttttccatgagggaattgctttggaacattaaccaagattttcttcaaatatagaggtgactatgtaatttgcttgtgccttttaaaaactgatggaggcctagtgaggcatctctgtgaagtcagaagttagacaagggatgcttttcttcacttgccaggtgtggaatgcaaatgagcttcatgcagaataagaggcctttaaaaatccaggttgcctttgaggacctggtaactcttgtttcgatccactgcttctcccaggttgcctatcttttctgtaggtgacagctaagaccatggcctacactttgttttccttcaaccccctaacttcttcctatggccaaccccacccccagtttttggaagatcgctgattttttgtcttagatgactgagtgttatcaacaggattctaaatgtgttgaggcagatacgaaacaaattcacacataccaccccgacatttcgtgtgtgactgccttctgctagtacaatgtcacgttatttcacaagcccctcaaaattctgtgatggaaatattataatattcttttgatagatgaggaaatgaaggctccactagtggctttaagaccacagtgttaaaaaattgtctggtcttggattcaaatgtggttcttgcatcttcagtttgggcacctcctctgctctaccctgcttctctctgtcagcctactactcttcctcccatcaccaccaccttatggccactgaggtgacattctccctcccagtttatgatggagaaacagaggcaaagaaaaaaaaaaaagacatgaggacaatatccaggtgcaactttgaatactcaaaagggctgggattagaacatctaagcaaaaaggctcatgaatcaagaggtacttctggtgcagccagagcaggcatacaactgggttataagttaacacgtgtatttgggtgaggctgtggctgtatgtctggttctaattagttgcttagttttcccccaaaataaataggaacatgctgattgtctaaaataagtcattcactatagcaggagtcattttatatatcaaggcctttactatctaaagccaaaacattcacctcatggacacacaagtttcttttctagctcagtggtcacccttttgtattctctaaggttgcttgaaggctggtgtaaatgaactgtgggggaccccaattcaggaacgaatcaacccaaattataatagattgccatttttttcatttattcagataggccaagatgaaaaaatgataatggtcaagtttggggtgggcataagggtaattttagacactactgatggaacaataaattagtatactttttctggtaggcagttggcatacacaaaaagctgtatgccaaagatgttatttcagaatttgatctaagaaaataattgcaaaagtaaataacagaaaataatatataaacacttcagtgctgcttataagtaagaaatattggaaatatcctaaatgattaacaatagaaaattggctgaacaaacaacattactgtgcattggtatagcaaacaacattacaactcattggtacagtgaaatactttatcaccattaaaatgattatacaaatggatatttattagcccagaaatatgtttatgatacattccaaagttaaaatgacttgttaccaaatactgtgcattttattgcatgtttattaagaagatataagaatacaggaaaaaatctctggaagggtatataccaaatcagtattttaaaaacatattttgatcatgatccactatgagaaatacattttacatttgtgagtcagtagacacatgtagctgaaacaatagtttattaacaatacttgtattttcttgtgtggtacgttctgatatatttatttatttattttctcttttttaccgtattatcctatcctttcctttcttaccctattctactttattctaattctatttcttttctcttctcctttcttttgtttcattttttaaaatgctagtcatgacctattaagttgattttatgatctcctaatgagccacaaaccacagtttgaaaaactgctctcaaatgttaacagtagttatgtctagcaggtggtaaataactctgttttgtgaggagacaagattactgtgacttctctgtgttacttatatgatccaaaaactaatgaaaatttgaaaaatggtataataattccatttataaacaaagtgatgcccacagctttttaggaagatactgattgtataaagtaagatgcctactctgctctacagttattgggcactcagaatgttctgggaactttaaagaacattatggcaggaaaaatatatccactgagacacatagtttaaataatagaacaataagaaaatacaacatgactttacatattcaaactcaaaagatcatcaggcatccatacatattgctttaccccagcaatgttgcatcatgtctatgggatttatttctatttctgatccagattgcattttttttcatactcattccccaccttaaaaaaaaagctactaaattcaccagacttctttctggccagattatcttggcttacagtactgttgaagttagcctcttttaaagctaaagataagtttaaatggaaggtagtcattaaaaacttagatcaggaagcaaaagctttaaaggaggatgggaagaatctctggctagagccagtacacttccctatgggcttcctgctttcagcacagagctggaaatctgcagaacaaccccaggagcccctcccggcatggccacacaaccaaccgggtggcatgttaagtgagctttccctgggtcttctctgggaaaaccttgatgaataacaaattccacagaaatgatgcaacatcactggggtaaagtgatgtgtattggtgcttggtgatcttctgagtttgaaggtgtaatattatgttttattttcttgttctttgggcaccatgagctaactgcccatgagggagggtgatctgctgggttgtggttggggagaggctggctggcattttcagggaaagagtatggagagagatgcttcctgcctttgaaaggaattaatgataggagataaccggggttgcttttcacgatgtagtaatttagttacttttctttcagactttatgctgagagtaacttggcgttgctaaaaatgtaatttggagccctggccttctgctcatggagaaggctaagttcatcctacctttgaaacattgtgaataacatatcaaagttattcatgtgctcattgatttattcattgattatgcaataactatccattcatgtggttgtttgctcatccattcatccatccatctatctatccatccatccacccatttttccaggtatccatttacatggtatttcttggctagatgctgtgtgttgagggatgtggtaatcactggggtgggagaagggactccataaggaagaagctgtctgtgtagttgagttgttcactgtctggtgaagcagataggcaagtaaacaaataattgccacaaagagtgggcagtgatacaaaagggaccaacctgtcttgattcatgtgaaactacttctcctcttcaggcctacaatcatggaatgttaacctgagagaggccttagagaaactgaagaagataatgttttccagactttatctcaagatccctgaggtgccattccagggtgtgaaggtgggagtaggagagaggaatgagaggaaagctgaacagaagttctggagctttctccagaaccagaacagattccttttcatctatttcatatattgaggttgcttgtaacctatcatttgaggaaaagggttggctgtttaataataattgcaaagcacttgaccagtcccccatctttccttgtttctcttgtttaaagatcgagactcaaaaatgtaaagtgattggctcaaagttgtaaaatcagcatgtgaacaatccaggaataagacttggtcttctaacttcatgtggacattgcctctgtatcagttagcttttgctgtgtaacaaataaccctaaaaatcagtggctttaaacaaccactgtttacttagcccataattctatgagttggcaatttgggctggactcagctgggtagctcttctagtttcagctgggcttgttcttgtctgtgatgagttactggttggctggcaagtcacctgagaactgactggtctaaagtggtcttacctctcagggttggctgggtgttggccagagtaattgggttactgagttgatagtctctcttctttagcagaatttcaacagagcagggaagcatgcacagcctcttgaggcccaggcttagggctggtcaaagcaaatcacgagaccagttaacacttagggagtgaagaaatagactctacttcttgactggagaatttcaaggtttttggacacaaggagaggagaattgttgccttttttgctatctaccacaagaatactaagttattgctatatcttttcttcttaatttggacattggaaaaatacatgtttgaaacgctatctaattccaaagccatttttacaaggatctgaaagcatggctctttctatagaccatggggattcctgcctacttgagttttctcttttttcttttcttttttttttcagacaaggtcttgctctgttgcccaggccggagtgcagtggtactatctcagcttactgcgacctccacctcccgggttcaagtgattctcctgcctcagcctcctgagtagctgggattacaggtgcacaccaccacggctggctaatttttgtatttttagtagagacagggtttcaccatgttggccaggctagtctagaactcctgacctcaagtgatccacccgccgtggcctcccaaagtgctggaattacaggcgtgagccaccatgcccgacccctacttgagttttcaaattgtttatatttgagacaggtgatagttactgcttgtggtaagggacactgtaccctaagaacattcctgctttactcccagtcacagtctttccatcaacaactcttcctatggaaaggaaccttcagctcttgattctgttaggtgtctctgagggataaatttatcctcatcatttccacaaacatttattgttgagtgactcttacgtatcatgcacctctctagatattgaagatacaaataagtctaagatagacccctaacttcaggtaactcacagtctggcagggaaggaagaaagatacggattgttacagtgaaataagatggggaagatggctggaaattgaattttttcagtggtcattgttttctttgtaataagaaggtgtggttgtatgatcacccaaatggatgtaggaatggcatttgacaaaattcagatcttttcatgacaaaaacacttaacaaactaggagtagaagggaatttcctcaatctgatgaagtacatctatgaaagacttacagctgacatcatacttaacagtgaaagattgaatgctttccccctaagattggaaacaagacaggctgtccattcttgccaattatatttaatattatgctgcagattctagccagagcaattggaagaaaaagaaataaaggcatccaattggaaaagcagaagtaaaagcatctttactcacagatgacataatcttgtatgtagaaaattctaaggaatccacaaaaattattagaactaataaatgagtttaggaagcttttaggatacaagatcaatacacaaaattcaactgtattctatacactagcaatgaacaatcagaaaaagaaattaagaaaacaattctaaggccaggtgtggtggctcatgcctgtaatcccagcactctgggaggctgaagtgggtggattacgaggtcaggatttcgagaccagcctggccaagatgatgaaacctcgtctctactaaaaatacaaaaattagctgggtgcagtggcagacgcctgtaatcccagctacttgggaagctgaggcaggagaatcacttgaacccgggaagcagaggttgcagtgagcccagattgtgccactgcactgtagcttgggtgacagagcaagactccatgtcaaaaagaaaaaaaaaaagagagagaatgagaagaaaacaattctatttacaatagcatcaaaaataataagatatttaggaattaatttaacaaaaaaagtgcaagactcatgcactgaaaaacatcaaagttcattgaaggaacataaagaagattaaataaatagaaagacatcttgcgttcgcggatcagaagattcaacgtttgcgagatggctatactccctaaatcaatatacagattcaatgcaatccatatcaaaatcccagctgacttttttgcagtaattgacaaagtgatcctaaaattaatgtggaaagggaaggaacccaaaatagccaaaaaacagtcttgaaaaagaaggacaaagtgggagaactcacacttcccagttttgaaacttattacaaaactacagtaatcaagacagtgtggagctggtgtaaggatgcagatatagatcaatggaacagagtcaaaactccagaaataagtttttacatttatgatcagttgattatcgataagggtgccaagacaattcaatggggggaaacaatagtcttttcaacaaatggtgctgggacagctgaatatccacatgcaaaagaatgaggttgggccccctccttatatcatcacaacatttaactcaaaagcagtcatagctttaaacttaagagttaaaactataaagctcttataagcaaagtaagtctttatgaccttggatagggcaattaattcttagatatgaatcttacagtacaagtgacaaaagaaaaaataaataggacttcatagaaataaagaactttgtccttcaaaggatgccataaacaaagtgaaaagtcaacccacaaaatgggagaaagtatttgcaggtcatttacctgaaaaggcactttgtattagtttcctagggctgctgtgactacttaccacaaactggggtggcataagacaacagaagttaattttctcatttcaggaggctggaagtccaaaatcatggtgttaacaaggccatgctctctctgaaggttttatgaaagaatccttccttgcctgtctcttgtcttctggtggttgccagaaattcttggtgttccttggctttcagacatatgattacattctgtctccatctttgcatggtgctgtcttctcagtgtgtctttacatggccttattataaggataacagtcattggagctagggctcaccctaatccagtgtgtccttatcttaaattgattacatctgcaaagaccctattaccaagtgaggtcatattcacaagtactggggattggactttaacatatcatttcaaggtgcacaattcaacccataacaggcttgtatccagaatacataaagaaagtatataactcaacaataaaaagacaacctaattttttaagtgggcaaaagatttgaatagatattactccaaagaagacataaaaatggccataagcacatgaaaagatgctcaacatcactagtcaccaaggcaatgcaaatcaaaaccacaacgagataccacatcatcatacccattgggaaggataaaataaaaaaggcagacaatagtaagtgttggtgagaatctgaagaaattggaaccgttatacattgctggggaacagtttggcagttcctcaagatgttaaatgtagagttaccatatgactcaacaaattcactcctaaatatatatacaagagatctgaaaacatattctcacacaaaaacatgtacattgctgatcatagcagcactattcatagtaggcaaaatgttgaaatagtacagatgtccatcaaccaatgaatggataaagaaaatgtgggatatccatgcaataaaacattgtcaataaaaaggtgactaaaggcaataaagattattgatacatgctacaacatggatgacctttgaaaacatgctaagtgaaagaacacatttgcatgatcttaatgatatgaaatatccagaacagataaatttatagacagagagtagattagtggttgtctagggctgggaagaagggaatgggaagtgactgctaatgagtatggagtttcttttaggggtgatgaaaatattctaaaattagatagtgataatggttgtgcaactccgtgaatataccaaaaaccatcaaattacacattttaaagagtgaatttcatctcaataaagctgttaaaaaataagatgatgtcctttaccaagagtagagggtattagggggcttgaggaaaatgttgaagatttgaaattcccattcaaaagaataagagagggagctgttttagtcatattaggctagctactgtaataaacagactccaactttcagtggctgaacacaagaaaactttatttctctcatacagttgtctgatcttggtcaggtgaccatcctcaatggctctcctccaaatagtgactcagggacccaggttctttccatcttttgtctctgctatctttttggtccttggtcttttggatctttaggtcctgggcctccccacccatatgctggatggggaaagagaatggaggattgaacctgggagggttttatggaacaggcctggaggtaactttctttacttccactcacattcttttggccagaactcagtcacatggccacacctaactgcaggagagattggcacatacagtctacttatgtgtccaggaggaaaagataaacaggtttgctgaacagctagccagcttctgctacaagggctgaccaaggacaaagaacgattgcaggctccaagcccagcttgaggtggcatgttttcgtggctgagagcagggctggatcattttctcccactgttcttggtggaacattcataggttgaaagtactactatggggcacattcctgctggtaaatgtagcccagtctccaccagtaatatctggtgatggaataaacactagagcaaccttgaacactttggcatctcacccacagaatgagaaatgtagccatgctgtccacactgtcattcaaaggggagcaggagatgaatgtgggaaataaactgctatttctttgcacttggacaagggttgaataaaaataagactctgtccccttttaaggttgtgctttaaatagaaatctgccccaggcccttcttgatcttttttttcctggctccctctctcttagtgtccttcactcctggccacatctgctcctttgtggctgaggggcctgagttctccttgggaaccagattgcctggtggatccctcagattgaagccccctccccacttaccttttcataagtttctagtgctacccggacaggtgcagctattttagttatatttctatagtggttgtgcctgcccttctagacagctgccacttgtctttctgacagactgtttgcttgtgtgtggctgctaatgctgtagtaaaaatcacctcgctgtcctgtccttgttttcagaggcacttgtctcttggtgtaatgctggatgtttaatgggcattgtttataaggagtataagacggaatagtatagcctcttgctttgtgtcgtaattccctctgggcttactgaaaaggatgctgggagttaggccaggctggcaggaagagggatataaattagaaagggagggagcaccagggccagagagaagtgattctgttaagagtgggccctcagaaaaggtggccaaaggtctaaataacaatgaccaaagtgtgcagtaaggagggtgggatccgggttggtgtcaatgtctaagagtctgaagcactatattggtttctggaagagattttcaactggtgagtatgtttgccttgccttattctcccctaatccattctctacactcctgcagagtgaaatcttgcaaggtacaattcctagttcacattcttccatggcttcttataataatatctaaatgaactggttttcaagaccatatgagcctggtcccagcctctctccagcctaatctctccttctgcctccctagattcattgccatggccccagttctaagattcttctgtttccttcttatacgccaagctctctagcacctcatacagctccctctggtcccaactttgataccacttttttcctggtagctttcctgactaaccctccccattgagttagttgcccgtaacactctgtctctctctctctctctctctctctctccgtggcaattatctcactctattgcaattacctgctcatttttgtgctcttccactaaactggaaacttcataggatcagggaccatgacttagtccactttgtactcccaattctatagtcagaataggctaatttctgtaataaagaaccccaaaagtctcagtatctgaagacaacagaagttttatgtcttacccacatggaattcaatgtgggtgttcagtagataaccttctacactgttattcggcaattaggcccctttcattttgtagttttcttatctcctagggctgtcctctctttccaagcctgcatctgacagacagatggaagaagagggaatggagaattgtataggaaggtttttaatgggctctgcctggaagttgggtactaaacccccactcatattccattggctggaactcagccatatgactgcatatacctgcaggagctgctggaaaatgtcatctagccatgagcaggcttggtgagcaagtagtgggtctctgcatgccaccagttagtgcctgcctggaatgtggtaggagctgagtgaatatttgttgaatgagtgaactttggattctaggtttcatcttgattcttaggtgattcagtttaatcatcaggagggacatgtgatgactaatcacagtggatttcagggctctgggcaccttggaagggttacggataatgatagagagaagagtagtgctgcctaagagtccagctcccagtgaggtgctttccttcaaatccaacagggaaagagatttttaaaaattaatcttgaattttcattttttggagaggacaaaggaggaggtaacagagaagaggagtgaggactgcttcctggattttgtagactgtgacagtgtcagctttttccacacgtgcctcgtaggttgatggaagcagtgtgtgacatgctggtgcatgcacccagctgcctgtccctcccctgcctgagagagaacaggtgtgtaatagcacacgtgacgtgtccactctctgtttcacagttagagcatccctgaggccatgcttcctcaactgaaacatccactcaggcttcacccacaatccagttccctatgggtggaagagaactcattccccaggtgggtaggcagaagcaagagaaccacgttgtgagagctagcatggaccaacaatttagtttgaaaatttgcctccaaagacaacttctggatgagctgggatataataacttcttatcgtgggtggctcttcagaattttctaaagcactttcccacaccttatctcatttcatccttgtaacaacatggtgaggtaagaaagccaagagttattatgtcagtcttacagatgataaaaccgaggctcaaagtagctcagacgactttcccaagaccacgtggctgcttttcctctcctgccatttccaccccaaacccccttgtccacattggtaaagtagtttctagaagatgtcctcttagtttgcagtcagggagactggaaaatatgtctcatgactgaccttatccctcaacactggccatttattttcctgtctaaacaagcgggtctgcaagaagctaccacaaaatcctcccctatgtttacatctctgtgagctgtggatccatgccttccagtgtccccttcgattgttggtggagaaaaccaagacagctaaaatgtttcccaggttgcagcaccacacatctcagctagttacagcagtgtctaggtggagttgtgccatgggactctttttcattaaaacaaaacaaaacaaaacaaaacaccacggagctaggatgttttaataaatgtctgtgtgtgcgcttgctaggacacactactgttgcactctcaggaatcattaacgctgtctcccaaccttactcagacagaaagctgacgttaccttgccatcctacctaattaaagatgaaggctatagtttccccagtctattatagtctagtttctgtattttgccattgcagaggaagagggagaagctaaaggttgactgtgatgtgggaggatgcagccaggggcaaagagggtgaggatgagttgcttacctcacagaacctaacaccaaatttttagcatcaaaatcctaacagcagaaagaaagtttccctgtggaagaaggactgggccatgtcaattcccaaaccttccatccttccttcctcccaacggctcaggtatacctgagaaacctacatctgctggcatcatctcccatgcattgtttttgcagaagcagagcatgaccgacatctaataatatctatgttggtatctgtctcagcaaatcctttctgtattaaaagattaatgtagtaaatccagagttacagggagattgtggtgtttcctcttctggtgtcagagtgttgtttttttaatactatattttgttttcctttttcaccctcccttctcatccctataaaccatattttgaagcccttctccaattgcttgattttcctaatagtaataaaaagcctagacagtttggatggcatctgtaccacctcttttagggattataacccaatttttctccaacagtgaacttatgggtcttttatgatctggctttaggtctcttgaatgaggctgacatgaggatgtaaggcttgaatcataagattttaggaaaggctctgaaaagcaagctctttctgaggagtgttgattttttttgggggaagattattttgccagtgttcaggtaagaattcacatttgcttctgttactagtcatgatagctgaatggtgtgcttcattcagatactgtgtagtgatcacttactttgaattgcatattaagacatgtgaccatataaccttttatttgaaccaagcaatttacatggtggagctgaagattggttgttactggttcatttttagtgagcactgactgtttctaagactctatcttggtcagactctctcttgaggtctcccagggtaagtcagccagactgagagtgacccaagaagatggggcaacattctgaagaaaatagaaaatagtgctgtcatgtggtgaagaggccagggagcatttgtttccccatgcccctacccaccccgttatttattgattctgctcataacgtaacagtatatgtatttttgttgttgttgttgttgttggagacagggtctcactgtcacccaggctggagtacagtgatgtgatctcctctcactgcaacctccacctcctggactcagtcctcctacctcagcctctctagtagctgggaatacaggcatgtgccaccatacctggctaatttttgtattttttgtagagatggggttttgccatgttgcccaggctggacttgaactcctgggctcaagcgactctcccacctcggcctcccaaagttctggggttacaggcatgagccactgtacctgcctgaacagtatatgcacctctataaagaatgatcagatgatcaatattaatgtattgcttgattcaactcccagcgtgatgtttaatagcacatggtgggtgctcagtagatgtttgtggtattgaagcaatgtgtttattctatgtgttttccactagattatgagttctttggagtcagggcccatgtgtcctttgtctttgtgtccccagccccatccccagtgcccagtacataaggagtatttgttgagctcccacaaaacaacatccgtctgtcaaggattgttcaaatccctccttccaacttgttctcccttctcccttaggataagctcttttcttttattctagtgcctcagccctgagagaattttttttccaagtaattaccaactcatgtcatcggatgcccatttgactagtcccagtatgtattagtctactagggctgccatagaaagtaccatagattagactatttaaacaacagaaattaattcctcatggttctggaggctgagaagtccaagatcaaggtgactgccaattcagtttctggtgagggcccttttcttgtcttgtagataactgcgttcttgctgtatcctcacatgttagacagagagagggagaaaccgacggagagaggagagagagagagagagagagagagcaagggagcatacaggctccctggtgtctcttctgataaagatgctaattcacctggatcagagctccaccctcatgaacttgtttaaccttaatcacttccttagagcccccgtctccaaatacagccccactgggggttagggcttcagcatatgaaatttgggtacaaacaatcagttcataacacaaggtacttgttgcccactgtaacatctgctgtttcccgaacaagacaaaggtgatgataattaaacatggtactagactattcatgttaaaaagcatagtactgtgtgtgaagcatcttaaatgagtcaggcaggagcacttaatgaaaatctatggtcaattgaacataggtttactgtgcccttgtcttttccttccattatgttttttttttttttttaaattactattccatggggattctcctaagcttgtcaattacagacaggtgctcttgttttggagccagagcagcagttgtaaaaaggtgaaactggaaggtcaggataagctgggttatgccatgacaataaacatctcccaaatctcaatggctcatataacaaatgtttctttctcccctacgctacatgtctaaggggtgtcaccaggggtgctctgttagttgtaattgttcttggatctggactgatggaggcttcattctgacacgtgtcacaaaggagaatatagtaaattgtatactggctccaaagttttcacctagaagtgccacataccacttttgctcatccttcattggctaaagcaagtcacatggccacatccaacctcaaagaagtaggtgaaacaatcttactaagaaggaggagagctaaagctttcctttggcaaatggcactgattaatactataatggggtaataatgaggcctaggtaaacagggtaggacttgagcaaaacttgtggcacaaatgagaaattttatgtacttaatgcttttttagaaaaatgctgcttccaaaacagctctaacatccaggatttcttgcctagccagtatttctgtgcctagagtgagattcagagaatgaaacccttttttactgagatcctgagagttgcctttcaagtgtccatagagtataaataacaatagcctcaaagaaacaattaaaggctctccgggtggcttatctcagatccactgagaaatgaaaacccccaaacatgccagaacactaaaaaaatggctgtgtctgagggtggtctccttgtcatgataaagctttctcctcatccttctgaaaatgataccaccctcatgttagcaacagtatcgctgtctggaaaggggctggctgaatctggtgggattactttgagttgcataaacacagattgaattaagcatggcgagttgatgatggggagtgtagaaagagtcaggaccttgcgttgggataataactagttcattatctgcccagataaaggtcgtacaggcttttagcaacagcatggaaaggaaaccagattgacctttctgacggcaactctctgctttttttttttttttttttttccagaccttagaacaccagtgagtaaagaaatccgtgtccctcctgacacctttcctttccctttcctggcgttcccaaaatgcaggccttcatttccattggttttgaaatggctgcctttgtttaaattacttataatagaacgttcctggaaaactctcacataagcccatgagcagatgttagtatcttatatgcctccaattttatatgctatatcacacctcttccttgctccaaaattttgcctttgcatcaaaaaaggcaaaaatcctattatttagtcaaaggaaacttctgcttcttgggctatatcttccaaatttctttaaaagagctcattatgaatcatttggaaggagccagcacaccatattgtctttgtgtgaaacttagaaagcagtgtggtgtgggtggagatacgtccaactataaagagaaattatagttacaagtggctttcaagacattaaggatattttggagtcctaaattaagcaatggcaggttaatcttttcccaagaggtggtgattttggctaagtatcataaaagggttatcccaatgttttcaacgtggtttcaagtgaatgatcatctcttattcatttttcataatcattttaatatgccacatatgttccaaaatgggttggcaaatttattttctttctgctaccttagaaatcttgtcaataaaatgaagcctagtaatatggatttcttacgtagctataatttttctttgtgagggagttaagatgtgtacttcagtaagaggaatgggctgtgttgaatgccagatcataatgaggcctcctggcgccaataaattacacttgctctaggttgactagccatggaatgaggtcatgtatccttgatccagatcatgaatgtgacagcctgcatctacatacagtataacccaatccttgctaccgtactatatttcatcacagtctgtgtcaccttcagggcgtgggtttgacagaagatgacagtagtgatgcatattatgctcaatccttagcctcaaacagcaaaaggccttacatttagattttttttaaaaaaagaagacaattttatatcacctacagataattaacaggctctgtgtgaaaaatgaaattagaaatattgaacttagaaatagaggaaaaaatgaaatattccttgaaatatatccaggtagtgtagaataacccatgaccatattctgtaagattttccttttcctggctccctaccctatgtttatattcaccccaaatgcacttttaatcacagctttttctccatgagcaagtaattttttttgaaataagataatctgttttgtaaggggtaagtgattgttttatccaggaaagatgtatttcacaatggtattagaattatgtgtagtttcatacttttggtaacaggagatttttagatgaatgttcagccacccctgattatttatatagctccctgaagtttgcagtgacatagaatgaagtgataaagaatgatggtaaatgtcattatggtgttaagtgtatcttttcatatgaaatagtgagaaaagccttgtgcatatatgaagctcttgaactatggatgagtaacattagtgtggctccatttcaatgatatttatatacttaaataatgtattcttttataatatatattatatattaagataatatatatgtattctatcatcatatcaagaacatagctcaaaaatgttttcaaagaaattgagattgaaaacaagcgttgctgggtgcagtggctcatgcctgtaatcccagcactttgggaggtcgaggccggcagatcagttgaacccaggagttcaagaccagcctgggcaacatggcaaaaccccgtctctactaaaaataagaaaaaatcagctgggtgtggtggcatgcacctgtagtcccagctactcaggaggctggggtgggagaatcacctgagcccaggaagtcaaggctgcagtgagctgtgatcacgtcactgcactccagcctggtcaatgggagtgagaccctgtcttaagaagaaagagagagagagagagaaaacaaaggcagcaattatgctaagtctcaaaagttccttttaactgaatgcttagtgtgtcctgatatttaacatcactttccaataatctgaaaaaaagtctagtgcttgttgactcaaacttgaacaatgtttgcatgctgactgatgtgtgagtcagaaggtatccattatcttaatcaaagattcacaattttttttctgtaaagatccagagggtaaatatcttgagcattgcagatcatgaagtctctgtcatagctctttgtcactgagtgcgaaagcagccatagacaatacgtaaatgagtgagcatggctgtgttccaatgaaagtttataaaaaacaggtggtgggtcaatttggcttgtgggctgaagtttgtcagcctccgatcttaactatgaagcttttaaacttagcctaattgaaaaacgatttccatatggcacctagtagaatatgtgactacctgtgtatttagcgcttgtgtgtgtgtgcgtgcacacacgcacacacatacacacaagaatgaaggtttacatgcctttttgagatcagtctggaaaaactcctgtacatgtaattttgtcttacagtcaataaatatgttccattttctaaataaatagtccgattctctgtgggattgtggctaccttatccaattaaagtttatgtagcgttgtcattgttatcatttctcctctcaagttcattgcatcatgatcatatgggttgcttaattattactctttagtggtgatgatgctattcacatggacttttttaatgtgggctgtgcaagttgcttttgttatgagtcattctctcttgatgtcattagctgttttaaactaggcattaattgaaatgaaaccacaagcttggttagattgattaatcgtttcagaacctattcaaaatacttttctttcttcccagaaaaagaaactatagtcatttgcccagaaatgggagagaatcatgcttttccaaaggcgaagactgtttgttttgaaaagtggatttattgggatgataaatctggcttgtactatctgctcacctgtttgtcctcgggggagctatcactctattaatccttttacactggaaatgttgaaatgatagacagtttcaaaagttgcacccccaaaaaaagcagataaacataaacaaatcttactcttctactttggatatgctttgaatcagcatgctggggcacttccttataagaggaaggcaattaaacaagagctttggtcttttgtaaccaggtcctgccttgtatttgggaagctctgtcgtatagagaatcaggctgcaggtcttaccttctaaactctcagctttaacttttctttcctgttttttattttttttcaaagaaataactgatctttccacatctaaactgcaggtgcagacaggcacacaaaatgacactgtcccaaggtccaggctacttcttctggacatttgatctgccaggtcaaatttccaggaggactggcccagacaatgtcaagatgagaatttcttcccttactgctttctgtgcaattgattgcagcatctctgcaaaaccactgacattctcttaaccttagtttgcttttttgtgaaatgagtgaatcccagtacaaggcagcagcaaacaaaggtgtaaaaatcacctgaggcaggaaggccagaaacgaatcccggtggcttgaggtacagttgtgcattcataaattccatcagcatgtttggtcatgaatgtcagtgtgacatttcagtcatttaaatcattgacgatcatgtacttttatgtgcaatttgcttctaaaaatatgtgggctttccaggcttttatttcataatgttccctccctcccccgtctccgcgccagtgaaacaattaggtaatatgttttagagaatgcctcttcttagcttgggcctgttttctctaagacgttactagcagtttgctcattagcagtgacaaggaaatggcaccagagatgctttcctgagaggtctccctgcactgggacctggaaggtgagccactgggtggctgagaccctgggagttttagcatgacggcaaaggggaacaagaattttcctagcctatgatgttttcaagtatccactctgaaaacgatgaattagatgaattctactttaggataggcaacacagagagaaagacagacagaccttccccctccttgcccccttccacagaggcagaggaaagaaagattagaggcagagcagcaagggttcaagaatggaggacagaaaggcagaagagaaaatggtgaggctgcagttctctgttgcccttggcaacactgcatgggggcgggggttggctggtatcttggtactgagcctgccctgccctgccccgggaggttgtgggatatcacataggggtggagacctcgctggggacagctgagcagatgacaagtctgcaccaagaacaagcaaatgttctctgccgggacactggctctatctgtctggctccttccaggaccttttgaacttgttccctgggacacggtatagcccgcttgtggctcctctagatatttgtttttcctaagtgcattgatctatcagagtaaaaactagccaaaaataagaatggggaatgaatcaatcctctggactcctctctcctctgtgttcccgagtctcaatggtatcagatggccagttgcaaacatttacttctgactgagtgccctgatttctttagtctcttatcttctccccttccctccctcatttccttatcccttttcccctctgccctcctctctccacagctttggtaagaaatagccagccttgaattcaagcataattgctcggcaggggggacttccttgaaaaaacctcaaatttttgggctgtaacagtggaaatctgtttgaacccttgaacttcctttattgttgaaatgaccacctacagaaacatgctgggggaaagtagcagaagcacagtggtcccttttatgggaaaaacagtagctggaattatttcacttttgcaagaattctgtaatgaggaggcatttctgaagggagagtatggcacaaacattccacaagttggagatgtctggactgagattgggatattgtaataatcgatgtttctgggcttagaaacagagtcttcattctttttttgaccacaagcataaaagctggtaactgtagcatttctgtctacttttgttgccatttgcatgggctcgctctgggtactggagattttcaggcacacaagctgcaatagaaaggcggctggtatttgcctcttagaaagtaaagttggcatgctatgatttgtattttccaaccaacaggctgtgtggactttttcctcggttcactcaggcaccaggatatcttccatttatggatgccctgttcactcagtgtgccagagagggcttgtgcatgggtggacatacactgataaatctgggaagtcgttgctttcagtctctctctcaccctcatcctctctccaccctaccccccaacgttttcatcttaaaccaaaaatcagagtatgccatttatctgcttaacaaatgcctataaccctcacctatacaagataaagttcaaactccttagcaaggtgtaggtctgaacccagctcacttttcccaactcatctctttacacttccctgcttcccctggactccagcacatgtgatgtgcaggtctccagatctaccatgtttatttcacttcattgcatgtgctgttgctcctgctgcttaaaataccttttcttctctttttcactgcaaacaactcctactcagacttccaagcacaagtgaaatataacttcctctgtgaagtcttccctaacttcatctgctcactccatccactttgctgctaaaatgttttcatatttacagatatttctcttaacagtacttactgcatgggactgtaatcaaatgttacatgcctgttgcagtctgctgcaagcctggtgagggccggggccatatggtattctgttttggattcttagggcccagcatagcacctggcatctagtaagtgttcagtaaatattttctgaatgagtggttgggatccattaggaaaatgtaggagtatgtgtgtgtgtgtgtgtgtgtgtgtgtgagagagagagagagagagagagacaaactagggagtgcgtgttttgagttggaaggcagttactgcgattggtgtaaattgttatctagttacaaaagagtcatagttttctttcaatgagccttgtaaaagggggtgttctcttcaagaaatagaaagataattacattcaccctctttattacccttctggacaaacacttcaatattgttatgtgatgacacaatgcttctgtatttgtgggtctgtgtgaatttaagaaaacagaatacacacacacacacacacacacacacacagagtctgagtttcaaagacacaaaaactaagatttttttttaaattgaagtattgcataccagggtcagaaattttttttctgtaaaggaccagatagtaaatactttaggctttgtgggacatttagtctttgtcacagctactcaaagtctgctgttgtaaagaaaaagcagccatagacaatatgtaatttacaagaacatattttttaaaaggttttttaaaattaacatacaaactctctacatttaaatagtgaacattcagtaatgattttatctgaaaaattattcttttcctgaaaccttttcaattatataaaccatgttagggtagataagcagagcagcaggagcaaatgcactaagattgggtgattgcatcagaaccactttggtttcatgtcatcatgtcaaccacaaaacttgtgataaaactcttccacctgcaaaaagtaaaacaaaatgcaatataaaatccaagtttttagcaataattttactaacttatggccttcagggtccattttgtcatttacagtgattaatcattggcttatctgagaaagaaattttttctgcattactgttccttattggcattgtgttaatcagaccaatcctaattgggcattaaagacatgttcatagaagttacagtgtggtcaagatatctgcatattctgtagaatgttctgtgaacagtctagtgacttacatttggatgagaaataaaagaccacggattttgtgtgtcaatgttgtacctttggttaattttgctattttccattttgtcggtgatggcttccatttgcagccacatttggagatgcctcattttaagcaactcaggtcaggattatgcttgacacccaagagcatgttcatgaaagaacttcaaaaattgcaaagtcctggaaaagcataggcttcatttttattatttatcatgaagctgctcaaatctcctcttaagcatgaagcctgatattttcactgcagaatatttggaaggtgctgtccttgtccatcaaggactctttccaacaaaaccaagtagcaagacattaatgcaaaaagagaaggtaaacaatgagctagatggcaaatgtatgtgtgaatgccttaatgttatgagagagcaagatggtgcattcagagaactcattcattctctgaatgttggagacgttttactattgcttacttaaaaataggctagaagtctagagataacctcttcatcatcctgaaatggactggcccctctgggtaatttcctcctacatttctgggagaaattttacaactacagtttcttcagctgggcctacctggagaatgtccccagcggtcccaaatctaatctgtcaaaacaggatagtttctttctcctcattcttggctgccttcaatccaatgccaaggaggccagaaattccctcaacttcttacaggttcgggctactttgcagaaaagataaatctctattatctgaggatttgtgcatcctcaaatctctatgtggcgttagagcctatgacatttttttttgcaaagacctggtgcaatggtccttcccagtgcattttcacaaggcttctctttgtgatgatgtttattcagcccatttaatttggaagtgaaggaaagaggagaaatgaaaagaaactgtgggcacgagagagtcaaagaatgaataaggaaaactaagggacggaggaaaagaagaaggaaaagaaagaacagctctaacagcaaagagcaagtagaggagaatattgatgtcaggctggagactgataaacgttaagtttcacagctaaggctctcagagcagagaccactccttccttctcttgtgtatgtatttgtggatagaaccaaaaaggaatgggattattctgctgtagatattcttgtcgcagttttatcttagtgtctttatagtttaacatatatcctttccttttattaaatgcatcgtaaaatcagcaagctttgctatagactttcataaacagaattttccctttttggtatggagcctggaaatctgaaggacatggtactgcttacgggcagatcatttgtttaaactcttcaacggcctgccgtcagcaccaggaacatttttaaatcgggttctgagctgttaatctttggtttgcactaaaattctcaattgaaacatttttctttttcaagtggaccttctgaatctggacataaacttctaccgtctagtgtgtttctcagaataggaacatttaaagaaagcttttgggtgactgctatttctggattgaagtgagaacaaaaatgtagacaaaatgcacatgtagacaacatgaaaaaaataactgttgtctttaatgctgtgggaagcctgggtggtatttgccctgaattgtgtcaatttatgtaatattgcttaaacttggtctgctgcttgaagaaccatatatgtgcccatgtgtgcatatatatgatagaaagagagaatatttctagatttagtgtataaagaataatggcctagaagttctagaaagtgcgaatccattagtcatggccgtgaatcgcccacctcaaggatctgttgccaaccaactgtaaggtatgtaccatgaaaagctaaaattgtttcctgatatcactttaaaaggtaaggtatatgatagcttcttttctagaaagtcataattttgaattatcaaagtgccttgcttataaatacttttggaataagtaattctgtctttcctaatatttctagatattgggagcaaattcgtgtttaccttatgtgtatccctcatggatttttccatttccattgtattaactgtgactttcttcagcaaatctggtggttgtagatttattttaattctccgtgccatagtattctacctcagcatgcaatctgctgattccttcccctttctaaaatgagcttgcattttaatttttaaaattagtattaaccaggtaataaatattaactgagtaccgactatgaacctgactctgagaaatgtcataatgagatatttaatgacaacagtttgagaagctaaaaaataatttgccaaagcatataatttatttgctagtgctttgttcattcatccattcacccattaacctgacttccatcttcttattccctatctgctcatccgtccacccctgcacccatgcacttatccaagaatccattcattaatttattcactcatccatttattcacacactcatccacccatccacccatctatgaatccacccgtcaattcattcttccatccactcacttactgaactatccatgtacccatccacccatctattcatccactcatccattcttgcacccatctacccatctactcattcacccatccaccagtccacccatccattcagccacccatccacacttccacccattcacttgtccattcatccatccatctgtcgttcaccagacagatgctgaaggcctttgatggtcttgcacttatcttggcattttaaatataaagttggcaaagtagttcctgtcttcttaaagctcaaaatccaagcaaggagacagaccacataaaaaatatttgtaaatattttgaacttctttatagaaaagcagtcttcaacctcacagtggcctaatctcagtaaatgtgtattggcattctttaatagttatcattaaaaaaatactaagttctcctttggcaactgtatattgttttcctgcattcttctgacttcttacttagagttataatatttttataatgatctgtaatggtatgcttttaaaatggaaataagaaatatagagacaggtgttacatgaagggggctactaaaatgtaggaattcatttgggggacagatgagaatttactggttttaaaagtacttgccatcttttttttttcagtagcaggaaactaatgatttctttttattcttgggagggagagggcaggggtggtttcttaattatgaagtgcaattgtttagatttttaagtagtgttattcctgttatgagctgcccaggcagccacatcaaaagcagctctacgtgtgtgtgtgtgtgtgtgcgcgcacacacacacacacacgccagcctggattgtggagacagacctggtctctcagacctggatttaatttcattgcttgaaggagaaataagttggtgtgttctttctggcggagagtcattttttcctgccttgttttctagctttcaagtctgtatttgcattttaattaagaaagaagacaactgttggaaatgaaatttggatgaaagctgtgaatatttatcatttgaacaagtggtgttaacataagtctacctgttgaaaacaatggttttaaacttttatactgtggctgattttttcttttttgtactttttgtttattttattttattttatttttgagacagagtcttgctctgtcgcccatgctggagtgcagtggtgtgatcttggcttactgcaacctctgcctcccaggttcaagcaattctcctgcctcagcctcccaagtagctgggattacagctgtgcgccaccacacctggctaatttttgtatttttagtagagacagggtttcaccatgttggccaggctggtcttgaactcctgacctcaggtgatccgcccacctcagcttcccaaagtgctaggattacaggcgtgagccaccgcgcccggcctctactttttatttttaattaatgttttccttttcaaaaaatgagatataactgacatacagtaatgtgaataaatcttaagtgtatggcttgacaaattttgatgtgtgtacacatctatgggaccacaaatcagatacagatatagaacatttccagtgatccaaaaagttccttcatgcacctttttcagtcaatactcatacctcgcctttcacaacagtaactactattcagacctctgttatcatagatttattttgtttgtttttgaacttcatataaatggaatcgtacaataataatatgtatcttttgtgttgggttcttttgatcaatattatgcctatgagacttctaaagtaaataaaccttatgcttttattcacagactggggtaacaaaactatcaggattctacttaggttctaaaaaagtggaattgctaactgagttgttgttagttgggtttgtctgactttgttttggcaacaggagttggtcccagtgatagggcagctaatgattcaatccatcaatctataggtttttatcgaaaaccctctatatgcttagcatgtgtctcttctcgatggttcttttcaaatccagggtttcccaccctcagcactactgacatttggggctggatcattctttgctgtggagctgtctgtgcactgtaggatgtttagccacacccctgttctccactcactgggtaccagtggtatctactcctcttttgtccagttatgacaccaaaaatgttttcagatattgccaatatccctggtgaggcaaaattaccctcagttgagagtcactgtcataaacctactgccactgctttctacattttatttcacaaacttttttgggtactttctgataagaagaacctatgagacactttggacgagtagggaaggtgggctccaagttctttatttgttatgtacttggttgagtgaagcacacagttttcatttctaggggtgggtaatattatgaaaaaaaggtagaaattggtaagatttgatgatagctactgacagggtaactgggtcaaacttcaaagtggcaattctgaaaatgcactagcagtctgaatctccaagtgatttttagacgttttgaaaaatccaagaaattctaagaccaccacagtttggaaccatgccttgagtaataggcctgggatagacatgaaattcctacactgcatttaattaggaggttttgatcagggttccaactggcatttgcagctgatgtttgattaagagaaagtcctgtctcaaaatatgagaaaacttgaataataaaagcactgtgccaatggcttttcatgtatttgtttagaacctgccttggttccaggaaggatttaatgtggatttctatcattgcatgtgctgtcttcatcaatggtttaaaatatcaaccagggtgaagatataagagaggaatatcgaatcattgcttagaagaagacttgagcaggcatctcctcctcctccatctaagcttcaaaagaggcctcccctaaccagacagtccagtgagataatgaattaattagagacttggaagggttagcatgagagccttgtctgtcttgcctctggccctctgtctgctcggctagatcctggttaggagcttttggcagtcctcaggttggggatgagataccttggcaggcttgagtgggcatcaaagacaccaggaaggatcccagcccagtttctggcaattctatctgtcactgggttttatgcctgtgttcaaaatattccatttctccatctgtaaaatggagataatccttcctcaccttgcagggatgttgggaggattaattagctagtgttcctcaagtgctttgaagatgaaaaggcttgtggaagtgctaagtattaaggcaaggcagcgaatgcctgctggaagtgctcttcctttcctcatcctcttgtcagcagttgtgtttctcttgccttttctgcatatttcacagaccaaagtgctggcatggtaggtaggacaatgcatggatcagcacagaacaaagacagtaatgccttattttatgccttgctactaacttggcttatcagttggcatgacctctgaagatctttttgctctgaatgttttaatcatcaagttctggtggttatccaaggtgatcctaatctactttggggtggagggaggaagtggtgtcaggagagatcaaaccaggccaccttgagctgaaagctctgaaggagaaggattccttgaaatggaggtaatttttgaattataataagtgagaagactgcaagggagacaagctgagggacaaatgctctgtgcttttctcctcactttcacaaacaggaggagaacttccactgacctagcagtagtttgctcctccaggctgtcatgtcttctgatcatgtcttttatgaggtgaatttctcctcatgaaagactagactttaaggagagattctgtgcaggtccctacagtgtggagatggattgattgggcctacagattgcagctaatcaattcatcctttgcttcccaaaggtttatgcatttgggtggagttcacaatgagtggtctgggtgcagggccgtgtggagaagcatgtccaccgctcttgccccggtggcttctttagataatcttgcaatcttcacaggttcttttctaggtatgttattgtttggaataactcccttgagtttggaagaagaaaaggaatagtaccaggtttactcaatcatttgttagtttgcttgttatcttaaaaaattctataaaattcttttgagaagtttctctgctcattgatcttgaaaatctccttgctttagagaatggatgtgctcctcatatgctaaggataaaccagattttggtaaatcaggttatcttaggggtcccaggtgagtttgccattttaacgatgcttagagtgaatccttgtataagggaaagtatcttgtatattctgtatcctttaggaactcacgtctgttgactttatcagatgttggggtggtggtgaggctaaagaccaataggcgacatatggcaggatcttccctccaagtgaccctctggaaagggctatacttacttaattttggtggagctcatcatagggtcaggaaaccagggagaaagctgagcaactggtatttatagatctttctctttaaatcaggtttgctcatgatttgtctggtctttattcttctccatgtctgaaactgagttccttggattcccttctcttcaaagccctcttggcaaccttctgaggaatggcagagttcattctgatccacgtccggtgagcgtagctcaaccgtgatggagcttgacctgtcaaattcacagaaaaatgtccgttacatattccagctgttccttaaacatgctccctaagagctagttccatttgttagctgtcagaacgatgtggaggaattgctccagacccttggatgtcatcaaccacttttgtttatacaccagttattttctctattagcaaatcaatgtttggcaaaaagaaagcacaggctaagaacttttcctgatgagttgctgccccagccttggaactcttctcagccaaaaaaaaaaaaaaaaaaaaaaaaaaaaaaaaaaaaaaaaaaaaaaaaagaaagaaagaaagaaagaaagaaattgaggaggaattcagttttacatgttttccttcctgcttacatgaacagaggaggcctacctgaagctgaatccaagcactgcctttgacgttggtaaagatggggctctgagctcacatatcaccttggaaactggatcctgttactgctgggaaaggaatgcttggttgccaaaagcattaagatagggaatgtggattccacctctcagtgctcctgccttggatcaattaggtaggatactacccagagatacagacatgatggaccaagtaacttctccaaactttgattctctctggatcccatggatatgggaactgtgatgtccaggagatccagagagaatcagagtttcagtgagtgaaacctagagtgtgtgctgctaggattttcctcataaacctgggtgttttattcttgtgggccagaaagttatttcattcctaaacccgtgatgtagacttctcagaaattccagtggtgtggaggatccagcttctatcagctcacaagagctgattgcacatatctctccccaactgctgttcagtggcatcaagttggtagcttgaaatctgccatgatgagagtatttacactatagaaattggcaaatatggcaaataagggtccccaccacccatgcttgtgaaacatcttccagcacaccaaggaaattatcctaacacgtaacatcacttatgggggctgtttagcttcaggggaggaaatcccctttgctctgatctcattgtgtgtacctgctttgcataggcagactaccccttgttctctcatctattaaactcgacctgagagagagcttcatgagatgggttgtgtgacaggagatcactagggtaatgagtctgttcctttcgctgctcagctatatgacaggttattttacctctctaggcctcagcttcctcttcactataataaaagtaatttagatcattaaataattgctaagtttccttgtagcttcgacattctgcaatttgatgagtgcttggctgctggaaaatgtcatgtgtttcaaaggcttggggcacatgcacatcattcacagtgaccagctgagctctctcattttctttctggatcttggactcccagtaattctacttttatctggacttctatcttcagcatgaatgagcagggtgcctctaagtgagaagcataattgattagttccttccatctgggggtgtcaaagcactttcaagtcagtagtcagtatccatcatggttgctctgcagggaagactgcctgagagtgcctgttttgcaagggacatatcacagtggtggaccaaggacccagaattattgacttgtcttttaatcagaaaaggggctacttcctggtcttaaagaagttccagctttgagattaatctgctgtctataaccccagatcacttggcatgctcggcctggctgacctgctgacagaacttgatatatttcccatctctctgacatggagataaacctgaataggattttgctagttcagaggatttggggatacatgtttaggtaaagttttcctataaaattccttaaaagaggtgtggtgtgggtttttgttgggaattgaggctacacttaatggaatgtggaagagaccaaatccacctttatggggtgcctggatggaaaaggtgtactgataggaagttgggactgaccacagacttgggctgctttgtgattttgcttacagtcttgccaagacctagcatctgccaaaatacgtgtctctgggccctctctaccgaaatgtacacattgacatgcaccaactcatgccgctgttgttatgattgtgtttatgaagccatttactcttgaatcaagaacctgagtgacttgctgagtgtttgtaggtttattgtccactctgccagctgactgggctgtgtgtgttcaatggctgaagccatgattcccacagctgaaggtttggtccattgagtctgccaccataaagcacaagctatgtgaagggctggaaaagaaataaattcttctgggattaactccaaagcagaagtacagttctgtcttgcacagataatagaggctgggttcaaacttcttggggtcagactgccagctgtgacccacattggaggtctaccatcttttcttgttggaatacttcctaagaatatattttttaaaaaatcaagcaccccttgtgtattttacatttgatatctgaattttctaatcgtaagttgaattcatcacaaaagtatattttccagcacattgtgtattctcacagctcaaagtctgatgcacgggtcagcaacatcagcatcccctggcagcttgttagaaatgcagaatcttgggtctctctccagccccactaaatcagaataagcattttaataagattcccaggtgattcacatgcacatttaagtctgaggagcactggtgtatatcatatacatgctttaagtatatcttcattaaaacctttcaatttatgaaaaaattattagatcagggtacgtgacctaactgcaaagtcatttcttattgtcaaaccatcagccaagccagattaacttttagtcagtataaagaaaggggtttcttcattgattcaggtgaatgtgttaacatgtgtacttggccaatcttcatccttctgagttctggttttaggataagtaggcagctggctggccagatagatatataaggcacaaagctgtgctatgaatttgttgcctgaataaaatatggcactgtggccttcaaatttttttgaaatgttctttctttgccctgggaattttccttctaaagtgatgctgactcaaatgatacctcggtttggggctggggagatttttactccttaggaaaatgcatcctcataagattgagaataggtgggcaatttccctttctttattaaaggaggaggaaggcagctgtgaaaaagggaatatggagaagcagagctgccacagagatggcaggtcagctttgggaggcatgcatatggaagcagaaaatatggaaactgaatctcttaaagctatccatatacctacatactgccagaaagtctctggggaccccagtggtaggtgagcccaagtttaagaaagttgagttggagaatcaattaatgcccttttggaacttcctggtttccagcctttttatctccttgaatgcacatgtctctctctctctctctttctctctctgtgtgtgtgtgtttataaataagagtcattaagccccaattcaccacaaccaaagcttttgcctgttccctcatctcctcttgaattccaactgcaattaaatttatcaaatatttatttaatccaactgcgcatcaggcactacaccaggcattggtgatgttgagatgaccaatggagacaacaatagtcattgttgataacgaagacgcacacacttgtggaattctatagagattttcagaagaagggatggcaagcaacttccaatgttatccttggaaatcaactccttattaggggggaagttcctaaagaaaggataatgaagtctgctaaagaaaagatgcatctgcctgtgtgtactgggggatgtgtgtgtgtgtgtgtgtgtgtgtgtgtgtgtgcacacgtgcgcgcgcgctatacagatcaaaccattgcagacctgcaatgttttccaagtgctttaatgtttaattctctttgatttgatccacggcgtcatcaagtattcctgcgggcaattccaaggtgtctgaggacccttgctgggtatcaaaatccagtaagacctttggagaaattgaagaaggggaactttattggtttttaggccagtcttataatttaattctgttttttgtctgaaacacacatgcacggaatcttttatcgtctgttaggcatgtgtcctaccaatcacaagacttaagatgagaaaaataagcaaatgtttgatggagagaaaacagccgttggaatcctgtggctgttcccacactggggggatcaggcaaacccaggatccatgcattagaaaagaatggtgcagagagagctattgtcccctttgagctgtggcccatagtaaattgttgactctgatcctagggtcaggttattgctgagttgctgttagcattaataattatataatggccttcccatttttctaccccatgtggatcattttgggtgtttgtggtgagaatgttctctaggtggcatcacggaacttctcaccagtgctgtttgggggacccttgggcccagtctcctccttccatgcctgacattgcagcttgacctacagcacttgctgccttttccccctcactgtaaccactttggttaacttggctgaaggctgcaagcctcatgaaagaggttcatggctatgaacacccaaaatgatctcagattcagattatgcacatatttttccttccttccttccttccttccttccttccttccttcctttcctccatccctccctccctccctgccttccttccttctttctccttccttcccttcttccttcccttctttccctcccctccctcccttccttccttgcttccttccttccttccctccctccctccctcccctctttctttttctttctttctttctttctttctttctttctttctttctttctttctttctttcctttctttctttctttttcttctctttctttctttctttttcttctttctttctttccttctttctttcttttttctttctttctcctttctttctccttccttccttccttcctttctttctctctctctctttctttccttatttattgggtgctaaacatttatagcgtaaaatgtttattttaaaaaacatttaaaaataacagctttattaagatatagttcacccatttaaagcgtacagtttagtggtttttagtgtattcacacagttgtgtagccattactacatccatttgtagtcactccccatttactcctccccgcagcctctgacaaccaccgatgtactttttgttttcaaagatttgcctattctggacatttcatataaatgcagtcacacaatatgtgatccttggtgtctgacttctttcccttagcatgatgttttcaaggttcatttatgttgtagcatgtatcagtatttcattcctttttatggattaaatacattccattctatggatatactacattttatttgtccatttattcattgatggacatttgagctgttcccacctttttgctattatgaatagtgatgctatgaatatttgtgtgcaagtctttgtgtggacatatgttctcatttcttctcttatatacctaaggagtggaatttctgggtcatatgataactccatgtttaacccttggaggaatagattatgcatttttgacttgttattgtcccatgaggtctgaagttaggaaaggtagggagaataacttcttatggggtagacatcaatggatctcagcagtgcccaggctggcagtgccatttttatgagtgtaacaagtttatcttcttcagccctttgaggcctcattttccagagactactggccctcctgggtctgtgaccctggccagaactaggattttttatttttaacctctcataagggattcctacgaaatatgacccactagagtgcttggtggactgtcaactctgtatctgtggggaacaaaatccagctgttcagcttggttagctgctgtctcatctggaactgcctttcctaggtttatttccccaaacaatggcccaagttgtaggcttgtggttgccagccccctttaatttggtccttagttgcatagtctgttatttgtgctgtgactggctgtgattgaaggggtatgctttttcctaaactcaacagtgtagtaagatgcttggtggactccaataattcatctatcccatggagaatgtgaggagtgtgtgtagtgatggtgaggggcatggcacactgaggggaaagtacctttaaaacagaatactgaatttaatatcagatcaggctgatgttaaacctctgctttccatatgagaacactttcccaggggatttaattgtaaaatgacaaaagggtcttagtgcaatttcactgacaaatggccttctggtgtggatttccatgacgcaagcagagccaactaagagcttcgtcacttatgttcctggagcacatagaacaattttctcccattttgttgaacttacttgaacttggggtagaatacctccctggacttatactaccagcaggtttaggctcccagtttcatttatgtgtcttcatcccatgtatagcagtggctcccaccattggcaaagactgaacttgaaatgccttgctctggaattcaagaccatccgtgatttagagtatagtggataaggatgacagctatgaagctacactacccagggggtaaacacagctttgtgtgaccctggacaaacaatttaacttttctaatctgtggaatagaaataagaatactacctacctcatgtggttgttgggaggattaaataggttgacaaatgtaatatattagaaaggtgcttagtcagtgcttagctgtgtttgttgttattcttatcctatgttctgtccactcatggctgttggccctgctcagataccatctcttctatgaagctgtgcctgagtgtgtcttccttactgctttgtacacagtaccaaacatagtgcctagcatgtaatagatactcaataaatatttgttgaatgaacaatgaatgaatatttgttgaatgaatgcattttcccacttgggagcaatccactcttcctctatgcttttatatcactttgcctctacctcgttttatggagttttctacatttaacctttattttagctaattatgctttagatgcaaccccttctccagaaggtcagcccttggataatagtgcctgggtcaattgttttggtatttcctgttaggacttgcatggagggcaataaatatttggtaaataattcatcccctttggaaacaatgttcttaaaccattaaattgctaggtgttttttttttttaattaaccgaacacaaacacagagacatatgcatgcagagacagtatccctctaacaatttcatgacatgttgccttcttttttgttttcctaaaggaagtgataaaggtaaaagttgaagaggtgggcgacagtgggagccagagactcaaaataaataaaaatgtgagttcagttcaaagaacaggttgatattaaagttttattggagttcaacaatttcagaaaatacataggtttcattcttctttgaattccttcaaatgttatttttgctcccccttttttttttgagacggagtctcgctctgttgcccaggctggagttcagtggcgcaatctcggctcactgcaagctctccctcccaggttcacgccattctcctgcctcagcctcccgagtagctgggactacaggcgcccgccaccacgcccggctacttttttttttttttttttttttttttgtatttttagtagagacggggtttcaccatgttagccaggatggtcttgatctcctgacattgtgatctgcccacctcggcctcccatagtgctcccccttttaaataaaagctcacaaagccccttggttgtctgaaaaataatggaatatttgacttgagttctgggattggaagctagtcactgttgctgtgcttctttggttcatagctggaaatgctgtggttgtctagtggggagctgggcctgcctattctagggcatggctggttagagagaatgagaagtcacttggctggtggtccaacagatcagagcagagttagtccacacacaggccaggctccttcctggatgcctagaggaaaggtggcaggtcaaagggagatggatgccaactggcacctgaaaggatccctgcacttggtttaggatcagataacatttgaccaaactggaaagtagagaagtaagttttactgaactctttcacacatattctaggggaagaagctgtgtgcctgaaaaacaggaatatggagtggttcaaggtgatttttcttcactttgacctttgaatttatggattatatgtaccctgaagttttggtaaattggtgcagttttaaaaaatgtatattatccacgataaactaacttctacaacatccccaaacctcagtgacttaacccaataagtgttatttcccactcataccaatgtgggctagcagcgggtggagaagggtgctaggctacatatggtcactcaagaacccaggcttcttccatcttgtggcttcattctctctcgggccttggagtcctccactggatgtcgaattcagccagcagcccaaggatgagagcaagtgagtgtaggggagtgcaaaggcagtttttatgggctttgcctggaaatggcatttatcacttccatccacattccacttggcagccttaggccacacctagtcacagggagtttggaagctgtggtctagcagtgtgtccagaggaaaggcaaatggtttggtggaaaactagtcaatctctgccagaaaaactcaactggaaacttcccctctcagttggcgtaaggagaaacagaatattttactgtagtttagaaaatgcttgattcaaaaattgctaccaatgtgtcctggggaaagacccagtgctgaagacaccaagcacattcattcattcaaacaatttttttttttttttttttttggacagagtcttgctctgtcacccaggctggagtgcagtggcgcgatcttggttcactgcaagctccgcctcccgggttcacgccattcttctgcctcagcctcctgggtagctgggactacaggtgcccaccaccacgcccagctaattttttgtatttttagtagagacggggtttcactgtgttaaccaggatggtctcaatctcctgatctcgtgatccacctgccttggcctcccaaagtgctgggattatagccgtgagccaccacgcccggcctcaaacaattttttattaagcacctactctggcccaggcattaggttgggtgtgagggccttgatggcaagcaatacccagaagcagctcctgccttcttggagctggcatctgttggaagccaggcaattgaatgaacaaattccatatactatgagggcaatgtgaggaaaactaggggtgttatggaagctcatagctggagccctgggccaggctgggagagccagagaagcttctagaaagaagtgacatttccactgacacccaaaaggaggcatatgaagagttcatcagctgaaggaaggcagggcagtggatatgtgccaggcagagggaaaagctcagtggttttcggccttgactgtactttggagccacatgaggtagactgggccaattaactcagaatcttgggtggggtgagggatggcagagtaggtccagatatcagttttgtttggttttaaaagaaactttccaggtgatcctgatgtgcaaccagggtcaagagtcattagaatggcaggctcaaagagaggccaggaggagtaaagcacctagctgttatgtgagagactgaaggctttccaggttgctgaaggcatcccaaagtgagatgtggcatgggatgggtggggagcagggcaaaagggggaaaatggttcattgaggagaagccacttcccaggcactctttcctgtgtgtggagacagggatcctttttccccagagctccaagcctggtgggccttcacaagcagtgaggttctgcctgcgggctctaattatctcctcccctgcccttggtgatttggggagggaaagacaagcacaaggattgggaatgtgaaaacctgcctctccgtctgagttcttaagcagaaaagggccaaagggcaagccctgctccagagttgctgttgtttgtgtttcactggggttgggcaagttgcagcatcagaattgtcagcttatggttcagcaggctagtgagcggagttacaaagaatccagtgggatttatctggtcagcatggggtcctgcacataatggaggagtccactggctgttgtttctgcctcctcttgggcctatcagtctttgccaccatcaggagaaccgtggagaccctcaggtcccaggcctgcatactaaacaggcttgggtttggcaggactcatgctgccttccccaggccacattgttttgctcatgtgtttggaatcccctgaaatccttgctatcaaagatgcctgtgcccacctaagaggagttaccttaaaatgaaaagcaaacaactttgctcttatttagaaagcatgaaaccagtgccttaaccttatggttttatcattcaaactacagagttggaaaaagtgtgtgtttttttgttgttgttgtttgtttgtttgtttttaaaaaaaacttcaaaaagttggggctgggtgttgaattgaagtcagggttgtgtctctcagaaggttgtgacgttttgggggaaacaccccaaatatagaggatagcttgtttaagaataaaactgaaggaaaaacttagacccattcttaactatttttctcacaaaatccccaatcgttattgggtttttctcagagatttaaagaaaagccctccctttatctgagctctgtcgtctcatgggggcctcttgggcatgcatttttctagacaccttggacacttggtgtggaaacaaatgtttggaaatgatctatatctggatgctttcctcataaatatatatggatatatagaaactactttaaaaataaaattttagtgattatttctgtgtcatatactgcagccattttgccgggagattcttgataaatatttaggctaaaaaaaaaaaaaaaagaaagaaatcaagccacctctccccttggtggtttcctgctgcaggggaccagctgtggcaatatggagcctgacttgtatcttttcagatatgtgagtgtaatatccagctgaatgcctgggtttccatcaccacacaggaaaaaaaatctgctggaatccaagaagtccaggagagtcaccttgggttctgtgccagaaacaacctctcttacctcaaagttctcccatttgacagctggggaaacagaagacctgagactccaagtgccttttccaaagttatgcaactagttagtgacaaagctaggaccggaaacctggtctcttgatgctcggggaaagctcattacctcagcagagatggcaggtaggtttcctattgcatgccatcatcacttgatagtagctcaacactatgtggaagcactgtgttgagaaggatgctgcagcttgatattcacacacccggaaaacatgcggtgggccattagcttggtctgcctgaggtacaggtgagaggattcgttgcactttgtgtgtgtctccagctgttataccatgctgtgttttgattttttaagtaccataggttcaagagttcttgttgccctcccctcctggtgcaagcccaagcttctttaggatgacctgacagacacacatgcacacacacattgtagtccaaaagcaccaggaaaacctttcattgtttagaagaattagacgcctcacactaggaggttttgatgcgttcctcaactttgacacattgaggttacattgtctctctcttcttaccatttgttctccttccagtcacccatttctctggtaggcaggctcttcaggcaagggtcacaaagtgctgtaccttccctccttgggaaatggggcccagatccaggacaggaatgagatccctgggcctcttccagggaggcttcagtttccggtgtcatagtgatcaactccctggcatctttttagatcacaatttgggaagcagttgacattcgggttttcctcatcagccagtagcacttcctgtaagttttgattgaattgcctaaccacactaagcctcagttttcccatctgtaaaatagagatagtgatagtttccacatcacaggactgtcatgaggattcaataacacatataaagtactttgcaagtgtccaacaaatgttccctattatttttaagtcacagatacaagcccttgaggaagcatcagttgtgtatgctaattttgtgtgtgctgtgtgtgagcatttcaaagagagggagggagaggaagagcaaacgagcgagctagtggtctgtgcctaggatacatttcaaaacatcatgctgtatgtgataaatacgatttttatttttcaattaaaaataaattttttaaaagatgtagtgacacgtggagaattgccatcaggtatgcgggtttgtgtattgtttaggctggtgcatttgaaactttagtgcatatgtggatcatctagggatcttatttaaaatgcagattcagtagatctgggctcagggcctgggattctgcatttctcacaagctcccaggggatgccagttgtgttggtctgtgaaccccactttcagaagcaagagtttcaggggctgatgctgtcctttacatttggaataaccagaaacttcatggccccacggccagttagctggatcgctgtatccagcaactgatacctactgtagaaaaaatactgaagcacaactctgaagagccagatcctagtcctgagaggcagcgagtgagtcattttcctccctaggcctcggcagctttctcatctttaaaggaggtggggaaggtgctctgagaccttgctgttcccagagtggttctcggcccagcattattgggccaccacagatctcctgcaccctaaactgcatttgaacaagttccccaggagattcgcttgcacattagcattggaaaagcactggtctaagattcctttcagctagaagattctgtgaatctgaaaagttctaattctagctctggtgacagaaatctacaaaaacaaatcactccaattataaaatggggatgtcttcagcaagaaatagttctccaacactctccttggtgatatacagagatggccaaactaacgaaatttaatctgaaccagcatttgcctgaatttggttgggaggggagagtgttgaggatcctgatagaaattggaaatgaggcactggataccatatttagattctgtggcttctctagacccagggaaggtgttatggatagtgttggggaagcacgttgtctggagtaatgcccttcaccatcactgacacctctctagggacctcagtgaatttcagcatgatctccccatctttccagagaagtcccagacctagcatcagttcctccatcttccttcaaaattggtgcacattgacagaatggggagaaagatagcaggggtggggggtggggcatgtgcccataggtctacatcctaaggtcaccttctgctctttgaaggggattgaggcaaagagtgaaaaatttgtgttctgttgaatccaaaaggaagaagcaaaattgtcccaagacttctgttccatggaggaatttttttaactataaaaatatcatatatatatgaaaaagagaatgctataagaaacaccaccaagattaagaaataaactattacaaagaaaactgtgattgtagatttcttcctaatagcatcaccttcttcaaccacaccctgaaatttggtgttagtaactcccagccatgtcctcatattttaatatatatttatatattcctaagcagcatttggtattattgtgcatgttctaaaatttgtagaccttgttttgtactgtttgtatctttctgcagcttgttgtttttgctcaacgttatgtatggagatttattcatattgttacttgtagctcccattgattcctttttaattgctatatagagttcattatatgaaactacttcagtttatctattctcctattgatagacacttcagatgcttctagtttttcttcctccaaacaatgctagaatgaacatacattgcttttgtgtgtatatgtgtgagcttttcacagagtgtgttgtgacccattcatagatcatgaacttgaacaaatgggttgcaaatagtattttagaaaatgacatagaatcaacggctttggaaaatgtcagaatatgttgcacatggtaagagtagttactgtttcattaaacttgtctcaatgacaaagtaagaaaatttactttgacacccagttaaaatggaaacgaggccaggcgtggtggctcacacctgtaatcccagcactttgggaggctgaggcaggtggattgtttgaggtcaggagttcgagaccagcctggccaacgtggtgaaacccccgtctctactaaaaatacaataattagctggcttggtggcccatgcctgtaatcccagctactcagaggccaaggtgggagaattgcttgaacccaggaggcagaggttgcagcaagccgagattgtgcctgtgtactccagcctaggcaaccaagcaagactcagtcttaaaaaaaaaaaaaaaaaaaaaaaaaaaggaaaccagtttaatgatacagtaaccagtaactactttcaccatatgggtcacagtcaacaaatgtgaaagttccagggtgggagatacacctaaagatggactcactgggttgaaggccatgtatgtctttggctttgtgggagattgccaaattgctctttcaagtgtaccagttcacaagtctgggagattttacatcacaaagtccaaagaaaagaaatggacctcaaggacagatggaagccagagattgagtgagaagaaaataaagcttaaaattgccaccttgcttgctcttcttgtatgcctcttcaccctaagtaaacattatgggttttcatgaccttgtaaatttgcttttaatcttaaaaaagaaaaaagtttggaagtttggaaggaaattccttgttttcctgtctctctggcctcagttcaggaaggggcgaactggaaggaggtcagaaataagcaacccctttcctttttggaatccattaataacaagtttgaggtgagctgtggctaacctttgctctctagctgccgtttgcagtttttcaaagttagacaaagatttctctggatcagagtcaatggtgccattgttgctgtttgttttaaaattaagcagggatttggggagcccaaggagctatcctcccataggtcatctctctgggggactgggtcagtttctgttctggttccaaaccctcccaggaaggccaggctctcagtgactgcccctcacccaccactcccagctgtgaactgtgttctgtctgacttataccctattttcctggaaatgtgtattcttttccactctgcattgcacaagtaagacctagtgatataaagatggcagacgttggggaagagggagctcccgagtcctcagcctggcccctcctccgtgctggtcctggtgctctgcacctaccatccgtaatctcaattcatcctcgcaatacccttttctatagatgagaagactgaggctcagagaggttggatgacttccccaggtcagtcatccagtaagatgtaactcctaatctttatagagtactttctacatgccaggcattattctaagcaccttacacgattctctttaaatcctcatctcattccaataagagtaggtgtcattattatctcaattatatagatgaaactgagatactgagagggtgagaatgttactgaattgtggcttgagtagtcatctaatattttggcgcttgacactttctattttctgaatgtcagtaattagtgacttggttttcctgccctgtactgtatcatgggtaatgccccttcccaccttcccatctccctcctttcctccttccagtttttccttccttccttccttccttcgttccttccttccagcatttaccaataggcaagggaggtgttctctgtcccatgggaacctgagacaagcatgaacagcacaggggaagaagtgtggtcacaatgacagtgaccatatgtagttaagggccaaaatgagtgaatggcgcagagatcagaaaaggaggagctgggtgagccttgcaggaagtcttatggatttcaccagtgaatttctactcacttaagccagtggttcttaaacttgaatgagcgtcggaatcacctggaggacttgtttaaacaagatgtttgggctcaccacccctgtccccaagtttctgatttagtaggtctggagggaggcctgagaatttgcattagtaataagcttctgctgctgctatttcaggaacaacacttggaaaatcactgacataaacaataagtaagattttgtaagtggcaagataaaggaaatgagtgtgatctgtgtattagtcaggataggttaactgtcataacaaataaatgctaaagtctttgtggtgtagcacagtaatatttgatctcttgctcatgttacagtccagtgtgggttgatagaagagtgctctgctccatgcagtcattctaaggaccaaactccttctaccattgactctgccacaccccagtgccaaagagccctgaattgagccagcagatgacagaggaaaatatggcagatttggcaggtttttatgggtcagacctaaaggagaaacacatcacttctgcccacttgccgttggctggaactcagttacacacctctacttaactgcaagaaagtctgggaaatgtgtcccagccacgaggttccacatggaacttggtttgactagagaggagcattcaacattcacgttgagagaataaatggatgtttcatgttcttccaaggaaatttgcatcagacaattcgggtcattatttagcataattatagcatagattagagtagggggcaaatcaccagatttaggcccagatgctctttattcgaaagcaaaatagctgactgtaaagttacataacttctcagtacctgtttatttatttctctataaaaactgggataagatatatgtgaaaatcactagcctggtgctaagcacataaaaacagagtagttattcccgtgttttctgcattcagatggacagacagtgacaagctattgtggccctgagagccccttcatgtggacagctgtgggattcacagtttaaaggacatgggcacaacctgatctcagcagttgcatggctattctaaagactgctacactgatgtctcagatgtaccataggaaatcaggccatgccagcaaggcccaagggaacgcataggcctcagaccacaggattcattaagtacttggtttctggagtcatactccctagaatcaacactattacccagctagatgactttggcctttggacctcagttttctcatgtgtaagaaaacatgaatcatattactatgttatagagttgttgtgacaacagaatgagaaaaagccagcgactatatactgagaaatattttcgtaaatttcctagcctcctgtggtattctaccatgtctttctcttggcatggttagctgaggccaatatagatagaggttctttgagcgtgtaaacatgctattctctgtttggtcttaggacggccacctggtgctttccagagccctgtcctctccccatagcttgactgtccatgaatgattctgggtcccctgagctgtccatggacatgaaagcagtctgagggaggaggtggtgaggaatactctgagctctttcttaaggctgcacctacatgcttgattagtggcccaccactgagtgagcccagcagtggagatgagtctcctgggctccttgatggcagtagcaataccgctaaggttccccacctccccattgcaaatttccttcattccatcttgtaatttgctcccttgaggtctgggccctttaaaagcctttccctctgccttgttcaaatggtgcaattgtgggtgattgaaaccacatttttatacgtgtcgaaatcagttcagcccttagaaagaaatcttaatataaattggatcatatatcctaagtggatgccaccagctaattcgtttgttagacatttcagctacatgggattaagtgagtgtttactcttaagcagttacatgtgggcttcattaatacacacactctggcatggcttgtgcctaatatcttgtcaaataagggagtgtatagaagtaagggagcccttacttccccagtggaatcagcctctcttagctaccagggtgggactgagggaggtgactggctctctctgacttggtgttccagaaacttggtgtcttgcacttccattagcttctctgtaaagcagaggagggcaaaatgagagcccacacatatgcattagtacaaaggggacatggatctggaaactcattgtgtgcaagcaggcacaaggggctagaaaaatatctattttggaaaatgtttctgcccctaattgaaattaggcttcctgcagctcctgacaggctgtggtccatacccttactaggccaggttgggtcagggaccaacagcaccacattcttgagtcccaccctagaccaactgaaacagaatctaattttaatgtccagtgtatgtgcattaaagtttaagaagtgcttctctaagccatttattctcaaacttagctgcacgttggatataactggagggtttattaaaatgctggtgcctgagtcccattccagacattcagaagtaattggtatagactgtgcctgagcatcacattgggatgtctaaaagctccttaggtgattctaatatacagccaaagttggggagcactactgtcactggctgtgcctcaagtttccccccatattttagtgcattgcaatgcctggtttgtagttggctgggaggatttggggaggcaaccctgggaatttacccagcacaccacaggcacccagaggcctctcttccttcctgccttcaccacatttccttctgtccttcctgacttcccatttgtctacttcctgaagagtttctttggcccaatatgtgagagtgttgggaaatggtgctgagaagggttctggaagtcttatgcatttttttttttccatccagaactgtcttgttggctttgtgtttttgcaatgttgtagcaagagcatcatttacttatgatggcttttatttcacccccagtttatactattttttttggtactaccagccagtgagcactgaaatgtgggggaaaatgagtttggaaatgcttccttcctggtgcgtgtgctgggatgcagacttgtatctgaaattttggatatgtgctatcggctggttgtggtgtagatcagagccccaaagggcacatcgagcatttcatttggccaccagattgtcttttacaacagaggaggtaaggtattttaaacaggatctgtgttaggctgggaagcccacacaagatgggaaagactcatttctcctaggtccttccccctaagtacaactagaaaccctggaaataaagcaaaaaaataaataatgctaatagtatctacttgccccaagggtaaatgctgccctaacttctgacatcatagtgttatcttgcctctttttgtgttttaggtaaatggaatcatttagtttgtgctaaatgattttttgtgtgtctggctttttccattcagtgttatgtttttgagattcacccatgttgttgtgtgtagctgcagattgttctagggaagaattttgaccaaacattgatcttggactcttggcagagttaagacttgagtaaaactgaatcttgtggcagtttttactttttctcttagtatagaagcataaaacctattaaatgaacagaattttaaaaataaagatcattgttctttaacaaacaattgctgtctttgcattttctctttcctccaaaatcgctgaggtctcgacttactcactgctaaaaaaaaaaaaggggggggggactctgtatatttttaaatgaagagtgctgtttttacctaaatcaatctggcctggtatatgacaacatttaaaaaaaaaaaaaaaacaacaactcaaagatagagcctaaaaacttgccgaccaagcaagtaattacgctgaacccccttgggcccccttggatactctctaattagatgtcctgggtcctcccaattcttagtcttttaatatctgtttttcctcttctcatatttggaccttatgtcttccgtttagtttctcaattcatccaaaaccgtatccaggccatcatcaatgattctatatgacaaatgctccttctaacaaccccacgatatcaccccttaccacaaaatcttccttcagcttaatctctcccactctaggttcccacgccgccccaatcctgctcaaagcagccctgagaaacatcgcccattatctctccataccaccccccaaaatttttgctgccccaacacttcaacactattttgttttatttttcttattaatataagaagacaggaatgtcaggcctctgagcccaagctcagccatcatatcccctgtgacccgcacgtatacatccagatggcctgaagtaactgaagaatcacaacagaagtgaaaatggtttgttcctgccttaactgatgacattaccttgtgaaattccttctcctggctcatcctggctcaaaagctcccctactgagcaccttgtgacccccgcccctgcccgccagtgaacaaccccctttgactaattttcctttacctatccaaatcctataaaatggccccacccctatctcctttcgctaactctcttttcagactcagcccacctgcacccaggtgaaataaacagcctttttgcccaaaaaaaaaaaaaaatcaataaaataaaactaataacaataatctccaactctgtcacccagagaaaatcactgttaatattttggtgtatatccttcgggttttgttctgtacatgttttaataaaagtggcttatagtctacatattgctttgtaaattgatttttttcacttattagagcaagaatatatttctgtgtcaccaaatattcttttacaacatcccctttaattattgcagagtttcttttttggataacaaaattaggcttaatatatcttaaacttcttttttttgcatgaactttatgagttgcttcagctttcactgtcataaaaatgcaatcagtaagtaacattgccaactctttaattttggcctaaatggcgcatttgactgcacctggcttgtgggtgccaattggtgtttgctgggtggtgagaagctgggtaagatagttgtcaagataggtctccatgtgtttctgaaatgaaggccaatattaattgtctactgtcttgatttctgcttattttcagaaagccaggagctaaggggtgatgtttcactgacttacctttagggtagggattatgaattttctctttcccatctgccccaaaatcaaattgtgtctgctaggcattaggatcacaagattctaactctgaaagcacttctttttaattttacgaaataattcaattctgttaactagcacctgtgagcgttggttgattttttttttcccccctctttttaccacaagaaattaagtgggaattagatatctaattattatgcagttttctaactgagggcgaaagggacaggtggacattgtagtttttattagtgatgctattggagtgtttataaaacacagaactgttttggaaaacttcaaagtattttaagccaataagctcactaatgatgaggaaaaggaaataaaatttcattgtttttatatacatgcaatggccaaagtccaagtaattttggctaatatcaacatttgctggctagcactttgaaaacaaatagacacagtattagcaagattttgagtcaacaataaaaatttggactttggccacacacacacacacacgcacacacacacgcacacacacacacacacacacacacacacacacagaggattttctggttctttcttctttaattgtaaaacaagaagaaataactagatctgaaattcttttgagatctaaagaagtataactatttttgcttagaaagacctttccttatttcatacgatatgttactggccatcctgggatttcagagtcttttagctccatcgctgttccattcccaagtcccctccttgttgaactgatctgtaagattgggttttgagttgcttccttctgacccttttatgtatagcagtatattttcatcccatggtaacctcctgggtgaaatgttggagacagatatattacaggatatttgtaattatactagaagatgttttagtgggaaagttccttacttatgatcacagcatctctgaaaactttcactgctgtctagaaaaaaaatctttagagttgtcaaatatattccctttagagccaaggacatcttgatactacctaatgccacttccctatttctctctagcttggagatctgggacatttcatagatgtcatggaattctaaaagtcaacagaatttgtaagatgatactctgggatgatttgattttgtacctagtatttgctctaatgagaattcgagtaatccaactgcctttctcctttcatgaatgcccactgtggctgggggcccatgaatcaggtctcccatcaggaattatggccatttggtgacttccagctcacatagtgccatctcagaatgagtgaacccggtgtgcactcagggagggagacatttgagttctccagacctacttaaggcaaatatgttccttatgaatgaggttcctctccttgttttacacttcctttactttgatctcttgcctctggtttttaatgagcaggagctttgtaggaaggtgaggagaatttttgtcatctatagcctgagcagaggggagttgaaggtgaatatgtgtgggcatatacacacacatgtatgtaagtatatgtgcatatatatgtgtgcatctgtgagcatgtggttgtatgtgcacactgcacgtttgctggtctaggcattaagggtattgtctagatgataataataataatatctaatctttatgaagtaccatgtttcaggcagtgctctaagcatttaatgcctacaatatctatggcagcaggtactgtcgttgtctccatttttcagatgaggaaactgaggcacagaggtatgaagaaatttacctgaggtcacacagctagaaaatgagaaagctaggcttcagacccaggttggctgtttccagctcctaacttgcccactcaactgaaagggaagtccctatgggacgcaagacctcccccatcttgctccagataaagctgaatcttgttataattcagctcattgccccatggcagtgggtctgatgtcctacagagcagaactagaagtggattttggatacctgagaacctagagctgtagtgttcgtgcattagggtcagaagacctgagtgtagcatgttgatgtgtttggggacctgtcatcctatctaaggctgcatttctgataggaaagagaaaggtggcatatcagttacgtgaagttcaaaaccaagcaaagtcctcctctgagatacaggtcagaagagtgattatcttgggagaggcctgaagaagtttgctggagcactgggaatattccatatttggacctgaatgaccttaacatggctgtgtacttaagttttatgcactttactgtatgtaagtgatatctcaattaaaaagtacataaaaatggaggcatttaaattgacttgtgccactattgtagaagcagtgtgagggatgccaggggagaggaatagatatatttgatgcagatttaaaggaaaaatcagtcaggtgtttagagatgtagatagctcttaatctgtaagaaccagaagtgatttccaggaagacataattgcttatatccggaagacaataattttattgctcttaatttcatctttattttttttatttgtattttggcttctaatccccctgagcatttgtgtgtttgccctgccttcatttgattctggctctgccttttaaaacagttgctgctgccacctctcccaagttctgaaagatttacaaatgtttgaacagagaaacaaagacagaaaatgggagacatgctctggtttgctgcaaatggcttttcctgccaagctgcggggaatggtatttgggccagctttgccttcctaattggaaccatagctccttggattgccttcagattgaaaacttgagggtctgccactctgcaaggaccatttcatgctgggacactacgtaccaggattctcactttcattggcctttaagagagaacagcagagttccctaatcagtttggctaacacttgaaaggggagtagcaaacttctaattttttgtaggttttatacttctctgctactctcttcatgcccctctcccccagagctgtaataataataccagctaacgtttattgatagcttactctgtgcctgatgtcactctaagcattttgcatgtgttaattcatttaatcctcaccaactctggaagctggtattgctgttgctcaatatagatgaagaaattaggcacagagagatgaagtcagtggtccaagatcacacagctggttaagtgacagagccagcatttgaacacagtctcgttccagagtctgagctcttattcactgtctaaataaaattgattccctgggccgggcgtggtggctcacgcctgtaataatagcactttgggaggccgaggcaggtggatcacctgaggtcaggagttcgagacgagcctggccaacatggcaaaaccctgtctctactaaaaatacaaaaataagctgggcatggtggcgcatgcttgtaatctcaggtacttgggaggctgaggcaggagaatcgcttgaacctgggaggcagaggttgcagtgagccaggatcatgccactgcactccagcctgggcaacaagagagaaactccgtctaaaaaacaaaacaagaaaaaaaacttgatttcctggtgaggtgatctccacagctgtctttatacaagctagacccgccccattcagccgctagcaaaagatggctattaagtacttgaaatggggctagttgggagtgagatgtgatgtgctgtatgtgtaaaatacgcatttggtttcaaatagtacaacaaaaagaatgtacaatatttcttaataagtttttatattgattacatgttgaaaaatattttggatatattaggttaaatgtaataaattattaattttacctgtttctttttagttttcttaatgtggctactagaaaagctaacattacatgtgcgactcatattgtatttctgtttgtttctagtgctgagctagaccttccttccaatctgctccaaatacagtaaaattttgttctagcatagtcatgggtaaaatggacttgggagtaacataccacatattaaattcctattttccaccaccatcaccttgctgaccatttacaatttgacagttttttatatatgagggaaaaaatccaaacctttaatgaatgcgtgtcatgcaccaattatagtaccacgtcctttcacataattaattgcatttaatctttgtgacttttctattaggtccgtatcatcagctccattttacaaacagggaaattgaggtttagtttagcaacttgtctagatttctattactaataagggggaagagcaaggtttagatataggtcagctgactccagttctaatagcaattctccccccaaatggtctatctcttatagtatgtatctcattctgcattgtgtttgagatagttctgcatgctttaccctcttatatttgttaaatccttatgaaaaggtagtgtaacctataggagatcacagtcaatattcagtgaaccgaattgctttaacatatgttgtatgaaagacctaattctaatattctcctatggagtttggtatttgccccattattttcctcttaattgctgtggctagattactaaacccgcatccttaaattgctattttatgtctctatggcttcctgagtctttggagccctgttgatttatgtaattctttgatttaataaatatttattaagtatatactatgggacatttactgtgccaagccatgggaatccataggagaccaacaattcctgaagggtccttgccctcaaggaacttacggttaattgggaggtagatacatgtaaataggcaattgtgatgaacatggttcctgccttgatagcagtaggtgaaagggtttcgggggcacattgttgaagcacctcacccaatctagaggatatatgaaggcttctcaaaagaggggaaggaaatgcaaagtttcgtttccagtttagtgaaaataaaaatatgatttttttctctaacgccctgaattttattcatgaaattttgctatgtagataggaagtggaggctttacagagacaggaactaaaggataatctaaatctggggcctccccggtgaccctgcagtggggcctatggtctccagtgcagtactccaccattccctgggctcagtatctttctgtgttttttttttttgtttttgtttttgtttttgtttttccctgtaattaccctgagtcaaattctgggctttcctctgtactttctttcagctttgacttccaactgtaattgcatttttgcagtgtgtctcagttcacattctccaggagagcatgagagagagaggctgtctgatctagatcattttaaaaattattattttcaagccacatcattggctgcttaccaggcaatagttaggttgcccttgaatctggtgctcacccttggtccaatcaactatagcatgagaagggtcaggaacagttggcagaaaagaaaaaagctgccaaagtcactcttctatgtgcatgtcttttctgagctgtggtaggttgggcagtttatccagggatgtggcatggcaggccactgacctggaaagttcttttaatacctagagaaacaatataatggatgacaagtgagcaagttggaaaaatccacaagcctgtctctttaattgtaccaggggcggtccctggatcccttgctttgagattatttagctgtagttaaaccaggcttgtagtgccatgtcccagaacataatcttttcttcattgtcaggggctcagaatgttatttcaatatttagaaatttccctccccccaccaccaaaaattggctgttgacatacagtctcattgatataggtagctcactgagttccttttgagcagtctatccatgtggcttgtctctaggaccaggggacaaaggttgatcctaacctgaaatccacaccccccacccaaaggacctgtgcatagaaggcatggggttcaggaaaaaatgacatctttagtttcactaattttgaactggaatttagcatttccttccattacaaataaagacaaaaatcacagtagtgttagctgtacctgtaacttggtcactagcagaaatcatagacatttctgtatcatgttgtggttcctatagagatctcattattacctcaaaattatgatggtataagactcactactagatcttgttattcaatgcattgataaacaagcgcacattttactgtatgacaaatttgctgtttagtatttggataactttattttgatacaattgatttgctttataatcccatgtagtttaccttatacatttaaaataactgttctgacaaggggtccattggcttcaccagctttccaaaggggccaacacacagcaaaggtttggaacccctgctcaaggatgtaatcctttgatgaacaaactcatcatggaggtcactgctcactctaggagttcctactgatatgtatcagtctgagagagggaaatcctgaagctgaaatcttacagtgatcctggggaggatgattcaggtgatttgtagtcaagagacaaagctatgcaagtagaacagtaacttaaagaagatggcagcagggggcctttaattaaagccatcctgatgcacccacacccatggtatgtctatgtctatgagtgtgctccacagagtgcatatcttcttgtctgattgttaatcagccccacatgtttgtattgttattgaatgatatgagtccttaagttgatgcttccctttcctggattagaaggaagtagagcaggcaaattttgtataggagcccaactctgagtctttggagccctgttgatttataggctatttgatagcattgaagctcattggttaaccagtcctttcccactagaaagccaagtaaaggaagatgctgggtagatgggatgaaggaataaactcagggcagaagagaccacagaaaacatgggctacagcaagtcaagaactcctcatggacaccatctggtcagtggtcctagtcactggcaatcccaggtggacattcacataggctacttctgaggttctcccggtacctgactcagagctactgactccctttctattctagtcacaagcaatccattcgctcattctgctagtggagatttacaagctcagttcagcagctgaatgttggctagaaggccacttggtgaaaagaactcaagtttggaataaggaaaccgaagttctaacttttactgttctagtgacagctctgtgatcttgcgggagtcatattgtctctgtccacttcagtttattcatctgttaaatgagttcagtattaagttgccttctagaattcctgtgagcatcaaagggtatgaaaacacttgaagaagaacaaaattttatgagtgcacaagggaatatcgtaaggcatctacggactccatcataagagcttcatgtcaatttcttcttgctgtctttccatttggtgttcattgaagagaagggcctgagggactgagtttgtttctgtgcctagaataccgctaatggtcatctgtcaaattgcaataagagagtttaattttatgttcaatcagagcagggttcctgttggtttctacctcttagaggttgagctccaagcttaagcatgaggaatatgtgcagatttccttctttacatgggtttaatatggctatcccagagggtgccagaggggagagagggttataggtaatagtgaaaagtaaagtggaattgccctttaatttcccctctactacttttgtcaggggctggcatccccagcaactgtgagctggaatcccagggctttggaaggatcaaatgtagtttctcatacaaaaaaatactagaaatgttggtgttggaagaagagtttcacaagactaatagctacccctggttacctcccaatagctaagacagctcctcttcctccttctcctcctcctcatcatcatggtcattaacatcaccaccaccatttactatcaccaacatcatcaccattatcatgataacatattccatagctcattcctatgccagagaactgtgccaggtgttatgtacatagtctcatttagctccaacaaccatactcaattgaacataggcaactgaggcttagagaagccaagtggcttgactaaggacacagctggtcaagtggtagaactggaaattgagcaggtctgcttgaacccaaagcgcatgccctcaactagcatactacatatagtctctttggcacttgataaacctgtgacgaacacacgagcaaatggataaaagaataaataccagaggatggaaaaaaaggactagggttcacggtagtggatttactggagtgtcatttgttctatcattgtctcctcactttccatcccaaatattattaaaccctgttgtcctgttcttgtaaatctcaactcagagttgagctgcttttgcttgatgtggcagttgaacccctccctaaatgccaccatgttgctactacagggctcttgaaccatggactgcaaggtggtgtgtaatttgtagctaaggcaggcaaaatggagttcttcacaaaatttcctggagatatttgcaggcaagcagccccttcctgagaggaaggaatttagaatttacaaaggggctgtgaggtgcattttattacctgtcacctcagcctgccagataccagaagagacgctgtgtctttttgaagcagccaagctcatttgtagaaaaacgaatataatatgtttttttgcccatgaagaactcatgtatggagatctatgcatacagacataaatgtgtatacctctacacatcttggtttgtataaaatctaggcttctggcccctgggagatcttatgccaaattataaaatgaagtccatttgttcatctagaagagtctgggttattggtttataaaaatttgcccattgtgaggcctccgagccagtttaggtaaacagagatggcaaataattatctgcagatctgagatttcaaacaggacaagggagagaggaaagagagttgagctgctattttttaatccaaccttcctcaagttccatgttggggatcaataaactataaaaacaagaagaaaaagctgcagagaagagaaccagttgcagctggcagaagaaacctgctattgaaactggtaatgccattttaattaggctaaaacatgaatgagcgccgcgttaagaccttctccttggtgccctgggtcgctgggagagagaatgcactccctttgtgtgctttgccaaagcccaccagctgctaccttgcaggagagttacatctgagtcactggtttccaaaagggcgacaagtaggctatgtgtggctgaatgagaggggcctgtcttttcttgatcctgccagcttgggcctggactcaagccatcacagcaatggctctgatttgtaaatgggttggatgtttcaagaagctgctacaagagcggattgggagaggatgggaaaaccaaatagggtgaagaaagaaagctgtaggactcggctgggatttttgaggcccagaaggctgttttgtttatctcaaactccataagctgagatgtatcttgcccttgagggggtcagcttttaatgataatgatgatgaagatagtgttgataataataatgcaaacaaaaattaacagtgaacatttaacaacccctttctgtgtatcaagtgctgttttaagtttattatgtcaatgagctcagtcttgattctagccttgtgatggcagttatcctattatttccattttagagatgaggaaacagaagaacagagaggtcgtcttagtccatttgtgtttctataaaggataacctgagggtgggtaatttataaagagaagaggtttatttgactcacagtcctgtaggctgtgcaggaagcatagcaccagcatttgcttctggtgagcacctcggtaagcttctactcgtagtggaaggtgaagggagtcacctggcatcacatatcaagagaggaagaaagagagggggtggagggaggggccaggctctttttagccatcagttcctatgggaactaatagagtaagaactcactcctgggcaccaaagcatgcatgagggatccactctcacaacccaaacatctcccaccgggccccacctccaacattggagattaaatttcaacatgagctttggaggaaacaaatatccaaaccatagcagaggttaagtaacttaccccaaaatccatagccagcagaccaggatttagagctggagactgcgatattcaaggcagatctcagaaaaggacccagtgggcttaagatttaaagtatggagagcatcatatacagtgaagcctcagactctcagctttatgagggtagaaaccatgtatattatgttcattgtgggatccagcacagaatgtattccaggcctgacacagtccttgtgctctttcagtgcttgttgactcattgatttttgataaggcagagaaatgcacaaccaagacatgaaactttggtacataaatttaatgaacaaatgcctatatttatatttgttcttttatttaataaatattctattgagcctctactatgtgccaggtgttagaagtagaaaaatgaatacaatgtggtttttttgcccatgaagaactcatgtatggagatatatgcatacagcccaaccttttctctcaatttctctcacttgctgtctgggtctctcctaaggctcatcatgtgttacctggtgttaaagttttgtttttcatgtgtttgtgtgtgcatgcattctttttctttgtttgtttgtttgtttgtttcttgacagtgtcttgctctgtgtcccaggctggagtgcagtggcgagatctcggctcactgcagcctccgccccctggggttcaagtgattctcatgcctcagcctgctgagtagctgagaccacaggcgcacactaccacacctggctaatttttttatttttagtagagatgggatttcaccatgttggctaggctggtcttgaactcctgacctcaagtcatctacctgcctcggcctcccaaagtgctgggattacaggcgcgagagggagtctcactctgttgcccagtttggagagcagtggcttgatatcggctcactgcaacttctgcctcccgggttcaagcaattctcctgcctcagcttcccgagtagctgggattacaggtgcctgccaccatgcccagcttatttttatatttttattagagttggggtttcgccatgttagccaggctggtctcgaactcctgacctcaggtgatctgcctgccctggcctccaaaagtactgggattacaggcgtgagccaccgcacctggcctgtgcatgcattctttgggtccagtaattgattatagttacttcaggcaaactccacctattattcacctttgtaaccccaggagcagtgctactctaagtttggtccatggaccagaagcattagcatcacttgggagcttgttagaactgctgactctggactctacccccagacctactgcactagtagctctgggggtgggacccaggaatttgtgttttagcatttctccgggaggtccccatgcatgctccagtttgagaagcactgctaaggatagggaagccaggttctgtcatgtgtgattgctcaataaataatttttgcttgattgcatacataaattactgtatgaacagggaaagtgggttggtcttactaggtctgggcatgactccaagcatccattttgccaagtctgcggagactgtgaggaggtggagtcgtatttccttccctctcagaaaatttggatggatgtgtttaaatggctgggaagatagactccatcagcatcaatgtgggaaatggtgagcaactgagcatgaaacctgatgggaaccaagtgaatgggccagttcgtaatgaaggccagaagataaaacagggtggagtgatgatttcacagaagggctgagaactctgtgcagatggtttggggcaagatgctaaagccacaagtttacaagaattgtatgcttgggactcttttctgttccagggacttattacaaattaagccctccctattcctgcatatgtggcagagccttgctgtaaatctatttcaaactgttttttctttctcatcttattctccttttctctttctttaactcttccttccctctctatctcctttttcctttctgaccaagaggctattgttgtccgtgttttgatcagggctaaagctaccctgtggcataacatttgttaaggacaaggatgtgtgggtttttgtgagtaatcagcagctgcttttggagtcatggttttaaggaatctcccttcctcaatagtgtgatcattccctcctcccaacacccccttccaaaagagaaaacttgcataagagcagttggctcaatataataaaatatagcttggcatcatgagctttataaacaagaggcatttaatacactgcatagagttttggcagtgggagggacagtagcagccaaggagacacatatggctgggtttagcagcatcctgggctcataggaagaggatccccagctttagatccctgttggggggaggttgggtgaacaagaggttagaaagatgaagatggttcagcatccagggaacactgttatacccacattttcccaagtacaatgtttatttatttatttttcataaacaattacctagtgcctgttttaggtcaggcactgttctctaagcctttacatttttcagagcagctttattaagatataatttacatgccataaagctcacctattttattttatttatttatttatttttaatttataaacaaaagaggtttaattgaatcacagttccacactgctgaggagaccccaggaaacttaaaatcatggtggaaggtgaagggaaagcaaagcacatgttacattgctgcaggcaagagagtgtacacaggggaaaccgccacttttaaaatcatcagatctggtgaaagctcacctattttaaatgcaccattcaatgattttttttttttagtgaatttacagagaaatgctaccatcttcacaatctgattctgtcacctcttatgcccatttacagttaattccaaatcacacccccagccccagacaaccattaatttacttgctctccctattaatttgtcttttctggacagctgatgtaaattgaatcatataatatgtgatcttttgtgactggcttctttcactgagagtaatgtttctgtttgttccttttgattgccaaatggcattctgttatatagatagggtgctttacatttataacctcaattcattcttataagaaccccatgaggtagttgcttctgttatcagcaattacagatgaggaaactgaggcacagttaggaagttgaggggtaacgattcaagcccagggagtctgacctcagaatctgtgctcttgggctctcttgctatgttgcctctccataggtacaaaatatgtattcacttctaacttggagagtttctttgatataatgaccactgaatttattgaatacctactttgtgcgtggaactttgctaggtactgtgatggactgagacaggttttgtaccttcaaggaatgtagcattttatttggtagagaagactcagatccacgtgatcaagtggattctctagggccacacagaattccatgtgatccaaagcctaaatgcacacgccaggtatcgaaagtcaacaagacaatgatggtagtgagaagagccaaggaaagcttttcaggggaggtaacattgagctagttccatctccttggcctaatcaatcccaaattccatgaatggaagcttggaattatttagagcccaccatttgtcatcatgtcccttccaaacacaaagtccttttcttggtgtgttccaacttttagatcccatgtgtgtgactataattacaccaagaagcttttcctcttaagctgtttttaatagacatgtcttaaagaggggttgttctctttagaaaaactagttgcttcacaacatccagttcttgggctggccacagaagcctggcagacagggaatcagaagtaagaatggtacatggaactacatgttagactctacaaggcctgttacagttagcttgtgctgtgtaataaaccaccccaacacttaatggcataaaacaacaaccatttatttggcttacaattctgtgggtcatccgggcagtttttctgctctggactggttcagcaaaccttttgggctcacgtgcatctgtggccagtagggcttgtggctgagccacagatctggcttttggctggccattggtcagggtgacttaattctcttccatgtggtctcttatccttcagctgactagcttcggctcattcacaaggtagacagacacagggttcctaagagcaacaacagagtcccagttcctaagcctcttttcaagcctctgcttgcattatgtttgctaatggcccattgtccaaagcaagtcacatggtcagctcagattcaatgagtgaagaaatagattctacatcatgatgggagatctgcaatgttatattgcaaggatgttaatgcagaaaaaggatgaatttgtggccatttaaataattatccaccaagttagagagtataatagcgacaaggtcagccaacacatttattaaatgtttacagagtgtaggtactatttaagtactatatatatattcatttaagccatacaacagctctgagagctaggtgttattttttcccttatttttcagaggaatgacttgtagctctgagaagtgaagtaaagtgagaagttggctaaaaatcatacaactagtaagaggtggccccaggattcttttccaggcagtctggcttcagagtctgtgggctcttaaccactataacatcctgcccattatgagcttattgaaattgagttgatgtgccaccaaactatagggataatgattagtacgtagtaacattaattgaagacctaggatgtgcctggcactgttccaagtactttacatacgttatggtatttaaatatatgtaaagtacattgaaatgtactttatgaaagtacaaggcaatctgatccatcaaagactgcttttatccccatttcacagatgaggaaaccaaagctccaagaagtaagttatatgttgaagaggttgcacagttagtatatgggcaatttaagattcaaatccaggtctgaagggtcaactgtcttatctaattcacggcatcgtttcacttatttacactttatttcacagtctcaatttacagacatgggggagggggatctgaaaactctccagaacacagatgataataataagaaagaagaataaggggcatagagcagagcatctagagtcattgtcacaaagcccatgtatttgctggggaagttttttggttgatattgatatttcttgtccattgtgtatgttggagctgactgtgcactgccctcactccaaggggtaccagtagcatgagctgtgatgcaaatagcacactgggttgtgcaatgtggcacccatgcaatgctcccatgctcactcatctgggtctccaccttgcataaattagcaaagcaattaaaatggacttaagtaaaaaatctgacaacagcttataagctcattaccataggacaatgaaggaaatttccgaagaactagtttaccaaaaagcacaacaactcaaagtaagagagtttgggcagttgatgtagagacaaatagcccataaaaagcaccatagctcctggggatttgctgggggggagggcaggtcattgtcttgctacttggtataatggtggggtttttttttttcccccggaggaagaaagtttagattaggtttatatgctttggtgttcagaggaaggaattaaataatgtaatttggaaaggttgtcatagatgatcatgatgatgatattagtatttcttgggtaaagcatatcataccctgaaaggccagataaataggatattattgaaactgatattccagggttgctgtggcctcttgtgatccctgacttttcagatttttgcctcttgattttgttggggccaagggaaaggttcccttttgccatctggaggttcactgaaaatcactggcgagaggcagattgattaaactgttaaaaaggcatgtaaatgtacttaatatgtatacatgggagccttcaggatgaagacctaaagatccaggggaaattgtccatttttatgcttaggcttaacaaagtatggagagctttggagaaacagggataaaaagggcctgatcgaatgctgatagactgagtggggaaacccagcaaggcctgtctgtctagatccttcttggcctctctgagcagcattcctttctcctgggtgtggggcagaaccctctggaatgggggtcttataacctgcagtcaaacaaagtaggtccaagaatttctttgtagccaatttttacacagaaaagcagagtgaaaattagagttgtatttttaggtttatggctggctttggggaaaaggtgttttggtttctatgacctgccttgggggagaggaattctagtttccatgggtagccttggagagaatgggactgagagatagaggcaggagaaggtcagagaaaaacttttgcttctgaggctgctgctgaggccttcattttggggtattgttttttgagtcccaccagtttcctgtagggttgatgtaattccaaagacagaaaagtgaggactctcagagatcaaggagatggcccagtgaccctttaagacttgtgaaagagcatgactcaagcagctttcagactcaagagctggctggttcctcactgggagggtttgcacctagccttgagggtggttgtgaagagtcagtgcataacaatgagaagccacagcaaacaagtctgtcctggattgaccagtgtcctgaaatgagtccccacctccacatcccacctcctataattaagtgatggaaaggactcccatttctaaaatgctctgaagatcagataacagagggaaaatgaagataaggggagaggtgattcttctgaatctctagggttggtgccagcagccagctgcaagaatcaacttgggagatcccagcttagtgtttcaccagaaaatagcccaccattgtgctcagagaaagctttcatcctccctttgtcccaccattgtactcctttactttatgagaactttgagaaaaatcctagagccagatgcctcatgtccccatatatagccaggtctgcctttggtccaccagcagccatgtcatggtagcggtgcatctgtaaagggagaagaggaggctagagccagctgcatggaaataccagcctgccaaaccaaggcgggcatgatctctgatgctctagctggcaatacatggacactggtatatcggcaaagtgctttaaattcctgggaagaaagatgtagaacggaaggtgggaacttgcagccagcttatgagagccattaccatggccagcaagtcactgatgcacaaatgtatatttatgggggcagcaaggagatctatgtctccaggtaagtcccttagagtgactgcaattgtggattgtaggtgtctggggtgctgagtttgaccagagctcagaaacttttggatggttttgggaagagtgcaatgatactgtggggcaaataaatggatgcagttggctgcttgactcataaaagtcttggtaaatgccccaaagcaaaaatatggaaggaattaaagaagcactttggaggcctcgatttaaatttcttttctgtgtatcatatgtggtcaagacagccgcagagatattaaaggaaaggactctttatgcccttgttggtgcagggctcagataagggtgaggttgttctttgttaatatttataatggtatttgtggagatgaataaaaaatgaaattccctttggctaatttctcagattgctggaggagtagatgaagaggcaagaatagggttgcatgcatctcagaagaatctgctcttccaggacaaaaaaaaaaaaaaaaattactccttacataatggaagctagagtctaagagaatgttccctttctctgggaacacatcatttttgcttttcactgttttatacttttgtgtgtggcaatttctatttgccctgtctatgttaaagcatcatattcatcagtgtgtggttctactttatcatgtgtaatgtctaacatgccaaagctgttttacatccattgcctgaaagagcttaaatcttgctgtgtgctcacccagcgacaccctccttgcccctggggaagcagcattctgccagtctattctttcctctatggcctaccttcgttatataacggaatttgaatgtctagcatatggtgattagctgggacactgggtgtgtaagcatgccctgcaaaatgatgtgcatctgcatgcatgtgccttcctacaaatgcaaacagagcacagatcacagatgtggttattgtggaggtaattatacatttggtctgaaaccaaataaagttttgccctcctgccctgtcgggcatcatatttacctcattgaccaagagagagctgcagtggggcaggcaagagggtgaggctggagagaaggagatagagatgccatatggaagtggttggaaaacagatgggggaagtctggaaaaatccaatttgttgttctcaggtgtttaaaggaatgtctccatgttaggacattagaatggatttcagtgctcaagacaggttagaattagataatgcaaggccacttcccaggtagaattggtatataactaagctttgaataatgatgttgaattagtggctgatcaataaatggaaaggctaggtctatttaggcaggcttgagtggaagaagttggccagagttgggctagtcaagcacctcgtagtggaaagaagagtctgaaaataatcttattgtaatcttgtcaacaataaaatgggatggaggaacagaaagttctttgctggagggttgacaaatctggttgcatcactggggcagaagccactgccaggagatccgttatctaacgccagacccctagcatctcctttgttattatcacctcagaggggggttttgatgcagtccagaaacatagaccttcctgtcctgggcaatgcacatatccaacttttatgccattgtctgtacctttagaggtgatagaagcttgtttgatgtgtttgatcccgtgatgtgagaagctggacactctctttgcaggttcctttcatgggcttctgttgaagaaaatcagatttgaaaacagtcatgcataagctctggatgtccacgtgagcctgctgttaatgtacagaggccaatggacccacaaggagtaaaagatttctttttactggctcctgtactcagcatctagtctcagggcataagagcttagcaggccctggaagggcttcagattcctggtcctcagacatggtaagaagaagggaacagccctggatctcctgcttgactcctaatccagtggtatttctgctctaccattttttaaaattaccttttcttctacattaccttaatgttcctaattaatgaagatggtcttactgaagttgtcttttctttcttttaaattccaaaaaaagaaaaaaagacagaaatgtacttttacttactaaggggagttcatctagtttcccagaactgttgttctttcctttcagctacaaacacagcatctcatctcttggtttcatttaaaactaaacaaatgaacttaataagatttcatgattataggagttgggcatactgagttcctactaccttaggactctttcttgagaatggagggccatggagaggtgacattaaatttcatagtgattaaaattagatttttagttcatagcaatttagtttaccattccttcaaattataattttgccaattataattgaacatgtttttagaacctgaattttctcacttaaagtgattcccctaaatatcattttaaaaattaaattaattaccattgcactaattaattccttaattggctcttaacccaagaattagattgcctagattttaacagagaaagcaaaacagacaaaaacaacaaaaccacacaaggatttttttcttaaccagaatattctgaagggatcatttgatcagatctatggtatgtaggtgaaactgggataaaacattttttaaaagacattatataattgataagagccatatttttgacttgattaattggctattttgattaattaaaaatatgtaaaatatacttagaccctctccatgagaaagaacaaatttgtggatttgaacacatgattataaataatcatttttatttttgtctcttactgtcccccactgccaccccagggatttgggaatgggctgtctctgcttatattaagaacatgtaaaaaatagactcattgatctatcataacagagaaaggaaacaaagccatgggatttctagacatgacatgtaattcttatactcttctcaccttccataccctctgctggtttttcccatcatgctatttgccagtgttaaaaaaaaatgaggaatgagctcaccatgtcatctaaaataaaaaaagaaaagttccttgccatcgatcacagtttgtaaagtactttaaaatctttctcttggagcttgagatgtgagcctttggcagcttcagtcatatatgaggggcctgaaagaaggtgtctcgcagtgtggaagttgctgtttccattcactctcagctcatcatttaaagatattgggagagagctttttttttttttcttactgagaacaccaaaaccgatgatcaccacaggaagacttagttactatcacagctcagcctcaccaaaaattctttttcatttttttaaatgtttatttatttacttacttacttactgagacagggtcttgctctgtcacccaggctggagtgcagtgacatgatcatggctcactgcagcctcgaccttctgggctcaaagtctcctcccacctcagcctcccaaatagctgggactacaggcacatgtcaccatgcccagctaatttaaaaaaattttttgtagagacagggtcccggtatgttgcccaagctggcctcaaacttctggactcaagcaatcctcttgctttggcctcccaaagtgctgggattacaggtgtgaaccacctcgcctggccttaatacattttttaaattgaagcataacatacacatagaaaactgtaccaaaattaacagtatagcttggtgagttttaccaacgaatattataagcaccccagaagcccttcctgtctctgtccacctgccctgcccccaggatagccactcttatgacttctaaccccatagattaattttcttgttttgaactttatataaatggaatcatacagtatgtgcccttttatacctggtctcttttgttccacattatgtttgtgagagtcaaccatgtcatggtgtatagtagtggttcattcatccatattccattccatggtgtgaatagaccacaatgtattgatccagtctgctctctatgggcatttggatattttccagtttggggctattactagcagtgcttctgtgaacattcttgggtgtgacttttggaaaacatgcgtttgtatttctgttgggtatatatccaagggaggaaattctggatcattcaagagggactattcataaatctcgttttgcttttttcctccatcttctctaagagagggtagttataggatttcaggactggaggaggccccacagaacatgtatctggctggtgtttttctgattctgcctcaatatcctctaaggagttcaggcatcttcagtgaggggagaggcgagcttgtgtggggctctggggctctgcttcaaccagagcaatgcccccttcatctgattcatagacagtggtgaaattacaaagaacatattgtttcaagaatgagttctataagtttgtttgagtctcactgtgtcacccaggctgcagtgcagtagtgccatggcgtgatctcgactctctgcagcctccgcctcttgggttcaagtgattctcgtgcctcagcctgccaagtagctgggattacaggcatgcaccaccacgcctggccaatttttgtatttttagtagagagacagggttttgccatgttggctaggctggtctcaaactccttacctcaggtgattggcccgccttggcttcccaaagtgctgggattataggccaccatgcccagccatttttgcttgtttgtttgttttttgttttttgtttttaagagtttgaaaagagatgatttgggtttattgttttcacttgagaaaggggcaagcaggcctacacagcagactggggtggattgatgtacgtggggggtgctggcattttatgggtgctcttttactcaaccctgcaaatcaactctatgagagaggcgtgttcttatccctatttacagctggggaaactgagggggtgaagcagctaagtgacattcctaaggccacccatctaaacgaggcagagctgaatccaggtggtatgactccagggcttccccctgctcccttaattatccaaaccagagtactctactcccacgcactgcccgtttcacaatctccctcacagactgtcaagggcctacatgagccattatggtgacagtggtttactctttgggtttttgtttctctggtatgtaaagctattgcccaagaagccaaggcataatatagagacaggcccacatgaaactgactcccccacttaagttcatttcaaagcagaatgtaatccttcgtgcttaccctttcacatgcccgatgttatacgattgttgctggaaccctgcgagataagcatggtaagtactactggcccttattttgccaatctctctgcccaggtctctttacctgctcgctgcactccagctaccactggcttcctaaatatgccacaggtcctttgcacttattgtttcctctggctggaattctcttttctcaaatattctcatggcttgctttctcggttccttcaaggctctgctcaaaatcatctaataaagtagaccttttcttacctccctatctaaaatgacatctccatcatgttccactgcctgatctactttacttttcttcaaggcaagtctgcttcctgacttgtgatatatttactttgtttcgtagcaattgacagacaaggtaggcttcaggtgggatggcagtgggggggtgttgatcattgtgtatctctggcacatcaataaatatttaatgaatgagtgaatgaaagaaactggtgttaaaatttagatactttatacccaaggagggtagctggaacttatgtttaatgggataagcttgtaggtgctgtatctccttacatttctaatatttgttttgctttctctcttttttcttgattattcttgccaaaggtttatcttttcattgaacgtttcaaagaaccagcttttggtttggttgagccttttattccatgcctttcttcttgttcagctctatatttatttactttggtttgtatatgtctgttatatctctgcacattaaagattgtttgagtgcagagaccatagccaaccacagctatgatgaggcttgctgactaggttagacctttgagccaccatgtctgggggtctgtggtttaaatctctcctttgccaagctttcccatttttgcatgagccaccggggtggaaaagagcaacatttagatttttaaaaaataacaaattatccaattatcatttcagctaagctattttaaaacatttcaattggtatggactggtttctaacctatgaatatgattgctgttatagtatcatttgttaattcctttataacaaatgtcttctatagcttgcagtattacttatattattttactgctgtaattgaaaccatagggagatgaaggttatgctagaatgaaaaagttcaaaccacattttgggactcttttttccagatctaagtgaaatccgtgttagaataacaagacagaaaatctgtctctataattagggaattactggagtcagaatcaaaccgtaggaaggtgcatagctaaggaatgcttctaagacagtagaaaataaagccttatgtgaacaaggagaatctctgtgcatggaccttcagggatggggatatgtgcttgcagggccagggagggaattgatgggagctccatatctagttaaagcacttaacctctggggtgaaatcttagtccagagaacactgaatggtttcacagcaaaatgtcatctgatgaaccctgctgtataaagtagcagagaagtggtcgtaaatttgttcggggattcttgtgtctcattctgactttggtttgcaatatgataggtttgattttcctaggaagtctcctgatgccatgcccacttgtgttaagatcaaggcacttagttgtatgtgaaatgtgatcagggaatgcaccaaggattcggcatcttgggggcattatctctgatcctaaggtagatcagagaaagtcaaagggaaggagaaatgatgagggagggcaagataggtagatagatactgaaagagagagagagagagacagagagagacagagacagagagagacagagacaagagacatagctgggctgtttaggattatgaaaaagcatatctgtagtgccctgttaaagatgaaaattttaccccaaccccattcttcaggctcccaccattagatccacagtgagagaatgtgagagagacagagagatctgattcccaatattccttttggcttgaagcttctttgattctaaatgcagggaaggacattctctgcaaggcagagcaactttcaacgtaccttgagagttcaaaggtcagtgtttatctctaagtgctgttcaactgtgagcacaggaaatgttccctgcaaatcctgtgtccaggggaatttgggtccagcatccagaccaccatagactcaggttagggtgctttttagagttggatgggaatcagtctggattttttggacccaaaggacactgacctggtggagtgatgtagccaccatgtgcagaacagttttcatgggtgagtctctcaatgtgtgatatcaaaggcgtgtttcttttagcaaagggaattcaagttccaaacagcaactgtaacagaaggaaaaggttgtattctactttttcaaaggtgtcaaaggaatagagaccatggattaagtacaaatttgggtaaggaagattcaaattttccaatgatttgcagacagtgaaaagtttgaacataaacacacatgatttatttaccacagaatatcaagactgtcgagccaagtcaggaagcaagcgtgtgccaataaaatcttgacagataccagaagaaaaatgagaacccaacttagtaagtggtgggaaagaataagtggtggtagatggaattctttttaaagagcccatatagaaatgagtgagtgtagtgttcttgaacagtggcccatttatactggaagctatttctttgacatatatgaaccagccagatcactgagagggaggatgcttcttcccacaagaagagtaatctgattgtttttcctcaaataaataaccaatttattatccacccagatatgcaattgttaaagacactaaggttgtgctgttcaatatggcagcctctagctgcagagctgtaagcacttgaaatgtagttagtgcgattgaggagctgaatcttgaatttcatttaattttaatgagtttaaattttaaaatgggtgtttgattcagttattggaaaagtttttgttctttgcaacaattctggtatgtgaatctactttttcaaccatttcatgaaatctaaatatagatcaagtaattctgatgaaaatttaccatccaaattgagctgtgctttaactgtaaaaacacatgggatttcaaagacttaatataaaagaagagaatgtaaaatatctcgttagtaatttttttacattgatcacatgttgaaatgataatattttagacataatggattaaataaaacacattattaaacttaatttcacctcctttaaaaatttttttatgtggttattacatatgtggcctgcattcttgcattatatttcacatgaacaatgctttatatttatttatttatttatttatttttaacttttattttaggttcgggggtacacgtgaaggtttgttatataggtagacttgtgtcataggggtttgcggtacagattatttcatcacccaggtattaagactactacccaatagttattgtttctgctcctctccctcctcccaccttccaccctcaagtaggcctcagtgcctgttgttcccttctttgtatgaacaaggttttacgtgccacatttggtggataaggctagctttgccactgaagattgaaatgaactgggaaatgagaaaaatggtgaatcctttactcttgtatgaactgaaagttttccctgctcttcccttctgttcctgagcctaaccactagtgatttatttaatataagtctttatatcctgagagagctaggtattaatgaactttgtcatgtgctatttaagtcttaagctcaatgaagaatttagtttgtaagtgattttaggacaacgtgcttccttcttacacatccgtcttaggttgggtgcctaggacagactctgagatggagacccgtgcacaggaaagctactggggagtgccagtggaatcaacacctgcaaggagtgagggaagcagggctgggcatagggaagagctgaaccaccatgcagtacaacaaagacctcagctgtggaagcaagctggtcctttggagttgtcccaaattgaggcaagggggcctggcctttgtattttccaaatgaccagtctttggatgcaagtttcctctaggtagggggcaggagcttgggtgaggcagctcctttctgcagaaggcaattcccagagcaggaaaaagctgtgagccctcagaagccaataatcccagcagttgggagatggggtacctcaatccagaatgagaggtcttggaggcaccccacagcatccactatgacatctcaatcttgttctaatcataagcccccagccagacccagacaggcaaagcctttcaaatggcatcatcctagacctggggaactgaaaaaactccctgtgcctgagaatgaggagtagggtatgtgtcttcttgcattcctctccttcctgccctggaatgagccataatttctacaacacagaagtaataagggattgggggaagggagggaaaaatagagacagagaatagaaggatgaatcaatatgactcaaccacttataaatcccccagtggcatagataggcaaagagccattttactttcctctaacttctgaattgggctgtagccacaacccagcagctattcggaagtgtggagaaggatgagaaggaagcctggtcccagagcagacacgctgcccagatcaatttagaaagaagtcaagactgtcagcttgggctagtatttcactgacttctagccacacggagaacgaatgtcgctcagataataagccaagaaagagagcaggcctcggcctccagttctttcagataatgacctgcggttgctgcagaggaaataagagcttggtagccattcaggccctgagagcttgaccccaattcttctctgtgtgtctgtctggccatccatctggttgttctgtttcccgttttctagtttgtcctttaggacaaatttgcatcttagtatggcttcttcccaagcatctcccctgcctgtttgcaaacactgattcatcaaagatgcccaacagcctgtgatcattgggcagggacattttcccataagcctttcctgcttctcctgccagttatctttaatttaatagctgtgcatgtcacatatgtacatactcacagagggatgcacacattctttaactcacacacacctctaaaagcacattagtgcaaactgggttaaagctgcttccagctacctcacttcccttcctgcccctcgcctcgtccttttcctatctccagccaccttgctctttgcctctcatttcacgctgcctctgagagagaaatctcattatttctgatttaggggctcctgtgccctcccctgctacatgtcatgcccgctgccagcttgttgcaacatcacaagagaattcagagctctgatttatccgccagaggaatgcctctagggaggatgggggtgggtgagactggagaccaagaaagggtgtaaaagtggggagggattggcagagaaagcctgagtttttagagccttggtagcttcaggatgcttggattagctgggttagaccacactgtgaatatagcacattttatcagaagcctaaagaagaagcagtgcagcttttgtttatttgattttggagatgggctgaggacatgtaattggggcttgggcagagctattgagggatgctgtaatgggctttttaatccctccctccccttttcctcctggaaagtagtaaatggtgaggacagtcatgtaacttataatttaacattcttcataaatccatctttgccccattcattagcctaagagcaggaattagatgtcttgtgttgagcttaacacgtgggcacatagtgggattcagaaaatgtttgctccatatgtaatgcaggaattagccaggtctccctactgtcttggatttggttcccccagacacagatcctggcataatgattcaagtgaaggtaatttattttgtgtgtgggtgtgtgtgtgggggtaacactacctgtaggtagtgagaatatgatacagggaaggagggcaacaagtaaaggacattatcaagctgaatcctacagaaggattatcccacccaaggggcaagggagctggagtatttatacaccaacctcccaataatcattgcttggaggctgctcctggaggcattcattagttcttggcatttctagcccacctcgtgcatgggcagagtgaccttctacagtcctggttcaggaaaattagcccgtaggctcagagatgcaggcactagcagttggaaatctcctggtgcttacctgaaaggtctgagggatatgtgcaggggcactgacagtgtctgctatggtagccaagtttcatgcatccatttatccactcaacaaatatttattcaaccactcctatgttcctggcactgttgtaagtgttgaggatacaacaataaacaaaacacatacagatctctgttttcagagaacttgcagtctagtggaggtgaccaacataagataaatatgttatactctccttaggtggtgacactgtaatgaaaagaaaaataaaggtggggaataaggattgctgagggtgccatattaaatcaagcaatcaaggaaagcctcacggagaagtggatatgtgagtgaaaacctggaaggaacgagtcatgtggatatctgaagaagagagttccaagcaaaggaaatagtaagtgcaaaggccctgaggctggggtgtgtgcctgtcatatttgaggaatagcaaggagcccggtgtggtcagagctgcatgggtaaggcatgagctgtgggagaagagctcggagaaatcccaaggtgagggcaacagtgcaagacatgcaggatcttttgggtgattgcaaggcctttgccttttactctgaatgagatggggagtcactggggggcttttagcaaagaagggacacattgtggcttatgttactgtgttgggaacatactgaggcagggcaggggtggatggaagcagggagatcttgtgcaaagcacatcttctaggaccgtctattttactccataataaatgaattaaagatgagagtgggaacaggtctcttgagccctacatgtggaactggcatgatacaatttttgcttcattttgttggctaaaacaaattataaagtgagactaatttcaagggatggagaaatagactcacctagtgataggaggggttgtaaagtcccttcgcaaaggggtgtggatagaggaaggcaaattattgtggtcattttttgcaaacaatctaccatggcaaatgacctcaaattgaactttgaatatccctgttcttaaaatatcctggggctacctcacctcatgttatggagtaaaatggaaggtccaagaagatatgccacgttcactttagatcctgcccaccacagatgtcagtgggtattcatgtgccaggcagaggtgaggaactaattgtgaacctacttccacttaactgctttgctccttttaaccttaataccatgtcctttggccagcttcttctttcccttctcatccttgcttcttccagttctccttgagaacaaacacccactcccttgtgtcatgaagaagactttgccagatctttagtaatcttgttcctgaacactttgcaccaagtttcaaagttcacatcaagtagtgaccaagggattttcccaaccaaaatcagacctccatctctaacgtgctcaagatgaattctgtgccagttgttaatataatccattttcgatgtgctttataaatgaatgggcttgaccttgaaactgacaccaagattctgtgggttgggtggagaatggtattatagatgtggtgttgatagagttctcgttctatgctcttttactagtgtagtttatggctattgcttcttgaagccaaggtctgtgcctgtttctttgattcccctcccaatacctaggactttgtagactctcaagtaatgtgaccttgaaatttaaggtgagtttctacaacagtctatctaatattttagaccttcccctcttctcaagctaggagggaaggatctcaaagaattcccatagattaactagatttttgtatatctagaccagtgctgtccaataggattttctgtgatgctggaaatgttctgcatctgcactgtctaatatggtagccactagccacttaggggtattgagcacttgaaatgtgggtaatgtaactgaggaactgaattttaaattttctttaattttagtttaattttatttgaatttttttaattatactttaagttctgggatatatgtgccgaaggtgcgggtttgttacataggtatacacatgccatggtggtttgctgcacccaccaacccatcatctacattaggtatttctcctaatgctatccctcccctagcccctcactccccaacaggccctggtgtgtgatgttcccctccctgtatccatgtattctcattgttcaactcccacttatgagtgagaacatgtggtatttggttttctgttcctgtgttagtttgctgagatagatggtttccagcttcatccatgtttctgcaaaggacatgaattcatcctttttatggctacatagtattccatggtgtatatgtgccacattttctttatccagtgtatcattgatgggcatttgagttggttccaagtctttgctattgtgaatagtgctgcaataaatatacgtgtgcatgtgtctttatagtagagtgatttataatcctttgggcatataaccagtaatggtgttgctgggtcaaatggtatttctggttctagatccttgaggaatcaccacaatgtcttccacaatggttgaactaatttaccaacagtgtaaaagcattccaatttctccacatcctctccagcatctattgtttcctgactttttaatgattgccattctaactggcatgagatggtatctcattgtggttttgatgtgcatttttctaatgaccagtgatgatgagctttttttcatatgtttgttgggcacataaatgtcttcttttgagaagtgtctgttcatatccttcgcctactttttgatggggttgtttttttcttgtaaatttgtttaagtccattgtaggttctggatgttagccctttgtcagatagatagattgcaaaaatgttctcccattctggaggttgccttttcagtctgatgatagtttcttttgctgtgcagaagctctttagtttaattagatgccatttgtcaattttggcttttgttgccattgctttccatgttttagtcatgaagtctttgcccatgcctatgtcctgaatggtattgcctaggttttcttctagggtttggactctcatttgcaattgctacaaagagaataaaatacctaggaatacaacttacaagggatgcgaaggacctcttcaaggagaactacaaaccactgctcaaggaaataagagaggacacaaacaaatggaaaaacattccatgctcatggataggaagaatcaatatcatgcaaatggccatactgcccaaaataatttatagattcaatgctatccccatcaagctaccattgactttcttcacagaattagaaaaaactattttaaatttcatatggaaccaaaaaaaagagcctgtatagccaagacagtcctaagcagaaagaacaaagctggaggcattattttacctgacttcaaactatactacaaggctacagtaaccaaaacagcatgctactggtaccaaaacagatatataggccaatggaacagaacagaggcctcagaaataacgccacatatctacaaccgtctgatctttgacaaacctgacaaaaaccagcaatggggaaaggattccctatttaataaatggtgttggggaaactggctagccatatgcagaaaactgaaactggaccctttccttacaccttatacaaaaattaactcaaggtggattaaagactggaatgtaagccctaaaaccatgacgttttaattaatttaaatttaaacttaaataccatattagcctgtgcatctctagatagtgcttctcaaacttttctattgaagtgctcttgatggtagaaaaaagataatgcataccctgatggtatgggggcttcaatttttcaagtacaaaattactttgaagttagtttaaaaaatgcacggcgattttgcatttctctttataatatatatactctaacatggagccaagtgtatggtctagaaacatgtgcccatgacttccttagtacacggcttccatgtagtcttgaggggtcatgatggccagttagacatagatgaatgcattgcaagtaagttggcttaaagtttaaactttacattcttcctatttttagtgcagcctgagaataaaaacatctcatcaaacacccattcagtgttatgaacgaccttcttgctggtatgggttataaccgtcttactgcagtgcaaacctcctatttgatttaaaagaaaattctctcccagaaatctcttcaagtgcatttaatgaataaggcggtgtccgtaactttctgtgacatttactttaataagccatgggagtgatttagtgatcagtgggcactgacatttgaggagggaaagataaactttgctgcttctgacatgactttttttcttctcctcttgactctggtcttgcagccatggaaactttgtttcctgagagagatgctgtgttctctggcttttggaagtaatctattttttttcctttaacaggcagccacaaattaatttctcttttgtgtatttgatgttgcaagtgtttctactgagtagagtatgttttccacagtatttgaactttctgtcttgttttgtcttgtgtgtgtgtgtacatgtttttcctcaacatggaatttgttctatcatgtttgaaagaaaaaacatggaacaaaaaggattttaaagggaagatttaaaaaaatcactacacaaatacatatataactacaattataaccctgactatatatatctgtacaaccaccatacagaccaagatatataagaacattgtcctcactcctcaggaggttcttctgtgtccccattcagtccatacaccctgcccagaggcaactattctgactcgtgtcaccatagattaattttttcttgttcttaaacttcatgtaaatagaatcatatagaatacagttttcacttactcttagccaaaaggtcaagaagcaatcaaaatgcacttttgatattatgtctatgacattcatccatgctgtgtgtatcagtacttcatttttaaatgtaggctttggagcttcactaaattgggttcagatcctgcttctgttacctaccacctgtgtgaccttgggcaagtagctttacttcagttttctcatttctaaaatggggatactaataatatttagctcaaaggtttgtggagaaaaacaaaaggactgcttcatcacatgttcctaagtgctttgagtaggccaggggagctcctgcagtggaatttctgctgccaacttttgggtgcccactcattcccagtgggaaggataagagacatctcagggcttttttagggagctcttgaaatgtctcagcaacatgacaaagtattaactgcccaagcagcagtttatccacagtccctctctataaggtgagctccatttcctctgcaatgcttcagcctaaccagcaaaattgtttacttcctaaacatttttccaacctccaaaacagctcacaggtgcagacactctggcctcgaggaatcttctagtgctgaaggtgccatgtctaggttttctgaatcatagatcatggcagaatattcgtgattggtacttgttgaggacatccacttgccatgtttccaggactccagacataactgtggccagttcctgtaggagtcaaagcatgaaagtaactcaggaaacacccagtcagtggggatggagttgggaattgcatccggtgctgtcatggattggagagccttgtctggggccaggtaagccatagttaggatttctggtgggtaagagagaacaccaggcagtaagcaccatcctcctattcagcggatttctcttttaaatttttttaaagttttattttatttttaattgacaaataatacttgtatgtacaactcatagaattagagagtagaatggtatttactagaggctatggggaggggatggggaatggagacattttgatcagtggctttcttgatgttctgacacctcgtggggacacggagctgagacttttccagggggcatctgctccactgctatcacccaagtaagtctgttaatgccccagaagctgtgagaataataataacgataataataaagtagctaccatttttagtatcactccagggattcttgttgtttgtttgaaatatggcaatctagtgaaacctatggatcccttctcagaataatgtttcttaatgcgtaaagtataatacataggattgcaaaggaagccaagtatattgaaatacagttatcaaagtatttaaaaaattccaatattataatagatatatgctcctttattactacattaaataacaagagttagtggtgagtctaacacacattataatttgaagtagtggtggtgtaaataatatttcagtacagcaactttaatgtgatatgaaaatatctgtaattcctattggtaagaaactcacaagtactgctaataccaccgtggtttgttactttcacttataattgaaggaaatattaaatttcagttacaaatgaatgaaaaatatctgtttgtggctctcttgaccagtttaggaactcctgtttgtgtcaggcattgtgctattctctgaacgtacattattcctagccttacagtccagcaatgtcggagttcttattcccattttacagataagtgcactgaggtttggagtcagactaactcagccatggtcacatagcagtggagcttgctgtccaggccagggctttgtgatggcagagctcaggttttccctcccacaccttgcatgccttgaactcctgagccacatttccccctgagagacattggcataagagatgcccagggacttttaaaggaacgtagtaaaggcactctttcctagactttccatatttctccaaagagaaagcaagctcctttcttcttctgaaagcctgtcctgtggaagtatcaagcagcttttctcttggatctccagggccacattttgggaattcccttgagtctcccagccaatgttaggtggtcctattccattggtgtgccagagctgacatgtaaaggcttgcaagagccaattgtgtacatctcttctcacattggtagcttgaaatcaaccatggtagaactatttacatcatggaattcctaaacactactaatgaaagcgtttttattttaaaagccagttgtttaacatttactcttgaacatgcttctttgtccctcatgtgttcccagtcctcactcctccaaaggaaagggtttgagcaaccaaccaccacacagttggaagaactagcttgccttggtaacataaagtcttggcttacttgcttgctgtcttcctccttcctgggtactgaagctgttttaaaatgtaggttttattattattcaggtacagtgaggccaacagatcaggagatggacaattccattgaaaagacagtttgttactcacagatcctcccaagaggaggggctataccacatcatgggggcccacacggggaagcactagggtgggtcaggagacaggagagggtacaactgtggacaagagtcttacttgtggttttcatgggaaggaacaggcaaggcagggtaatcaggctttggattggctagtttcaggaatttcagtgggctctggggcatcccagggccaagtaccagacaactaaggacatctatgccttagttgtctggtacttggccctgggatgattagggcaggtggatggtgacctggagtgtgagagctgcataaaggaagtggttgggatgtggactctggattggttggttcgcatatgaaaggagctctcccaggtgagttgtttgctatctctaggaattacctagccctgggaggtgcagctcctctagggtgaacaaggccccaagatgtcaaagcatcaaaaatacagaattaatgcaaaagccaacactgtcctcagagtggatggcagcagcattagattggagtgatttcccaataagtggtgtgagaggctcccctcttcatttagctccaatggcgagaatgttttacattgcacatattggcagctccgttgtcctcataaaaagaagcatgatagaaagtaaaagctgagacttaatggccaatttaagcttgagataactctgctatggtagatctaaagaggctcccaggttacctacgtagcaccagtctcaaccttatgtgcactaattcaaacttcaggggacacacattttgcatttctacaaactaagcgagtattaggaaaaataaacactcaccagttctttttatgctatcacattctatgttgcacataagaaaaaaatatgctttctagagagttgtaaacattctgcacacaacatccattatgttatagctggcaatggggtccaaatggaataatctgcagactaaaccctttctttatccccagagctgaggctgaggtcagtaggacagtgtgggtgaaacagcttctgaggtgccctccgactctgaaatgtgctgacctggagttttgccagttggcccaggttggataatagactgttagatggcctacatctaagggatgataaaatagcagcccagaccttgatccctgctcctgccaggttctaaagcatcagctctgggtggtgggggtggggttccggatggactgcttttcaattttcccaagccccagaaaagcagtcggctgttacagaccaggattgctttagcctgaaggagaggagaaatgcaacttactgcctttccgatcgtaggtttgtgctgggttgtattgagcaaaaacatggcagcgttttggattctgaacatcagtggcaatttgaaggctgtagagctttctatagggctgagaggatcctggccactgacagccttcctgttgagcagacacatggctggctaaagactttggtggattccagtggtgatcatggcatgcaagccttcctcccctagctgggactaatatatcacagggcacaacttggcttctaagaatcagcatattaggcagcaaaacgtgatttcactgcaggaactaaacggagatggtcctgaagcatgtgtttccccagcacctagtgtgacatctgtctgcatgtagtaggtgctcagtaaatggtagttgagtgaatgaacagatgctcattttatgtatcctacaaggaaaagacaacaattcctcctgttgtttcttttaataatgagagttggccagaaatggaatggagtgatttttaagatttaacattacaacctcaaagtatacaagctgtagctagatagtaaaaataacagtagctattggtcactcattgctgtataacaaataactctaaaattcagtggcaagtatctattgtcatgttttcagttttgcagatcagccatggtgacgctgcttcaagctgcaggtctgtgcattgattagctaatgtacgctgggcttggttctcatcttcaggtttggttccagtctgttccacgtggctttcttgcttctgggacagtgggctctccagggcatgttcttcttatggcaatggcagaagcacaggaggacaagccccacagaacaagcacattttaagcttcagcccacatcgtatttgccagcatcccatcagacagagcaagttatatggccaagcccaaaagcaataagtagtaaaatatactttgccttcagtgggaacaggagggaaattagttatcactgaacaataataagcaacaacaataataaatgagcaataaacaaactacctaccatttattggatgttactgtgtgccaggcactgttctaagcattttccatgcttagaacattttctatattcattttccaataaacttatctaaccaccatagcaacctaacggggtaggtgctgctatggttaagctccattttacaggtaagaaaactgaggcacagaatgactgatgaacttgttgcagggcacacacccaagaggcagtggaaccaggattcacacccagttagtccagccccaatgcctactctcttagccactctacgctcctgctccagaaagcaagaagcatgctaaacaactttggggcactttgaagtttgcaaaatgctatcacaaatgtctcatttaatatttcatggaagccaggataggctatttccatttactaagcacgaggacactgaggcccagagaggttaaggaacttgcccaagtcacacaactgggaagtgactgagccaacatggagtcccgggccttgcttctagcaggaattccactcttgtgaatgaggagcaactcagcagttatccagggtttttttctgcctttgggccttgggaggcttctaatttagggcgcccaccctccaacgcagccttttacttgacttatttatgtattttctggctggaggatttgtgcccttgttccttggcatgggattgatgtcatggcaagatagctgtgctctagttctcacggtctccaaggccttagtttctcatgacatggcatgtccctgagtgtccccttctctccctgatgtacccgcccttgctttcttcctctactgaatgctgggacagccttggctgtcctatgtgtctggttacaggctcagaagggcaagaccagctcagaggctgtaattttagtcctggatgaaaggcaaggggaagcaaaggggactctttaacaggtgtacccaagccacaaggctgtatctcctgaactctggtagaaagcagacacttagggaagagtctcaatgtgagcaatattttcaggatccaaagcccccagtgtggggagtgccagggagtcaggagttcccaacaccaaaataaaaagtgcagattgacagctctgaacaaaaccttgtgcttgctgctctctgcagtgtggtggggcacagggggtggaggtttatgccaatatatgctcccattcttgcaaccaatttgaacaagtctcgaaaccagcaaaaatcctattaatgtgtttctcctcacctgtatcctgccggcatcccacctgcctgccttttcctcccacctcgccgcctcgcttctggcagaatctgatggctacacaactgtcattcaggagtttccgctacgggtagagattcccatacataaggcaccaatgagccagaaaggacaagcagagaatgttacattttatttggcccactgcccaacatttcttacctcattgcctgaattctgtcatactagagtcagggcttatcttcaagacactggaaatttccagatgcttacagctccctttcccccattctgagccctccagtcagggtgacgtttgggcttgagggctgaaggacctgcattttttggtgcgggaagggatgggagatgtcctgcagctacaggcaggagaggcctcctgtggggttacaggggtgatgtaggtatgcaatcaccacatccagaaacttgacctagacctggaaactagagccagcatttctaactttttctatgccatggacccctgggcaggctggtgaaatctggactcttctcggactgaggtttgaaaatatgtagaattacaaaggacctacagttactatgtaaatacagttatgcaaatatgaatttgtgatatagtaaaatatgtgcttcttattaacccacgaattatcaagatctagttgaagtgttaaagttgtactatttccagatatctgaaacaactctttctgtgatgtgaaaatatctatgtattctttttttctttctttctttttttaaattataatttaagttctgggatacatgtgtagaacgtgcagttttgttacataagtatacatgtgccatggtggtttgctgcacccatcaacccgtcatctacattaggtatttctgctaatgctatccctcccctagccccacacccctcgacaggccctggtgtgtgatgttcccctccctgtgttcatgtgttctcattgttcaactcctacttatgagtgagaacatgtggtgtttggttttctgttcctgtgttagtttgctgagaatgatggtttccagcttcatccatgtccctgcaaaggacatgaattcatccttttttatggctgcatagtattctacggtgtatatgtgccatattttctttatccagtctatcactgatgggcatttgggttggttccaagtctttgctattgtgaacagtgtggctataaatgtacatgtgcatgtgtctttacaatagaatgatttatagtcctttgggtatatacccagtaatgggatggctgggtcaaatgatatttctggttctagatccttaaggaatcgccacactgacttccacaatggttgaactaatttacactcccaccaacagtgtaaaagtgttcctatttctccacatcgtctccagcacctgttgtttcctgactttttgtttttctttgttgttgttgttgttgttgttgtttgagatggagtctcgctctgtcacccaggctggagtgcaatggcactatctcagctcactgaaagctcagcctcctgggttcacgccattctcctgcctcagcctccccagcagctgggactacaggcacacaccgccacgcccagctaattttttgtatttttagtagagacagggtttcactgtgttagccaggattgtctccatctcctgaccttgtgatctgcccacctcggcctcccaaagtgctgggattacaggcatgagccacagcgcccggctctgttgtttcctaactttttaatgattgccattctaactgacgtgagatggtatctcattgtggttttgatttgcatttctctaataaccagtgacgatgagctttttttaatatgtttgttggccgtataaatgtcttcttttgagaagtgtctgtacatatacttcacccactttttgatggagttgtttttttcttgtaaatttgtttaagttctttgtagattctagatattagccctttgtcagatcaatagattacaaaaatgttctctcattctgtaggttgcctgttcactctgatgatagtttcttttgctgtgcagaagctctttagtttaattagatgccatttgtcaattttggcttttgttgccattgcttttggtgttttagtcataaagtctttgcccatgcctatgtcctgaatggtattgcctaggttttcttctagggtttttatggttttaggtcttatgtttaattctttaatccatcttgagttaatttttgtataaggtgtaagaaaggggttcagtttcagttttctgcatatggctagccagttttcccaacaccaattactaaatagagaatcctttccccattgctggtttttgtcaggtttgtcaaagatcagatagttgtaaatgtgtggtattatttctgaggcctctgttctgttccattggtttatatatctgttttggtaccagtagcatgctgttttgattaccgtagccttgtagtatagtttgaagtcaggtagcatgatgcctccagctttgttctttttcttaggattgtcttgactatacgggctcttttttggttccatatgaaatttaaagtagtttttttctaattctgtgaagaaagacaatggtaccttgatggggatagcattgaatctataaattactttgggcagtatggccattttcatgatattgattcttcctatccatgagcatggaatgtttttccatttgtttgtgtcctctcttatttccttgagcagtggcttgtagttctccttgaagaggtccttcacatcccttgtaagttgtattcctaggtattttattctctttgtagcaatggtgaatgggagttcactcatgatttggctctcagtttgtctatgattggtgtataggaatgcttgtgatttttgcacattgattttgtatcctgagactttgctgaagttgcttatctacttaaggagattttgggttaagatgatgggattttctaaatatacaatcatgtcatctgcaaacagagacaatttgacttcctctctttctatttgaatatcctttattgctttcttgtgcctgattgccctggccagaacttccaatactgtgttgaataggagtggtgagagagggcatccttgtcttgggccgcttttcaaagggaatgcttccagcttttgcccattcagtatgatgttggctgtgggtttgtcataaatagctcttattattttgagatacgttccgtcaacattattgagagtttttagcatgaaggggtgttgaattttattgaaggccttgtctgcatctattgagataatcatgtggtttttgtcattggttctgtttttgtgatggattacgtttattgatttgcgtatgttgaaccagccttgcatcccagggatgaagctaacttgatcgtggtggataagctttttgatgtgctgctggattcggtttgccagtattttattgaggatttttgcatcgatgttcatcagggatattggcctgaaattttctttttttgttgtgtctttgccaggctttggtatcaggatgatgttggcctcataaaatgagttaggaaggagtctctatttttctattgtttggaatagtttcagaaggaatggtaccagctcctccttgtatctctggttgaattcggctgtgaatccacctggtcctgggcttttttttttttttttttggttggtaggctattaattactgcctcaatttcagaacttgttattgttctattcagggattcgacttcttcctggtttagtcttgggagggtgtatgtgtccaggaatttatccatttcttctagatttttctagtttatttgcatagaagtgtttgtagtattctttgatggtagtttgtatttttgtgggatcagtggtgatatcccctttatcattttttattgtgtctatttgattcttttctcttttcttctttattagtctggcttacagtctatctattttgttgatctttttaaaaaaacagctcttggattcattgatttttttgaaagggttttcatgtctctatctccttcagttctgctctgatcttaattatttcttgtcgtctgctagcttttgaatttgattgctcttgcttctgtagttcctttaattgtgatgttagggtgttgattttagatctttcctcctttctcctgtgcacatttagtgctataagtttccctctaaacactgctttagctgtgtgccacagattctggtacattgtgtctttgttctcattagtttcaaagaacatctttatttctgccttaatttcgttatttacctgttagtcattcaggagcaggttgttcagtttctatgtagttgtgcagttttgagtgactttcttcatcctgagttctaatttgattgcactgtggtctgagtgactctttgttatgatttccattcttttgcatttgctgaggagtgttttacttccaattatgtggtcaattttagaataagtgaaatgtgttgctgagaagaatttatattctgttgatttagggtggagagttctgtagatatctatgaggtctacttggtccagagctgagctcaagtcctgaatatccttgttaattttctgtctcgttgatctgtctaatattgacagtggggtgttaaagtctcccactattattgtgtgggagtctaagtctctttgtaggtctttctattggtgatggagtaacaggttctgctcataccattgtggtttgttgcctatgatcataactaaaaggaatgctacatttcagttagagatgacaaaaaataaaattttaaatttctctccaagtttctggacctcctaaattctagcttaagttcccctgatataggatcaagctacatggtgacttgtaagttcttggagggcagatattatgttccaaccacttacatagttgaattctgttttttgttgtggaaaatgtcaaatatataataaatggaacaatatgatgaacctttcctaggcacctatgaaccagcttcaactattaccaactcacagccaatattgtttcacctatacctttacccacttcccttcctgtattattttgaagtcagtcttagacactggatcgtttcatcccatactttgacttatacatagtaggtgggccattacgtatttgtggattgctgatggcttaatttagaaaggccatttcaggtgcttgcttccagtgatcatgggtcagtgtcccagaagtgtggactggggtcagagaatcccctccctgtcctcagtcatggtctattccatgcttcccagcacatacctgatgctgcattagttatttattcatttccacatctattttcagtctttttccactgcagtgtaaatttcatgaaggaaaagactttgtctgcttgtccactgcatcgccagtcccccagcacagtgcctggcatatagtaggtgcttagtaaactcagtacatttcgaatgagtggatggctaggccccctgaattgaaagtgaatgaggaaagggaagttatggagatgtatgctatttctactcaaaagtagggtccctgtaccacagcatcagtatcttctggaagcttattagaaatgcagaatctcaggccccacgccagatctactgagtcagaatctgcatttaaacaagatttttaggtgattctgtagttacataacagtttcaggagccctgctttgccaccttaacctgcaagggagagaatgacaaccaggaagagctttccgctgacttccaagatattaccaaccaggagggcagggcagggcaaaggaatgcactcatttgtgagttagggatcctagttttgaagtttggttctctgggcctcagtttcctcatctgaaaggtgggtgaataagacattgctgcaagggttatgggaagattaaatgaggcaatggctctggtgtgaagtacagagcaggtcctggatgacttttttttttttttttttttttgacagaatttcactctatcacccaggctgtagtgcagtggtgcaatctcagctcactgcagcctctgcctcttgggttcaagcgattctccagcctcagtctccccagtagttgggattacaggtgcatgccaccacactcagctaatgtttgtatttttggtagagacggtgttttaccatgttggccaggctagtttcaaattcctgagatcaagtgatccatctgccttggcctcccaaagtgctgggattacaggaatgagccactgtgcccagccctgtatgactcttgaactaattccacatggctgtctttccaaaatatgaaggaatgacatttgttcatttttcaaatgccatttgatatttttgacttctgactccaaacttgttctgggaatcctcccccttctgtttaatcataactgtggagagtgcttggaaaaagtgtgaagtgtgaggctcacctttggtgctcccagccattaacttctgtaccctttctccttttctgggatatccttctccctatggggcatcacagaccctcttccataagatcctgctcccaggcaaaacagccaagatcacagtcacatagcatttcattccctgagaactgggggtccttgatggtagaataaaattgttttccttgatgtaggtatcagagggctagtgggggaattttttaaaaacccaaaacattttgcatgtgcatgccattgaggaagggacttcccagccattgaaatattataacatcccatggataagtgcttgctttggccttgggtgttaagagttctgatggtcacaatcacttctttgtgttggagccatggaccaacaaggttgggtcagttcagctcgagaacagttggacagattgaggcacttcttacttctaaactcacatttggctgttctaatctggacgtattcaaaacaactggctgaggcagggaagcggaactgaagctttttaatgcttacagggaatattgatagcccaggtgaatgctcctcaccccttgcctccaaatactccccagccttgcctcacacatccattacatgatactctgtgtttacccggggcttgtcccaacagaacttagtaatcctacttctatcttggtctggctgtgtatttacatggtaaacatttctacaaaagacagggaaatattcacttcaaaataccctataaaaattgccctttagagatgagtggataggaaaaagcaaacatttcatatttataaaatgaatcatttttataaaaatgttactcatagaccaaaaacttaataatattgttggtagcacagtaatacttgtataggtttgtttcgcattgtagagatatatagatgtattctttcatatacataatttcatctaagcttctcagaatccagtaaggtagacaccattatctctagttttaaaaatgagaaaacaggggcttaggaaggttgtataaatgtccagtattatgctcctaggcagcctgaagataaggatatgaggctaggtcttctcagtcaaaactaaatgcctattggcatatttcagccaagggtaccttagaagccagttgtaaacccattggcacacagctgtctcaaagtatctgtaccattgagtgtctaaccaggaaaatgaaactactgcagatatttcacacagagggaatttaatataaggaattggctccactggtgatggaagagctgagaagtcacacagagaatggtgaggtaacctggagtttagcaatggtagtaacctgctacctctctcaagctggagggacatagggaaggggccaagctaacagaacctaagggctggtggcactctggaaaggctggaacaatggtgagccagcctggagggagtggaaaccccagaggatacatggccatggtctctaagagggaagggaggaaataccctacctcttcccttcctcctgccctccaatctcctctgggtgcctcctcttggctgagcccagccaagcccagcccagcccagctagaagccagtagacctgggatatgcagcctgcaggggtaagcaaagcagtagaaggtgaggaatggatctaggggaacaggcccagggcagcacagcatcttttattcctaggtatgggtgaactcctggaactaggtttgtgccattgaattttcctcctccaaggacccctgatttagcctgtttctttggtgacacctacctcctagttgcctccctgacccacctcaaacaggcttgacagcaatccgtttttgaccactttctgggataaaaaaggaagagctcagaagtttgtaaaggtgagagaaagtggtttagatttgcccagttatgcatttgagacccagatagaaactcctgttgattttgggacacaaagaccaaagctccagtcattcaacaaagggctgtgtcagtgaatatcttggcaagcagatgtcaaaaagagcactgccaaatgtcctgccaggagaactggtttggcaacaagctgatagacccaaaggactagaatacaccacccgttcttcttctagatactacttaatcagctctgattaaaataataatttcaacctttgttattttgcaaaaccctctcccaatttgctggattttgcaggactgttgtcttcctctatccactgccctccctccacccccaggatcccgctttccatagatatttctctgttaaaggtaagtttgtttgcaggactttttattgctgtcgttcattccacaaccttctatgtagataattggagatatctgatgcccttaaactaaaatgggaaaaccctggcggaagaaaaattgtgtctgtggttcatagcagttttgcaaacttttatcaatgaaaaaagaaactcatggttatttgggttcatgattgcgatgagataaaagggaaaccctacacctcattcagggttgggtgcacaataggttctcataaaagaaatgctcgctgaatggatgggaacatgcaaaatgtacagtaccctgttcattccctttgacaggtgcctttttgttttaaatacacatggcagcatttgatagcatgcaactaatgccttggagtttttctggggacttaataaagcccaaatagtaaaaggtcttcaaggttttgtttggtttcttttaaggggttgctacctctgtcctctgtactgttgagtttatgatgaatttgaggcttatgtgtatgttgagtcactttatctgcttgatcacttttatattctgtagctttaaatatttattatgcaagctttcagagaatgacataacagtcatgtatcaaccattcagttctaccaaagctaacgtttctcccacgcctgctttctgtttaaagaaataaaatgttagttagaattgaaagcccctgctttcccatcctaatctaattctgtcctttccccagtgttaacttttattctaacttttgtatttcctcacctcgatatgttttaatattattactatgtatgtatatattcaataatagtattaacatgtttttaaattttgcagagctcatataatgtatgtgtcattctgtaacttgctttatgatttaaacatatcgatacacatggtgtactgtattcatctttaactgccctgaggaatgctattaaaggaatacagtacaatttatttatgcatgctcctattgatgggtatttaggttacttccaatttcttgctcctgcaaacagtgctgccataaataattatgtcaaatgtccttatggcacatgggggaaaaggtctctagggcagtggatctcaatcttttgtacacatcagaattgcctagggatctttgaaaagtcccactgccaggttgcacccagactaattaaatccgaatcactaaggtgaagcccaggcacctgtatttttttaaaactccccagatgattccaatgtgctgccagcattgacagccattgctttaggtcacataactagaaatgaagtttctgggccaaaatgtttgttcctcttcagctttctcgatattaccaaattattctccaatgtggtctttccaatggaaacgccaccagcagggtatgagatctcctgtgcctgtggcattatctcctcacctaaacttgattaatcttgtccctgcagggatctcaaagggatgtgtcgagagatatccctttgatggccttcccacacctgcctctatctgatttatcccctggtaaaaattttgcctcgcccaaaagtcatggagtaggaaccgttctcacaaagtataactaaaaacttggggcatccaacaccacctgattttgcaattcagggtgttgcagtcaagaggttgttgccattaattcttgtttgtatagtctaacattcatttcgtggcgtgatgtggtgcttatctgtgatatctaggtttgggggtagaaaatgacacaagccttgttgctatgatgttgctataccttccatttagccacaggtccaatatgatagtgccctgagcatctggaaaaacaagatgctcagcccaaactcatacttccatgatggttagatcagagttattgcggagaaacaacaaagagatcctagccttgaccttaatcaagctatagctgtgtcgaaataaataatttctagccatgatgtcctctctctttggacattgtggacacttgagtgaggtttttttaagctgctcacatgctgaaagcttatgttaaaccctctccctgtgttgatgcagatttagaaaatttcatggataaaaattgatggggttacaattgttacccactttgaatttaacaaccttaaacataatacagtaaacttccctcatagtatgcaagtaaaatgccatgccatgaagttgatgaaaaattgggcaagtcttcatagctacctggccaggagttccagaagtctgactgtgtgatcaaaatctgttctagcactggctgcagtttctggtggcagtggacctctctggcttaaatattcatggggatgattctgggtcctatggttggctaggatactccaggaatctcctggagagttggcactctttcattggcctatttggggagattgggtcagaagaatactggggactcagggacttactgtcttcctccctgcatcacttgctgacacagggttgcctgccatttcccagtccagcctcaccttcccctacacaattctatccactttcccctaaatagaagtttattttgcccctttttgaaagcacaacccaccactaactgcattaaatccagaatcttgctatcatgggtgacttattgcagggttttactcttgaacttatctttgcttccaactctgtgtcttggattgggttcccgagagacagcacccgacacagggattctagtgcatgtgatttattgggagagagttctcgggggaaacctgtaagagtatgaaggaagctgaatggggcacaggacactgctgagctggaatgtggtctcatatggagcctagctttgcttttatctgcagggagagagcttttgtcatgggaaaggagtgacttaccttccaggcaaggtggctctcatcggccaaggagaactctcctgagaagtgagtagttgtgagacactagcagccaccactcacagtatctggagaatagctacacaggcttggtaaaggggatccgggtggggcaccctgtcctgggtgcagggctctgaaaggagatgaactttcagctctcacacattgccatgcagggctctgaaaggagatgggcttcatgtggatagtcaaataacaagcatgacatccatgggtatggagtgctataaaatgactatgtttaataatgcgtctttcttctggctacaggtctgagtatattttgctgttttaatcttaatcctggaattgagtctgggacttcctccgtgcctgtaaaccactttgatgttatgttgagaagcattctgaggcacatgtgtgaactgataaccaggataagtggcatgatgaaattaatcccctagtagatgggaaaggaaggccagtgcctttcccagtctgggcttctagagatgattcacaagctggggctttaaggcatggagaacaaacagtagacacaagagtgttggatgcaattacttccttaagccataaagctggagaacccagatgattgaagtgaatgtttgttaggctgaggtcaggtttgattttgctgggagccttccttgattctgattgtgtcttatcatttgtttgtcttctgaaggttgtggaggaggagggaagggttcatagaaatgccctggctgtgatcccattgttgctggttgtaatgtctggccacgtttcctcctgcggtgtctgattggaacttccactctgatcaagcagcaggagcaataaatagctaggtctgtgcctccttttctatgtgaagctagggaaaggactttatgagctttaagcggtaacttgatggaagactttacgcctctgcacatactgtcagatgctccctcagaagagaatgacaagggttcaaggtagcatggagtagggacaagtgtgtgtggcttttgcgttaggcagactggggtttgaatcttgattccagtgcttatcagctgtgcgaactttcttagttgagtcccttacctgctcccagactcaattgtttcacctgaaagtggggataatagtacctgttttaaagggttatttgagagattaagtgaaatagtgttgtgtaaattgcctgtcattgtaaatactcaataagtgacatctattattagagctttctttaaaagttgtgctgcatttctgatttatggggaggtcagaatagaccagagctaatagcccttcttgaggagatcaagaaagggatcaggccaggcagggtggctcacagctgtaatcctagcactttaggagattgaggagggaggattccctgagcccaggagtttgagaccagcctggacaacatggcaaaaccctgtctctagaaaaaaaatcagccatgtgtggtggtgcatgcctgtgggcccaggctgagatgggaggatcacttgagcatgggaggttgaggctgcagtgagccgtcattgtaccactgcactctagcctgggtgacagagcaagaccctatctcaagaaaaaaaaaaagtggggggattaggatatttagaaggacttacttccttgagaccatagccaaggtggaaataagagaaggtcaaggtgtgtgggtggggcccgcacagtggctcacacctgtagtcccaacactttgggaggcagaggcaggaggattgcttgagcccaggagtttgagaccagcctgagcaacatgggggaaaccccatctctataaaaattagccaggcatagtggtgggcgcctatattctcaactattcaggaggctgaaatgggaggaatgcttgagtctgggaggtcaaggctgcagtgagccatgattacaccaactgcactccagcctgggcaacagagcgagaccctgtctcaaaaacaaacaaacaaacaaaaagatgtgtgggctgggtaacaacaagtcttgaatgttccaggacggtgatgatttcagatattccctttcagcgagaaaccaagtatatagatttggggttcatagaaaacatgatcactatccttgtgagaaaatgcagctctaggccaacttgcttgggaatattaagagtctttggcacatcttcaaagaaaagtttccccatggggttacttctgacgtttatgcttccagtttcaattgtttggtggagagtccattgaactcagttaattctttttatttacctcaatgttcgatatgacaggccaacattttaagtgctattctaaattgtagcttgtgtacactcgggaaaaaagggcctatttgtctcctcgggtctcctccatttttttcttcctgcattggttaatgttcccttctccttgttgaatatttggaagtttccttccaaagcttgggaggggctagtttcacaggaaggtcacatgaacacgatctcatgggcagttcattgactctgcccagctttaatctctgcggttggagcaggagagtgaagggcagtggacagacactgccctctccctctccatttattctcctccttccatgccccttttctgcctggaaccttctccatgctctagttaacaaatgtgcatttcagcattcaggctgaaactcaactgccagcacaaggcaagtaatgccatttgacttaagaacaatctgcatttaagaagtcagggttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaagtcagggttttctagtctgcccgatgcttctgctttagaacaaattaaagagggggacctcagcccatctttatatcccagctttatccatttacctgtcagaaacacaccctgttttcctttgagtttctctacatcccactttcaactcttccctctcttgtgcctccagtatcctgagtctacagttcccacctccatagctcccaatgcacacagtgaacatcctctttaaaaatgacctaatctttctagaaccttaaggctggcaaagaaaaaaatatcaatgcatcccttgccttcctggcccttataaatttttaaatgacacaacatgtgtttctagaagggaaagtgttatttgaattcttgggttttgccctggcaatgatgggcctattaacctcccattaacattggctttttgatgatggccaaaccattatccttttcatttcactttttaaaattactgcttgattacagtgaaagtgttgtataaaaatggtaatgttggagtgaggatgccccactttaggacctcaagatctcagtgactttattttgcttaaagaaacattgatatggtacttactatgtgtcaggtcatgtcctgtgtgctttacagctacaaacccacttaatccatatcacaatcctatgtgatatagactactgctatcttcattttacagatgaggaaatagaggcccagagaggtcaggtaacttactcaaggtcctgtaaaatgctggggtttgaacctactcattctggctccagagtcccagctcagaaccactagcactgttttctctctgttgaggattatctgggacaccatttctttatttgtacaatgaaggagttgaaatgtataacttctgaattcattccaggactaatatcatgggggacagtgataatttcagggtgttttgtaggccataacacctggcttttataatttttgtcctgatccatgtgttgaaataattattttgggtaaaatattctgtgcatagctcttaagtcccatgcccagccattctgtgatcccaacattgaggaggagaaacaacccttgaatgaattgacttcccaaagcacattccaagacccaccaatgcagtgccatgtttgaaagaaagggttccccagacaggaagtctgggaaacactgcatatcacatctcacccttttcaggaatcatagtacactgaacatattggaggaacctagttgttctgcaattgggaaaccaattcaactttgattattcaagtgtttaccacccttgtcttaccaggaaatctactctttgagcagcattttattagcatcccctacaaccaggcttctgaaagacactaggggcacactggctgacacatttttataagtggtttctacagcttttaatctgcagagatgcgaaagttttactcttttgtgctggtacccatctgtgtatatatagctgtataaatattaggaacaacaggagtcttctgtaaaaagatacatatctaccacctcttgagattctcagctaacaagatatgtatacttctcccacagccatccttatggtgaaaatattcacttaaatacaaactgtacatgtaaagatgtgaaattgaccctcaagctgtctctctcttcacagttccatgccagctagagaatgtggtcaaacgttgactttctctcaccctcttcttacatcatcttttcttcccatatattcttgggctttttctgtatttatttcctttggctttccatttctattttcccctccttcctctacctttcataattcccaaagacaaggatgttcaggagagagaggactggcagctaacagaacaatgtccctaaacactgaggctgggtcaccacatgtggcaacgcagtgtttccatttgctgatttattatttttacaatgcccacttgcaaaaagggtttctttactccacttgctagttttcttttatggtgtgtaattttgaattaaaaaattaaaatacatgtacactgttaaaaataaaacctaactctaaagaaaggaataaaataaaatgaaatgtgaaagtcttcctctcccctgagttctagtcttctctccaaagataaacactgctaacaggttcatgtgtatcatttcagaaaggttttattcaactacctatgtgtgtgtgtgtgtgaatatatatgtatatatatataatgtaaataaatctatctcatactacacacaatgttcattatcttgctttttagttgccttaataacaaaccttagacatctttctagttctaaattagctactcatttttttcatcagatgcagaatatttaaaactttataatatattgaaccagtacccaatgacagatgtaggtttttccattttctgctatcaacattgctgcattgtgtattcttttacatataatttggcttacttttgcagctatgtctgggagtaaattccatacagtggaattgccagttcaaagggtggtatgttttctaactggagaaaagtttgccaaattgccctccaattaggttgcaccatttgtgtttttaccctgtgtgtatgagaaccttcttccttccaacctgcaacaaccttaggtattaccaagcttttaacttttgctcatccgaaatagctgatacaagttatatttgctgatttaaaatgacaactgtcattttgattgtgatttactttacagaatacagattacgccttcttatttaatctgcataatgaatagtgacaccgggatcagtgttttttttttttttccatatgaggaagcagaggctcaaagagggaaagtgacttgcccgagccaagcagtgagagaacagagaatcaaaatcaggtttcctgactcaagattgattgattgactgatttttctaaatcgcactgtctctccagcaggggtgagggtgaaaatattgtgtggatatgtgtgtgtatgagtgtgtgtgcatgtgcctgtatatgcatgtgtgtgcttctgtaatggggaactggggcctgaggagggaagatgactgaatgtaggatcttttcccttcttctctccactagtcccccttaataccctgaaaaagaatcacatttgagcatcaggtgctttcttcaacatgatcagatttaattctcacacccagcatcattcttcctcatctgactctcggccaaatcctcactttgtggatcccacagaaatagaactgaggaatatggaaataagaggccatgtgtgaaatttaagttagagccaagtcagaactttgtcacctcacatttctaaagcactcagtcctagaatcggcacccacaggctgcttttcttatctcttattcacacacaccccacttaaagtcaggtgcacttggctgggtgcggtggctcacgtctgtaatcccagcactttgggagaccaaggtgggcaaatcacctgaggtcagaagttccagaccagcctgaccaacatggcaaaatcccgtctctactaaaaaatacaaaaattagccaggtgtggtggtgggctcctgtaatcccagctactcaggaggctgaggcagggagaattgcttgaacctgggaggtggaggttgcagtgagccgagatcacaccactgcactccagcctgggcgatagagtgagactctgtaataaataaataaataaataaataaataaataaataaataagtaaataaattcaggtgcacttgtcctgatggtactgagagacttcagggacttagaatctttgcctctttctccttgtgactgttggtaattccttgagagagagggtaactacagaaatgtctgccttttaaattctcaacaagatagtggattggcctctagcatctattctcacatccttccagcatatcttcctataatatgctagagaggctggaaagctagaaatgatgtttttcagactcccttgcagctaggttccagttggaaagtagattttgttaagtagatgtagctacttaatccactggcagatttttcaggttcactggcttctagggcataaatctgtgacatatcttctccctggccacatttaaggctggggaaaaaaacaccagtcagattagatgactaatcttgctaaaatggagtatagtttgaaatgtctacttttcagattccttactaccttttgtagttgacagatttttttccagtctgtatctgggttgtattacaatcccattggccagtcttattaggcttcttgctaaagcaaacaatccctaagtagccaacaaacaaaaacaggacaaaagtttctactcttcctttgtaaaaggtgacatcttcagatgccatatattatgggcttcataaatgtatacttagttcatggatcattaacaatcatgaaatgagtggagagataatgttactgatgttttgacatctggggtatttctgtggtgagatattttctgttgtaacttgggtgctcctgtgaacttgtctgtcacacctttcccgcccttcacttgtgctggagttttgctttgagatggaaaaacacaaatacctaaaaaaacatacctcaccccactgtaatgaagatcaaagtgaaaaaatgaagaatggcaagacatcccaggtgtgtttttaaattcccagaaaattttgcctctggggattctccgtgcttcttgccagaaaaggttttcccttttagaacgtaaggcactgttgcttatttttcagttacagatggggatttttagtaaagacctggccccctctcaccattgtttacccgaggtgtctgatcactttctttattggcatattgcccaagacatagacaaaactgctaaagggttttggatgcattagctgagcaaaaggtgtgtgttcctctgtctctagagcacaaatttgattagccctttttattaggagtcaagaatgacattcagtcttaacctagctcatctctcacactgtggctttggtgtttcaccttctttctctgaaagatgggggcaagcatgataaaggacagcatttcttgggtgtttactctgccaggcatagtgctaaagtgttttgcatatactatctcatttaatcctcatagtaagcctgaggttgttattgttattattattattttggaattgtatattttttcattgaggcgaaatttgcataacaaaattaaccattctggaagtgaacaattcagtggcatctagtacattcacaatggtacaaccattgtgatgaactatggtacaaccatcacctctagttctaaaacattgtcatcaccccaaaaggaaatcccatatctggtaaacagccaccccaccattcccatttcccccagccccctcccaccaccaatctactttctgtctctatggatttgcctattctggacatttcatataactggaatcatacaatattcattcttttgtgaccagcttctttcagttagcataatgttttctaggttcattcacattacagcaggtattagtatttcattcctttttatggcagaataacgttccagtgtatggatataccaccttttgtttatcttttttgttgttgtttgtttgtttgtttttgagactgggtctcactgtcacccaaactggagtgcagtggcatgatctcggctcactgcaacctccacctcccaggctcaagtgattctcctgcctcagcctcccgagtagctgggattacaggcatgtgccactactgcccggctaatatttgtgtttttagtagacggggtttcaccatgttggccaggctagacttgaactcctgacctcaaattatccgcctgcctcagcctcccaaagtgctgggattacaagagtgagccactgtgcccggctcatttttgtttatctattcatctgttgatgtacttttgggctccttctaccttttggctattgtgaatagtgccatgtgaacatttgtgtgtgtatttgcttgagtactagttttcatttcttttgggcatatacaaggaaagtcagcatgtggaagtgtgggtacagagaaggtaaggggttggagataggattcaaacccagagccttcatgtaaccaccatgtggtgctgcttcctataatacagcactgtccctggaatccctcttagggaactagcttataacaaagtctctttagcatttggtaatgaaagtcctgcaggcatgatggggttcaggtagaatccctttaaagtatcagctgctctccagcaaatggtggtgttgggaggcattcttctttattcttgaacttcaggtaatagttacaagtaatttatttatttatttatttatttatttatttatttatgagacagagtcttactctgttgcccaggctggagtgcagtggtgtgatcttggcccactgcaacctccgcctcccaggttcaagtgattctcgtgtctcagcctccagagtagctgggactacaggcacccgccatgatgcccagctattttttgtacttttagtaaagacgaggtttctccatgttggccaggctggtctcaaactccttacctcaggtgatccacctgccttggtcccccaaagtgctgggattacaggcgtgagccaccacgcctggcccagtagttagaagtagttttaatctctatggcatgttactcttaaaaaatatttttacctagggttttcatttggccattataacaaccatctgaggtagccagctttataacttgcatctccattttacaaatgaagaaactgggactcagagaggtcaaggaacttgctcaaggtcacacagcttaaaggtagacaatccagggcctatactgggtcttctatggccttgttgcctctccacttagcaataagaaatggttagaaaacaggcacatgcaaactgccttctttacatcaaaagctagttgtaataaaggagtgaagttttatagctatcatgccataataatggtaacaacagcagccacaatagtagcagcagacaattccagcgtctctacattgtgcttatgcagcaaatataatccagcacacagtaactttctactaacattttttaatcagttcactttagtatgtggaataagcatcataaaagctctcaatcctgaaatgtgtaccctggtctcccagggtctaccttgaagtttatccccgacagttgttcatccttggtgaccttaccgttgactacaactagaaactgttattttatttctctttttcagtgtctctttctatttcccactatctcagatcatatgaaccatctcctgttttgtagttaagcacctggaagtgaaacatcaagtgagcagaaagagctaggcacagaattctgggtgcctttctagaactttccaaattgccttgctttcccttggagggctgagcccaccacacttctccctgagtattggtcatgggcctttacacagcctcccagtctaggtctcattccacctcatgaatttactggtctgcagatgcccacctcctgctttcttgttggaatatttgttcctaagatgtcacgtgaagatgatttcagtgtgaaccactgctagtgaacaatggggaaagcattgcttcccaggatggccaatacatacccatgcccaaggttagcactattcctatagcagcagctgagctggtacttaagtagtgaggttataaatcgagtggtgaggctgtttagattttcccaaagtagcctgggtggctggtctctccatttccctttatccatgagggatggttctgtctttctgattcagacattgttacatgtaaaaataaactccagccttattactctgacattttatatctggacattttttgatgtgggcataaggcttcgtggcctatttaactgaagacatagatttatttactcatcaattctaaagcaatattctccatcattcagtttcatagatgagggctttattcatttgaccagcctcagaaattagccatatttggggttaaggaaaaataaggaattgaggctgatgcacaagagattgtccctggttgtagatggactggctggctgcagaattccagttctgtgttcagccatgggtggtgaggtgggattgccttggccttaagctctaggagattaaatgtacagcaatttcctgaagctgagttatctctaggaagagagaagctgttctggggccttaagtcaccttacttgtgggtgggcaggatgtgaccttggctgggaggccctcatgcctgccccctctagctctctataaaccacttactgccattgaagattaagggaagagacaaatgaccatagcctgcctgccacctctttgttttctgatagtgggtgcagttgggggctggaggggctgagcaccaccgtaggtctctccatagtgatttctaggcactcttctgcccctgtcacatagtataggaacttctcctgaggccagtcagaatctggcagaactagtgtattatttgtttggcattgtttcccaggcttgccagataagacagtcacctttggaggctggcagtgggatggggagaggtttgttcatgataaaaaaaagcttcttaggcccttcctctagagaatttgattcaatagatgtagggtaggtcccaggaatctgtattttaacaaaccttgtgttattcctagtgccaggcaagcttggaaaacactggcttacagtaagaggttttgaaatgtgcaatcccatctcttgtcttcttttcttctgcagtatttttcccttttctgccttggtggcagatgctcataagaagatgactcgtatcccttggatcttaccacttcagtgtgctccagtgggatttccatctatttacatctcattgccttcctggggactcaggaaggagggatccatgagggatggttctgtccttcttattcagacattcaggctggaattaccccaggagcagccctcaaccaggacacaagaggagttggtgtataaataccccagctccatcacctctcagctgggataaatctgagccatgtcctgcaccatttcccagaatttcccagtgggattaaactctagtcatgcacagtaatagtatgcttgacaatgcactctttataggctgcctttccttcctgtctcacttacttgcttctatatttccttacgagcatttccttgcctctcaaataaactacagtcagttctgctataacatgacaaatgagtttctagaaaatcaccatgctatgcaaaattatgcaataaaaaccacagggcttgtgggataaatgagattagggggcacaacacttaaaaacgtagtgatatataaaaaataagataggaacctaataaaaattgtagttttacacataatgtatgttttaaaaatgcataagtacaaaaatagatatggcattttacctagaaaaatccctgaaggtggcttgtggaagtggtcattggaagagttgcagcttgtgacttaccatgcaagagtggaaggaaggtggtcagaaacccgaaggaaaattttaacaccagatatggatggttgtggcttctaaggtgaactgaggtagctggtcgatgttcaaggtgtgtgtatgtgtgtgcattttgtaaatgcagctcaattcagctgggtgcacttttctgtgttcacctactatttctttcagacaaaatggcacataagcaaatgtgaaatttgcatgatgcccaagtcatttcctaatgtatcagtcacactggaacaaatttttgtttttaagacaagcgtttagagcagaattttccatacttgtactagtgttcttgttgcagggcttgcttctaaacctagctaaaattacctatcaatgacagcttgatggtggttttattttttaagtggccctttctcctgttgaacaaggctgataagcaaaacacaagccccttcacacccaagtaagttcagtagagactgtggctggatataagaagtgacaacttaagccagaatgtccctgttggaggctctgcactccaagttacctggtctcacctactcattttcttgtaactcacctggagactgcaaccctgttttacaggtcttgagaatcttggctgcctatttacagtttcttggaacgggcttaaacctaaaatcaaatgtcagattattacgagctgaagcagaattctgtaaatgctcggtttcttcattaggggaaaaaattaacgtggaaccttggtagatatattactcacctgcattcagtgcttcccaggaggtaaaattacagtatgagctcagtgcattcttaatttcccatggtaggttacaaatgggctcttttctattctacaacttctttaatctcaataccttatttctcccacgtgtagctctacacaatcaagcaacttatacaccacatggctcatttgtctaactggttctgctttggtttcaagttcatgctttctataaccttgattttgacctgggtgtgcatgcaggctgcaagttcaatgtttttcagaatgtggacttcagatcaaccacatcagaatctcccccagagagcttgttgcaagcacagcttcttgggctccaccctagacctcctgaatcaaactattttgagagtggggctcagggatctacattgttttctacaagctattgggtgatgcttatgtgcactcaaggttgagactcactggtttcgaccagtgggtctcaactggggccagttgtgcaccacaaggggacatttgacaatgtctggaaatgtatttggttgtcacatctggagggaggtgctactgcctaagtaagtagaggccaggtgtgatggttaatattgaatgtcaacttgattgaaggatgcaaaatattcttcctggatgtgtgtattagtctgttttctgctgctgataaagatatacccaaggccgggcaatttacaaaagaaagaggtttaatggatttatagttccacgtggctggggaggcctcacaatcatggcagaaggcaaggaggagcaagtcatgtcttacatcagtggtgacaggcaaagagagagcttgtgcagggaacctcccctttataaagccatcagatctcatgagactttttcactatcacgagaacaccatgggaaagacctgccttcatgattcagttacctcccaccaggtccctcttccaacacatgagaattcaagatgagatttaagtggggacaaagccaaaccaaatcagcatgtctgtgagggtgttaccaaaggagattaacatttgagtcagtagactgggagaggcagacctatccttaatccagtgggcaccatctaatcagctgccagcgtggctagaataaagcaggcagaagaatgtggaaggacttgacttgacttgctgagtcttctggccttcatctttctcctgtgctggatgcttcctgccctcaaacatcagactccaagctcttcagcttttggactctttgacttacaccagtggtttgccaggggctctcgggcctttggccatagactgaaggctgcactgttggctttcctacttttgaggttttgggacttggactggcttccttgctcttcagcctgcagaaggcctattgtaggacttcaccttgtgatcatgtgagtcaattctaatcaactccccttcatctatacatatatctgttagttctgtccctttagagaacgttgactaatacaccagggatgctgctaaacttcctataagtgcacaggacagcccccaggacatgtaaatggtgccaagtttgagacaccctggtttcaaccctgagagatttctccaaggtctgctgcacttatagggctgtttcctttgtcattattttctttggtttctctgcaactggatggcttagaagcaacaaagttctctggataagcagaaatgtgtgggggggcagactggcagctttatgtgggtagaatcagggtcggtatgagtgatcactgactccttgaaagatgccttccccagaatccaagagttgaactataaatcaggtcagcttaggtcatcctagagatgaggggcccttgcagatttggagcaaataacacaaatttggagaagcagaatgggcttttctttcagtgtgtgtggattctttgtcaaacatactcagttgttattacctgacatgtacatgatacagtgaaagctggccctattcatcacctagggcagtgcctgtatgacccttccatgcttcatgtgttactgacctgtgcttactaaaaactctgcaaatatcttctaaatcatcaaagaggggttagtgtgtttaataccatttcaacattgggagtattccattgtgccatgaatctttgaaaactggtaattcatgtataggataaatggtgattcaactgccagctctgaaattctgagtctatattatataccaaggaatatttatctgttttataagtctattattcagtgataagacttgtccacattatgtacaaagaaggatgttttgactgctaactagtgagattttacaagttcatgtatattattgaaatgtttttgtatatgctgtagcttgaatgtagaacctctttcatctatagcctgttgaagtctggaaaaccttttaggatcctttaaaatgactaaaatgttaacatggtttggataattataatgcttaacatctattgagcactcacacctgccagatgctcttctaagcactggacatttattttgctcattcaattctcacaacaaccctatgggatagaggtatgattattaccattttacagatgaggttaaatatgaaggacacgcagctagtaggtggccaaactacaattggaactcaggcagtctgggttcttaacaagagtattattctgcctcaattacttcaaatgtagtcaataatttgtcacatctgacttgaatcaagtgaaataatcattaagatgattttcctggtccagcgtagaaatgggatgcaagccacatgtataatttcaagttttctaggagacaaactgttaaaagatgtaaaaaaaaaaaaaaaggtgaacttaatcttaatagtatattttattaaccaacatatctgaagtactataatttgaacatgtgatcactataaaacattattagcattttacatttttcttttgtagtatgcctttgaagttctgtatatattttacacttacagcatatctcaattcagactagccaagtttcaaataccccaaagccatatgtgacaactggccaccatattggacagtgcatccttagctgatacttggtgagaagcattaggcttggagaactgagtttgaatgattttttgaaaggcaggaagattgttttccaatcctgcttatttagctcaagtcagagagaggccttaaatgtttttccatattttgacagacttcagtggctacttctttccagggtctggcttctgcaaatggacccaagcatttataccctcatgtgcacacatgcccctcctctgccaataaatattcttgaaaggggatttaacttacaacacacacacacgcgcacacacacacacacacacacacacacacacacacgaagaaaacactgaccatctttgttaccaatgtgttattttcattagattgaggagtgtacaggaggggagagatgtttcatttgtgcctgtgtgatatcttcctatgtctgcttgacctttcaacctccacatactgccaacttggccccagtgtaattcaaatggcacacacacacacacacacgtgcacatacacattttaacccaggaatgggaatatatggatctacagccttaaaagcaaaagcttgttgcatggctagcccagaactcaaacaaagctcccacatttgtgtcataatggcatcaagtttgatgaaagacatcagctcaactcagaagcatatggggctgctttaaagcctagaagagcaagtgccttttgggtatctgtctagtggaagacgtctgtccctgattgctggataaaatgcacagaggcgccccttgaacactcagaccaacaggaacattagccattggtattgtcatctttcttttaattaaattcatgggagcaagtggttcttctagaaaaacacaatcattgagaagcaacatactgcagtgagaagatcacggatgaaaggttttagtcttgacttttgccattaactagccatgtgaccttcatccctctaagcctttgaggtaataaagggacttgggattagatttcaacccaggatgcacattagagtcactgaggagtttgttgttaaatgttgatgcccaaatccaattctagaccaattaaatcagaacctctgaggttggagccaggttgagaatcactggattaaatgatctgtaattttcctctaagtcttcaatgctatagtgaatcacctgttacagatagtatagcgtattacctacttccaagccttaggaaggaaagtgtcatttgcattgtgtgcctcctattccttttgaatcagtcagggccctggtttcagggtgggaagtcaagttgggctgctatctgcctcaaaatcttcattcctaaggaactactagtattggggagaatgttagagggcttattgtgttgtaaatgggccctcactcttttggtggaaaattaggggaccagagagaaagaagaggaggatttaggtgtctaatttcaaatgctatttgtttgtaagagagagaaaatccatttattttaattcaatttcatttagttaggccctttccagtctcagaaatgatttaaggtatcaggggagaactaatattaggtgtctccattcctccctcctgagaagagttccatggagaaggaaatgctctggtgtgtctcatccatattccctagagtatagatgaaatcagagtatttcaagggtgggtgattgtatcagtcaggaccagcccagtaacaaatgactcccaaatctcaccagtttacaacagcagatgtttttttcttgctcatgaaaaatgtctgatacaggtcagctacagctctctcctgtctccttcactccaggactggggctgatgggattggtctctgcctagaacactgctggcccaagtgacagataaaagaagagaaaatggtgaatcacacacttgatcttaatgtttatgctcagaagcgacacaacccttctgctcacacttaattggccaaagcaactcatgtggcccagccaactctgagttcaacagagcaaagatggggatgtgtcaaccttctgcaaggataaggatgaaaacagtaatacaatctactacggtagcaaaagatgctgtagtaaagagagtcacaaactcccatctacacaaggagtgaacgcatggccacaacccaagttagctcatagctgtcatggcctgcctctccccgcccctccagttgatctaccagagttcacttttgccctgaacacaccaagcaagagcccttgggacatactgtaacagcaattcctgtcatgctggcctctgctgatctttgacctttccaaaatccttccatctgctgaaagatgcttgtttgctctccatgcagatttactgatgacttgaacaaagatctaggatgggctcagcctttctacctggcggcaaggaagcatggtggctgggaacaatggttctcaaatttggctgcacaccagagtcacctggggagcttgagaaaatactgatgactgggtcctactctctgagattctgatatagttgatcttgagtgcagcttgggcttggatgattctaacgcaaactctgagaacctctggttaaaagcaccagcttcccagccagctgagacctgggttcataacttgactttcccatttctcagctgtgttgcttttgcccaagttactgtatttctctgttgcttggttttctcatctgtctctatgtcataggcttttgttgtgataattagaggagggtgaataaagcactaagtgttgtgcttaggttctagtaagtgttcaatatgtataataattgttgttactgtcatcatgctgcagcttcctgtgctgcacgaatgcctcctggaaaaaccagctgttctactagattggccgttgaagaaatggttgtaaaagccatactgtgctattaaacatgattacatttagcaatggtctaagcaatgggaatgaatgcagcttttggctttccttgacatctcgagacctcacagcagaaaaaatcctctggactttctggaaccctcaccactcattctttcatctccagtatggaaggcttattttgggggaagtgtttatgatgaaaccaaaaagtaaaaaagaaagaaatgtaacaattttgaaatgtgtctttccattgttttgcggcccattttagtttccaatatgaatgagcaagctgttgagaagtaagggggacagcatgttgctgtcttcccagggccttacacaacaaggaggcttgggccagctggactgagacccaggagcacttgcacacgcacaccatccgcccggatgttccggagtgtgtttgggtttcactttgaaataaaacatgaaacatgggaagtgccaggaaggggcagggtggctatcagattaaaagagctctaataccacttgaccacttgcttctagctatagtcgtatttctttgtggtttaggataacccaccgggaccaccatcctgagggacttaggggaaggaagagagatgatcactggtgtacctcccatcatcatcatcgtcatcatcatcctcatttcatttaaaataaggatgtagggctcttcagtcttttaattctgatttagcaagttctttgcctcttaatctctcaattcccaacataaggcatttcccactccccacccccacccccatttgtgcttatggagtttttaatgatttaatgagcaaatgtcaagacttacatttctgtttccaggaactagttcttgatcattcctaattctttgcatatgacacacacatcagagttagttccatttgacatttgtgaatttatgggaaacctcatctttgtggacatttaaaacttggctgcacccattgaatccaccctagggaataattttgcaaggttccctaaaggattaggcgagataaccaataacatgctatttctgtaaattccaattctgggggggctttgatgagaaaggcactttttcatttttgttttctttctcctgcaaacatggaaaataggaatgtctctgaatgattaagatctaagagtggataatgaaagcacagacagtgatagtcttgctgactgccaagaaagcaagctctgtagggatttgggactggctcggaggatagcatggattgctcacattctgtttggacagaaagcagaattgctggatctgaaacattttaccccttttaggaattgcttctccagttgtggacatccagctgggttaacatgctgtctgaagggcatcatgcttattgtcatgttaagagggattgtaagggaagagagggagagactggagagaagaaaattagcaatttttaaatggaatttccctaagcatgattgggaagtagaaacacatttccatccattctaaatattgccgtcattatttgggtgaaattgtgcaagcatgaaccctctttcttaattgcaagtgtaatttcaagatggagaagaggctgtaagtagagggtgttttcatttatttgaactgggatgcataccctgccaccactctctttatttacaggtgtattttagagcctgctttctcaaagtgggatccatggagccagcagcatcgcatcgtcagggagctcattagaaacaaagaccctcaaccccaccccagacccactgagtcagaatctgcatttcagccagggcccaggatggctggctcgcacgcacagtacagtctaagaagcattgctcttgagaattttaaagagttataggttctttccttgctgcgttgactctctgcaacccagttacatgaaggagcccaatttggccctctctaaggagcacaaagctaggggcctgtgtgctcagaaatgttatatccatggtgggaatagaaatgttctgttccagaaagtctagttggagggatggcaggggcagggtggcagatctgtttgagatgtctcttgtaatgtgtgaccaatgagaccttgcagaattaagctgggtctcccatttctctatgcttttgctactgaggaaaatctccagtgagttctacctttttctcccttccctctttttttttttttgagacagggtctcactctgtcaaccaggctggagtgcagtggcatgatcttgggtcactgcagcctcgacctccctgggctcaagcgatcctcctacctcagcctccagtatacctgggaccacaggtgcacgccacaatatgtggctaatttttttgtctttagtagagacagggtcttactgtcttacccaggctggtctcaagttcctgggatcaagtgatccttccacctcagcctcccaaactgctgggattactggcgtgagccaccatgcctggcctatcccaccctctattgtcctacaaatatctattacatctaatgcattatatgtttccaaaagtgcttctttgggagagatgtctgctcaatttttgctgcttaattttcttcttttaatcattcattcattttgcaaagccaaatgtatttttatttgcaagtgcttcattttcattattaagctagctaaggcctggtcaccatagctgaagcaaagtggaaaactaagaaacggtcttcatttagctgaatgatgttggaaaatcagggtttggttccaattctctggataattccctggttgcttcgttttggtttggcagaggaagcagcccgcatgctcagcccttaactgggttttgtcaaagtcaagataccttgctctctgctcccctgggggctgtggcatgaggcccaggcttggaagacagagacaggtaggtcctgggccacagccatgtccagctacaagggccacttgagagatggtgtccactattctttgtggcattttaaggtcgtgctttctgattctctgctttgtgctgcctccgagtcacctggagcaagctcttagttagttagtgtgtggattctggcctcggaggaatgcagtggctcctccagagccgccccactgacctgtaggataagggggcgggaggaagagctggagaatatttcaaccttggctttttccagatggtttggcctggttggtgccatagcctctgaagaacctgtcttgggagtggggctctgtgtcaggcccacaatttccccctgggggcagctctgacacatttgctcaaatagtagccagaagccgcccccccccccccgccccatcccccccatccggaagcagcccagggccgtctgtggtccaggtttcaggagctgcagccgcctgggtgtggctgctcttccgaagttcccggtgctgccatctggaaaagccggactggatttcagttcaggcctggctcagagcaaatgtgggcttgctgtagcagggaagctttctttgtgaggtgctgatttagagaccccgaatgttaatttgtgaagttggtgattggcctgttaggagccatcttgtgacactgcccctaaatctttccttgtttttcttaagataattcctctccaagttattatgtgagaacccaacaaggccaccttcagtaactgcagttgggaaactgatgtggctccatcatgcagttctaattcatcttcttcctggtacctgctctagttacatcaagaagtcaggtttgcactggtgtatggttctatgttggaggtcagaggtcgtctctgaggttacattgtccatcacttgctaggaaaaaaaaaatggataaggaagactctttgaagaaaaactcacattggtgactgtcttttgaggagttgtccatggtcagcaaggcagttctgtcgctaagtatcatgagtctagcatgtgtgctcatggagctggaatatggtgagtaggggtggtagtggggaagtacagagtgcctgatggctctgcagggagagaactagggcaccatcaggctgagtcttagagcctggcaggactcaggcctgacagaatgcaggaatgctggaatggaaactgaggtagcaacacagtcacatgattgggtggacacagcagcaattaggaaactcagcagcaggtgccacttgagaggcagagacccagtcttcctgccagggatgtctttccagggcccaccccccaggccttgatctctgctgctgccaaaaatggcagggctgacacagcaggattgcttatctctactgagcagagcagatgaggaaaccgaggcatagagccgccatgagactcatcccaaggctcctgacagtccagaggcagagccagtagtgggggcagtctccccagatgagctgacctcaatggatctctacacagaagagggaaaacagatagggcggcatccagtaaataccccaaaagctcatcttggaacctgtgagtccctgcttgtgtttcttggcttcccaggtccctcacacctcaataaaagcccagtcttgtctttctctcccaacagtgccggcaaaagaaataagacctccaaccaccacagtggaaaacctgcaggaagaaaatgttcataaagagttgaaccatggcccgaagtggttttggttttctttcaaggcctgcagcatcctggagtgccaggggcctgtggtcacaaaagcttcatctcaaaagaagctaagagggggtccattctggggaatactctggacagtgctatgaagggcagctgggaagagagctggctctctgctgcatattgactactcgggggtacaattttgtcttgcccttacccttatccacccatagcaagctccgcatttggtgatgtttgcttgtttcactttttattttgaaataattaaaacttacaggacaggtgcaagaatagtgtaaataactcttgtatacctttatctagattcactaattgttcatattttgttgcatttatcccttctctcccccacactaattcatgttcatatatatgtgaatttttttgctgaaccatttaggagtaggcagctgtcatcaaactccctttaccccttgcatttcccaagaatgagaatattctcttgtatatgtacagctatcaaatttagaaaatataatatttatttcatacttttatgtaacctgtgtcccaataatgccctttatcacaattttcttaaggttcacaatctagtcctggatcccacattgcatttagttgtcctgtctcttttgtccccgttaatcaagaacagttcataactcttcctttgtcttcagtggccttgacatttttgaagaataccagccagttgttttatagaatgttccttaattttggtttctctgatgtttcttcacatttacatttggatttaggcatttttcagttggaatgctatataggcatgtaagtgatttgttctctggggaccatatcaggaggcacagatgtccatttggcccttgttggtgaggtcacatttgattagttaagctggtgtctgtgtagctgttctttttccttttgtaatgaacaaatataatttgttggaagatattttgacattatgtaaatatcccattcctcatcaaactctctccacctagctttagcattcattgaggattcttgcctggataatgatttactctaatggtttcatccatcatcccttctatatttgttagtccaaaatagtctttgattgggtgggaaggcatactaagcctgccgatcttagtagctgagctcacagggaggaagggccttgatttcctccttggactctgactgacagctcttttgaagcagtcctgttctgttgggtgtatgttttgacacatgtagtaactcattttggaaatacttattttttactagataactttcaaataagtttttaaatactttacaaaaaaatggtaggatgttggttgcatatgttatcatttatttttgtggcatctgctggaaaattgcacctggttcttttacacagtgttgatcaacagaaacctgatcatgatgatagcaataataatatcttctcaccatctgaaccctgctccagagaaagggatgaaattagagagattgtttgaattctgagaaggatggttggactaaaaaggaaaaccagctattggaagcagatgaattaagtaaaacatgaatttccaggaatgtttcaaaatacttgtgtgggagttctttttggaatgttaaagcagtgaatggcattgcttggaattttgtttttttctttattgattttggttcaaaacgaatccttaatcagtttctagccagttcatttttgtctattttttgcagcaatttactgttttgtttttgttttcttttttctttcttttctttttttttttttttttttttactacagtggaaggggtttttatgggagaaacctctgattattgttttagtgggcctagaatattaagttcttggttttgatttttgtctttttaaatagctctttatagcccatagtaagaacaaaggactaatgggggatgtttgggaggtttctcagctcttatatgttgttataacactggttgttacagttgccattaaggttaatgttttcagaacagcaccaaaagctataagcggacatgaaggaaaagcagctgtttttcataaaacttacagatgaaccaatgctagttactcctgtgatgagtgatctagagcagcctttccctagtgtgtgtgttccttggaatgtgcatgtgtgtatacacacagaagagagaaaagggagagttaagttcatggtcaaagaagtttcaaaaacattgcatattgtaactccatattggagaatcacaaggttaaaagagtatagttaatgctttgaatgttacacctttgctagaaaacaaactaccccaaaatttagtggcgctgaacaacaaacatatatcttagtctgtggttgagctcagtggttgttccagtctgggctaggccaggccaggtggttgtagctgggctagcgcatgtgtccacaatcagtgataggtcagctgaggcctagctgatctagattggcctcatctgggatgttccccctggcagtgtcctcttatcgtctagcaggccagcctgggcttgttcatatggtgatcacggaattctgagcatgcgagcagaagtgcgcaaggcctttcgagatccaggcttggaactcagacagtgccacttctgaattgcattggccaaagcaagtcacagaaccaaacccagattcaagggtttgagaaatagactccacctctcgatgggagggcttacaaggtctcattgcaaatggatggggagataccgaaaggggaatgattgcagccattttgacaatctagcagagagatcaactaatacgtgactggctattatttctatgcgcatttctgggtttgggagaatttgtaggggaggaggaaaagagatacagatcatttataattgcagaaagtaaaaataagacttcagttgagatttaatgagctaatctatttcaagtgctttgaactcgcatgtagtaagagctctataaatgttgctgttattattatcatgaatgcatatgtcacttgaggtcctcaacctcacttagaagtgaagcaggaagattcatttgacaacaaaatgaacaaaacttcagatacttgtgcaaaacatataatcaagtgaaggaatttaaataaaatacccccagcaaaaatagtctggagcacagaacagacattttcctctgggggttgaaggtgggaagatgtgtccagttttgccttctgtgaccagttcaccctgttgggcttgtttccaaggtaaggtcagagcttgccgggttcttgctaaactggagtctgtaataaagagggtacccaggtgtgaagagttttatgttctcaggacttgttctttgtttatttagttagcctttattaagtgcattggagccttggagggctctgcagtggcttttgttgcatgataaaggtggcacatagcttttctttggctgacttgggctcccaagtgaaaaaggcagagagggccctgccagcttccctggctctgccccttcagggcatttcagggagcagtccagtgactgacgccaaatgcccttgagcactgtgccagccctcttgactggaagctggggaaggaaactttctcaggccctctctctctttgcttctatttcccctttcattttgtggtctgagcagcccccgcccctccttgcgtaaacccctctgcagttagcatcaacaaatcccaagttgtttgtatgtgtgtctaaaagaaaaattctctgaggattagaagcagacacaatagagggagtgctcccttttgctttaatcacttcaggctcctacgtgttgacaggaagttttgttagtatccaagtttaaggaaaggagcattcaggggtggcattttttttcctgcgttgaattcttaaagtaagtttgataagatatctggtaaactacaagccgctccctttttaaataggcttcactgcccccttggcctgcctgtaaaagcgctgctcccttcaaagggacccataatcacgccgagtctgtgggttgcacgactatacccactgtcttatctgcaagttgagtttgatcttcctggctgaaacctgtgagatgttcctttatgtctccacattcttttcttccctttctgctcccaaccccacccccaaattaattggtgtctggtgactttttctaccgcttcctcttgttttctgtggcttttgtctagggcagtgggggagggtgattcttccctcacccccaggggacatgtggcaatgtctggagacatttttggttgccacaactggagaaaaggggcatctggtgaggagaagtgaaggatgctgctaaacctcctacaatgcacagtgcagcccccacagcagagaatgatccagcctcaaatgtcaccagtgccaccacaaggagcccctgatctagcaggttgctttctggtagggtgctcctgcttctgatatggctcctccctctctctcttcttcctcaagaggactgttcttgtgtctagtattggttacatcacccctgcccttaaataactaaactcacagaaggagaaaatttttccttaaggatgctactgactctggaatccttgagttacatgtgaataactgggtcgtgcatgtcagcattaagaaataatcacagaactcctgattctggtttgctctgggtggcagctgtgctgggtttaccaatggaggaacttcatggctgctcatctttgactctttttctgaggaaccaaatctctctgggagtgctggctaactcaccccttcttcaaacacgctgtgtggcttcaggatatggctgctggctttaaaaaagaaggaaaaataaattaagacacccacactgcaagacaacccctgtgagtatatgttatactgggaatgccccatttctcaaatatttataaatatatggtctcttggagtgttctaggtctgtcatttgggaaggttagacagccctgggccactatcctttttcgtaagcacagggcactttcacaaataccagattgacagctgggtgatgccaagggaatggtgatgtgttgccctgtgtatatctgggatgtgttagacatccctcccttccttctttttctttgttttccctccctccttcccttcttcccttccttctttcttttttcttcctccctccttcccttcttcccctcctttctttccaagcacatcagtgagaatgtagcacagcttggttttctgaagtccgtcaactactgtgtactgcttgtcaagaagggtgctatataagctgaaatgctgctctaaatttcacattatcccttcctgctgctcattgagttatttaattagaagctgccatattttctagggaaaacactttgaacagaaggcctgatttcactgagaatggatgcctttattatgtgtcaaggagctaaaaattgctagtaagatgtcagtgtgtatatgtatatgaaatacagaaaagtgcatgtacatatatgaagagcaatcaaaagagaaatgcgaaggggttggaaaatgaagaggtgtcagatccagtcgatgatttggttcctgctcaggagtgtgtaagcttcagttggctccagtttggctaacactgcaatgcctttagtgtcactgaagccgacaaagaaagctgacgcgttgtttttctagggggaaaaaaaatgctctccttccacattcccagtgcagacaacagcagaaaacagaaatgagaccgtactgcccagagtccacacagactccaactcaaagtctttgaattatgtattcaattcttgccactttgcacattttcccttaaagaaaagagaaaaaaatcagttcatagtagctcttaaaaagcatggaggggcattcaggattcaattcatcctgagaggcagattttaagtttcattcttagaaggagatttcgtgtttagggtatgacagtgtggagttcataggaagggatgtcagctaaaaccaactgcatcctgtcttttgagtttgttttacctttggtgtcccctgttgacatgtgcctttcacttcgcttggagactctctggatgtgcaggctgcttcatgtcctttaggctcttctgtggcagccaagggggtttccttttttcttccctctatttctgggccacagagaggaaagaacaaagatgctttccctgcactgactccaagttgaagctagtcaaactcccctctgaaaggggttaatcattttaaaatagctcgagaataacttgaaagtgactttcagtgaacgtgtccagagatctctggatttaaatcccctcccctcctctccctctccagccaggtcaccggatgggaatggcttatttctatctgccattaggtttttcagccctgccgagagagacgccagtgctggactttaatgtggaggaaattcagttaaggagcatgacatttctcaggtttctggagagatggatgttttggcttatgttgagtgctaccgaccccatttgtcaccagcaagcaggtggatagtcccttaacctctcagaatggggtgaagggatgatttggacccttgctactcaaagtgtggtccttggactagcagtatcgtctcccctgggagctggttagagatgcagaatcagggctccactgctgaccgactgaatctgaatttgctgtttaacatgatccccaggtgattcagacgcacattaatgtttcagaagcgctggtccagggcagtggttatcaaatttgagcatatattggaatttgtttcaacaatcctattaaaacacagattgctcagccttactctcagagttttgaatctatcaggtttgggtcagggccagagaatctgcatttcatccttttttctttttttttcagacaaggtctcactctgccgcccaggtttgggtaccgtggcacaatcatagctcactgcagcctcaaattcctaggctggtcttgaactgctggcctcaagtgattcccctgcctcaacctcccaaagtgctggaatttcaggcgggagccaccctgccagccaaatctgcatttcaaacaggttccctggtgatgcccatgcttctggtgaggtggaggagcacacattgggaatagctgctctcgaggaaccctggcccttctggcagcctttatttctctctccatggaaaccctcgcaccagccaggctacccttgccccctgcctcatgcttttaattcccttccccttcctccttttggagaggccagtacctcccccttataaacctcccccatttcctagctgtgaatccaaacccacactttcctttcctggccactctgagctttctcatcccccttcagtggccccccagttcttcccctggtgccccagccttcccagttagattgcaagctggaagtgggcctccccctccctcactgtccccctaatccatcaccaggatcattcatttcactgcccagtgtctctcagatccctcttctgccctctaccctaactaccacccctgtggtctaagccccatcttctcctgcagctgtctttggaggtctccttgtagcctctcttgcatttgtccagtctcttttctactatcaagtccaagtgacctattcaaagtttcccgcaccattattcccccctcctcctctgccactgcttcagctctttctgtgacaccattggtcgtagcctacaatcctgagcatggccctgaaggcctctagggtgggccctggctatgcttctgtctttctctctgctgccctcccttggctttgtgctgcagccacgctggcctattttcaggcccccacagggcctttgcacaagctgaggtgctttctccagccccacctcacctgcttagtgcctcagcatcctgccaatggcccctcaagcttccccagggaggctttctctgaccttctccagccagtgagattcctttgttgttgaccctccttcttatcctcatagtgctttttgccctatgcagttatatatccaaagtgtgacaattggattaatgcgtgtctctcctgctagactgtaagtttcatggagtgaggacccattcatttgtgttgattcttgtctccccaggagctggtatctagaatgcacccaacaaatatttgttggtgaagccagtgggatcctttgcagctccatgcagtggttcacaccccacatagactcctaaaatatgacactggaaaatgaaaactttttaaaattgttttaaatatataagaattcagctctgaatgtctagataattggtagcatgaattggccctcgaggtcaggaagacttctttgctctggttttaattagtgcaaagcggaagccatttctatgtaaatgaatcaatccatcgaggcacacttctttagccctgattatatgccaggcactggaccggagccccaggaaacaaagatgaatgatatagtccctgcccttgaagggaggaaaagcagatggctggtccctggagaccttcctagcagtaaagaattcagtaacagtatggacgatggcaccagaagtgtgccttgagtttcgtatcaacctcagtgctcccctcactgtgcatttgaaggcttcctcctttacaaagacaagagcaaattcagagagcctgagacgtcaccatgagatatggtctatagaatgtctcccaggaagggatgagatcttggcccttcagtgaaaatgccaacattattggaagaaagcccagaccaaggcaggggctagggctggggttctggagtaaactaactggcatataatcagggctaaagaagtgtgcctcgatggattgattcatttacatagaaatggcttccgctttgcactaacctgggttcaaaccctggcccggccacttactggtgggcaacttgggcccttttcttaacttatctgagccttagtttctcatctatgaaatgggtataatagcttctaccagtagagccatggggaggaataaataaaatcctgagtgtgaggcattcagcacaatgcctgtagtatagagatgctgaatctattgttatgatgagtattagctctgcagagcagggcctaccaaagacctacgtggatttttctataatgaacaacaaccatcaccagaaaaggccagtaagttgctggcaagtgtctgccccgcccaccacacaggagtgtgggggcagcaaagacatgggagagggccaaagctcttagagaagtgaaagtcattggcatggctctatatggaatcgtctccagtgtgtgagtctgtgtgcttaagtcctttacagatttttcggcaacctttttttgtaaggttgctcgttgatttttatttttttgagtgagacagggttttgctctgtcacccaggctggagtgcgatgacacgatcatggctcactgtagcctcgacctcccaggctcaagtgatcctcctgcctcagcctcccaagtagctgggattacaggcatgcaccaccacgcctggctaatttttgtattttttctataaagacagggtctctgtatgttacccaggtcttgaactccggagctcaagcagtccacctgcctctgcttctcaaagtgctgggattacaggtgtgaaccactggccctggccttgttgacttttaaaattatgacttttaaagcaatcagggaataatcactttcaagtactgagcacaaagtgatgactcctgctaggaagatggacagggctggggtcataggcatggtcttgggtcttggagaactgagtttgcttcctgacacagccctttgggtcccatgaccttgggcagcccccacagcctctctaagtcttgctttcatggcctgcactatgaggttaatagtaatgcctattctgagggctgttttgaagattacatgacataaatacagaaatgtctaacactatgtccaataaattgttgtttctcttctcttgccattaatatgcacttttcttgagcaaaagtcttgtcagcacttaacagaattaattacaaaacctaattaagggagtctataagtgtgatattttactgttttctcccttttgatgatgagttctctaacctactgagaggaagaaagccttcttcggactgttgcctgaaaggtcattgtgtgtgtgtgtgtgtgtgtgtgtgcatacacacgtgtgtctactctcacattaacacactttgcccaggatgcattcatgatgccctggcagccagtgggtctttggaaggaattcataggattgagactatgagttgatttcatgagcagaaaattgtatattttgatgagagaacattagagaatgcctcctgaagaagaaggtcacaaggaggccagtgtggttagcgatgcctgggacattgattttgggaagtaatgccatgtttttcttcccccaggcctatagctacctttgcttagccagcacacgccctcatgttggagacctaggtggctcttggtggatttttgtgttgctgtagctttcctgttttgaaagttagggacaagagctcagaaagcagcaatgtcttcaaagagagaagttaaaattctagttatgactctaatgactctagtggccccataaatggcaactccccagggtctatggcttcatgagagacccttggccaaatccactgtggggttccaaaatttaattgtatggactcttccaagcataaaggcaagtttataaaaaatcatttccaacaatttccacaggccctggttgtttgattcaggaactgaataagtgcccagattcatgttcaatgtttgtccttgcttttctagcagatgctattggtgcccacccacaagttcttggcatctggtgtcccagtgcacacctggagagtgtcctactccaagtgtctgcagttctcttcctgagggctttctgtcagccttcgagcagggcaggcccagagtgcctggggattaatgttcctgaacagccttcagtcaatgaaagatgagagctggagaatcaataccctagcttcctcacttctcaggtgggccagctctgagctgtgtactacagtgtctcccagagtctccaaacaagattgaacctcagttgcctgtggcagaaacctgtttcataacctacctttatagcttccttcccttccccgtctcacttaccccctctcccactatgtttcctgaaagcatctcccaaacatatcccaccatttcctctgaccttggggatttcttgagattttgtccctcttctataaaatgatggtcacaggttgcttctgctggggtgtgataggtggatcaggtggaacaatgatttgttgcatgggatgaactgagcattccaggtcatctagaatctctgtgcctactagaagcagtaaggaaggccctctcctagtcacaaccaaaagcacccccaacactgccatatacctgtagggggcagcaccatccctagtcaaacaccgctaacagatatttctcgtctgctctagttttgacatcctaaggtgagttgattgatcaagaacctcagactgggatagcgcccaccatggtatatttcagtctggggagtggtgaggagtggccgaatgctaactttttcttttagagacagggtcttgctctgtcacccaggctggaatgcagcagtgtgatcacaggtcctcactgcaaccttggactcctgggctcaaacaatcattttgcctcagccccccaagtagctgggaccacgggtgcccaccaccacactcggctattttttaaaaagctttttgtagatatgggatcttgctacattgcccaggctgttcttgaactcctgggctcaagtgatcctcccatcttggcttcccaaagtgctgggattacaggtatgagccactgcacccagctggtaactcttgaatagattctgtattgtcagaaataaccactgacttgcctccttcctgaaatgtcgaagaagggaacatttaactcattccctctgcttccctaaactccttggccaagttccccttcattcatttgacaggtcttccctgtgtctgtagctggtgatgaactttaaaaacttgcatttgggctgggcgcagtggctcacgcctgtaatcccagcactttgggaggacaaggcaggcggatcatgaggtcaggagatcaagaccatcctggctaacacagtgaaaccccgtctctgctaaaaatgcaaaaaattagccaggcgtggtggcgggtgcctgtagtcccagctactcaggaggctgaggcaggagaatggtgggaacctgggaggcggagcttgcagtgagccgagatcgcgccactgcactccagcctgggcaacagagcgagactccgtctcaaaaaaacaaacaaacaaaaaacaaacaaacaaacaaaaaacttgcattcggacctatgtgtgttccaaaagcactggctctttcttacagccagctcatccctgggcaataacatctccagctgtctctacctagtcagagatccatgtgtagagtatagagggaaggaaaaagtactggaagggttgctccttctgagtcagagtcagatttgtgatttattgatttattcctgaaccatttgttgttctgctagtggggtggtttgggattttctctttcttacagaaaagttagaggaacccaataaattgcttctttttctttaagaaaatctaaaagtatattcttgtgtgggcaagataggtctcacttatgccacacacctaaccactgtctgacacgtaggaaactttctataaatgggtactgtgttgactaatcaacaagttgttcttgttcgttgcatgaaacctttgagaatgtttctttgcaaagcctctttttttccattctaagacggtatttgaagaccatgctaccaggcttttatggtgtatggtgagttgaatttttccaggaaggaaacttttggggaattctaatcttgattttctataaagtgattgaactgtggagataaattgaaatatgagtcatgaaatgtattgaaatagcagcaaagtcttgccagatggaaagcaaagcaaagactcttgtcatgtccaagcaagacaaagaccaatttacaaaaaaaggataagtggggcatcttccttccatctgtcccatctcgggcacgtatatggcaccaaacttgaagtgaagtttctggtagatgttttgcctgttctgttaggttttggaatcagcaaaactgaccagctaagttcgatcaaaagcaccattaggagatgagagctttatctttaaatgtgatccaagcataatgaacaatgaaattcctgtgattaaaggtttaaactggagcaaatctacacctagaagaagacagaatctctttggatgaggaggagaaagcaaagtgaattggaagtaaattatgtagctgaaaaacttccagtaatatgcttcctagcctgccccaggcagagataaggacagggtcctgcctggtgctatcctgagctaacttctcaaaaatcagacactttggaggtgaatttctgtaaaaggacaaagttgaacttcaaaaaagaaaagtatcaggtccccccaaaatggaggtggcctgttggctcagcagagtggctaagtcaagtaggaaatgtggtgtctggcctagcagtgacaggagactatgttgcattaggggttagacaaaggtcagcaaagccaaagggtttaaaagaggcgggagtggggactgtcctgctcagcttcctgacccgccaggctgatgtcagagggtttattcagatttgagggcttttgtttggggggattggagtgattcctaagagacaatgcccgactggaggctgggggcacgcgacgcctgaattgaatttgggcagttgctgagcagatggggatcagaggggaaaacaaaagggaagctgttcccagcacatccacaggaagggagaattgcagagccagccacgggcaggagggcttcctgctcagcctggctgtggaggcctccagtgcccccatcttgcggaaggccaagcattcccagggctagtgggactttggctctttcgcagagaggagagagggtggaattggaggcaggtcaggagcatgaacttcttgagttcagatttcaggtttgtgcatttcctcatctgcaggctggcaaggttcctggactcatatagtctcacaccctcattttcaggtgcgggagctgagacctgtaaaagtgcactgcctttcctggactctgtcagtgtcttaggttggcttcctctaaaagcagacatgacatgaggaatggagcaaatgctctttgctcaggggggtcctggaagcagtggttagggcctggagaggtaacacagggacgagaaggaagctgacataggtgcactaaagagtaggctcccagcgtgggcaattggggcttcgtcctgttggggacctctgggaaactaagcagaacacacgtcagagtttcctgcctaggaggtgaggaagctggggtgttcttcataattcctgccctttgctgattgctcccagagatgttgagtcctggcacttctgtgctccagtgaccagagaaagccctcagggagagggtcataggtgtacggagcaagaagccatgaacacgtgcaaagtgggaaggggcttcaccggatagatttctggtcatgctctcatcaatttccttagcttgtggggaagccaacctttctgaggccaggaaagcatttctctgggtgcccaatgttgcacagacagatcaaaaccgcttttctttgctcttaagtggggcgtacacttctcttcttcctgggagcgcattagatgtccaggttggatgtacagtgactctccctctctcctgcttccctgtctagccactgcccttgtctttctgcctccctttcagccaggctttttggctttccattttatttccagtaaaagccagagtcccaagcacctacaggagtctacatgatgggcacatgccctctacccacatgcgtctctcatgacacctctaccatttttcctctttctcactgcatccccactgcattgcccccttgttgcttcttaagcctaccatatatgcagggtcttccttcaaggcctttgcccttgctgttccctctgcctggaatgctttcccctgaaagcatggctctggctctttcctctttaggagagagtcatatcttgccttattggttagtgaggcccttcccaactaccccatttaaaacagcacacaaccactccctttctctgtcctccttccctgcttgatggttctccacagtccttaatgctctgcgacatagcatataattggtttatttaactttacaccatgtatctgcttctctgcttggcctttcttgaatataagcttcatggggtcagagacctgtgtctggttcactgctgtatctccagtgcctagaattgtgcctggcacatagtagatgctaaacaaaattatcgaatgaatgatcagtggcaattagaacatgttttctctttttcctcccttctctagctcctagcacatgtctgggacctttctgccctaaaattgaagcatccccagggaagtttctccttgtgcagtagacagaacagaggctttggaccctagcagaccttggttggaacccctaggttcaaaatccagctcctccaaaattctaaacattaccagctcaccaatatccagctctcccctcctttgggcacatggaatcttacactcctcagtgctctttaatggggcagggtcacatgactagttctggccagtgggctttcagtatagaagagcaggtgtgaggtttctgtttgctcttgtcacctgcctcagcaaaccctgaagccacatgtggagatggtggagcctgtgtcagcctggatccctgagtaatcatgtggaacagaggcttccactatcctgctttggacatgtgatgtgaacaaaaagcaaacctttaatattggagttatttgttgctacagcataacctagcctattctaaccaatagaattaagtactagtggtgttgctatgggaaagtcatttcactctgagcccatactttctcattcgttaataatctttgtaccatagggcagatgttcaacatggtatgttgaacacactcatactttaacttatgacttccacagtaaccctagggaggagttgctgaggactccatctctcttacagatgcaatatctcagccaggtagacatagcattatgcctttacattcagaaaaggaagcaaattctgtgacatgggactatcagggggtttcttggtgcatttgggccttgacctgggttctttagaatggcaaattttgccaccaggaaaaggcagaagagattgtgagtgataaaagctaaagcagtctgggccagaagagctacatatgagttctgtgtctatacagcatgtgactttgttatttgagaaagtagaatgtcaggttgagggagagaaaaacagatcaggccaaaactactaggcatctgatttgggtggtggagagagggtgggcagaagagaacagaaatgatgaaatctggatcctagttcttgataaaccgtcaaccctctgaagaacttgggaaaattaatttcacttatctgaactctggttagggcaaaacacaagtcatttcccaagagtctttaaataatgagcatcatcacaattgtaagggctcacactgattgaatgtttattgtgtgggctgggcacggtggcttatgcctgtaatccctgcactttgggaggccaagacgggtggatcacttgagcctaggagttcaagaccagcctgggcaacatggcgagactccgtctctacaaaaaattagctgggcatggtggtgtgtgcctgtagtctcagctacttgggaggctgaggcgggaggattgcttgaatctgagaggcagaggtttcaatgagccaagattgcaccaatgtactccaacctgggtgatggagtcagatcctgtctaaaaagtaaattaaaaaaaaaatttattatgtactccttgccttgcctttagtggattacttgaatcaacccatgtgactttctccacaatgccatgtgatagacactgccattgttctcatttcacagatgaggaaaccaaggcacaaagaggttaagagacttgcctggagttaagtagcagagttgagagtcaaactcagatagtctgacttcagagccaggtttgaatgtgactggttcctgcacaaggcttttctatgagatgcgtaaaatgctttagtggacaaatctttccatttttccctctggagggggtttaagtggtatttgtcttccttctacctcacagggtgattgtgaaggtgaacagcttagtaacatactgggagtgggagtggtgatacagcccactctgcaatgcagggtgtgtggttaaacctgtaaattgaatgttgataatgataatgatttttactttacagataacatttatcacatgttaataaaatataaagtaagatgcacgtaagtaaagaatgtagttactctgtccagaccctctggaattttttaagggtctttcccccacttcagctttgatgggctttcagcggccagccctgcagctcatctttggactattggacctgcattgatcccaggatgaaagagcccaaggtatctgagtttgcgaacacacacacacacacacacacacacacacacacacacacacacacactttagccaaagactgatgggtacaagagcccagctgccttacctcaaattgagacaactttgaggtgtaaactcacactctagagttccctgtgcgacctcagtggaactttgctggagaccttcgccttgcttagctcttgcccttctctcttgggagcatctcttatccaatagcttgtaatcccaatttccttgggaaacaatgagaagagaaaacattgaaaaacaaaccagtagggacatctaaagcttcaaaagaggcatggcaaggagggcttgatcttcttggtttgacaagtcattgtttgctgattgcttgacatccattacagagccaggcctgccacaagccatctctgccctacctccctgccaacattgtcctgcaagacggccagggccttttgaagcagcctgtggagagcctgccagggttctgtgtacttgcatgcctgctctccggttgcagaggagcagtttttacatttctgccacttgcctgacctgctgcggcaaagcagcccactggggaaacttggcatcactgcctggcactggtgcttattccttcctggcattggcccatgccagcaggaacaaggacagtgccaagcatgccaccatggttgtgccaaccagttccactgcagcagtgccctgaggatgcttgaacctgcctggctgtcattacaactaatgccaaagacattgaagggggttggccatttccttgcaattttctttctccaagcaattgtggcttgctgggtcagcttcagaagcatttattattcacatgtctgaatccagagaaggtagagcttctacaaagtgacacaaagggaacttttccttatggaagtcctgaatccagagagagagagagagagagagagaaatgggtgagaaacagaccacagagacagagaaagttgaggcgtgtagtactcagacctgggttcaacctcaaaatccatgacttctaggctggataaccttgggcaagttatatgagcattctaagccccagttgtctcgtctacaaaattggtagaataattatatccagcttgtaggatttttatgaggagtaaaggagatataagtaataacacagtatataacacacagtatttattcaattaatgttagctgttatgattacttgtatattattaataatgtcctcatatatgttttatcctctgggggaggtggtataaaccagtgcttctcaaactttagtacataataatcatcaggagagttggtcaaaatgcagatttctgagccctgcccccagagattctgattctacaggtctttatttgtaacaaattccctggtgctactggtgatgttggcccacgggtcacactttgagcggcagcattggtataagccacagggcagcattatccttatctgcaacagatattctgatgcatttgagggatggatacagtgcgtttcgccttagttcttgctttacctgcctgcaactcctattccatttggctgcagaatgaatgcttaacattgtcctaagcactgataagatgaaaaggcagaagctaatgcctggaaaaactaacataactaggaaatgcttagagcttgaaggttgatcccattgctgaacctgacgctacttagaagtcagaacatattccagtcacagataagtatgggttcctcttcccagggaaggcagacggagctgatggaaggaaaacatgcgcattgtctgcttctcttgtacagaggtcatgcagggaggaaaataagggtgcttcagaaatactctgtaggcagttcttgttttttttgttttgttttttgtttttgtagttatgagacatgaaatcaaagactattactatcaaaataagaggctagatggctctccatgtcctgtcaatttcccctaacatcttcctgtgtcagtgcttctcttcagagttcgggattttgctcccttttccatgccccctcctctttttccttttgataccaggagctacttcacttaaaagtgcctggattctaggagtaccttggtttggggcccttcaaggccaaaatgaagataaagagatggagctgcggggcatatataaatcatggtttctttcttataatttctttccagattgttctaattgcccacaattaggaaatgtcacttttatagtcagaaaacctagataatattttctttcaatcaagattgattaagtctgtccatagcctataacaatagctaatatctcttaagtgctttgtctcagccaggcagacgctatgctaagtattatcatgtataacgtcatttaattcttgctacaaattgaatgagattagaattgttgtccccattttatagataaacaaatggagacacgaagaagtgaagtgacttgttcaatgttgtagggctggaaagcgacagagataggatttgaatccgacaatttggactcaatttttaaccatgatgctttgtgtataatccccaccatgtaaaaaatataagccaggcaaaaattcaagaaggaaatgtatcaacatttgacattgatttgtctggatggtgcaatggtacgactatggacttttttccttctgctgattttctgattattttctcaatgaccatatactatttttccaataaaaatactttatttatttatttatttatttttatttgagatagagtctctgtctgttgcccaggctggagtgcagtggcgcgatcttggctccctgcaacctctgcctcccgggttcaagcgaatctccctgcctcagcctcctgagtagctgggattacaggcacccaccaccatgcctagctaattcttgtatttttagtacagacggagttttgccatgttggcccggctggtcttgaacttctgacctcaggtgatccacctgcctcagcctcccaaagtgctgggattacaggcatgagccaccacacccagacaacactttatttattaattggaaaaaatcacttagctcagtctctttcctccaagttcaatgtctaaagtcatcccgggcagatgatcttttgttattctgtgaagagtcccagcgacactaactctgcaggagctagtcagtttggttaatcattccatagatttacctatgtgaggccccagaactggctgactccattttcaggatggaaggactgcttgtaatcatgtgctctccctgctgggcagggacctgctgtcaggaggctgtgccctttgagctgttcctccaggtgttgaaatgagcttgtgctgatcatccaaattcctgcttagccaccttcatgccccaaagcctgcattgaagagtgtgatggccagggctagagatcaaacttgtgcccttggcctctttattgatctggggaggctaattgctggaacaagcaattcccaaatctcagcagcttaatacaatagacatttattatttgctcggctaatagtcccatttcaacgttttctgtttcaacatttggcaggaggtcctccacctggtcgttcggaaaccaggctcttccactctagagttttccgttggatcgtctatacctggccagtccacagaggaatcttaccggtaggagatgtctgtgggccaggtttggaagtggtgtacatcacattggccaggactcattcacatgggcacccctgactgtaagagcaattgggaaatgtagtccagctcctgcctggggagtccatagctgtctctgccatgggcccattcatttgttcaataaatatttttggagtgtctgctgtccaggtactccatacattggtcagtgtccaggcccatggacattgtttgtgtcctgtttgctgtaggaatgaggcattttgtctgttctctaggtcagagccagatttggaagggtcctattcaagtccaagcggaggtcactgtgcctgacttctaatcttttggaggagtgcacaaggtgctgttacccctacaaacaccatagttcccatatcagttgggattcagcccagagaagagcaacatgccaattattttaacagagaatttagcagaaggcattggttaaacagatcttagaggatggaagaggcagaaagtgtagcagagatgggaactgcagaaagcagagaacacccttaagactgggctgacaaagggaagggattaaggttatgagaactttggagttaataccctgcagagctgagacccagacacctgaggaggaagtgctgcctggctagtgctggtgtctcagagggggtacagtgagactggctcagggactgccaaaaaaagggactagattctggggccaattgccactgcctgaatgtagggctattattagggaatgctcatggaaacaggaggaaagggaggcacaagccccttcttcttcctccatcctgccattctctgtctcattcccctcctggcagggccaaacagggtgcagctggcaaaacagaaatgaggtgtgcagagtcccagccctagtatcacagggcagagtatagaaaaagtgggtttgaaactgagagacaataacttaaaaaatggtgcgggggctttgtttcaagctcacacaatttatgttttggctacatggtgcaaccacagtggagcttcaaggggtcactcacccagagaaacctctgagtatgatctattcattcattcattggttcactgagcacataactgaatgccaggcatgtgcttggtactggagatagagctataaataaggcagttcttgcccacaaggagctcacaccacacctgtacacacatggcacacacatgcacacatatatgcacgtgacataaatgaaacaaggaatggagaagcactgaaagatctggaattaaagacacagggcttttttattcttggctgctgccactgaaagattgcgtagaaatgagtttagcttttctcattgaagaaaaatgagaggaggagaaggtggcatttaacacgtccttggcatggcatgatcattgattgttctgctgcctggacttgttctactgatcaggggtcagatcaagtggaggttgaccttgactcaacagaatgagaaaagtataaaataaatgagggcagtcaatgtatgctggcctcttggaggcctctgctttcctccctggggtccaggaggagtctgctccttttctttgcacccttcaggcatttgctgcagggtgcccagagctaaactttttcttgcattgggaaggtggtacattttccatgattctgtgtgagtggagaagaagggccctgcaggtatgattttttcctttagtgtaacaagttttccacatgggtgtcctcatttgacattaattgagcacctgctgtgtgccagtcacaaacaaccagacagactctgtggattcaaagcagtgagcagtgggcgctgctgagcccatccctacccctctgatccaggcaagtcacgagtcatctggatacccccttttttcgtgtattgagcatcatgttgcagggaagccacatactttccttgagcctctgttttctcatctgtaaaatcggaagtgagattagatgagctcaggagtccagccagtattcattcagagcccactctgtgccatactctgcatgtctctaggctgtcattatggtgacccatttaacttagcatctcccatacagtcctgattttatatagtttaattcctttcaataaagggacgttctaaatatataaccaaatgtgatttaatgttttctgttttctttagacattttatctgagttgggaaaaatgaggctaagtgttagaggtggtggctatggggaagtaatgcaggtgtttctgttatctcttgctgtaacttagtgacttacagacacatacacttattctttctcatgatcctgtgggtcagctgggcagactgccaggtctgagctgactcagcagggctggaaggtctaggatggcctcacctccatggctggcgtctcagctgcagcagctgcattgttggtcctctctccatgtggtcttgtgccttccaggaggctagtccgggcttgttcacatggtggtggaagggcctgcagaagcaagcaggagaggacaagcctggaagcacaggtgtttcttcatgtctctgcttgagtcagacttgctattttctcatggaccaaagcaagttgcaagaccaagccagaatcagcataggtggggaggacccaagggccattctgcacacagtttttgcttgatgtaatagataccagatacattctggaggcttgtttccacaagggggctggctggctagagggaggccaactgtgaaggtgtcaaggacatggagcttgataagaaaaatggtgaggccattaagagccaggaaaccagaaggaagaatagatttgacgaatgagtttttttttttcccatgcagattggggtgcagatgggtctcacaccagtgctatctaacagactgcttgaagtcattcagcacatttttcctgggctccatctatgtgccagttttgtggatccccagggaacagaggctggggtgggggtagtaacatagtagaatcatatgagttcttgacatggacatgatgggagaaaagatgaatttactacaggagagattcaagactgctagaaactagggccatgcatgtatgcacatgcaccacacacacacacgcacacattcctgcatgcacatacacatatagacatgcatgtgcccatacacatgtatgctctctcacacacttgtacacacatcttcatgtgtacatgcttgtacatgccacatgtgtatatgcaccacatacatgcatgatcttccagacagcctcagaggactcacagaagcccatcctaggggatctatgaattgcagaataaaagctaggctgcagagagaggaaaaggaagagggctgacaacaggcccctgggggatggctgcccccccttgcttttaaggtgaacgttgaatcaagacaccaccatgctctgttctgcataatgattcctgaagtacaattttgtaacgtcatacttgtcccttttttttaagaacggggttgacacatgtctgtttaaattaattttcccatctctatggatgcatttgggggaaacaagttttcctgcttaaaaacaaagagggtgggggtggagagactggaagaaagggagggggagacctatttgaaaaggtttcaagatgagtaggcccctcattaaaaaaaaaaaaaaaagaaagaaaatgaaagctaggctgcacattagcatcagaaaaacagccctcttcagtgtctgccaggccaggccagggccaggtcctttagtggctgtgaataacaggcttttctggaaactgtggaaggcaacaagcactgtccttgccttcctgcctgaagggctgagtttttcctttaagtactactttggtgctaactgcccccgttgttcctggatctcttggtcccagacactcagcaaaaatgtggcctcatcccaccctccaccctccccactaccatgaaaaagagacaagctgtcagatgcccctccctgcaagcccagggctctcctcctgtttctgtttagaggttttcagctgacaagagtgtcagcttccatcccagcactcaatggcattacagccagcttttcacagcagcggtgggtgtgaggatgcgctgaccacagaaaagctcgtttctgtttagcagaagcgtgagggcgcagggtgccagctgctgctacagtctcttacagaaatgggcaccatttattctccaagaggaagctcaggatgatcttctcagaggtagaagggcagctgatatcagcaccagagaaaacagctgggggatgagggaccggagggagcaggaagagggatggggagaaaaagaattggggaagcctttagccctggaaaaggaacaagtgtgtttgagttgggccacatctttggtctggatggggggacttgaacaggccccttgggtcaagaagggatgtcttttagagacaacgagggatttggaagaaagattgaattcattattactaatggggagctcaagttcaaatgcagggcatttaaactgcttactgtagggtcatgatttttcttaagatggtaaaaataaatgtaaatgaacaggtaaggtgttgatttcttgatacccaaagccttcaaagacacaactctcaccatcttgcttatacatacaagcatgcgcacgtgcacacacacagctggctggctttgcgaggcagaaaggaattcacgtcacagggcagtctgagcttgttcctgaccacacacttagcttttcctttttgaacatctcaaaccttccttggacttggcattgcctctcagagacacatcctggggagacgaatgttttattgtttgggtgctttcaagattctaactcactaaagataaggctggtggatgcctgggtcagcctctagtggcactatggtgttgcagcaatgagcagtcaaaggcaggatgtagccaagggtgcctggattttgctattgcttagccatggggtggccattggacaccaatgtcaggggctggtctgctggcctggggctgagccgcgcaggtctggcctggagtcacagaagtggtctagttggatgcccatggggctcctctctttgctccagccctgctaggtaccctgaatgtctggagtttaggagggagaggacacccaagccactgttgcctgtcacctggattactgaggcagcctcctaatggtcttcccacttccccctctgcccacctcgaatccattttgcatacaactgctaggatagtcattttaaaagaggtcatatcacgtctctccactgctcaaaaccattcaaaggttgccgactcactcagggtatgagccaaagtcctggctttggagtggcccacaagaccctatgtgatctggcccactgtatctgctaccattcaccccatctgcacagctctatgcagctgcactggcttcctgctggccctagaacacaccaagcccatccaacccagggttttctttcttgctgttcctctgcctggaacagtctttctccagatatccacgtggctccctcccttatgtccttcagaattcacctttcctgactgctctattaaaaattgtcacctgctaggctctctgaaccccccttcctcacttaatttttctccatagcgtgtatcgccttaactatgtattttgtgtatgagttttgtttagtatccacctcccccactagagtgtaggttccatgggggcaaaggtttttgccttatttaacactgtacctgcaggtcctagaacagtaggagctcaataaatgttcctacaaagaatgaagggatctggaccagagaatgtctttctggatgacacccaaatcatcactcaagtcctggtgcttcaactgaggtgcagaagccaaattctttttcagccttgaagactagagtaagcgggatggattgtctctggaacctgcccccttccccagcagtcttgatgttgatggctgcacctaggctggccaaagctgccgtgtcagatcttcctcccgtaaacacagcacttgaaacaaaaagaatggcctgtttccatggcatctgttagagctccttggtctggtaatacttgtatttaaagcttcatcatggtggggtgcgggggggccccttgatgaagctgccggtcccataaatggtagcatgcagcaggtgcacaagtgcagagaatcaaatgaaggagggtggcctctcagcgtgcttccctgatgtacccctctcctccctgtgcctgttcgttgccctgcctgcaccctttcacagatgttccctgcagtagactgggcctgccacactgcagctgtgggaggaggagacccttgtaatcactgcagccgttcaatgcagggtgctccaaacagccgccagcacagatcatatgggttttctgttatagtatttagatgctatttatagagtatctgctctgtgccaggtgttttacacatatctttagtctttacaagaatcctcccaaagaggcattatcattcctctttaaagggaggaaaccgaggctcagagaggttactaactggtccaggaccaattaggcaagtaagtaatggaactgagttttaccaaggtctggctttaaagatcacactacctccatggctaccttgcatcttaatgcaggttttgcactacacaagtccaaaggcattctgaatggtgtctcccggagtgtgcagtttgcatagctgtacacagccaaccctaaccatctgctgggaatagtatttggctgagggatcagttatatcagtttgaaatgcattccactgtaaggaatagaaaacctgaactctcggagcaggagggcattaaacaaaatggggttttagttttctcacagagcacaaggtctagagataggaggctgtagggattggctcagcagctgaacagtgctgggtttggtgactcagaaattctcttggcctttcctcatgattgcgagatggctgctatagctccaagcatcatgtctgtgttctagggagaaagaagatgaggaaggtggcgttagtcacatctgttccctttttatcaagaaagttaaactttcccagacttccatccgggatctttgaaaatttgaatttcaaggctttaagggagagggggtggggaaagaactctaggctagtgcctgccaccccagtattatccgaagaatcggaaggcagagcgatgctcagatatgggttgtggcctccctgaaatagagaggaattctagatccttcatgttcaaagcatcagcgtcatccaggagctgtgagaaatgcagaatctcaggccccagcccagacctactggatttgagtctgcattttggcacagtccccaggtgatccacgtgcacattagtgcttgagaagcactgtttccagaaattgactgataacacaggacttctttacttccaccaaagttctcacagctttcagctcttgggcgaccaactcatcctggtttgcccaggactatcccagagatagtgctgacagtcccatgtcctgggagactccccagtcctgggcagaccaccctatcactcttatctgtgggggtcctaccctcctcctcccaccaaactaaggcagagcctataaccaagaggcagaaagcctagaaaacttcctttgaggagtcaggaaagatagatagtggtctttcctttggggtatggaattgaacaaggcctgagccaggactcacaagaataagaacatggcaaggccctgccctcccagtgggaggtgtggagagctggcaatgagatggttaagagccctgagggcgtttgatccaggtgggtctgaggtatcattactggacttaataatacattaacagccagcatgaatgggttttggattaagaacttggtaacaaagcagattaactctttcctcacttctttctttcatcccttcatgttgctttcttccttctgccaagaaaatagaaaagaaatgcccaaatctcacacaggaagcatttgtcatgagtagcactggtgactcaaacttattttttagccctgccagccaagagcaacaggaatgaactcgagtgatctgatttattagtgaaaaaaaaccaactacaaacttttcctggcctcatacctcctcccagaccttcccgttctgcctcccagcttccttctttccttattcacgccctgggcagcccatgtggctacctggaaactcctgtttcgggggcggggtaggggggcggtgcttgggagactgctttctcaggcctcaagctccattaacaaatatttgcaatgggcctactggagttggaaagagaagacagagcctggctatggatgcctgggtgtctgggagccacttgacaagtaacacagcacaacacaacagaacttctgtgtgccacctacagaatgggggcaagacattctagaacagtggggacaacttccttaagaactacaatttgctccttcattttggccattctggtggctcagcggagttttgggaaaactctcccacactaaggagaagagctaaggagctaaggagaagagtgccttcccccagggcctttagtcagctctctgcagcgcagcatgtccatatttgtctccctcttaactactgtgcaattgtctaagagatgttttggattcaaggaaactgttgacccaggagccttgctgtagacttggtgagctgctccagacccttctgctgtccgtaaggacagctgtgaagtgtcagggtggagttcctcattgcaagcttctgtgactaagtttcgtcagtgcctttcctcagaacactgtgcagagaccttttagacactccatattatcatacacaggccagagctggaggggggacacgggtcatgaggatggtcagggatgaaaaggtgatgatgacaaggtcatcaaggaagatgttcacgttaggcaccgtttgccaaaaacaggcaaataagggcagtccctgcctggtctcagctctggactgtcaaagccttctgggccagccaggtttaagtcagctccttcaacggctggaggtctgtgagtttaaacaacagcatgttatgcagaacaaggaactgtgtcgtggttggcccaacaggaccattctagtaggagccattgttcactgacccgtatatgttgagacgcgtgtctgtctgttgtcccaaccaaatgattctttattgtactgtatttgtctccaagagtgtgaagcccaactggaagactcatgtttattttgcagtactgtcaggaatggctgttttcttttttttctttttttttcttttttaaaattatactttaagttctgggatacatgtgcagaatgtgcaggtttgttacatagctatacatgtgccatggtggtttgctgcacccatcaacccgtcatctacgttaagctatttctcctaacgctatccctccccttcccctccactccccaacaggccctggtgtgtgatgttcccctccctgtgtccatgtgttctcattgagaaacagctgttttctaagggacagtggccatgtttacaactacagtgaccgttaatctttgagttagaagaatcttcctttcagggagttcattgtgttgatgctgagggggactgtgtgagggctgttcaggaagtggggtggggctggcagcgggttattttttttttttttttcaaaccttggtttggatttgtttcccattcagtagtttatctgtcccctcactagactgcagtgatgatttgagctccaaggctgtgaatctctgttgcgtgtggctgactacctaaagcagggcttctcacagtggagaatgcatagcatcatctggaaagcttgacagtgcccagatgctgtgccctactctcagggattcagattccataggtctggagtggggcccaagaattggcatttctcacaggctcctagatggggctgatgctgctggtctggggacacactctgagtagcagtgggtcaaaagaggtgccaagtgctgttcctctctctagctcctgcttagcacaggttgcatatgttaggataagaggaaatcagtgtgatctctacctttccttttgagcctagctcttaatttccactcttccaatcctcactgatgggggaagttaagataccatcttggagtgtgaagcaggaatcctaggtcctaagggatttgcctggattgccccatactccctcctccacccacccccaggaggttttgggggcctaggaattcctgctggcactgcagtagcaggcggcttgcatctggagttacacccttcaaaggtctctggaggaacaggaacaaaccggagagaaaattacatttgaaataatttattttcacatgcaggggagaaatcacatttggtctagattcatgtaaagaaaacagagattagattttttaaaatgtgttgctggcaagagagaagagcagacgggtttggataaaatacacattctgttgaaactggccttcaatcccagactacatttaaaggggttttgagttagcctatggaggggaatcaagtctggattttattttcaattgtttctttcttttgaaatacttcctaggttgggactgggagtgacagaaacatctggactgcaggaaagattgttcctagaattctgagctttttctatctgagcaggctgatttagaagtcttatccaagatgagagaagattttctcttggaatttctggccaaagccagaagaaacaggagtctggggaaggcaaggagggcaagctggagcaagaagcgaaggctgcacagaccacgcaaatggccatgccaggagggctcctctatagagccttagtgtggaaaagggtcaatgtcaggtttaagtccatcacaaagatgattaaagaaacaaccacagcaagagctgatgcttactgggtactcaccatgtacctggctgtatgttcatcatcatatgaaatccttacttagctctataaagtagttactagcatcatctccactttatagatgaagaaaatggagagaagttaagtaattttcccaaagctgtactggtaggaagtggcagcgttgagctctacagccagggctgtctgactcagatgcccattccaagaatcagtttagataatgatataataattaccatcagtagcattatcattgtcagtaaagggccgttgtttgtgtgtatgaaaatcggttaggttggatcatatgaaagagctatttttgtaggcaaaaaatggctgaacattggcaatttcatatgacttaacaaaatatcgtaccttatgattggtgggaggagggataaattgtgttgtaactaaaaaatggactactatacaggaatgaaagttgactggcttaaaacatggatatatatatatatctatatatatataacgtactgttgaggaaaatatctcattgcagaaagatacatgaaatataataccatttatatatagataggtaaatatatacaaagctatttgttgttaagggggattttgtgtgtgtgtgtgtgtgtgtgtgtgtgtgtgtgtgtgtgtgtattcaagctttctctaaagacagagaagacccctctgatggttaccttggcagtccagatgtgtgagagagttcaaataccctccaagagccatccacttaatgatgagagtcagggtgtaaatatcccagctcctttgcctctgggagaatatttagtgacagagattctgtgatatatatatatatatatatatcttgcatttcaatttcagtctggttccagagagcatctggagaggaaggaggggaaagtgatgaaggtagaatacaaggaaggggctttaagtatccttgtaatttgtttttttctaaggctgcatgctacatgggccatacacaagtattcaccaggttattctttatacctttttgcattagttgtctatcactgcataaccaatcaccccagagcttatcagcttaaaacaacacatatttacgatctcacagtctctgtgggccaggagtttgggcacagtctaactgggtcctctgctccggctctcaccggcagcattaaggtgtcagctgggactgtagcatctcaaggctcaactggggtggatttgcttgcaagcttgctcatatagctgttggcaggcctcagaaggtccacttcgaagtttacacacatggttgttggcaggatttggattctcatgggccattggaccaaggcctcagttcttcactgggtgttgcccaaaggcctcccttagtttgttgcaatgtgtcccacctcatagggcaactcacaacctggcagccagatttatcagggtgagggttttgagagagagagaatagtcacaatattttataacctacttacaaaagtgacatcccatcacttttgctgtattttgttcattggaagtcagtcactaggtacagccgacactcaagtggagggatttacacaacaacatgaataccaggaagcagggatcattgggggagcccttagaggcttgcctagtacaatatgtctgaaatatcttacaataaatttttaagagaaaaaacatatttaaaggtgaattagaactgattcctggcgttacaaactccttaatcctcagtggcagcagccacatttctggctgctactaaatctttcctgtgcctcctgcccccatctcattctccacaatgtacatcataatcaatgacaaaattaattaaggatattttctcattactagatttagagagatgtcagtatcatatcaaaagtgcttttatttcttcaactatacctttgtggagtcaatggtaacagtacctttcagaagtctgttttccaagagtgcccgttggctagagtcgtaaagaaggcattgtggaacagtaagacgtacatgggcttcgtagccacagagctaagttctgacccctgctccacctgttaccagctgtgtgatttgctgacagatacttacagtcttaaaaagctagtcttctgatctgtcaaatgagaggaatggtacctatctcaaagcttcctggaggattaaatatacaagaaaacatgtgctagtcctagggcagtgatcagcacaaagtaggcacctgacaaggtgaggaaagtttcctccaggtctcttaccttccaaaatgctatgtaccccttcatgagcaggctgtgcaaattgttttgaagggtgacagttttgggatgccatgaaaagaatggatcttcataatttctcatttgaccccaagattaatttcctattataaacttaaagtttcatgcattcattgattcatttttacattcatatacacattcattcaacaaatagaatttcttaaagaaagtaaagaccaatcttcttcaaaactctaatgcctttttatctcccaggggtggataggataatccaagttatatataagcagtttctcatgtccagggtagcaaaagcatcagatgtggtgcaaatctacctgttttctatgtggctccctgagagggctgttccatcaagggaagatgctccaatgtatgctagcctttgagattttggcttagtagaggagaggagctagtgcctagaaggaaatacaacaccatgagatagaggtccatgtaaacatgttctttgtggaggcctgcctgccactaggatacacaccatccccactggttgatttactgctacatactggcctttgcatccaagaaagattgtagtacttgacttcagagatctttaagcagaggcttgattcaagcctcctgagtcagctgagatgaggcagggtgcttttagctggaacctgggctaaggcattggcctccgtgcacccccattgaagaaaaaaagtagagcaaaaatccatactgtttatttatgaattatatgcacgtgttgctgtattaataagttacttactgtaacagtttctaggcccctgcccatatccctaacctttcacatttagaggaagccttcttttgatagccaactgccagattcttcatctctttgcctgcagtctttctctaaagatggagaagacccctctgctggctccctgggcagtccagacatgcaagggaattcagacacctcccaagagccctcatccacttaataatgggaaccaaggtgtaaatatcccagctcccttgcccccgggagaatacttaatagcggacattctgtgcttcttttgcagcttctccctgtgagactaagctccagttactcgctaactctctctttattgacttccttctcttccctgttttacttccccatcgccctatcagggttccctgcagctctgaagtaaactctttaccctggaatccttgtatctgagtctgctagaaaaacccaatttatatttaaaaaaacataaaaacagaccgtttaacagtacataaatatacatacatatacacatagtctaatgtttttccttacccctagagtgcacactctgcattttgaaggccgcttgtttaaggaacttagaggctcccatttcagtcttgtaatctgatatctcgaggttgatatcagagccagccctctctcctttgggctgcctgcttccaagccctgtttaacttactcagggtggcttggcatactttcacgttgattcatggtagtgatttctgggtcacaggctagccaactggaaggagatcttcaggattggatttcctgcactcctctatttgaaagaataatttctgtatcttggacttccaatgaggaaaacaaaaacaaaaacaaaaacctgcaagttcagagttggacaaaagtttctccacaggcactttaccccactttgggacctcatagtttctctcagttcagctctctgtgtatgggagaccaggcaacaggtacatcattgccaccttgaatcatcctgctattacatgatgggcagccccatgagatcgggatggtatgaatattctgacttgttgtcatctttaaccccagcacatggttcagcactatgtggacatataaacacacttcaaacagccttttgctagaaaacagactctactggccccagcataaagatttgcaagaaccgaatgctcccttattttctctctgcctggaacaaagcctcctattgtttttcaggtgatcacattctttagacattcaagtttaagttgttcctcaacaactgaattcaaagctagaggcttactctgctggctgtgcctgcacaagcaaacggtcccacccaaaggcccttttctccagggcctcccagtggcctttaaattattttggtcttcaacatcacagtctcccagaatgcttatcagaggataatgtcaccccctttcatgcctgcccaccatttctactcaaaagccactcctatttctctacagatagctcattctctcagaaacgaacctacagcaaattaatgtccagtgaggcctggcttgtagggaaagtcttgggtatccctatgctcttccagactggccatccaggacataaggtccatgagcttaatcttgttctaagttccctcgaatttcccattgactctattttccttggctgaatagatgttgttgctctgtaatagtgagaaacagtatctgtggtgatggaacaggcagaaataaaaatatttccctagctctttcctcagttctaatccctacaagtcttgccccttacctttgccagatcatccacttgggaggattcagaggtgctatctccattccagcgtctgggaaggagaagaggattgacacaagtttcaattttgtattaaaaagtcccgtcttgtagggttttgaagggaggaggaagagccaagaggagtctacgtctatactcctcaagccactggatagagttactttgagttcttcacacatgcaagtgcatgcgcgcgcgcgcgcgcgcacacacacacacacacacacacacacacacacacacacacacacatcatgccttcccaaggtactggcttggcttggcaggaatgctggatttgggcttggagagccgtccactgcttggtgcccacttttagaaaataaagaagtgacccaggttcatgggtgaagttttaatgagaaataagtcactgaagcagtcagggaataaaccccaagaacagaaatcatgatgctaatctcccaaaatagggcaataaaatgttgaaaggtcttaaggggttgtgagagggaagattagggaactggggcacgtttgtctaatcttggaggatgatatgagggatctaaattcatatgttggtcatgaatagactcctactccacatgaaccaaggtttggtgtttctggctttcatcttccctaatatttgttctcacccttttccttagtacgtgtgtatgtgtgtgtactgtagaaaaaccctatgctactgttctgaaattgtagattctataaatgggttgggaatgaccatcttaggttgggttcctcagaagcaaaccctaaaacaagacctcaagtgtaagcagtttatttgagaggtggtggaaaaactggtaggaagagaggagaagggggttaggaaaggcaatgaagccaaggaagggttattaagtgaattgctactgtgagtaactggagctgaatcccaagggagactctgggaggctatgcataaaactcagagttatcccacctgaggggtgaggcagctgggatatttatactcccaactactaagaatcatttgttgagagatgctcctggaagttgctaattccccagaatttcaggccaaacctgtgggtatagtggccttcatcagttatgggaaaaagccaggcacagagacacaggtaggggtctttggaagtcaggtgcagtgaactgaggtgagaggtataagggagatggggagggcacagatggtggctgctataatcacaaaggggtgggtatgtagattgttggggaggaagactttctcatagttatggtcttgataaatatttctatcctttaataaaatataatggaagttttggaataataaacaaagaatctttaaagaaagagagttttacaaaaaccagaggatagtggtgtgggatccaaaaattaattatactatacatttgaaatctgttcatttcactgaaaacaaatgttacctaaattttaaaagaagcaggtatgagattccagattgtaacatctttcaatagaatcctaagctcctgcatattgagatatacttgcctgaatccctaaaattctgcctgggttgtggaccaatagttgaagcattttctctagaacttcagtcagaaaatgttgaaatgtgctctgggtagtgactccccaacaagaaagcaggctccttcagctgcttctgtgccatggtttgtgcccacgctgccttttctaggttttccttgtgaccatggcttgcattttctaagagaaatggctagggatttcatgtctagggccacaggacaaacatctgcaatgcagaagaaactgacagagcctgttcttactaacttaacctgtttggtcaagctagctgagtccatctgccatgcctaaatagggaaatgatgatgagatgatgtcctaggatgggcactaggtcaggactgacctcaatgcctggcacatagggggcattcagttaatgtttaatgggctgagcagatttgcttcagctcactgacatcacctatgactagcctcacctgagaccagaacagggtggaggtgggcgaagcaccaataatgtggaggccaacggcccttctgttccttcttgaaggacccagatatggagctgatgaggtgggccttcacagcagaggagctttctaatgacttttcaattaattgacttgaagctggtggggagagtgccagagtctgaaaaagatgaaaggtattgaagaggaaaagctttgatgtcactgcaatcccattcagatttggaaaggttttttcaggaactttatattttaaccacaaaagcctcatagggtcgatcagtcacgcaagaagatttttgtcattctctgggattggtgggtgatgagaggttgaatggaaagccagaaaggaagggctgtgtgtggtttctgtgggtggcaaacgtatgtgatggagtgggtggacgggtgggggaggtggagaggaaaggtacacaaggagggaatggggatatgtaggtgtgaattacattttcagggcagtgctatgcctattctacaaagtttggcatggatatgttttttcaacaggtttcgttcttttagactcagtgacttcttactgtgtttgttcctaaagctaatctaatctaggtatagtaaccaatataacctggccatttatatacatgcccactcccatacagcatatttatgcaaaatttaaatagtcagaaaacttacagaagtacaattacctcgcagatcaataatgaatacaattttagaagtagacagacccgaaacagcaattgtgctgttttctgctaatggtaagaccatggaggtttggatgtgaaactgatctctcatccacctagaccaggtcttggccttggtactcatgacatttagggccaggtaattctttgttattgggactgtcctttgcattgtagaatgtttaacagcatccctggcctctacccactagatgccagttgcactgttccctagttgtgtcaaccagaactgtttccaaacattgccaagtagctcctgggggacacgatcattgctgattgagaaccactggcctagatagaagcctggtgggtccagcacttattgtactgtcctgtgcaatttgggggtttcaaatgatgacgcttatatggcttcagaatcatgtacaaacattgaaatggaatgattctgtgtgtggtgtgcatgctacaattggcaatgttcaaatgccaaccaggctatttgtcttaccaggacgctccattctctaacagctctaaatgaggtgtttctttttcagaatgtgttaggttagagcatgtcaaattgccatttttttgtgtatggccctaacggtcaaataccagcaatttcatagatttaatgggaacacaccaactttaggagatatgtcctgagcaccttctgaaactcccccaaattgtgaatgtggaaatgtttgtttaggctcatgactctgtcctgtcacatttcaaaggcgagtccagtgtttccacacggagccttgcaccacaaactaactgcattgcaaaattcccctcaagatttctttctcatcctgtggcaaattgggtacagccacatttttttttatttattttttttttttgcagcaactcccattaagaggtggagcctatttctccacctccattgaatctgggctgactttgtgacttgctttgagcaacagaatgtggcggaagtggtggtgttcaagtttcagaacccagatctttaagaggccttgtggcgtccaccttgtagtgtccctcttggccactatcctgagactgccctgccaggaagctggtgtagctcactggaggatgagtggccatgtggaggactgccaaggcaccctgctaacggccagcaccactaaccaggcgtgtaagtagggccatctcagatcttccagtctgctgaccctccagccaaatccagtcaaatgagtgagtccagataagaccagcagaaacaccaccaagtgtatgcacataatcatgagaaatcataaatcattgttgttttaagttactagattttggaatggcttgttatgcagcagtagataactcataaacatccaatggcagctttacagtttttaacaatttcttagagtttgacttcaaatagagagcagtgaacccatgctcccctgggctgctggatggtggctagcatctcactagctgaatgcctcatgccttcacaccagccttgcagtgggcaccattcaatcacatttttcaggaaaactgctgatttctatatttggaggctacgagagagggccaaaaagttataagtaaaagctacactaggccaagtggctgctttacttaatgaccacctgcacagcattcatatgtagtagacacctcatatgttctgcccatgaatatacgccacatacaaatgtcacacatatacacccattgcctactgagtttaaccatgatccatatcttaggcatggttatgtgactgaaaatatcttaagcctacatttcctacaattatagtttggaaggggatatttcaaaccaagaatttcttcacaaatggtgagccgtaattgactttctgtcttttttttttttttttacagggtcttgctctgttgcccaggctggagtgcagtggtgtgatcacggctcactgcagcctcgaccactctgggctgaagcaattctcccacctcagtctcctgaatagctgggactacaggtgcgtgccaccacacccagctaatttttaattttttttttgtagagacggaatttcaccatattgcccaggctgttctctaactcctgggctcaagcgatcctcctgtctcggcctcccaaagagctgggattacgggcatgagccaccgtatactgcctgagtttccatgttaatcactgaacatctcttttgatcttcagcagatgccttaggaagccctttctctattatgtaaggaaaactgtacttagcattctcactgtagttagaactcacaattctttgtgatttctttaatgttgcacacaccagctcccactggactttacctacgtgagaagagaaattctgtctgtctctttgctcacagcatccccagctcatagcgcagggtttggtccctgtttgttcctcagtaaatttatggaccaatgaacgaatgagtaaatgaatgaattatggaagctgagagccgagagagaccttggaattcattgtcttccatctcctgctctgctttgtaagataagacactgagattcagagaggattagcatttgtttgtttttttttttttttattccaggatttttttcctttcaaaagccacttgacacacttgcttatctgatccgttacagcttgtgattatggaagaggaaactgagaattccttcttggactcaatgggatgtactgtgaacatccctgacattgggctagcctcgtgccattcagggcaggcttctgtccaccccatttaaccttgtgactcattgaggggctgtcagacccacccgggcactgagcaggcaccagatatacctctcagagttacattataatcactattcatctgcctgtcaagctgagcccttttctgtgctccagaatgtgaaagcaaaatggccttttccgttatgaagctaataatagttctcatcttgattctacttaacactgaactggagatttggcctctagggtgaagctcatagttaattcatttattttaaaaataattacagaaaccgtaaaagatacatcccaattgggcccatgagtggtctgattctcagtgtttctcagtaaccagttgtgtgctgggtgcttgaagaaatacgaatgtggcaactgcgtttgaagccttaggcagaaggtgaagccggaatggaattcctctgcagtcactctggttaggagcagcgatgtccagcctcctggcacccactcacatcattctctgtgatgacctaaatgagaaagacagttggcttccttccccctcagctcagtcccccatgcagacaaacaggctgcatccctggcagactgcaccggggttatgcgctgtctcatccattcgagaatgatctatagcttcaaaggaaaaaattaacaaacaagcaaagtcgacccctgtctaggaggaaatggatgggttttggggcttccacctcccctccacgtattgcctatgcccctgagccccagggaaagaacagctagtgaagaaaagaagctgtttctagttgtttgtggagcagggagaagaagagagagggggaggaagagagagaaaagaaaaagagaggagggagaaggagaagaagagagagaaagagagaaggagagagggaaacaggcaagaaagaggaagagaaaaaatatctagacagaggggaggagggaggaagaagggagaaagggaaaaagaaagagggagagaaaagatagggactagtttaaaagagggcagaggagtgattcaagtagtgatttcaaaacgtgaataaagctatttaaagtatcttttccctccccaatttcactttgtccttccagatatagttgtaagtagcccctcccccaccacccagtcctcttgtctaattctgaaatatattggagacttggcagcacaggcctcaggcaattcatcctcagaaccagtaaataaattcaacctttccatggtatctggctacaaacgtcaaagagaacagttcccaccctcctggcctcttggtcagctagcatgaaagccatggacttgttgctgggcacatcagaaacagctgtccatgtctcagcctttccacttccagagtgccatccaggtgagctgtcccatgtagaaggcagccccagagagggccttcccctccacgtgtgctggatgtgatgttcatgctagcgcaatgaagaacccatatggtttgccatatgtaagatcactattcagggtaaaaactaagtgagataatctatatcaagcatatggcacatagtaaatgatcagaaaatagtagttactataatctgatggcataataatagccaataagtttttttctctttagcagtatgtgctgggaactattctaagtaaatcttttttttttttttgtattaatgaaacgaaagtttatttcttgctcatacaaaagtctatttcagtccagacaactccacagggaaattgtccttcatgtaatagatcagtattccaggttacttagttattattattattattattattattattattattatgctttaagttctgtgttacatgtgcagaacatgcagttttgttacataggtatacaggtgccatggtggtttgctgcacccatcaacccatcacctacattaggtatttctcctgatgttatcgctcccctagccccccaccccacagaggccccagtgtgtgatgttcccctccctgtgaccatgtgttctcatagttcaactcccacttatgagtgagaaaatgcggtgtttggttttctgaccttgtgatagtttgctgagaatgatggtttccagcttcatccatgtcccttcaaaggacaggaactcatcctttttcatggctgcatattattccatggtgtatatgtgccacattttcttaatccagtctatcattgatggaaatttgggttggttccaagtctttgctattgtgaatagtgctgcaataaacatacgtgtgcatgtgtctttatagtagaatgatttgtaatcctttgagtatatgcccagtaatgggattgctgggtcaaatggtatttctagttctagatccttgaggaatcgccacactgtctttcacaatggttgaactaatttacactcccaccaacagtgtaaaagtgttcctatttctccacatcctctccagcacctgttgtttcctgactttttaatgatcgccattctaaaactggtgtgagatggtatctcattgtggttttgatttgcatttctctgatggccagtgatgatgagcattttttcatgtgtctgttggctgcataaatgtcttcttttgagaagtgtctgttcatatcctttgcccattttttgatggggttgtttgcttttttcttgtaaatttgtttaagttctttgtagattctggatattagccctttgtcagatgaatacattgcaaaaatgttctcccactctctaggttgcctgttcactctgatgatagtttcttttgctgggcagaagctctttagtttaattagatcccatttgtcaattttggcttttgttgccattgcttttggtgttttagacatgaagtccttgcccgtgcctatgtcctgaatggtattgcccaggttttcttctaggattaaaatggtactaggtcttacatttaagtctttgatccatcttgagttgatttttgtataaggtgtaaggaaggggtctagtttcagttttctgcatatgactagccagttttcccaacaccttttattaaatagggaatcatttccccattgcttgtgtgtgtcaggtttgtcaaagatcagatggtggtacatgtatggtgttatttctgaggcctctgttctgttccattggtctatatatctgttttggtaccagtagcatgctgttttggttactgtggccttgtagcatactttgaagtcaggtagcatgatgcctccagctttgttcttcttgcccaggattgtcttggctatgtgggctcttttttggttccatatgaactttaaagtagtttttttccaattctgtgaagaaagtcagtggtagcttgatggggataaaattgaatctataaattactttgagcagtaaggccgttttcacaatattgattcttcctatccatgagcatgaaatgtttttccattgtttgtgtcctcttttatttccttgagcagtggtttgtagttctcattgaagacgtccttcacattccttgtaagttgtattcctaggtattttattctctttatagcaattgtgaatgggaattcactcatgatttggctctctgtttgtctgttattggtgtataggaatgcttgtgatttttgcacattgattttgtatcctgagactttgctgaagttgcttatcagcttaaggagattttgggctgagatgatggggttttctaaatatacaatcatgtcatctgcaaacagagacaatctgacttcctctcttcctatctgaataccctttattgctttctcttgcctgattgccctggccagaacttccaatactatgttgaataggagcggtgagagagggcatccttgtcttgtgctggttttcaaagggaatgcttccagtttttgcccgttcagcatgatattggctgtgggtttgtcataaatagctcttattatgttgagatacattccactgatacctagtttactgagagtttttaccatgaaaggctgatgaattttgtcgaaggccttttctgaatctattgagataatcatgtggtttttgtcattggttctgtttatgtgacggattgcatttattgatttgcatatgttgaaccagccttgcatcccaggggtgaagccaacttgattgtggtggataagctttttgatgcgctgctggatttggtttgccagtattttattgaggattttcccattgatgttcatcggggatactggcctaaaattctcttttttgttgtgtctccatcaggctttggtatcaggatgatgctggcctcataaaatgagttagggaggattccctctttttctgttgtttggaatagtttcagaaggaatggcaccagctcctctttgtacctctggtagaattcggctgtgaatccatctggtcctgtatttgttttgattggtaggctagtaattattgcctcaatttcagaacctgttattggtctattcagagattcaacttcttcctggtttagtcttgagagggtgtatgtgtacaggaatttatcaatttcttccagattttctagtttatttgtgtagaggtgtttatagtattgtctgatggtagtttgtatttctgtgggattggtggtggtatcccctttatcattttttattgcatctatttgattcttctctcttttctttattagtcttgctagtggtctatctgttttgttgatcttttcaaaaaaccagctcctggattcattgattttttgaaggggtttttgtgtctctatctccttcagttctgctctgatcttagttatttcttgtcttctgctagcttttgaatgtgtttgctcttgcttctctagttcttttaattgtgatgttagggtgttgattttagatcattcctgctttctcttgtgggcatttagtgctataaattttcctctacacactgcttaaatgtgtcccagaggttctggtacattgtgtctttgttcttattggtttcaaagaacatctttatttctgccttgatttcgttatgtacccagtagtcattcaggagcaggttgttcagtttccatgtagttgtgtagttttgagtgagtttcttaatcctgagttctagttcgattgcactgtggtctgagagacattttgttgtgatttctgttcttttacatttgctgaggagtgttttacttccaattatgtggtcaattttggaataagtgtgatgtgttgctgagaagaatgtgtattctgttgatttggggtggagagttctgtagatgtctattaggtctgcttggtgcagagctgagttcaagtcctggatatccttgttaacctcctgtcttgttgatctgtctaatattgacagtggggtgttaaagtctcccattattattgtgtgggagtctaagtctctttgtagatctctaaggacttgctttatgaatcttggtgctcctgtattgggtgcatatatatttaggatagttagctcttcttgttgaattgatccctttaccattatataatggccttctttgtctcttttgatctttattttaaagtctgttttatcagagaccaggactgcaacccctgcttttttttttttttttttttttgctttccatttgcttcataggtcttcctccatccctttattttgagcctttgtgtgtctttgcatgtgagatgggtctcctgaatacagcacactgatgggtcttggctctttatccaatttgccagtctgtgtcttttaattgggggcatttagcccgtttacatttaaggttaatattgttatgtgtgaatttgatcctgtcgctatgatgctagctggttatttcacccattagttgatgcagtttcttcatagcgtcaatggtctttgcaatttggcatgtttttgcagtggctggtaccggttgctcctttccatgtttagtgcttccttcaggagctcttgtaaggaaggcctggtggtgacaaaatctctcagcatttgcttctctgtaaagtattttatttctccgtcacttatgaagcttagtttggctggatatgaaattctgggttgaaaattcttttctttaggaatgttgaatatcggcccccactctcttctggcttgtagcatttctgcagagagatcagctgttagtctgatgggcttccctttgtgggtaacccgacctttctctggctgcccttaatattttttccttcatttcaaccttggtgaatctgacaattatgtgtcttggggttgctcttctcgaagagtgtctttgtcgtgttctctgttatttactgaatttgaatgttggcctgccttgctaggttggggaaattctcctggataatatcctgaagagtgttttctaacttggttccattctccccatcactttcaggtacaccaatcaaaggtagatttggtgttttcacatagtccaatatttcttggaagctttgttcatttcttttcactcttttttctgtaatcttgtcttctcactttatttcattaatttgatcttcaatcactgatatcctttcttctgcttgatcgagtcagctattgaagcttatgtatgcttcacgaagttctcgtaatgtggttttcagctccatcagatcatttaagctcttctctacactgtttattctagttagccattcatctaaccttttttcaaggtttttagcttccttgcaatgggttagaacatgctccttcagctcggaaaagtttattaccgaccttctgaagcctacttctgtcaactcgtcaaactcattctccatccagttttgttcccttgctggcgaggagttgtgttcctttggaggagaagcagcattctggtttttggaattttcagcctttctgctctggtttctccccatctttgtggttttatctaactttggtctttgatgttggtgacctacggatggggttttggtgtggatgtcctttttgttgatgttgatgctattcctttctgtttgttagtttttcttctaacagacaggcctctcagctgcaggtctgttggagttggctggaggtccactccagaccctgtttgcctgggtttcaccagcagaagctgcagaacagtaaatactgctgcccgatccttcctctggaagcttcattccagaggggcacctgcctatatgaggtgtctgttggcctctactgggaggtgtctcccagtcatgctacacaggggtcagggacccacttgaggcagtctgtccatcattagagctcgaacgccatgctgggagaaccactgctctcttcagagctgtcaggcagggacgtttaagtctggagaagctgtctgctgccttttgttcagatatgccctgcccccagaggtggaatctagagagacagtcggccttgctgagctgcggtgggctctgcccagttcgagcttccctgccactttgtttacactgtgagcatagaaccatctactcaagcctcagccatggtggactcccctccccccaccaagctccagtgtcccaggtctatctcagaatgctgtgctagcagcgagcaaggctccatgggcatgggacccaccgagccagacaggaaggaatctcctggtctgctggttgcaaagacaatgagaaaagcgcagtatttgggctgaagtgtaccgctcctccaggtacagtcactcatggcttcccttggctaggagagggaaatcccccgaccccttgtgcttcctaggtgaggcgacaccccatcctgcttcggctcaccctccatgggctgcacccactgtccaaccagtcccaatgagatgaaccagctacctcagttggaaatgcagaaatcacccgtcttctgcatcgatctcgctgggagctgtagattggagctgttcccatttggccatcttggaaccaacctccctgttctaaatacatcttaaatcaatcctatgatgtaggtgctgttaccattatagatggggaaactgaggcacagaatggctccagttcctaggacctagacatgagggtctgttttaacatgatgatattgatccttcatgagcagagacagtgacaatgaagggagaagagaattcagtaacatccgctgcctcctcttcatctctggcaccactgcctaaaactactacgtactcctacctggaccatagcagctgcctccttcctggcctccctacgtccactagtgtttgctgcagtccattctgcacacaaccatcaaagtgatcctttaactcatgggtcacacactggcgtgcccctttataaactcctcctttccttcccactgcacttaggatgaaatccaagctcctggccatggcctgcaaggccctgcatgacctggcaagctgttcccaccggtccagcttcatgctgggccatactcccttggcacactggcccatcaccagtttttaaaatacatcaccagtttttaaaatacatcaccagtttttaaaatacatgcaagctctttcctgcctcagagcattcatacctgctgtttcctctgctatttttcccatcacttcatcctccagaactctgcttaatgttacctcctcatacttgagtatccctccccctcctccatgttttctgtatctcaacacactcattatatccttcatcaatcttctcacaatttattaatagaagtcttttcatttatttgagtaggtccttgatttctctttacttcccccactaaactgtaagctccatgaaagcaataaccatgtctacattgtttgctgttgtacctccagcactcagcacaatgctcctctcatggtaggtgtgcaatcaatatttattgacacacaaatggctcatgtatctggcatgtctaggatgtctatttggaagcatgaagggttatggctggggctcagctcctctgacttctctcactgccccaaatcttctttatacccccttgcctgccattgtgtgccccagacacgagcaaaggcctgtctcattccagagagtggtaccctccttggaatttcaacacaaagaggccacagatctgttgcatagcaagaaaagatagtgtctgttgcaattggttctcttggccttgtggcaggatgcagagtgaaaaatagagggatattagaagttcaatagttctctcgatgtctagagtatccagggaatgttattcactgaatagcacttatagaatacctaatatgttattctctcactatcctcagccacccaaaatagttgaatctctgactcacagataatcagtcatgtatatattcaccctccaataatttaatattacagaaagtgaaccagaattcagctttgcacctttggaagttaatttcttctttgtatgattactagagatattctctgataagggtaacgagatgtatagatttggtctcttcccaccttgctgacattccttgaatttttctcaggaagactgatccaaggcaaatcacattttttctcatcaccccacctttgtcctggccaaagggtgaactatgggaagatctcatgggtggtgttctaaacaactttcccttgattaaataacccttctcccaagggctacttgtgtgggttaaattacttaaaaataaaacaaacaatccagagtaagagaattagtttgaaaaacagaaggttaccaacagccttgccctgtacagctggaaaagatgtgaaacgcacaggctctaagcacccaagaggataaataaacgtgtcgcaggtgccattaagaaaacacatctgcacactgtcaatggtgaggataaacacacgattgttttccctttcatgagaagcagtgatggggaaaggcgacttatggaccctatccagttctgttcaatttacagcatctcaaggttgagggatgggcacttatccagccttgatgcattcccaaaatctctcatcagaagcaaatcttcaaagaaaacaaatagtatgttcattctcctcccagtgcacagacaggagaacaaacaaggaaagaaagaaaatgccctaaaggttatctggtggacctcagttgcccgagattgtgattttagacccgacatccttctctggttttcctccttctcctaatccccctgccagtaggaagatcaaatggaactgacataaatatccttcccagctgttaagtgtagccattgtttcttcttttaacactacactacactccaaacttccagggtccatcaacttccctagtgtcttaatgaagtagattatacatttttatgaaccataatcagaattcatgaaagataactaggagcctagggaattatgatggatccattcaaatcctcatggacttaatttgagaaaaggttcaaatgcacaagaaaataaaggcgacttttggagatgccaggcacctggaacctctgtgctttgtatttctcgggttactgatagtttgctatagaagtcatgagttgaatcttcttcatttttattagatcaaatgcctcttatattatgtgcctaaattggaaaatggaatatgatgaatgtcttacaccaggcttagagtcaaacatctatatgcccttagccacctgaattttaacatttgatctaaagtggattaaatatccactttaaattgaaatacccactttaaattgaaaacctcaatttttcatactaatagaaggtggccaaaaaaacctgccaacacctcagaaatcattcacatttgactttggaaagtgttcctggtttattggctgacatgctgaaagttggctctaaagataataatgaagaaatatggaaactgactcagagttagaagcctgtctgtgtctacctcattctgtcttgtctcccttcctctactttctgtacttcatcaaactctttccattttctcatctttaaaaagggataggagtgttttggcagggtggttaaatgagaatgtttctaaggactcctccagtactatagttctgcagtttaatagaacatatatgccctgatataacttccagctattcattcattcattcaacaaacttgtttgtgtgagtgcctgttaggtgttactgtgctagccatgaaactagcaccattcttgtcctagaaataatataaaatatgtttgttaaatatgtagtaagcatttcataaatgctcttgaagggtgtacacaatagaggctataacagcttctctgaacaatcctgtggttaatgatgttctttaattatgccaacatccaatacctcatgttaaagacttttagcattttccagatgttggaaatgatcagaaaattgtatattctcagtaactatgaagaataatctgagttcttagttgtgggtgctgaggcccaagaggtatatccttcatcaaggttacatgtgggtagaggtagatgcctcctgcatcccagcattgggttagttagctaagaaagtaggctcgaggcccaactgccggggttccaattctgtctctgccacctataggttaagtgatcttgaggaagtcatttaacttctctgtgttttagtttccttctctgtgaagtggggctggaatagtaactggctgcatagggtgtatggattcagtgagttcctatatatcgaaatactcaagagtgtaaacagtatagtttcatgtgtaataacagccattagcaacaagaagtaaggctggactgttttctcacatatggcagaaattcaattggtgttataaaataatcaaaactggtaaatagccagttcttagatctatctgtccaagatatttcatgagcagattgtatttccacaaacaaagaaaaacctgtttacaactgtacctggcatatagtaagtgctcaataagtgttcgctagtatcttgcggcactgctctcatctcctgcagtgttggagagggtgtttgaagcgctttattggagtcaaaggataatgctcccaccccctgactctgtgcgcatgtgtgtgagtgtgtgtgtatgtgtgtgagtgtgtaccagtgtacaaaaaggtgtgttgtagtggaaaatcaagtaactcactcagtaaattatctcagccaaaagttcagttgcaggaaatcaaattcggatttgtaagcctggtgaaattcaaattccttttaaacatttattgccatttctaggcaagaaacatttcccctgatcatatcattctggccgggaagtcttgcgttttaaagcaagtaaaaagtgaaaaaaataattctcagtacatgacacaatttacagttagctcctcaggaatgtgtgtcatgttttaaacttgagtaggttgatgctctccaaacatcctagtccttcgtatttatagagtgctttattttagtgtgttaacaatgaatgagaaaaagcggaactttctgtaggcattttttcctgatgctattttgatttgaatgcagccttgcttctcctgcctttttcaagcactataggattccattctctctctctctctccccctgctccccctctccctctcctttttatccccaaaggaaacactttaattgcctttattgatgaagagaggaaaaatctaaacatcaggcaaccaggctaatgagggacaggcggacatgccaactaacaaagaacaaaaccaattaccccctctttacgcaggcatagcggatccagacggaaacagtgaagaactgtagcagatactatgagtgccctgcccctatccccttggtccagtcggtggtcacctgtagctcagtggaaattggctacacacctagtttctcacctcaagaattgcagtctctctgtctgaaggctttctctgggcttcaggaaagtattcaacacccactccaccctgctgcagagtaactggcaaccaaagttgggtgagggggatgatttggtgggagaataccctagattcctcccggccttggtgagatgtgttctctactctccctcagagggtccccagcaggatggagtcccaattgcccaaagtggcttgtactggcatccttcccttccctgtctcacatccccccatttctttctggccttcctagaattacccaaatcatgcacctgaatcatcctttcaaggtctgctcttttggggaactcaaaataagacaaagacctaaaaatatttcaccaatgatagtcattatcctgcccctttccccactctctccaaatgccagaaaaaaaaaaaagaagggaaaagatggactgtagagctatcataaaacccttcatttgagcattctttaatgccatacactagtttgggatgtacagttctctttaggtactaaaagctaaggtgtcttcagctgctaattttcattaagctattcaacaagtattaattgagcacctactacgtaccacacactatcctgggtactgggatgatcttagtgaacaaagcagagaaagtcccttccctctttctctagtgggagggggcagagaagaaacaataaatgtaatgaatagataaagtagatagtatgttagaaatggataactgctatgaaataaagcagtctagccgaacactgagcacaggagctcagcagtgggaggcgtggggaactggttgcagtgttaactagggttagcagtagcttttctgtctcctgcggaggacagagtgtggagcttgatgctgtgatttgttgctcctgcaagatagccactcccccttctcatttcccaagtcagtctccaaggagaagctaatgctattaatagtcactaaggacaggaaacaaatgtctgtcttctctccagatggaattctttgctcacattgacttctttactcataactagagcttggctagcagtatacatgaagaagtaaatgttcaatgaatgaagcatgcatgtcgggaactctctgattgaagtccagttgaactttaatgggcaaccttgctgtagccaggaccactggggcggggagggcagtgaggaagttggagagtatgcctcgttcaaattcccctgtaattaaaagtgaagcttaatcattagtttcaagggcatggggtggctctcgagcacagtggggaaatctgagtttcaccttctcttgcctcctgggaccatgcagatgtgatctcaaggctgtgactctggatgaggttaccagggagacaggaagcaaggggtaactccaatatccctcttcacagggtgacatcagaatgtgagaggacagggctcaggttaattctggcaacatctattcctcgtattgttcctggagaggagtgaaagtgtggagagagaactgggccacgtctatgactgggaaagaaggtggagaactgatattgaggaaacaatggaggcttgcacccaagagttgatggtagagggtcccccagaaatgggaagagagactggaggtgggggagccaagctaaagaatccagctgagaagacacaggggccactgcagagggtgttttgggcattgggaccaccagccatgaagggaactgaaggaagggagagaagtcaaagacacacaggagaagtgtgttggaattggctaataattccaacagagtaaaatgaggccatctgtagctggctaataattccaacagagtaaaataaggctgctgcagctggtttattctccactctgtgctttctgtggaatcgcttggaggaaaggcaggctggcctttggaattaacaggttaattaggaaattgggatttcctgctttctagggctgcctttcaccttccccttcgtggtgacttgaaactgatgaaggcaagatctcctgcgaacgtttggaatgaaacactttgtcaggaaaacaagcaaggaaatttgacagctgcttgatgtaggacagtcattaaactttcaagaatgtaggtcttctattatttagtgacgttaatctctcttccaaaaaagaaacaaaaaagattccagaattgcagagtgagaaagttgtgccattggctctgctgaaagtcaccaagggccctgcctccacactccctttcttgatggggctactgagctggtcccgtccggccattgaattaaaatcagataattcagttgggttttcgggagctgttatggaggcctcaaatttattcagtttcctcacttactttctcttttctcttccattacctgctttttagctatttccctacttttaaaacccagcattggagaaatggggcgaagaaataaaacttcaatcaaccatttgttctgttgcctgagggtgtttctgggaggaagatttggtacaaagggaagttgaaatgctggccaaaaggagattttacaaaattctgtagctttccttgtttcttgtcactgaagagggataactaagaattgatatatttattttccaagaaaggctgaaacaccatagggggtaaaagcaaggttgtgtagcagggttttcttcaactccatccatacctagaagtgagaggggttgtccagttaggaggtggatgagggaatgataggaactgctcctctggtggctttgagaagagagagtccttggccttttcttggatatgctagagctcttcagacatggaggacagtgcgctccctgggcctgctaggatacaacctgactctgcacagagaagccttttagatgcatggtgtgtttccccacattctaggtggctgcaatgggggctaagtgctcaggggtgaatcctgcctctgcaaccttcctgcagcacgacctaggtcaagtcacttggccttcgtgtgcctcagtttcctgttctttaaaataaagataataaaacccagattgtataagtgtgtgctcacaggcagacattcatacccatacacatatgcacacaggtatgtaaaatggatgccaagttaggaggggccatagccagctgtgagtctgagttaactgggtcaggatggtatgggcattgaagccctgccttggctcccactgggaccatatgccaacctactgattgagtcattggtttggtctttctatcatgagttggagtttaactgctctgggaagaatctggatgttttataacttttggggtagaacattccaccaggctgtttctacatgtcatttggagtgccactttccaatgatcttgcatagctaatcaacaaatatttcttggccactgtgtacataattctaggtgcaggagatacaggggtttgcaagtcagataaggtccttgagctcagagagcttatatcctagggaagagagggagataatgaactatgtcaggtggcggtaagtgctatgggaaggatactgcaaatccatcccataacaagtaatgcctccaactccattcattcatttggtattgatggatcctctgaggatgatgtaacgagcctcccaacttccaggtgtttacacaaatcaatcctctctccttcctccctaaacaaggtatcttgtgttcaagggaatgatctggagtagttaatcttaagcaaaactaattcagccttgaaatgcccaccagacgtggccacccaaacaaattatttccgccaaaggaatgacacaggtgaattcggaagacctagatttggactggctgttgcgaggaggaattccctcagcagataagcaactcccgaaggaaacgaaggaaagtcagtcttcatgccatcccaccttgcctcaccctgccccacttcacgtttaagccagagatgtccacaaattattgtaggatttccctgtatactttcctttgttaggtttgactggggataatatcatagctctagtgaaagttttctgctatttggtgggttgtaaattgaatcttaatgaggttttagaacaatgttcatgtaaaaatatatttaggccatttccaaaatggagcttattaatccaattatgcaaatggatgtggcaaccagcagatgtccctgattcttcttcctctctctctgtctctttttcctgctctgttttctgagagggttgggagttggcatagaggaagccctgatcgaagtggataatttgtttgctgagacaggcagtcctgtgtctctgtaagaagaccagaagctttccttatgggggtatgatgggcagtgaggagagtttgagctgccgagttttctagattctctgatttgaaaattagagactctcaaaagaagtctgtccttcctgagtaattgcatcctgacactgttgaacttcctctgggtttcgactttcatacccctcagaggctctgaggagggaggacaaaggagaggccaccccttccctggggagggagggcagggtggggcacacaacccagctactcgggtggctactgctcctgctttctgggcagagaagctgggtgtcttgtttctccttttcctcttgcctgctgccttggtgggcctcctattggtgtttgttcaccatcagtgtctcgtggcagctgccacacaaagttctgtttttgcaaaaggcggtggcatcaaagataaacgttggatttggcagtaattcatgaattttattcagctactctgttcttgtgatatgaacaaaccttgttagaccagagccactagtgtggaatttgggatgttgattcaccaaggactagaaaatgagtaatgctgggaaagctgggagaatatttaaaatgcctcagaagatgaagcattttaagcatccccagtcacttgaggtcccctttttcaataccttttcacaaacaaatagtctccctagaaaaccttactgggtggtacttggttggcctggcttcaacacttaaagacgagagctatactttcttttaaaatattgttatcaatataggaacttagctttttttttcatgtagtctgaattaggctgactttatagcttgcaacatcctttttaattgcagaagtaatgcagttgcttgtggctaaaaaaataataaacagtaatgcatacaatttttatttattttcgtgaggatagagacagggtctagttatgttgctcaggctggtcttgaacccctggcctcaaatgatcctcctgcctgggcctcccaaagtgcagggattataggcatgagccaccgtgcctggactacagttttttaaaagtggaaagtagcccgtctccaaactgttccttagagttaatcattatttattattgctctagctgtgtgtcgttggactggttacctaacttctctgtgcctgtttcctcatctgtaaaagtgagacaatattagcacttacttcatagggtggttgtgaggatttagtgcaatatctgacattttctgggctaaactactattagctattgttgtgagtagtatgtgctttttctgtatatcagtgctgagtacatgtttcttagattcagacctttaggggtatggcaaacatcaatgagcagtgttttgccagcagcattttcacccaggatggggcgatgtgagtgaagaagcagggccctctgtttggttttctaaagatccattgggatccagtgtggttagattttcttcatggttgctctcttcaataagagaggagaatacctggaatgggccttttgctctgaggaggggtcccccaggtaaagctattccttcccttggaagcacctgcagccttcctacagatgccaccatccagaggaggccccacctcccagggatatcatgggggatttatgaccaaaaataatagtaataataataataataataataataataactcagactgacttagaacaaaaatcacattctagatgagctgatggaagatcgattgaggttttagggttttttttatgaagtgaaaaaaagaactgtttattttgccaatttcattataaaaaaataataagagtgtgtctctgtggttgtttgtacacagaaagcagaagaaatgagaagaacctcgaagtcatctggcaaaaggcgggaccagactggagatgcttttttttctcttttcaaaaccaggagtgtatttgttatcacacaatttaattcaaaaagtccagtggtagagtcagagcacccatctccttgtcttggttctgccaccaaccagctctggggcctgggacaagttacttaacctctctgtgccccctcttatctatttaagaatatgggtctggaagttcttgtcttacagaaccatgttggtggtctgagagcagtgacaatgaggtgctgtgggttgggtgagtgtgggagtgtctgtcctttgtatactgcagactctcttctctggatgtgccaactgagaatggctacaagaacatcagaaaacaagccaccgccctaaaggtacttagatccaaagaaaacccaaagcacacatgtaaaagctgctcaaacacatacaaaggaaagcatacaattatagtcaccacagagcatttaataataataagatgcctgagagaaaatgtagctgggaacccacatgggattgacagaaggacaggacactttgtcacttgctttttcaataaacagatcagattctcctttttaaccacatgctccttggccaccttctgtgagcaaacacaggatttatcgaagatctgagaatgttgctaatgttgcttgacccctggtaggactagaatccatgacttccttagcccagccctctaatcaaccctgcccatccaccaggtcttgggaagctgggcagagatgccataagcaaaggactgctggctgaagcaccatgggaagcatggatgctccttctctgtggccaaaatggcagagcagccctgaaaaaactttcttggctgtgctgtaggctttacacaggcttgttattattttttgaaccctctgagattgacagggcaggaaatggtatcacgattttctcttaacttctaaagtgacttgctatagtcacctaggtttttcatgaattatagaagagaagaggcctaaaaactgaatttcccaatacctgggacaatgctgatttagtaagttggggtttctaggagaagatagaaatacattgacatatattaatccattgattaattaatttatgaggcaactgccatctacattaaagaatacacatttttttcacttaataaaaatgagatctctctcatgcacttcttaagcttcttccaaaaacaaactaccaaactggtaactgtccaattagttggaataaattgaacaggcgccctcagttaattgtcaaactgagtagtctaaaaaccacgtaacaccaccaagcacagagtgttccttcccttcctcaccaggtctgctgctctgggaacagggttgagaaccccttccagtttcagtccagcgaagatgcgttctttggccatgaactagaagccagtcctccatgcagtgcctttcgggctgaagccagttgtccactaaatctgcttgggaactgatttgttaattattcttttccttttgtgacatttttcaagataaacttacttgggccagcctcctagaaaaccttttaaaatgctaattacgcaattgtgcgaataatgtaaaaatgagtcctgtggtgcactcagcacttgactaattaacaagcagtaaatgaatcctagcctaggaaattctgtacagggctgtgtgaacggcagagagcttcctggagccacagttggaagagtggttttaagcaaataggttcttagagaaattgaccagtgaaaatcaagaattatttggtcatagcataatcttttaccaaaattgaatatcattggtggatttgattcagcaaatgtttgttgaagccttgtaaggctctataatagacctagggaacaaggatacaaagatgaattagatatgaaggatgtcctgaaagctaatgatcttgtgaaagacagaggcgagtaatcagagactacagcgggatggcttttaacttcaaggacagaataccatagtaatggtggctccaatgataaagattgtcttacaaaatataatgcctgaatgtagatggttctagggttgtctcttcccattcttttgcttggtcattctcagcatgttggctttgtgttcttaggcttgtcttgtgattgcaacatggttgccttgttctaagcatcatattccaaaataacacggttcaaaagcagtaagcaagtcagggtctggggaggggtgcagtatggtaggagatctatgctcccacatagcattcacaaaaataagtcacatggccactcctagatgccagggttggggagagggtgcctggaaatccagtctggctctgcagctactttccatcagcagctcaagactatggaagggattaaaaaattttgttggccagttggacatctctgctacataatacagtaagcgctgtagtacagatgcatacagaagacagagacagtcaattctgccttaaaaataatgggaggttttgtagaggacctgacagcttagctgagtcatcaggtggatgacagagagaaatgtgcaaagcatagactcacgaaagagcttatcaagttattgtgctgtttgtgggggattttttttttttgccctttttccccattttttggtcaaacctcacgacctagcaagtcatttaactcatcagggtttcaggatcttcatctgtgaaagtgaggcagttggactctgtaaacataaaatgatctccattgttctttcatcccttttttgtttaaaccttcagagtagaagttacatagatattaacagtctcaacatttcttgtacagatatagcagggttctttaatcttatctcctctataaaaatacatttcaaaaatttctcagggaggcaatgtggtattgtaggcagagcatgagattgggaatcacggatctgcatttgaagccaaactttgtcattttcttgctgtgtgaccttgagaagacacaacatctttaagtctcagtttcctcacctgcaaaattgagattatagtacctgtcttccaggtttcttggaagatttagtgataattgtttttcaacacatagcacagtgttagatacttactaggttctcaataattcacaaaagaagaaatacaaatggccaatacatgaagttttatttttattttttaattttttatttccataggtttttggggaacaggtggcatttggttacacaagtaagttctttagtggtgatttgtgagattttggtacacccatcacctgagcagtatatactgaacccaatttgaagtcctttatccctccccaccttcccactctttttactcctgagtccccaaaatccattgtgtcattcttatgcctttgcatcctcatagcttagctcccacttataagtaagaacatacgatgtttggttttccattcctgagttacatcacttagaataatagtctccaatctcatccaggtagctgcgaatgccatcattttgttcctttttatggctgagtagcattccatggtattccatggtatgtatgtgtgtatgtgggtaacattttctttctccactcgttgactgatggacatttgggttggttccctatttttgcaattgcgaattgtgctgctataaacatgcgtgagtgagtatctttttcatatgacttattttcttctgggtacatacccagtagtgggattgctgtatcaaatggtagatctacttttagttctttaaggaatctccacactgttttccatagtggttatactagtttacattcccaccagcagtgtagaagtgttctgttttcactgcatccatgccaatgtctattattttttatatttttttgattatgcccattcttgcaggagtaagatggtattggattgtggttttgatttgcatttccctgatcatcagtgatgttgagcatttttttcatgtgtttgttggtcatttgtatatcttcttttgagaattgtctattcatgtccttgtttgagagcaatacatgaagttttaaatgttcaatgagaaataactctctgtgtgtgtgcaagtgtgtatgtatcaaatgggcaaacattttttaaattggtgatccccagcatgggtgagggtgtgatgagacagagattctcatatattcctaatgggaatatgaaatgatacatttctgggggactgtgtggcagttggaatctgtcttttgaaaatgttcgaaccctttgatctggtaattcaaaatctaaaagcttatgctaggtggaccatctatgatgatatgataggatacgattagtataaagttgttcatcttggtgctatctggaataaataacattggattcatcacaaatgatcaacaacagacaatttattaaatgaattaagctccattcatggtttttagtattacccagatattaaaaatcatgttttgggaagatatttaatgatatggaggaaatggttgttatataaaattatttaaaaagggcagtctataaaacagtatatatagtatagtcccagttttataaaaacaaacaccataaatggaaaaatgactggcagtaaaatgccaaaatgtgaaaatgattatctctgggtactgaaaaaacaagggttttttattttcttctgtgcctctgaattctccaagctgtcttgcattgtgcatgtaatgatgtggaaaacacttataaaattaagagaaaatatcatatcaggttagaaaaattaccaaaaatgtcagaatacaaatggactccaactatgtaagaatacacacacatcccccccaacacacacatacaaagaaaaaccaagaagatgaaaggaactatgtccaaatcttagtaattttctctgagatggtggaatgatggattatcatcattttcttctttatactagtttatatttttccacttgaatagaaaaagaaaatcgccaccaaataaaacctataaaaagaagttttcttgagtactgtgttccatatagtcactggctctggtagccataagcaacacataaatctgaaggccaggacttcttttaccccacagctggggaatcatttgtcctatgtggaacctggtacccatgttaatcctctgcctcctgaatacatcaagtcccacattgtaaaaggcaaaaggacaaggccagagttactgttgatggagaaaatgagtggattttgctggtgtaagagatagcaatagaatctgtgctctaggtcgtagggagggcaccctgcattttgcaaacttgtgcttgctgatccaataggcacccctggttggatgcagggagctctctggtggccaaagggtgtcaacgcagcaatttttgcacttccacaaccaaacccaagatctactagccgagatcagaagccgatgcatacttgcagattacattttaagcccttataatgggtaggaaaacatctgtctctattatttccatggtatttggtatgaagacagaatcctccaccctgcccttaaaatttcacatagaataggtatgctttctgccttcgtgcccaggtcaaactcacttgacactgcgtagttttaaactgtgtaataaattgcccgaggtgcaccaactaatgtgtgaccccggatcacactgcttgccccacaaatccatactgtgtgaaattgaccttgctggttgtttttcaagtgggtctttatagcatcatagaatggaaggagtcttaaaaacaaaaagactgagacagagcttgctgaaagaaatgactcattactggctgaaccgggaatggaatatatttccaatcttgagaatattgtccagcaggctccctcatttccctccggctgcctttatctgaggtggccaacttgaaaccaaaactaaagcttctgactctcgtggttcctggatagtcttgtgtttctgtgtgtttgcatcatactgcgactgtgcatctgagatggagtggtccactgatgtgtgtgtgtgtgtgtgtgtgtgtgtacatgtgcatgcaaatacacatatgtataatagtgtgcagtcactgtaataatcactgtatacctgtctatctctgtcattttatttaggcatagtccatagactcaaccatattatacattccttggagatgatcttctgtgtcttttgtacttcagtataatactatccagaggtgttggagccattagcacaatttaggctactttctttgtaagccatgattgaaaacaatgtctgactcatttgggtccttaaactcaggactttgtttgtagaatattgttctatatttagcttttgtgtcagccctaggttttaaagaggcctgaagattagtggaaacttaccccctgggtattctagaatgttccattgagaggtaattaaggggaagaaaaggaacaacttgtgctccccaattggcaagccagcgacttggttatatatttctgtttgctggagcaaaagagctttgaattctatcccattttaacatcgtctcaacaatcaccaaggtagtttaataatggcaccttcgaactttgcctggcaaatggaaatctgaggataagccctgaaatgttctctatagtccatttgaatgttctatcaaatttattcattttgacaatgactttttaaaaaaagagaaatgtgccaggaaatgataattttaagtggaccttaggaatgttataataaagcccagtgctaggacaaagcaaggaccagcttggtggagggttttggaggcagaccaatggggtttgatttttgacactgccaagctgggaaggaagaagtgcagggggtatagacagggcagatgggccctagatggttgttacatgtgtgtgatgggtatgtggaatttcatggtaaagttctatctactttggggtatgttaaaaattcatcattcaccataataaaaacctgaacatttttccaaaaaaaatttttaaaagaagaaggaaacaagcttggccaaggacattcaacaagtaagtggcagagaaaagcagcagcatgtaatgtaagagcatacttattgaaacatcatggcacaaaattaaaatgagcacaggctttgaagtaggatatgagttcaagttatgactcttactccatttgtaaaccttaagtcacttaacctctctgatgtcaacagtcccctccgctataaaatgaggatacaacactcacctcccagagttgctgccaccatgagaaattaacatatatgtcaagcacctagaaccctatttggccttgataagcattcctgcttttattattaatatagtaagcagattaagaatcccagtggattccagtgggcccactgggaaggaacatattttggagtcaccattcctttggtcttcaggaaaacaggagctcttcaggcacatggggaagaccagccaagaagtcccaatttcttagaacttggtagtttgggggtctctttcaggctgcagcaacttaatggggatgatttcccatcaaatctcaagggatacctagttgttttgataggagaatgcaagaatccttcacacaggaaggacttcaagaataaacgacttatcagtgtggaactgagcccctgatctcctgtttccacctccatccaggtacccctggattcccaaaggtagaggtatgcagctattgtcagcaatgagctgtaaacttcttacatgtctatgtctatgtctgttttacttctgtatccacaatacctggctcacaagggatactaaggtttcgaggggttttttgatgaatggatgagtagatggacagatggatgggaaagtaggtggatggatggatggatggaggaaactgacctgaagcgggatgcctgtgtgtctgtgtgtgctaagagtagagttttctttttcagtttctttttcatacctgtttgtccttttttgaagtctccactaaggagaagcacctactatataccagatagtctaccactgagtacctattgtgtaccaggtaggatacaatgaacatctagtttttatattatttaatcttcccaacaactctgtgaggtaggtcttattaacaccactttacagatgaagaaatctatgttcagaaaagttgaataactggcccgtgtttacccactttatataataagtccatgctctttctggtacaccatgcaatgtaagcattcctatagcaaaagcaaaacaaaaccaaaaccaaaaccaaaaacaaaaaacacgccagtgtagaagtgaggaagggggtcactaactcaaaggcagaagaaagtccaatggaagaaagggagtctttgcttggatatctatgagagggtgggtggcaggtgagggagggcatggatcagtaaagggaagatagaggtacctggcagtcttacacgccaaggcttctcctccaagtggaattcagtcattggttggaaggagtaaggtgggttactctgtctccgttctgcctggggtacccctgggatcaggctattccacctgtccaggcaatctctgtcaacaaattctaaggcaattcggaggcagtgggggagactgaaggtcttgcctgtcctattgtctttgtttaggttcagaaaaagaagcaaacagaacaggagaagacactgagacattgattcttgtgcacgcccttcattgagagcgtcctctcagaaggggcataagggaagcaggctgtgactggggaaaagttctaagcaagtttgtggccttagctaaagactagctacagtgcaatctcactgcagcaggaattgcaccacagagttgatcccaccttgaagtagggcactggccttttgtaccatgctatcagccagtcattagctatgggctgcctctgggagaggaggaatcaccttctgagctagatgattcccattggccaagggcaattctccagagaagtgagttgcttttagcagccaacactcatagctggtggggaggaggattccaccagagttaaggggatctgggtggatatcaacagcagccactacacccaccaagctgctatatatgttcctgctgacatggaatatatgtagaagttctgtagggattttggctcttctcattcagatgcaggctgccttgctgggtgcagatagctcacctgcaagctcattctttgatcctgaagagtgggtaccaagcaaggatcctttccatgagactgatggtatagacactttccctacccattctttgtgagccatctgctgctgaagtcctcctctgtctcagctgagatttaatgtggcaacatctgccctagggttttgactttaatggcatttatcatgcacacttccctttgatgtaggacagccaacctcatgacatcttctgtcttctatctccaggttttatttctcctcttagtttagatgtccctcatattctctctaaactcctgtccaacccttccctctcaaatcttgttaatacttaacctggggtcaaggtttctttgggcgcagaacaatgaaaaggcaattagctagctggctttgagtgctaagggagtgaaaactggttatgactctaacttgagacattcctaagagtaggcctttcctgtatggtcaagactgaaagaaataaacggatgtgggcttttttcttgcctttagactttatggattagtcataggatcttgttgaaattattcagtccagaaataagtgattaacatttaacttctttaatgggcaattactcaacagctatgccagtgggtaaatatttacttatcatctattccaaggagtgaatgttaacttgagtcaaacagttacttgtgttggttctttaatagcggaaaagtgaatttatatggctctaggagttccaatttcccaccaaataagaacttactgaaggatgttcagagccctgggctggagttaaattacagacaatttgcttacctactccctccctccaaaaaaaaaaagatgaagattttttgtactcaccactatttattgaaatctggtagcttcaaatctcacaaagccaaacaaattcactcagtttttcagtctgtaggtctgtgacagcctctgtttaccacaaaactgcctgtatcttgtcactatggatgcaagtcaagacagaggcaaagtctggatgatgaatggcttgttcttagtaatgtgcttgtaattgttcttccttagaatgggaaggatggcttgggaggacctgtctatcatagagggacttggcagcttccaatctctttgcttgcttgtctacaatgcagccaatgggactaattcaaatatcccagacatgcccagatggatacacagagcatatggcttgaagactcagttatggaaataacaggcaccatttctgagactttcaattcacttccaacaaatatattttaatcaacaggcaggaaaccaaattaaaagttgaagcatgaaccaaggtcaaaggttaagggttaggatgtgggattttggtgttcatgctccaggtttggcctaccatgcagagaggtcaaagatgactgcacagggaaccattgggagagaggaatgtggtattccagtttgtagaaagtttgagagtctggaatttggtatattagtcagtgccagccactccaagtctcaggggcttcacacaaagtttatttcttgttcatgtcacattccaggcatgggagtggggaagtgagggatcaggacctgtgttccacgcaggcattcagactcccaggctccttccattttatgacttccctgtgccctaaggcctccaagtccacctcagctactgcatccagactgcagatgaggcaaagagaaagtgtggaggatagcgtggaggttttatgggcccacctatattctggccagaactgtcacgtggccccactaacatgcaagggaggctgggaaatagagtcatctgtgtgcccaaggtgtaaagggaaatgttttggtgtaaaactagccagtgtgtcatacacggcttcaggaacttaagactattcttccgtttttttttttttttttttttgatacggagtcttgctctgtcacccaggctggaatgcaatggcgcgatctcggctcagtgcaagctccgcctcccgggttcacgccattctcctgcctcagcctcccaaatagctgggactacaggcgcccgctaccatgcctggctaattttatttttttgtatttttcgtagagacggggtttcactgtgttagccaggatgatctcgatctcctgacctcgtgatccgcccacctcggcctcccaaagtgctgggattacaagcgtgagccaccgcgcctggctattctcttttttttttttttttaagaaaaaacaaaaaactggcaggggtagggacaagggatacactcttcctcagtgagcatttggaagagagctggagaaagagcaaaagaagagagcaggctagaaatgacttaaaaattagtgggatattcctggagagttgccaagctagaggagattcacttccactcataatgggagataaaaattgttctcatttgggtttattttttttccaggcacaggctttagagggtgagttaaacttcctaaagcaaaggattagataagagggaactcagctttgattgaagagccagctgtgtcagaaagtaacagggagaggaagagtgggtcgagccacaccgcgggtacctgattgtggtggactctggaggttgcctgtaaaaggagacactcctcaggctcctcattcactagggatgttcagtgaagaacaaacccaagcgagagagggtgcccagaatgatcgcaggctcatttctaggagggtaggacactcctgcttgattctctctcttctctttcttttcttttcctgtctatgaatgcagccctgtcttagtcagctctttttggaggagacctgtgatggaagggaaggttctgactgggagctagaggaaaggccagggttcagggcctgcctacccagcaggtagactcagggggctgtgtcctggcatgggtcctgactggatggcactctccctccccagcaattccaacaggccttcttgggcggactcttttgtggcagttcctggcagtcccagatgtggctcgttgtcaagcctctggaccaatgcccggagcctgttgggagtccagactccaagtcaagaagaacagaattaactggccaggcgccaagataatatttttccctcataagcaagaatgctgcctaggaaataagtttaactcctttcttatttccttaactcttctttagtctcctttaaagtagttagtgatcatcaaaagacatttttaagtgtgcccccacaaagaaaacttttatttaaaaaacacttatatgatgcctaccctgtgccttacactagcgttgtacaaatattaacctattagattgtcacaacaacccacaacaaaggtactatcattatcctcacttcacagataagggcatacaggtgaaaaaggcttcatggcttccctagggtcatgcagcttacaggtggtaaacctgggatttgaaccaaggcaatctagtttagagtctatattcactgtattgaccctttctatattcactatattgacctttctttccccaaagaaaacgtggattgctttcataaaatggtatacatatagaaaaatgcacaaatcctaagtgtacacttccttgaattttcacaaactgaacacacctaagtacctactctcctcacaaaaaaaccccaaagatcactggccccagaagagccccttcatttcactccccaccccaaggataacccgtatactgatttttccttcattgattagtttgaactgttttttgaacttgtataagtggaataatacagcctactttctcttgtgtctgatttctttccctctgcatcaccctggttgttgagtatagttcaaatttccttctttttgttgctttgtagtatttcattttctgaacatatcacaagtgatttatgaattccattattgatgggcattttgctaatatccagtttgggactttacagagaatgctgctatatacacatcttttggtgaacacatggatatagttccattgagtatatacccagaagcacacagccatagggtaaacaaatattctgctttcacaggcactgccaagcagttttccagagtgggggcaccaattcacaatcccaccagcagtgtgcaagagttccagttttgctaacatttggaatcttctgtcttttaatttataaccattctggtgggtggcagaattttttttttgctttcttctgttttaagaaaaatagactttattttttaccacagatttagatttacagaaaaattgagatgatagtaaagacagctcccatatatctcccaccctattaacatcttacattagtatggtacatttcttaacaactcatgaaccagtactaatatattatatactgatatattatatatactaatatattatcattcacataattatttttaaattgcaaacacatccaaaaaatgaataacaatgttaatgtcttttatataaaatgaggaccattagataacagtttgccagttacattatttaacgggatgggttgatgactctagtaccgttctttgctggataaagtcaaaaccaccagttgatgcagggaagttgttacctagcataaacctttatgatgatcattctgtatcagtggggctcctatttaaatgtccattcttgtgcccctccccacactaagaatcaaaacctctggagatgcagaccaagaatgtgccttttgatcaagaaatttcaggtggttctaatacatcctaaagcctgataacctatgttttagacataggaaagcaagcccaataaatgcctgtaatattttaagtctagggggcatatcattttctgggctgggcagctagtactaagacactaatttagttctgattttaataatgtaaaggtatatggataaaaaggccgcctgtcaataccagagttctaaggaggatgactcttgagttaggtttcccaagaccttgaataaaaaagtttgcgctggaaaagttaaatgatgctgccaaccccagggggcaaggcagctgagacagagagagacagagagagagagagagagagagagagagtgagttggggattgtggctctttggcatctcaaaaggagcttgaatgtcagacagggtgtggaggacagcaagaagagatcagtgtgtaaaatattccaatggaaaattccaaaaaagcgtcagccacagctaaatgggacaagaaacaatatacgttaatttaagacgacgccgtcaatttagtggcatgtttattgaaatagccctttgcattctaaaaacagcactagggtatggacctctgaatccttgcaggaaactgtacaaattcctaggagggaacagcagccccaaatctgactttaataacaaaaggcaattatttttagtattttccagtagatctcagctgtctggtattgtcaggctctattcatggagaggtggaatttggagagagttagttcagtgaatggtgagtgggggagggaggaaaggaaggaggaaaataaggcagggaaaaaacacagaaaggttgggtgggggagcgagaaggaaggagagaaggagagagaaaggagagaatgagaatatgagtgggagcttgtgagcttttccactctggtactattatctggcatgatggccctcaaggcaaggtgccagtcatataataataaatgccaagatcaaacctctaggaacaaatataaagggactctaaaacaagcaatttgtcagactggtttcagggtacggagaaacataaagaacttgggagaaagtaagtcaccgataaattctcatggaaacaacaggaaagccattataggtgctagcattgtaactaattaagaagtggtaaaaccatagagggggtggcattggaggggatggtggcaataggttatgaaggagaggaagggtatggaattaattttttaaaagctgcttggaaaacccaaacttgtagattcagcaggtttgatggatgaatacctaggtgaggaagagaaatggacattgtgtttcttgccaattgtgttttgcgaaatcatggagaagcaggaaggttgtcaagtggagagatgactctgtagagcatttgtcatttataggaggtaaagcacaatcttgtcaataacaggccagaaaaagaacattattttgttctcaaagtaaggaataaacatggaggaaaatactaaaagattctaggtgtggtggaactgtttatgatgggcagtttccacatcttaaatcaagacaaatggatttgatgatggaaaggagccatcatccttaaaaacttatgtaactgttggacaaggaagaagaacattatgtctagagctttaaaagatgtttctatggtgtcctaggaaatcttgtgtggaaattcatccagattggcttggatactagcagtctcatgtagatttttcaagtggcttaaggagcacagtccgcaaacgataattcatagaaacatttcagcctgggaggaatataacgacttagtttttaaaggtttgctgttcactggtgcttcattcgatcccaccctcgatactctgggaaacactgtgagagatactagcctcttttacataaaaggacatataaactcagaggcattaagtcactgtctaaagtcacaaagcttatttagaagctcagatcaagttcccaactattgttatttaaccttgagagtcacttttcaacacgttctcttacaaacttggctttaacatataaatgtgaggtgtcagtgcatgccaggaagataagaggattgcaaccaaagtcctcctgtggagagctgttgattaaaacagcaaacaattcctccttctaaataatgcaagctaggattcctaaggaataggattggtgagatcaggcataagaactgatcacacacacaacaacaacaacaacaaacaaacaaacaaacaaaaaaacagagaaccaaacctatgtggctctcaaggcattccttggtgaactaggtgataatctgagaaatcattttagaatcttcccaggaaagcatactgagtgcttagaactggtaaggcagggaagagatgaagaatcaccccttccatccacatggcctctggtctttggtaataactgacaatgtttcctactgtgcctcagaaattgggtggggcaggctttcaaggatgaaaaggggagattgctcaactggagagggcccactatactctaagaaaggagtgagtctctggaaggtgccaatgggacactgctagagaaaggtagtgtatttgctgcaaatggagaggagataaatatcctagtgagatacctatgaccttgcatggaaaacagtatggagtagcctagcatggatgctgcaagtggcttgctgctttactaagcaagttaactttgactttttttttttctctgagaactgagaacagtatttagggaaagagaaaggttcaaagacagaaggcaatgtttatggttctttttttttacatttttaaacttttaatagacaaataataattgtggatatttatggggcacaactacaatttttttttttttttttttttttaaagacggggtcttgctctgtcacccaggctggaatgcagtgctgtggtcatagctcaccgcagcttctaactcctgggatcgggtgatcctcctgcctcagcctcctgaatagctggggttacaggcatgtaccaccacgcccagctaatttgtaaaatttttcttttgtagagacaaggtcttggtatgttgaccaggctagtttccgactcccagtctcaagtggtcctcccactttcaccttccaaagtgttgggattacaggtgtgagctgctgcaaccagcctataattctttaagtggggtttcttctgtgtgtgtgtatgggggggcccttagaacatgaggctacttggcaacagcccagctgctgttaacatgagaaatttgttaaacttttaatttccatttttatgtgcatttgtgcacacatttgtatttcttttctttggaatttagcaacggtgattttaggcttgggggtttaaatcaagataaactactttccttctttctgaagagtgaattcaagaaatacggtggccaagagccagaatagtctcagacgaaacatactggcttcatttggagatactgaattgattcttgtaaccatttcaaatctctctccaagacatttcagagctcagaaaatagaacaaaaggaatttgctttttttttctctttccagaatctacagcttctcaccaatgcctaccaaacctactatacagttagacatttcttcatttattcacatactcattattaatggttcaaacaaagaacataataaaatagagttataagtgctaaaaggtgtttctatgacttcacaccgtggctcaacaccaccttaacattactgctttcatagccaagtcagtaagcctcttaagccttaagtctgatttacacccaaagctagagtggcagtaagagggggcacatattttaataagctatggaaacttcttttgcccatagcattggcccaggtgctattagcttgatttcaattacctctcatagtcattgaaaggaagactacagattcctgaagggctatgagtttgcctctttgatgacctcttatctttaccccatatcatactactctgggaccttatgaatatcacttaaacaatatctgtgtcctcataataaaatattattaatattcttttaaataatagttttaaaatgtatcagttaataatagtgtacaaatacaaggtattttatgtagcacaaatatatattaataaattacatctccagataagagttgtttatatcaagttaatggtacattgctttaataaagtgtctcccaaactacatggtttcctcaggatattaatagatcacacacacacacacacacacacacacacacacacacacattaatgtggtccaaaaagtttgagaaaactggatgatttaaaaataaaatgggtttctttattgcagaacctatcaaagcctttaatatcctgaagtacattataactctctcaaagaggatcaaacatgaagggttttctaaactcattggaagatgcagctctgttaccacatttgggattgggttctataaaacacattttcagagatgctgttttagaaagtaacttcctgcaacagcgatcctttatagggcaggcaggccatgcctctaggaatgaggaatttctgggactatttaagaggaagaaggggagaaggagttgttgaccaagggtaaccaggtatctgaataattaaggtcttgaggccaggaactccttgaggactctttgaggtcaccatcatcagcatgtagcataggtatttgttatttgattgttgggtgaatgaatgcatgcatgcatgaatgaatgcttcctctaaacctgagtaagccaagcaccagctggtcctgattacctctggacccagggtcatatgagaatgtaaaatgcatcctgatgatttgaggtccctcacattagataaatgaccaaatcagatgaagaaatgtcaaagctggctcaccctcgggtgtctcacaactgtagcccaaccccaataaaacattcaagggcaattcaggttggggcaggaggtgcctgatgcctcccagtttgacttgagaaagatgaaggcatgtctgtttacattctgaggtgggttttaaagacaacatcgtggatattctcctctgctcttacactgacataaaggggcatctattctcagatgcaggtcctgacaaatcagtgtgtcagttgtaagctatgcctcaagtactttgttattaatgccagacatttgggaatgtcttacttttaaatatgaattagaacagatttaaggctatagctaacttcactctcactcccagcttgatatgctttcttgagtgagagagaaaacagcttgcttgccaggaattgtatttgcttgcaccatcagatagatgtatcttattggaacaaaaatgatgagagtgctgtaatagaggttggagaaatgcatcttccacacagatgctaagcgagaaactaggtaaagcgctggtccaaagacccttaacaacaagccagtgggtagcttcgttaacttagattttcttctctttctttggggctcataatgttttccctggtggtgccaatcttgatgctctctcaccatgggtcagccacctcagcccctttagtataggggccctaaaggtctcttgcccattgtctttccttcatacaattagccctatcccccatcctaagcactcattgccaaggagcgccattcctcttagttttctgctggccgttctttgtcctcagccctaggtggaggtccaacttccttgcatcttctcctgtccctgcatacaatgagcaggggctagccggcctccaactctggaggagtttgtcactgtggggaaagggttaatgtaacctttccccttctctgtggaaatctgtccttgttttaactttccagctctgttgccctggaaacgtggtgaaggtggaatgtcagctgtgttaccaggcagtattgcttatagtagaaatgacccaattgttaaattgcttttatgccacaggattgtaaatgaatttgaatacctggtgaaaaaccatagctttgggcttccctgagtgtcaaactcttggtactggcatgtcccatatggggcccctggaaactttagttgtttacaagacatattagctcccgtggggtatggggcttctaagccaagatggaccctatactctctgaagtgcttcttgtctgtttgcacctgagctgccacttggagttccagagaggaggccctggacagcatgtgggctgctgtaaagacccccacagaggagggatgcctgaagctatcctcctggccatggtggttcctggcagtttgtttgtgagtagactcccagaagcagtgacctacagtggtcttgtgagtcagtgttttgctgaactgaaggaggcccctggtagacatgagagtcatgagagggtaggtttgctctccatacttgctggggccgacgtgacatgttgtcttcccgccaagtttcctcacacatgctggtctgactcttcaaacataagtttgcagggagttgtttctctgtcactggaagatattcagagcccatttccataaaaaatgaccctgttgatttattgtgtttgatcaaaaacgaccagttggaggggccaaaaaggatttctattcccagtttttctagaagttttctatttcctacagatggggtggttcgtactgcttttaaatctcttaaatgccttgcactgccagaagcctccttaacatgtaagtttcagaagactggagcatgttttcagtgtttcgttttactgagcatattcagctctgccactgtttgtgggctcattggcacgattcatactgagactcctcatttagtgggctgagcttggcaggaggagttcaatagccaacatttatcgagcacttataacgaacccaggaaccgttccaagtgctttacgtgtattaacgcataaacaacaacactatgaggtaggaaatattatttatgatcttcgttttaaacgtgaggcacatggggcacagagtacattaaatgacttgtccagggccacatagcttgtaagtgacagagacagtgctcacactcagggagtctggctccaggactcaagttgcccctctgagtctcatgataaaagcaagatcttgtccagcctcagggagttgagggttggggcagtttgagggtgtccttggtggtccctggtgtacttggtggatccagacagcagtttcccactggtcaagcaaggaagtggaggatgtttttgttccctgccttgtagaagaaagcagagataacctaccccatcggattactcatccaacagcatttaccaagcatctcctcttaagcactgtagtgactgccaaggatacaacagtgaaccaaaaggctccaactcccagcccttggggaggttctactctagtgtatgtcctggtcagattctcccatccacaaaaatgaggaaggggagactcaggaataggaaaataagtacaaaagtaaggaaagaggaggaaggagaaatggttcaggcttttctgtttctccccctagtaaggagttatctgtttcccagtatgactcctttccccctgcctaaccccatcacaaaacaaaatggaatcattgataacactgcctaatagaactttctatgatgatggaaatgttctaaatttgtgctgcctactagtgagccacactcaatcaagtgctactgagcatttgaaatgtggctagtgtgactgaggaaccaaatttttaattttcttaattttaactaattggaatttaaatataaatataaatatatgtgactactggcttctctagtcgacagtgcagccctagaactttcccatcctgaatatggcatcaagaccccttttcccagcctgatccaggtttcgtttcttctctttttcttttcttttctttttttttttttttttgagacagggtctgtctctgtcacccacgctggcgttcagtggcacgatcatagctcactgcagcttccatctcctgggctcaagcaatcctcctgcttgtctccagagtagctaggactacaggcacgctaccatgcccagctaatttttttgtttttagtagagatggagtctcactatgttgcccaagctggtcttgaacttctgggcttgagcgatccccctgcctccgcctcccaaagcgtttggattacaggcgtgagccaccatgcctggccaggtccaggttattccaataaattcccaaattgcactgggaaaagtttaaggaggtggccagagctgtagctttcaaatgtgcattgatggattaaaacttaaatccacgaacatgggccgcaaaactccaaatccagtctttctcttcagagttgagtttccacccactgctgtttcctttgaacacatttccaggtagctaagtaaaacaagagatgctcaaaaatcgtttttgttcaaaaaggcaagtaggaggtaagagaaagggcaggaggggagtgaaagaaaggctgatattgtagcatcctaccaatctttgtttctaaatctcagcagccttgaaagagaacattaagatatcttttactctcaggcctggcttcccagggagaaggagccataaatgaaagcctgctttgtgtggctatactatgactgcagaaacaatgaaaagacttttttttttttttggggggatataagtttatgtgtgtgttgaagcccttgtcgctacaaagcaatctcacaattagctactgttcaccttcttggcttcagtctttctaaaaataattatgatagtaactttttaaaaacctgctatctatactcaaggcaatttcttggatcctaaaggatttaacaaatagtactcaaagcctcaggccctagctgacctaatcagcttgaaacttgagcagtttttaaagacggaatcagatataaaatacccttcactgaaatcctggctgttgggatttaggccaaggttgagctttggttgggacacaccagcccagccaggaatccacttgattggtcagtgctcagaccatacagttgtgaaatattttgaatatcacccctggatatcgtggctgtgccaggcctccaggaaatgaaatgattgcagtgggaagggactgagccaccccatcattgatttatttaatgccaaattgagtcagccagccagggagacaggtgtgcaaataaataattaccttatggaaaaacttgagccaaggctgaagtggaagtgtttataaaaagctgtgggaggccagaggaggaagacattgttttgacctggggtatcagagaagtttgaaggagaagctgatatttgatctggatcttgaaggatgagtaggagctcaccaggacacaaggcattctaggcagagggaacaatgtttgaaacaccaaagagaggactcacaagttccatgtgtttgagcatagcatttgggtggtggtggtggttagggtaggaagtccaaccagagataaagtggaggatctttgttggtgtcatattatgaagggcttccaataccatggcagaaattgacttaatcctgtaaataatagggaggcaagacagtttatgttagcatgttgagagatgatggggtttgatttggaggaagacatttacagtcatgtgacaacatcaccagaggagacaaatggactagtgttggagaaattagcaaggagacaacagttcacatgagagttaaggggaccattgatctatggcagtagctgaggtgatgggaagtaaggagtggctggagttgagtgccactgagacataggattagcagctgttggttactggatttggaagacaggaaggaggtgaagatggttctgaggactctagcttggtgggcctagtggagatggacattttaaactaagatgcggcagccttgggtagaaatgggatgttcagctttagacaggagacttttgagacgcttggtccaggaggtaattggaagtccatcagcatgttatactagcccgccagttgagcatgaaggcttttctctttcagttctttctgagttgttaatgatctcttatatccaactggctttccttatttgttacacaatcgaatagtcaatgttccctggtgactgcagagtttctacagaagtacttaaagatgatcgtctggctggaaggagacttctcttgaagtctccattgcataggaagcacattgcttttaactgaattgtgtattatgggtctataaaaataggacaaggaaaaagaactaatatcaaataaatcactttaggaatattaccaaaacataattctttgcctctcacatgagtggtataatcagttgccctgggactgatcaacacaaaataaaacaaatataattaatgaaaatgtattactgcactttgctctcattataagggatacttaaatggttttatagaggcagaataattatttgttcatttggggtagattttggtgggaatctgatggatatttggaggggctaatagccctccaggtcatcctttagtgctgccattatgaagacttaattccaatacatcaagctgaaccttgtggccacattgcttcttgaagatcctgtttcaactacagagatttagctactggagttttgcttgttcctattggattgaattctacatctattgaactgtttctctcatgaatcattcacaggatatagccaaagtaatgtaactttgtccccgtttattaaggcttttattcccccttgtctgggcggtgataacacttgcctctccaaagactgtgagaagtcattgtatgcagtgaatttagataccttcctgggtctgtgatctgcaaacttcactccgtgtaatcacatagatctgtaaccactactcatgtatgatccttggtgaagtctgctaaagattacagcagatatgcccatttagaaacttttactggctactgttttgtttcaggatggctggcgggaccacaaattgcgcttaagatgaatcttgaaaccctttagccatgtcccacatttgattagaatcagtcaacccctttgaaagttatcatgaaacaaataggcagataaaagcaaaatgctgagtggccgaggtgaaacagaccccttgttttggttggttatttgatctcaacccatatcctgtcatttggcacattgtcagatttaagaactaattctagacttccatttatatgagggaagccagtgaacacaataagaggggaggggaaaacccacatggtttgttgcagccatgcctaccctccgctttccttttcctagttccagaggcacctttcctgcattcaggctcaaggctgtgcctgcacatatggacccaaatcagtggacaaaatgtgctcttagctagttgaaggcttttagccctccccctacggaaacataacatgtgattttctggtttaaaataaaaagttaaggggaagaactatcaaagggaaagaaacattttgaaaagtttttctttttttttttaatagaaacttgtctgactgtttcataataaagttggcttagcaatgttaggtccatttaaattatcatcgacaggtaggttagggaagactatagggcaaaattctcaaactttcagtattttcagcagacaaacaagaaccaaattatccacactcaggtactcagagaagagatgagggagtctccttgggagtgaaagccaagggtcttcaaatccatactattaaggaggggaccttgtgaaatttgtgttctcagggtgtgtagatgcaaccagttagagaactgccacggaagcaaagatgtcagtgttggttgctgttcagatcttgtgcatttgaagagaaccagaatttttggtacttttggtaaagaacttttggtaaagcacaaatgcatggttagttaatgagattcaatagtaaaattcattactgcacctcacccccctccacagacaacaagtttcttctaggattgccccctacacccccagcatgttattatgaaaagtttcaaacagcacagtttttccccaaagtaccaaacatcaccgaactggaacaagtagtaggaatttgaatcaggtagattcagacaccaaattgactttgcatgtttcctcatgacttttttttttttttgggcagggccagacttacacattattgtgaaaatgtggctgttcatcttgctgaaatagacaaacacgatcttctggcactttgagcacctcaagtttgaaactgctaatcttctatttcctgcctctttcccccggttctgtcaatcatcctcccacactcccacttccaagacccccgaatctcagaggcatcttttgtgctccctgtcctttgcttctccaggtccagctgggtgacaggtctcccttggaaacatctctcccagccttccttgttcctttctggttgctactgccctactgccccccaagtttattgagcattttttcatgccacatcccatgcaaagcactttctacacattaactcatttaattcttatagcagtcctataaggaaggtaattattatcctcattttgcaaatgggaaaatagatccacactacttttgccctgattgctgccctgttcactgcactctggaaatgccttggatcttccatctggtccactgtttcccatgtttttgtgccttcctcgtctctctatccatccaaactctgcttattttgccaggccctgttctggcttctacagcaggaagtgatcattccttaaatcagagctctcaccacctataccactctcttgttcaacctcaaacagagccttgcaaggcatttctctcccatgtgcacgtcttatcttccaaactagattgcatccccttggctgcctgtgtgtgataggtatgctgtatggatgtactgattgatcatttttcaaaagtaattgctgttttcatcactttttttttttttttaacatatctcatagtcatgatgcagtaatgacgttgaacaaaaaagtaatggtgctaaggctgggcacagtggctgaggcctgtaatcccagcactttgggaggctgaggcaggtggatcacttgaggtcaggagttcaagaccagcctgcccaacatggtgaaacctggtctgtactaaaaatacaaaaattggccggatatggtggcaggtacctgtaatcccagctacttgggaggctgaggcaggagaatcgcttgaaccctggcggcagaggttgcagtgagctgagatcgtgcctttggtcttaaaggtagtgtcccagtgtttccaagtgccagggttaagatccaaatggccattcgtactacaagaacaacccttccccctagattcagtttatttgcaaggcctaacttcatttccttgagaccttctacttgttctgatcatcatgatctttagaacaagagctcttcccttctgactgcctgtgatgaaagcattttctgccccccttcttagagcttcagaaactgactttctgaaggcacatctaatggtagcactggaggaaaacccatccctggcatctgaattcaacccaggttcatgtttagagcacaaatcccacttctgttcttgtaacttctcataatgacccttcccctccacagtgcatgcattctattcagttcctcttaaggtggccttttaaagaaatattttaaatgtactgtgacagtgggataaatactgaagagtgcagttaaacacaagagacttgaacttcagataatggtcaacaagatcattctgaccggtggttctattgaggatgacaaaaaatgatgcaaaaatataaagaagctacagatccatcagttccccatgaaattgaattaattaatgggtttgtgattaatctgctagtagacccattttgctcaatatgcactttcttctgggggtaggtataggggcatagtgtttggtttgttcttgtgagattaaaagagacacctggtatcacttagtatcaattggactggggaggtggtgttaaagtgctgagcgtcctccagaagaaagtctgcactgttgtgaatacagggagagagagaggatgagtgatagctataagcagtggccctcacttttcagaggcgtggagctgttgacagaacaaataatcacatctcaaagactttgaagctcctcacatggtcagcagacaagaggccgcaaggctcaaccataaatgctggaattagttctgagagcagaaggaaggacttgcctttgcttgaagccaaaaccaatctgaaaccacagaacctcagcctgagggctagggctaggcagaaagcttgcttttgaaacctgagctctccttgcaacggtggtgggggtgggggtgttggtgtatgttccacttgtacaagcaaaccctctcataagtttgaccctgaaaaaattacataatcctttcatcacagcgggttacattttccaagggcagagctttgacttacaactgattataggtgtattgttaggactccagcacccatgcttgatatgtgtttgtttcatttccagtgttacatgtattaagtgtcaacaatctacactcatgctacctcacgtttgaaaattaactcaggaagtcacaaaatgaactttttcccctccttagcaatttcccatcttcattgtgtgataaaggtttttgctaacagccaagtaccacactagacattaggtaggttcatgggcctgtggtctgttatcaatgtcttgtgttaatccaggctttcttccaaagagtttgcagtgctttttttcagacatcatatcatgtcacatctctccttcctcctgtgttccctaatctcacttaatgacaacaccatgagctcctttccctcttcccttacttccctgatagcttaatattcctccactatgccttttgcatcttccctctctttctcactttttctttccctgtcccagggcaggctcttgtcattcatacatatatatatatatgtgtgtatatatatatgtatatatatatatacacacatatacatatgtgtgtatatatatacgtgtatatatactatatatatacgtatatatatagtatatatacacatatatacgtatatatatacgtatatatacacatatatatacgtatatatatacacatatatacacatatatatatatatatggtctcactctgttgcccaggctggggtgcagtggcacacttatggctcactgtagcatcagtcttctgggctcaagtgatcctcccacctcagccttctgagtagctgggactacaggtgcatgacaacacactcggctaatttttttttttttgtggagatgaggttcctccatattgtccaggctggtctccaactcctgggatcaagcctcctacctcggcctcccaaagtgctgtgattacaggcgtgagccactgcacccagccatgctcttgctgtttcttgcttggagtattgccatggtctccatgagcccatcactcctctcctccaaaaccacactagtctcaactgattcacttgtcgtttggtccctttggacttttcaaacctcatctgtcaggacctctctcccttttcccccacaccattccctgaacgcactatccatttacatgcattccttggctcagctgtttacatcatctgcactgcccacccccccaccccaccgacaacatcctgcatgcctatcacagttcatcttaagtgttactgcatggaaagcccaccctgattgatatccataggcagaattcatcactgttcacccttatgctctgggagccctttattgtgagctcaatttcagcatttagttcagtctaactttaaaaaaatagttaattacgtgcttgaaaacaattagattgcaaaccccttgagccagggactatgtcttatttgtctctgtggcccactatagcaaccagctagtggcctggccctaatgacaacctggtaaatgaacagagtgagcgatatccctgtatcaaaggtaaagaaagattagcatttgctgctgtaaggatggctaaagggattcatttgtccaaagtccttcaaagggcaagtcaagttgagacactgtcacttctgtcacaatccccagttggctgggtggcgccacctcttcagagatcttggcagtagatttttggttgccatttgttattttatacattgggtgggtctgtatgtatgcgcatctgtgacaacaacttggctgggcaggtagatgacatctgcttgtgcaaatctcttttcattcttgaatatagttgtaccttagaaatacaatgcaaaacacagatgtcatttaaaaatatctaataatgaaattacaaaagtaaaaagaagcaggtgatgttagttttgattatgtgttttatttagcccaaatgtccaaactattaccatttcaaaatgcaatcaatattttaaaattattaatgcgatgtttcatattttttgtattgtcttcaaaatcccatatccattgcacacgtgcagtgcatcttaattcaaatgcttaattttcatcagaaatacttgatatgtatttagatttcataaaatttacagttgaaaaagtagatacacatatccaaattcttccaaatgtatttaaaattttcccaataactggatttaatatcagcctgtacatttacatttgaattaattaaaattaaacaaaatttttaaattccattctttggacatactagccttgtttcaaatgcccaatagccacatgtgactagtagcaattgtttcggggcatacagtcttagggcacaaagatttctaagtatcattcagcttattcctctgtcctcgtaatttaattgtaaaagaaaaaaaagtgtgacagggatagttattagagaccttcgattagccagctgccttttctctccagccttgccatcagctttgtgaaactggggcctactgctggcttcccgggactgtcgtgaaagtaataggattctgttgacaaagcacttgaaaatccagggatgaaagggcctgtgtaattcccgggtttgttggccaggctaggctgtgaattggggtctgcgtctatactgcagctgcccctacgcaaccacactgatctgtgcttccttctgcagccaaggtctacaccagcatctcacagcacatgagtcaactgcatgttttatcgtccacagcaccgggatgccatgtttttagatgctcatggctttgattagattataacatatttgacgtttcagtgcttaactgcttttgggtgatcaaatatgtggaaaacatctttctcagccaaatagcatattttccaaatccaaaagaattgaatatatttttcgccttccttcaagtttcccattgaatgtcaccccagagaccaatttaaagcttgaaaagtttagaccaaaaatgtttgggaacaaatgaaaatgagatgtgtcacctaagccagtatccagtcggtgtctcatgcaaaactgtgaaagcactcggtattatttatttataataggaaactggggttaggaattgatttccccagaatgctgctagggcgaggcatggggccctgtggctggctctgatatgagattcgagacctaaggggaaactgaaatgactctagacccttaagggttttgaaacaggtgcagtctctcttctttccctctgggaagcatgctgtccacagttggatgaatgcttcagcagcagttcactgagctcttggatgaaaatggcaaatttctccccaaatgagcttattatctgctgctgttgggtgcaaggcatccctcagctatggcgggaattacagcttccatctgttccctaatgtgaaaaatgtgtgcaggcctctgtgctaccaagctacatgaactttagacattcagatctgctgacacatttgggtcgcggcctcagaatggcttttgtcaattatttcattacatatccaaataaccatcctgagggtggtctggatttgtgatctgtgacagtgtggtgctgacatatttcttgcccttggaactatctgttttttggctttgtttagggattgatgatatataagtactcagtatatttaatcattattacttttgaagttagcacagtaccaccattatgaaaaattcttgagtacagttacagccaaatccacatcattaattcttggcttcttcccaaactctccagtctttctccttgctccattattttgttcagacaaatcaaataatgctttgtgcttagagagcaactttcatcagaaaattttaagaccctctgcaaatttttatttctctaagtacaaataaatatcttcagagagccatgcatatttaagcatgtttatttgtgctgggttttttcaatgggtaagaaaaattatggctttctgtgtgctcactttggaatagagacatgcaatgtacagacttaaattttacttgacatatttaataaatatcccttgaataatgattagatacagagtcatatatgttcttgagaatatggccaggcattagtttcttctactaattttatatacttgaacattgtcagagttacagctggtgcattaggtggataatttgtttctatcaattaataactgcttctgattgtcacctggaggaggaaatgctttgactaaagtaagcagcattaactcaccaattgaaaattacagtctgttatttaagacttaacttgaagtttaattgttgtcgggtggtctagtggttggttaattggtttactcaatactacagatctattttcacaaactgatccattctgtattttttcacactgttaggtgtccttatggcatagaaaatgctagatatttacccaactctatattctttttgttctggacacacagagagactacatttcccagcattcattgtagttagttggatagaaccctgtgattgagttatgacgaatgagatgtgagcagaagtaatggagtccactttcagccctggccttaaatttttcctttctagtcctccaaatagtctctccttattggcctgttggctagattcagagaatctggtgacatacactaggcctgttggagaaggtggggccacaagatagaaggagcctgattccctgaatgacttcatggagcagagcatctcagctgaactgtgtgtgtgctcagctccagtgtgacagaagcaggaaactgacctctgttgcctaaagccagtgaaatatgagaattgtttgttacactagttagcccaccctaactaatcttgtatatgtggccaaaaatcagtactgtcctcatacacattctacaagtttcagaggggcatgtagaacacacttctctgtaatttgcactgaacagtaggtcgtgaaaatgcataaccaatgagccatgtggctctttgatcaccatgtccaattaagccacatggttatgtgattttctggtttgagtcagctttttatctggggcagatgcaactgtggacagtttcttgtagtaaaaactgatcatttcagtaagtggcttctccagaggatggagaggaaggtacagaaattcatgttaattaccaaacacttcaggctttagcttcagattttttttctctgagaaaccttttctaaccccactcatgtctgggttgcttgcctcccatgcctcccaccctgtgttcttgccactgcccatgcacctacagcgacttcttacctcactggctggtaatgtctagctcttgatcttgactctctttctttgtagaccatatgtctcagagggtaggggccatttaaacttggctcagtgttgtgtccccagcattctgcccagtgcctgacacatacacattgttgactgaatgattaaaggaaataaatgaatgacaatgggattttggttatcaagcatgagcaatagccttaggatcattcatgagctgctcctcagaccacttaagtaaggcaggctgtatttttttttcctgcctaacaataggaaatataagaagggaaactgacgttcatttttaatcaacagtcaaaacacaaatcagaattagaaacaagggcagaatctattttcaggttttgttttattagcccctgtgagtttttaagagttgaaactcaactaattggtagcccaaattccttaacaaaaacgttttagagcaaaaatacaagtagaagttagagccagatcatctgtttatggcccaagacagctcttgatgttttactcttttgtgcattcatttgatgaacatttattgagcctcttctatggcagagtctgtttctaggtgctgggacacagtagtgcacaagacagaatgaaccagctctcaagaaggcaacagttgagtggtagacagactgacaataaacaatcaagaaaatgtcagatgggataaagttccctgaaaaaaaaaaaaagggaacggattgatgtgatggaaagttcctggatcccgaagattccatagtcaggaaggcctctggggagggagtatttccctgacacagaagttgaagcctgaatgaccaaaagtagtcagccatatagaaatctgggaggagaatattctgggcaaaggaacatatctggatttgtctgctcctgagatgagggaaagtggcctgtccaggaatgggactatgtcttgagtggtgggagcagagagtatattgggtggggaggggaaaagtggagggttgaaggaaggagttggggtgagagacaggtagagggttgtttatggaaagcctcatttgctctgtttccagagtctggatttaagtcagagagcaatgggtagccatgagagagattttaagcagaagagaagaatgagccaccatgcattataggaagaatactctgctgctctgcaaagaaatcaccccaacccaggccccagatgaaggcctgactacgggaaaggtcagaaggtgtgaaaagaagcagccaggtctggaaccgcttgggaggtagaatttaaggcccttggaagtagactggacctggggattgggacagaggacagagtcctgggcaatgcccaggttcctggcttgggtgttggatatagaggttataggtgtccacctctgagacaggaagctccgaggaagagtgagtgtgcagaggatgctgaggagttggttctggccatggccaatctgaggtacccatgacattgcctacagggaccatagaggagacatttaatatgtggctaggcctagagaaaagaggtaggcattctgggtaaacaaccaggtgctaatacagaggaagaacacaaggaaaggcaggatgaggtcagattctgaatgtttaaccacttgattttatatgacatttatttttgcttccttgtccatctcctcaagatggtaaatagtcatttctgcctctccaacctagtctgctgcaatctgggctttccctggtctcctttctgctcctacccattagcttttatcctcagagatcttccccttcccgacacatgatcttgctatttctttggtcctttctctggggctctaggaaatgagccccccaggtagtgactcattccctgaacattagtgatgagcaggctgccgctggagcctgtgtgcaagcctgggtttatgccctagctctgctgttctctaacagtgtggttcaggcctccctttcctcatccgtaaaatgaggggattggactgaagagtactttgagctttaacattttctaattctaagttgtcccagtcctcagggtgaagtgaatggcctcttctgaattgggagttggagcttgtgtaatagccatcaatacctgagagagaatagcttttgtttgtgtgtgcaaggccctgaggaggctgggtgggctgcagctgttcagcttcaattaaaaacatacacaaacctcctgctttgtttcggtttcaaaccttgaccatttgactgagtgtgtctgaattcctaagactccagtgtaggtgtggggaggcactactccacaggcttcattcaacccccttgcttttcaaatttcatttattgagggcaagagagattttgaagtcctggagatacaaggaaagaatgtaccttggctttaaaagccattggcaagcagcttcccgtgcccatttatccatccctagtcaagggcgtcttaaatgccaacatgggcttgtgagccctggtatttgggcaggcatttctaagtggcttaagagagaaaatgagtctgtcagttatgaagagtctgccaactgcctgtggtggtcttgaagcaacctcacttcctccaacaaaagcaggagtccccatggctaaaatcatgttctggaacctcaggcagctgtcctgtcacttcagggtgggatgtgtgcacaggccctaggtcctgaggctgcatctgtacctgcttggggcgggaataagttgatagcctccgggctgttggggtacacccagtaagcaagccatgaccagaaatgagttgcaattccactgagtgtggtgatggcctggagagcagggcacagagcaggatcctgggcagatgcaggacgatgggtgctgcaggccagcagagcaagcatttagggccctgcaatcaggcgtggtttgagaggtctagcagtcaggatcatcagaagtagaggcaaggtgtatgggagggctccacgggcgggccaatgcctggacagagaggggtttctcagtgacctcttattttattattaaaaaaaaattttttttttagatgggttcttgctcagtcacccaggctggaatgcagtggtgtgatcatagctcactgcagcttcatcctccggagctcaactgatcctcccacctcagtctcccaaacagctaggactatagtcatccaccaccatgccctgctaattttttcttttattttttgtataatagaaacgaggggtctccctatgttgaccaggctggtctcaaactcctgggctcaagcaatcctcctgcctcagcctcccaaagtgctcggattataggcacaagccactgtggccggccctcaatggcctctttgatgtcccctgcaaagtgttgttggctttccaagcagggagaagggaattaacatgaggcagaggcagttactgcttaccaatatgcatgttcttctcttcttcctggacacacggccaggaagactaaatttcccagcctcccttgtagtggtggagtcgtgctagacagcgaatgaagcccaggctctttctcctcctttcatttgcatgtgcgtgtgggaagtggggatgggggtaggggggaggtggaactgtggctaggctaggagatgtagcttgttcctgatgaaggttggagtgaagtgctcggtcttccaagaggccttcacaatcttcccccagagacctggatgaaccacaggatataggtatgagtctcaactgacaggaacctagggtattggaagtgatagagatggcaaaaagtgatttcttgactggaaaaatatccccaggggcctgctggtgaggccacattcatgtcccttacatagtggtgccctctgtgaatcctgccctctcagtccctcctcactgtctccctcagtggaagaaaggaacacaacctgacacacccccatcctccatgctcttcttcctcatgccacacccttccttgccctctgtagccacaccctgggccttcactgtcagtgtagcctgcagggtctgcatagcacaatagcttgcgtcacatctggaattatcattggagttgtaggtctcaagctcaactgcctacgcagccaggcagccagcttcaacgtgtgacagagttggcatagcatactaaggagtagtggggactgagatgctgtgtgtgttgtaagcaaataaaggcattcaaagtcaatttaaatatacatcattgtactgtttaagcaggacagctccccgcaagctgcctacctccaaatgaaatctactattatttatttctcacaaggactaatgaaagggcaaaactacaagccatgtctaaaaattctggtttacccttttctgtgcctagcagagcatggtgtaaaaacaataattagtattcgatttctttttttaccctttgagtgatgtctaacatacatacagaaaagcatccaaatcatacaattcaaggaattattacaaagtgaacacactcctgtaccggctactaggtcaagacttaaaacattattagcttcccaggataccccatgagctgttcttcctccccaaaggaaatcactctcttgatttctaacaccatagattagatttacctgatttctaactttagaaaaatggaatcacacaacatgtactcttttgtgtctagcttttactcaacattatatctgagattcacccatactgcatgtgacagtggcttgttcattctcattgctgtatagtattccatggtgtgaaacaccagaatttctctatccattctactatcaattagcatttggttatttgtgggttttggactctcactaatagtactgcagcatgagagaaagccctcaggcagaacaacagagagaactggatggttgtggtgggaaatggtcacagtagcaacaagtggacttagaggtgagccaaggcatgatgggaagagatgataacagcatccgctaccaagcccctctagaacagcaattgtcaaacttatagatcaggatggttttatactattaaaaattattaagggccccagagggcttctgtttgtatgagttatataaatatttatcatattagaaattaaaactgagaaataaaaatattttcttagtaatttatttcaaaatcaacaaacaataattacatatactacattatatataacatgtttataaataaaatattttgaggagaaaattctatatttttcaaaacaaaaaatgtcaatgagaagaatggctttcttgtactttttttgcaaatctcttgactagcaagcaatgtggcttaatagaagactgctggattctcatatctgcctctatgttccatctggtatggtatcacatgtcactcatgaaagaatgagtgaaaatggcaagtagtgtattaatatcattataaaaatagttttgactttgcagactccctgaaaggatctcagggatccccagaggttccctgaacaaaacttgagaaccactgccctagaacaccatggccaagtgccagccagctttagaatagaaacgtccaatgaattgaaagctctaagttagcccacacaatggggagttgctacttactgcaaatcaccatgaattaatttgcttcttagctgattaaaaacccatatgttcttctcaacactttataatccttcagtttgaaatgtattgcttttgttcattttaagccagcaatgtgcattagaaatatgatgtgagtcatttacgtaattaaaaaatttttagtaaccatttaaaaaatgcaagagaaattggtgaaattaattttaataatgaattttatttagcccactcttttcaaaatattatcattttggtatataaaatcaacataaagtataatcataaaaatcaaatcaatataaattattaatgagatagcttacgttcttttttatactaagtcttcaaattccagtgtatatttacatttatagcacatctgaattcagatggtaaattttcatcagaaatacttgatctgtatttagatttcatatcattctataaaatttgaaaaagtagattcacaaatccaggttcttccaaatgtacttaaaagttttccaataactgaatgcagtatccatattcaaattaattaaaatcaaatgaaattaaaaattcagtgccttattcacacttgctacatttcaagtgctctataaccacatatggctaggggctgccatattggagagagcagatctagatttttaatcctttgcttttcttatctattctatccctttgttcttcagtgcttagaaacttgattaggaaaaacttactcattctcattatttgcctagaaaactggtgccatgatggatttcttcataggcaagttaagatatttgacaaagagagaggtaggggtgggagaatcactgtgtagccgtagtttgcaatggcaggttccctttcagcttggcttccaggactttctcatttgatattttcacaaaactagaataatctcaccttgtttctgaaacagctgtgaaatatgctgcagcccccagccagccctggaatggacttctttctggttggacatggcagaaacttcaatgggatgacactatggacttagaccaggctgctgtgcttatttgaactaagcactgggaagtttgctaagtgcttagtgatgaactccacatcagtgtcagaaagataaggcaggttttcttgccgtttgtctccttgccttcattcaatggtatgctatccaaaaggtaaagggacataatggaatgaaattctaagccgaaaatgcagctctgaggttagcatcttataactcaaaggcagcaaaaataatttaacaagtttcaaaggggagagccgaagaacatctgtacagagttatttaaagattttgttctgtttgtgaactgcatcacttccaagccattttgaatacaggaaaatgaaaagttactccatttgacacaatggggatctcttacttattactctccaaatgaaaaagacgaattccaagtctaaacatttgatcccattgctgcaagttttgtggctggtcagttgtttgtcattgaatgggcaaatgagaaaaatgagttttatctccctctaatatttccccttccccaagttgattgcttaagcttttagccaatcttaaaattccatcatatccattctcctaatgttggactcaacaagaattctgcatctgggtgcatgatgtcatttacaataaatctaaaaggaactggaaagcttctggaatttccttatctgaggtagccaagctaaatagacttgattggcatccatcaggagctcagtgagggctagcaccattctggttgaaatgatttcacgctaaatgacatgccaagactgaagttttcctgggctccttgttgaaccagatactctaacttttctgtttccaagcccacagtgcagagtgtcagaggaccaatgaccacacaatactactggctaggcacaaaatgcctttcaattaatacaatcaactcagaatcaggagttacataactaatacagcaactgtgcaccatcttgaatacatttggattggggaagccaagcctttctttagcattcacactaaaggcaccagagtcatcaagagatgaaccaaagttcaatctgagtgctagaactattagggacctcagtgatcatctaatgctgtctctcttttcctgaatggtcttgctcttaggaccattttaatgttctttctcttttctgggtaaaatacagttaatacagttttgtttttactaggatcctcatgcaatcttaggtgaagtgttagctagttctagaactgtagaaaaccccatggtttctcctcctctcccatgcccaaatcctcttctacctgctggctgatgcctctagttttaccattccaggttggtcctctcagcaataggcttgatttccattaaaatgcaaaaaccctaggacaggcttaagccattatcaggtgtttttcactttgttgtgaaggaagggtcaaagtaatatgttgtggaatgaaagttttatttctgtaaggccagagggttagagaaaggaagaggaagtgccagcctggagggcaaaaggttctaaactgggaacttgggggcccacatggcagctccacagactctcactccttctcccaaaatgtctttatttgtatgtatttgtctttggactccctgtggtgatcaggtacttggtaattgttcttgctacaactggagctctgccaagtggaaggttcccaattgagaggcagctcaaatccgggatgagggtccccagccttgtcagaagggtgtgttagtgcttttttttttaatcccagtttgtggaagcagcagtggggatctgtgcaaagagggaaggttagagtgttgttttcaacttcatttgatatgggaactctttatccaggctcaaaggagagcattgcataagggggcatatgtagcctctcatgcatgcatatgcatgcttacacccatggactcacacacaaacacacacaactctgtctacacatgaatgttcctcctgaaacactcagcaaagcaagtgacagacgtttcctgtgggtagctgggatttcaatcctgctcttgcttattgtctgttttactaggattggaatgtgagtgatgggagatggtaaatctgtactttctgaggcaggataatgggttccctaccatttatcattggggtaacccagcatagtggtcaggagcccaggctctgccatttaccacctccaatgccttgggcaagttgtttaacctctctacacctcagtttcctgatctgtaaaatggaggtaatactattatctatcttgtagagttgctgtaagaattaactgaaatagcacatacaaagaacttaaaaccatgcctgacacatagtaggtgttcaatacatatttgctgaatgaataaaccattacatttatcattattatattattaccatgaagaaacttccattgcatgttggctttagatttagtggaaacagtgaggagagagttaagagttgtgacttctgttattacagtagggccagattgccctgcaggctcatctacagatatttctcagtgtgtgaaggaaaagagaaaacaacaactaaatgcctgaaaacaaaacaaacaatgaaatctggggtgagggggagagggagattgacatcttgcaattaaagaacagcttctggagagacagttgagtcaggcctggatatttcctgtttctagctccagacttcagttggaagtattgtgcttcctcctgagttgaaattaatcacaaaagcaaagcatattgttctcttttttgcagcactcctcacttcttgctcccttctctgcttcttgtcctgggtctctgccctgatatagaaaccaaaatggcaacacttccttgatgagagcagagactgagtagcgtggggctctatagtggtatggagtactatgtaaactcttcttggttaatctcctgatgaaaaacaactgatggactcaggaactgggtcctgagtgctttatcactgaggctccccatttcttgaccatgtggtgaggacggcttcaatggacactggcatcaggcctggtggatggaggttggagtagctgaggggcaaggcagctccaggccacagccaggcctttaattttccacacatgttcacacatgtacaggaattcagcagatgggctgcaagcaagcttgggcagcaatccactgacaagtagcagtagctctgaataaatcacattggcctgggctgcaaatttagctccagggagtggggactcaggcaaacaaggagaaaaggcattcacccaactttttcctgaaatgccagaggaacaaaacaggtcagtggtgaatacaaaattagcttctggccaccctccaaagtgatctgacctatttgggactcatcaagaataaggcaaaggaagttcagttgcctgcatcttgatctgtcaagggagaagagagagggcacaaatcgccaggtggccagattccctgagttactggttatggagcatatgaatggatatggctggaactcatgagaagggctctgggacaatgactttgggccaacccctagcacaacttagcatgcgaatgataaccccggtggatgcattggtaatctagtgtgccagcttggtggccctggccactgaaaggattgtatcgcattctgaaactcttcctgcagtctaaggccataccaccctgaatgcacccaatctcatccgaaacccttcctgcaagttaaactcatatccaagacccttatgtaaaaggggaccttgggccaagccagcaaagggacattagagccctagcagagtgcaaagctgaccacaactcctagcaggttggagctggtagtggatgctgttagtgccctgcctacatctcctttacaagctagtgcatgggtcctccagctgctgtgagtgttggctgctaaatgctatagctgccctcttccccagagacttgctgttggccaaatgcaagccccatcaaccatctcacctccaggtgacaccagctctgtggtgcattttgtgccccagagatctccgtgggatcaggctggagcaaatatccagctgagactatactcctgctcagtcccttcccctaccatatccagcttccttcatgccccttctactaagagcactccctccatacattacttgaacaatagtgtcaatcttaacttagactttgcttctggataacccaatcttaggcagagttgggaggaggggcatttatgaatagtctcaaacctgactgcacctcagaatcacctgggcagctttaaaaatacagattcccaggccccacctccagtgattctgattcagtgggtctggagtgaggcctgagattctatagttttcctgagttcagtgtttggtaattttaatgcagctagtcctttgaccaatgagaaccactcattctagcccattgtctttatttcttttcttagatcttctaagaaacattcattgatcaagttcaggaacaaatcacacaatctgtcaaagacactaagaagcagagatttaagtcaaaagatccacagtctttggcaaatctcttggagtccagcatacgatgctgactctcagaactttctcagcaaattgcatctttaaatttttttcatgtgtcctgaaatgtaaaggtctatttggttgggaaaagggagagacttttgagacatcaagttaccatggagttttccaaaaagggatatttgaccaagtttagaatataattcatgctttccatcctccatgctcagaagtattaacctattaaccctcctttcactaacagacctaaatcttcattattgttggttgtgtggatgatttagtgatgaaattcaaagagaaacattttgttttgttatcagagactctatattaggaagatttatgaataggttctcatgaaagacacaattctagggatttttaagcaaatggacaattaaataactgaatgaaggtggctcagactaatgcagaataggggagtattctagattttgtaatgatattgatgataatagtgataagaacagcaacaaaacatgattgctaagatttgtttcagtgcttagtatgtataagaccaagcactaattatttgatctgtattatcttatttaatccccccagcaactgtttgaggtaaatgtatcagctggggatcaacaaaggctttaaaaagatgaaactttatttttcgcttgtgtaaaagaagttaaaggtttgtatgcagactcagcaataatgaggtaccgaggcttcttccggctcctagttccactatccctagactgtggccctcatcttcacagtctaagatagctgctggagtgccagtcatcacattattggcctaagcatcaggatgaaagaaggaacatgccccttgttttctggggagtctttctagaaatcctgtaccacagttgctttgaccacattgaccaggtagcaatccctagctaaaagggagacctggatatgtagaattttggttgtatggcatgggtacagttttttaaatgagattttataaatttgaaagagaaggagaatgtggaaggttcactaagaaattgacaacttatgccacagtaggtaatattcttatccccatgttgcagataaggaaaataaggcactaagagactgaatgagttggtgaagttcacacactttataggtggcagtcacagtaggacgcaattctctatgatcatccctctcctgactgctatttcatcctgtccatttttttttccgattttgtaaaacagttttttttttttagaaaaacatttgttcatttcctgctttcttcttggtgtgccttttaccacctttgcatagatcctagccattcttcaaagttcagctccaatgccccagaaagccctcccttgcacccacaactgctttctagtaaatatttattgagcacctattatgtgccaggcaccgttctaggcacttgggcttcatcagtgattaaaaaaaacaaaaacaaaaaaaaacgaagaccccggctagcttaatagttctgtgaccttggtcaagttctctgagcctcagttctacatgtgtaaaatggaaataataaaaattactgtgcagagttattgtaaagattaaagatgttactgtatataaagtgcaattactggcatatcattagattttgaaaaatgatgccttttagtattattattgttgttgctattattgttatactattgtactgtattattatattcccctaatgagaaatgctattccttattaggctgtaaacttctgggcaggaatagtatccaaagccttctggtatcactcaaatacttgatcaaagtcagggcttattaaatgtttgttgagtggataaaaagtgttttgatgtagagagaacttcctgcttacttatgctgtagatttaggaaacagtaataaacagcctgagacccataggaagggtttttgtttttttttttagcgggggcgttgcccaatttaaactgtgagtgttggtgagtggtgtcctaaagcaaaacaagaatgagtaataatctactcctcatactcttccggaaggcctcagaaagaaaatatatcctcttcctttcagtttctttttttcaccttcactgatagatttcatgttccaacaagtcctgctgatctctttttgtgttttatttctgtcttctaattctcttctccatctctgatctttgctacctatgggaatagggctgctggcctagtgtccacagaagaaaacttctggaaatcaggaggcattgtgcatccagggtcctagagctgttacattctagacctacggacagcaccccagcaagagctaaccagtgcttgcatcaaaagtgcacatcaggtttgttgagcaccaaactccttttattttgccatctcagcccagctttcccctcagcccttctgcaaaggtgaaaggcaagttcacaggatgcagggccttctttcttccctcacatctggtttgattctgggcagctaaatagtggctttgccatgaacaacaaaagctaattcactgtggtggtttttaaacaccaagtgcaaatatttttccttttcagcttggggtcactggaagggaaaaaacagggctgagagggagattaaccttttaaaacctattatgacttcccagaaaaaataaaacaatggcagcatttcctttcattcgcgacagtctttttatgagtgattgttgtttgaggcaagattggggccctgaagaagatttttaaatactagcttagcttggttttctactcaaaaggccaccatgattgcttttaagaacccacacaaatccctgtaaagcccagggccaccctctttgctttctctctcttctgtcttcatctctggctgaccttccctccttttctccagccctttgctttcttccctcaatcaggagcctgactctctgctaaagggaggggatcagtgcaatcagccatgccagccactgatgccactgacagatgcttgggaggctgaagattctgtctgggtcatttctctgaggttccagccagactttctgttgatctgggctgtcttaatgcatcccagagcctcagcgccgttcagttcctcttcggaaatgaagtcgcccattctggttcttgctgcgcatgattaaggagcagaagtatccaatacagggagtcacagccatcagcacaaatctggcagatgagaaaaaagcaagtctatctgcctcactagtagtccttttaatcttctctctggactgcagaggaaaagctcgtctcccactcttcattagtttatcttctttccttctctcttccctttcagcttctgcacacagattcacttgctgggctcaggtgggaggcaaatcatgtgccatgacaacataaggctattagggcaaagatgtggaagtacctaaactctccctttcttgccaagaggaagatctgaacagggtccaggatggttgctgtttgtgaagtggtttgagtattcttgctatgcgctattactgctgttatcagcatcacgagagtctaacatgttgatacaggtggtgtgtgttgagggcgggtgggtgggaagggatcagaaattgatttgtaacctgcaaagagcaaactccagttgtatcgcctccacctgcaccattcttgtcctttcggtgtgtgcgcaaatatttgcaaacctgttgaatagcgcaccctcacaccaacctaaaatttcacagccaagtaagccagccccatcctggtgagaagaatgggtggcaacctggggcagctatggagtgatgggatgaaatgtattccttctcctgatcaggcagttggtgtaggggctgggctgctgtggctccctggatttatttgtccagcttcctgtctctggcagtgtgctaatggtttcgatagccacatggcacttggcagagcttcttaaactggtgtggcccgagactctgcattctaacaagctcccaggttgatgcctatgctcctaaccccctggccaactgcaattggagtagcaaggctgtaaagaagtcccactgcaacctaaactgctccagggatgaaaaaggaaagtgctaagcccctcctctggagacagggtgtgtccaggctgccctggagtcctgatttgccattcaagtgaaccctggagggattagcagccagcctagcacttgggtgagaccatctccccctccaggggggagtcctagatgcagcacagaggttctgtgaaaatctgccatcctccttgcagaaggttgccctctctcgccctccatcccccccgccgtgcttgctgacttaagcagatcagctttcagctctctggcattcagagacgtctttgcataaaagaaaaggcccttccttaaggagcagagcgggaatccaagcatggctctggcctgctgcatgcccaagaatgcaggtatttggggtttgcagcatttcttggcaagacaaaggggagggggaggctgggtctaacgaagaggggcttgtgctgtagccacttcctattctgggagagaagataactatgtttcccaatgaaagtgagccctttcacaggaacagctgtgaggaggggaatctgcacttgaccctcactcaaggctgactttgacatttagggtcagtggctcctaagctttgaggaccttgcattgttcatactggctggccaacgttttcgcctttgctctccttctgaggcatcaaactacccaagacaaagaggacaaccctttcttccttctcctcttctgctccgacatttgaacgtcttaaagaagggccagagggtagctccagtagagattccagggcaggattccggggctctagctcaggacttctgggaaggggccccatcctgcatgggcttgcaccaggccctatgttgctttcttctcctccagcactgccccctccagtcttcttggaattcttcagtatcttaccttcatcctgagattacagagaaagacttgtttatctcccagtgtccccaaaacagccctaaactgagagtccccagacccaaatcccccaacctctcgtttctgttacatcttcaatggccttacacaaatctgttaaaccactgtggggcctgtcttgatttctttagccctctaagccctccttcactatacttctttatcacataagtttggccatgcaattgaaccctatttgaaaagcattgaactttttacagtattcttccaacactggggttattagtccttcagttgtaactcaggctccttaatgtcaaggacagtgccttactttcatttcttgctatgcgctattaggttgttctgcaggaggtggccagtgtgacagttgacgctggccactctccttgcctcagctaaaccccttcactgcacatttgcctccactgcctctgcggaggctgacacagggccaagtttcaagggtctcctattagcccaacagctaccaacaccgtgtatgcagcctttcttaatgaagggtttgtcctacctgctgtctgagaacactctctctgagctgcctttccaggccatgatgatggggaagcactgttgtgtgcagctttgttacttaagatcgctcaggagaagaaggaagcattcctgtgaaccaggcagcttccaatgggtgtcatggagcctctatcagtttgttcaggacattgtggtttctgaattttatggcagagaagttgttcaaatgcaagtccctaatatcatatatatttatgataaataaccattatttgatgggcaggccaattataacaattaaacacctcagaccaatcaaatcagaatctctgggagtgggtcccgataacagtgcatgtttttaaaactccccaggtggattccaatgtgcagccgtaagaagtaagaactgcacttccacccaaacccccaattcccctcagggaaccaaggaagacaactaagggcctacattcatacattttcatacagatcagtggattcaggagagagcgtccaacagccagatagtctttatttattaggcctgaagaactaagtaatgggagagtaccaaagaaataaggccctgccagaagtttcagtttaggctcaataagaaagatgagaaagcctttagaatagctcgacccagttttccctcaagacttgaagatccaaggcctatacgtggctgacagaccaggaagggactgggcgggggtggtggtggtgacagggctacttgacagagggctcaacttttttgaagctgctggcgtgtcatgagtttggctatctttgggcattagtctcagcaatgtcatggtactcctgccaactctggatggttcacaagtgggaagactaggcccttaatcaaagatgccttcaagtaggacttggcagatactgcattcagcacaataaaagctgaagggaaaatgactgcttttaccttaacgcaaattttattaccaccaggtttcattataaaaatgttacaggtttgggtgtgtgtttattacataaacgatggagttactctgatcttcaccagctttcaaactggaatctcaaagggagttctatttgctagatttaaagctgtggaaccattgtttctcatgactgccttataagcataggaataaaatgcagggaaaaacaaactctctgttttctttccttctcgacccctgccaaatttccccaatctggaggaaggcacagccacgtgctggatgttgtagctgatagactatatttgggctaggcttaccagggataggatggtcttcaggaaaagtgggaatgtgactcaaatttcaggctcctgttgcgtctagcttagaaaggtgtcctggaggcttggacaggtgtgagaatcacttaagctgatcaggcaaactctcagaaacacagacccttatgccaacccatagtcagtggtcacaaagtacaacagctactgtcattatgtgttcccagatctctgggcatttgtctttcccagaagcaaagctttcatgtcattatcagtgtcatcttaggtcccttagttcattcctgggaaccctgcattcagagggagcaaggcataggctgccactgtcttatggcaaagaccattttgtcaattttactgatgttctgtattttaaaattaatgtacctgattttatattctttacttgagattttaaattattaaaaatatttcttaaattgaatgtttcaataaaaaatgtgagaattgaaaactacaaatttacctcagagtatagctttggtaatttccattggtttttctatgtgggcttattgttattggtttcatcctctgaatagttagttttgggcaagacagcatggtgtgaggaaaatgggctttggtgtctgccagatctggatgtgaatctttactctgccctttatcagttgtgtgactaagttataggatcacaacttccttatttctaaaatggagataataatatctgcttgttgtattctttaaacgatgatgaaatgaaagaatgcaggcaaaggacttagcatggtgcacctagtagatgctcaatccatggttgctatggataataatagcaaaaataatacatcactggcacaggcaaaagctttgtggctgggaagtgctctccatttgcatgtcttgggcagagggccaggacagtgggtatcctttctggatcaaactacttatcctaatgtcctccagagacactggcagatgggacatgaaataccaacagtgtgcctaggggagggcatgcagccaaatgttacactgaattgagcacgccaaggcaatccaggaaaaaactcagcacaaaaactcaccattcagaaattcccctgaactgtcttgatctcattttctcttgtgggatgttcctcaatgaactgagcttccctaccccagatctggcttctttcctggctacccagctgggttgctttcccctctgtagggttttgactgcacattatagccagagccttgagggaagtgagcatttggggagcaaaactttatggagcagcatctctgtgctgggaattaggcttggctctgagcatcaaacatgactaagtcacagttctgttcttgaggacttccaagtcaggtgccttagtccattttctgttgctataacagaataccacagactgggtaatttataaagaaaataaatgtattacttacagttctagaggctgagaagtccaagatcaagtggttgcatctggttggcttctggtgagggcttcatgctgtgtcataacattgtggaaggcatcccagggtaataggggggttgcaccgagagccaaactggctcttataacatatctactcttgtgataaccaccccattcatgtgataacccatttaatccattaacccattaatctattaatccatttaatccattaacccattaatctgttaattcattaatctgtttatccattgggttatggaaagagccctcataacccaatcacttcttaaagaccccatctcttaatactgttaaattggagattatgtttcaacatgagtttctgaggggacaaacattcaaaccatagcatcaggagaatactgacccatgaacatcagaaaggctaaacacagtgcctttaggcccatccacaggaaggaggaaccaactctttcttgtggagtggcatgggaagccaagtgaggctgatggaggagaggacttttgaactgactttgtcaggataaataggttaagatgtatcaagttttcggtaagtttttaaaaatacctatttgcctttggttgattcttgccttctctgagtctgaggggcataggaggtgatggaggagatggtaaggtttaggaagagataaggctgcaggaagctataagcaactgtaatctgctatccacactctctccatcctgcagaactccactgtatatagaggtaaactgaagtggaagttacttatctgtgttcaaagcagaatcttctagttttctctgaagcccaccctgtacttctgaatactttggtgggtagcatggctctttctctcctagtctttttggctcagcaagaataccggaaactccactctcctgaagggtattacttttcatggccttgcatgtggctataactcattgatcttgaatgtagctgcacccccggctcctgaaatggcagaaaggacatacagaagggaattaatctcagccatatccattcacaactgaaacacagaactggttcttcagcatccagaggccaaatgtcaagctccaataagaggaaagatgcaaatgcttcctcagcttcaaggaactgaggcctcccaggaatgttgtctttgctcctttcttgatcccacctttgcaattgagtgaggaggaagttttcatttattcttcaagatagagtaaatcactcttctctcaccaccttgtctttgtgttaatgcttgccatggatgacatttggccattaacagctaagctccctcttccatctaagtttttatccctggaaacattcacaggcaagtaagagctggatgattaattttcgaataaggatgtgtttgagaacaggccaggggcacacatcaacagccacatagccgttggcttaaatggatgataaattctgcatcccaactaatacaggcccatagtccctgctttgaaaaccaggggtgatgacaggggccatgggtttctagtgctttccacacctgtctcagaaagcaagcaaaataaccacttgggagaattaagataattgtgtgttgagtgtttttccctaagaaagagttgatctgttgcttcttttgattaggcttttatttttgccctttccctctctccactgagtttctagttgcttcttttttattttattttattttatttttttacacaaaagacatcatgggtaagaagaggagattttattttgaagaacaatgaccacattaacaaggtgacaacagataagctaaaagtcactccattttctgccagggaaaaatgtcctttgctgccaaatcacattctgcttctctttgtctactctccttttataggagggtggcaggcccagccactgatggactcagaagaaatatctgggagataagatacacccttgattcatatgagaaaagaagcttttgagttcaatgataaaaaataacttcctttcctgttccacaacattcttgtggctggagccctctgtaggacaacgacatttctctccccttggtccaacatatcacgctgaaaataactatgaatttggaaacttggtaaagggcaaaaatccaatttcttgcatttaatagatatctaggcttagattagattctgtaggtatagaatctgccctacatcctgctctatatttggggcaaagctgagaacctctctatctttaaagtgtcacagctgcatttagagacccaacccattcagcattctgtgaaagaacagtagaaccaaatatccatgtgtgattatattcccaagtgtgtctatttaaaaaaaaaaaaagaaaagaaaaaaacaaacttcaaaatgattggagaaagaaaaactggatgtgggatggaggaggtgacaagggaaagggaaggaagcttctaaggaagtgagatttgagctaggctttgatgaattggtagaaatgtattagccagagaaacattttagggtatatctttttgttgttgttgttgttgttgttggagtcttgctctgtcactgaggctggagtgcaatggcacaatatcggctcactgcaacctccgcctcctgggttcaagcgattctcctgcctcagcttcccgagtagctaggattacaggcgcaggccaccaggcctggctaatttttttgtatttttggtagagaaggagtttcaccatgttagccaggatggtctcgatctcctgacctcgtgatccgccctcctcggcttcccaaagtgctgggattacaggcgtgagccgccacgctcgacctagggtatatctttctaagttttggtttcttctataaaatctcataggcttgttgtgaagatttaatggcataattaaaatagtgcacatggcacactgcttgggacataaggactgaataagtggttgtagttgttgtcattgctactgttattatcattgcaattaggaggtggtattggaagtatgtgaaaagaaccttcgtagggacatgatgctattaccacaggtaattaaacccctttttcctgacccctttttctctgatcttatcccgttctttctgagactgtcatcttttatattttggcatactttggttaatattagttcgcttctggcaagatgaaagcagacccaaccaagtatcaaaagattttttttaaccccgctccatttcccaatataacatcttatacactgatttacaatttcagtagtgggtggatattcgagtgaagatgtaaatataaaaccaatagcttatgctataatttctccaggggtctttgtttttagcaacttattttagcaatttcaaaaaatattcactccggttattttgattttcttctaatctgtttatcttccagtgatttcattcaagtcacaaaggaaaggtgtttctggaaataagcaatgaaacatttcttttttaagtttagtagttaatatggcagtatttttgcctcataagtgatggatataatgtgtttgagaggggcttgtccattgatgttagggactgaggagattgtcacatgcagtggttgggggaaaccaggatggtaatgttaaaagtaatttaatgactcatgtgctcaggaggattatgctaattgcttggtcatagcttatcctcatcacaatcctctgatgcaggtacagttattcttctccttccatagatgaagaaaatgaggcttagaatatttacataacaacttgcccaagattacagcttagttgttgcagagccagaatttagactcagttctctctggctccaaaacctatgttttgtgtgtgtttttctttctttctttctttctttttttttcccagtaggttatactgtctgcagggatttaaaaataatgatcccaaactaaacatgggagtgatgtttttaggttatcatacagtgccttggggaaagtgggagctctcaatgaggttaagggttaaaagatgtgctatggcctgtgctacaatctctgtttagttcgtccaaagtagaaggaatttagttctgatctgaaggtgtaaaaactgatcagaagaaatggcctcaatcaaaatacaagactgtgaactgagaagtggtgtcacttggacaagggacagagccaatagtgtcctgtgtcttgaaaaaagggaggggcatggtaggtaaagcctgttaccttcacttttggtttctttaatgacactagaactttttgctaattaacttgattgcctgcaactgatatatttattactaagcattgtttatcaatgacatattgttcaaatatttgtttcccaggagaaggctgtaaatgtcctctgggatcataaaaggtgatggattaacaagtgctggtagttgtggtaggtcaagaagttacaatgcagaatttcccatactgttgtttggatatgttggcaggtcagcatgaagagatggtgtttttccatgatgagaaagatgatagtttgtcctctaatttcttagctttagcatccggtgaagttgcttgcagggactatattttatcttatctcattcaaagtctctgaatgaaataacaagtagcaaatatgattacaactctttctgtagttacaaaaacctatttttaaatgtctcccatctacaattggctatcttcataccaccatctgctttctcaaatttcccaaggccatttgctgtggataaccacaaagctgcccggggccaaaaatgccacctgttgactggaacagagaactcttggattcaatatctttttcccctccacctcctttcttgcaccttggaatgataatgcatgtgtctctgaagttccccacactagccagatgttccagtcatacaaaaaaattgcttgcaatttctcatcacatcatgctctctcacacacctacaggtctgtgtacactaaaacctctgaatgcttttatgacctattttacctggctatttcttcagtttagaagccttaagcatcacttttttgggggaagccttccctgaaattgcccagggtgatttagatatctccctttccatagcctatatgtaaaggaaagatagttgtgcctgtctatcttttagtggatggtagtgcttccaagggaagagggtgaaccagtacccctataaggacctgagccagtggtggagatagggagggataaagtcaggcatggctccaaacagtcttttatatcatcatttgaatttttttttcatagttgcatgcctcatcctaaacattcttataaaattagcactattatctatgttatgtaatataaaataatctctcctcaatcattgagtaaagctagtggtccaggaagatccttctatatttatcctgtggcttcctgaactgccaggcacgctacagtgtatctcgggagtatgcataagtccctctgaaaaccaggtataaaatagcgtctctcaaggcagccattcaatggtctccttcagagtaggccctaggtctttcatctctgctatagtattgtctagtggattttagatactcaagaaatattattttttggaatgagttaatctttcaagtgatatcagacataataaagaatcagtgtcattaatcttcaaaaagacagataattcatttgtagaccccaaagtctccatcaatctactactctttctctaattattcttgcattttatgaggtactggcatttaaaattaatttttaaaactatcttcttgagttatgttaacattggttactcactaccatgataccagtattattttccactcttcattgcaaatacatgttttccagcaatattatgggggaaataagccttgatggaaaaacctggaactctaaacaccatctgtagtttcttttccatgggaaaatatgtcctgaattaaaagggaaaactgacttagaaatgagcttcggaacacttcaaggctgaagaagactgcattcaagcatcagacccctgcatcctacagctccaatttatacagcttactgcccgaagcctgggggcctaagggagggagcctaaatccagagacacaaaatgacatcctagaactgctgaagtgggcagggaggacctcagtgtggtcccccgctgggctatttcagagttctatcagcatcatcactaggccatcttggatacatattgaccatcccagaaagccagaaaacttctttcttacaaatcctactgagatttacatctctgtgatcccaaaactgttccctcttgagacaagaaatatccgaatcatctgttttctctgttttaaaaagtcaatttttaaaaatattgtttgttaagaaatatttatgagagaaggagctcctgtgtgcaaagcaactttctaacacatggtccatttattatgaaattattctgcagaaacttcctgttgctttgtctttctccttttatgtatatatgtatgtatatatgtatgtatgtatctctttagagataggttcttgctcttctgacatccaggctggagtgcagtaccgtgatcacggctcactgcagcctcgaactcctgggcggaagcaatcctcccaccccagcctcccaagtagctgggattagccaccatgcccagctaattttttattttctgtaggaacagagtctcactattttgcccaggctggtctcaaacttctggcctcaaataattctcctgcctcagcctcccaaagcgctgggattacaggcatgagccaccatgcccagttccctttctccttttagaagtgaattactctgaaccaaaaccttacaagagcaagccaaactgtgccttgattctctttcatgtcaaagtctaggtggtaaaacatggataaggggcttttgacaagaacaggagacttctttacctggcttctctagtaaagcttctagtatctcagaggggccattgattctccatacctggtcatttctccatacctggtcatttctctttcctgctattccactcaaccctatcctcaaacaaggaaaccttccctcccaattgagtacatgatacttttatgtctcctctgctctggaaatgtcatttctgattctgctgggaaggcaaccaatggaggtctcagcctagagccttaatccactgtcctaggcatgttctcagactggaaaaaactgttgggaaacaagttcagaacctgaactaggtgagactgcaaatactggtatagacaggtttgttttaatttataaggttgctcagcaaaacatccccttttctggaacataattagtatgtttttaactgcagatgtagaaaaaattgtttagggtacagaccaatatattttcttatgtttataaggaaggtttccttctctctgtttctcctttatctactctttacgaaaccttgcaagagtagactaaaagggacctcctttcattacacatcttttttcctaagaagcaaaatgaactaaattagttcattcactcagtactgtaaataccaaataaaaaagtcatagacgtatagatataaatactgcttctgtaatgatttttttgtgtgtgtttgtataactagagggcactgggagaaagagaaaagaaattattcaaagttcaaaggctccaagatttactaagaaaataagaaaagggaaaaaaaagcccaagcattcacatgctaagatagctgaaggatcaagtaatatgttaccccagcattttcttcaaaagaaacggcttttgtagaaactggtggaaagtccaaatctgaacattttttctgattataataaataaagctagtaatccctgtagagattaagaatgcaggctttggagttgctttcactgtgctgaaattccaacatacagtcaaggttgagaacactgctttaagtacttagttgtaacttcctttctcagatagttcaatttggccctaatttggtttataattacagcattctttccttccttttgagagtctccatctgtacatttcccaagtgtgtggaaagggagggtggacatctctttccctctctcccacctgtgtctttgcataccttatcttcttaggaagacagcatgactattgttgttaaatacaaaactgaccccatattctaacaaatcatagttcttcttggcccacagcattactttttaatttcagtgatggatttctaggggtcatgcattggcattagcagtctttaaacacatcatctctttttctcttccttccatccactgattgtttcttgagggaggctctgagccattcaccttggtgattctttcccccaaaccatatcacccaaaatcaagctgccaagcccaggattggaggaggaaaggtggtcttctggaactgtatccataggaatcctttccgaactggcactttcatggggcatattgaagtattgtgaagaccttgagcagcgacagtatttggagccatcagaaaggatttaccttttttttttttaagtctttagtttatgatccttgtgctcaaaccaataatctttaaccattagtacctgttttgacatatggccagaaatttattttaaagaacggcattagttagccttttctgcataaaaagtcacccagtacttagtggcttaaaatttagtgggtggttctggtctgggatggctcagttaagctctgtggagtttgcttatgtgtctatagtcagctggggctgaatgacctagagtggccttattcatgtctggtgattagcagaccaagatgggggtaggggacaactgggccacctgtacctcatcatccaacaggatgggccaggcttcttcatgagcagcagtaagcagggcaggtgccaagatcagcagaagcagaagttgcaaggcttcttgaggcccaggctcagacatgtacaatgtcacttccaccgcattcttctggccaaatcaggtcataaggcctgctcagattcaaggtggagaaatagactccatatcttgctgggaagagctgaaaagcaccatggctattttttgaaatctaccgtaataacgaagcacctgtatttgcaaatttttatacacataaattaaaatggatttgaagttcttccaatagtagggtaactctccttgtattcaaataaatgggagaaaagggggtgggaatttcccatggttatgataatgagtggttcatgtaaatatcatgggtcatgaaagaaaaaggttttgaacagctgcccaagagacagtgtagtgaggtggaaagagcatgaatcttaaaatcagacagacctgtgttcaaactccatctctccaacttgttagttggatggccttgggcaagttatttaacctgtctgaacatcaatttcctcaccataaaacaggaataataatacctaaggcacatatctgttgtgaggattaaataagattatggggtaatgcccagaacctagtaaagagccatttcatggtgctagtttccttccttgaccccttaattttgtgaaatcggtgtgtagtgggcatagtgattctttcattcagaatcaaagctgtcccacccctttcccttccagataccagcctgtcttttttcacatattgcatatctttgagagatgacttcaatacaatatttttcaacctgggatctttgcaatgtttgcaaacataaacttacagttaaaaattccaagacaattattagctttggtgctatagattattcacatttttgagttgtgcatagcttgctttttctttatggtctggatatactgtgcaattttggaaacccaccatcagaaaaggaggctttgaaatagtagaagttgggcagcaatgtatgggaaccatgttttttcagaaaggatgcatttacattggataaggttttcaaacatatccaggaattctatgtagtgaggttagtctttgggggctagaggaggccaggttgggcaaaacctttgcttaatcttctcctctgatgcattctatagggctccattttggctaaatcatcataattcccaccaagacagcacagaatgataatggttttatttattattttatattcattgccggtatatgcaaagttttatagcttgctataaatcgagagggattatcacagctgttacttattttaacaggtcacaatagagtagtttatgccagatggtttggagaattttgagggagaaattttatacaggcagccatatagatactagcttgggtagtcacaccctgaaattaatttacatttgttatgatataaaatatatatgaataaacacatagttccttatgaatgagtgatccattttatagcagctatttcttctggaagtcaagggagtccctttgtgagcagtggtggggcaggagcaatagtaatgtgctgctactgggataggtgagaagtaaagctccaccacatgcatagctctggaggggacattcaacttgctccagggaagtaagccttggagacaaaattgagttttcataattgggtctcagcacgtatttgagtcaaagagaataaagcaggaaactcgccctaggtaaacataaggagagaatgggtatggtataaatacagtagagctagaattgggatcctcgaggtcaccctcaaggtcagtctgggaccaaaaggttatccagccctgggcaaatcacagaacatattacttcccttgcagatgctgaagtttatgggttgaatggccaattctggatgctcagcagaaacaggaagataaaataagtactgatgatcagaaatcattttagaaggtatttttggttccaagtctcatagaaaaattgacttacacaatgaaagacgtagagaaaattttacagatctctaccctccttattttatagatgaagaaacagaccaagaggatcatttaaatatgatcatcttagttttttcagtaaagaagtaaaatcagactgtcaaagtatttgggctccattggcttcctccaatctttctccccttgatccagccccacgagttcctctcctgtatcccacctcatgatgggaaaggaccacattcccacctatcagaataatccaaagaccaggtctaaagcacacctggattttcttggtaaattgtctgaggcataaagttaatataccacctcttgaactgaattaaaactatttagccttgtagagtcaattcttccagctcctgtaaaataggagtcaattaagatctgtttgtgtcaacaaaatagtaaattaaccagcaaaggtaaatttaaaatgggagatttggagcatataacagctaaaatctatatgtacaaaatcaggaaatgacagtattttgacaattgaatagtccatgcatgttgaaggacagaactggaatctgtatcgtggagtcccccaagatggctagtagaagaatgaaagctttgaaaatttgtaagctcagcaatacagaaatacccccactcttctcagggctgctgaacttccaataacttcagctttcaggaatacagcaccaaacctggaagtaagtgaaaagagtttcccaaggctacaaataattgtcagcaagcccacatgtatccttttggctcttgctggagaattggtaactcttctttaatggacagatgtttcccagccatgggtgtctgttatccccagctcactggagacttaaactctggggaaaggagctagaagaaggttgagaaaggaatgataatggagaactaaataccaaggaaagagcatggaaatccacaaaggagtcttagaaatgtgttaccatagagaccaataataagctttcttaataaagaccctaagtaatcaacaaaacattaaattgtgttttgtagcatctgattaaagagacaggaaagtgaattactcaaggtaggctaattctggtaataaacccccaatatttcagtgtcttacctctcactttccttgcagtttaatgctggttagcttgcaggtgggtacctaggctcttcccatcttaggaatccaccatcccatagagcctctgtgttcagccagcagggaagacaagaaagtgtgtgtaggaataggtaagagtttttatgtgccaaggctggaggcacacgtaacttctgcccacattccattggccaggactcagttagagggctgtacctaactgcaagggaggctgggaaatgtagtttagctgtaggagaaaggagacagtttggtggacaactaattagccagtttcttctaaagaaagtataaaatatgctcagaacaataaggggcttcagaaaattgttcttggttggataaactttagttatatggaaaattacctgtgtagactttaccatttcctggcaataccagttaaaggaaatagttatttcctgagccacactgtagatcagaggttggcaaattatggcccatgggccaaatcccacacactctctatttttgtgcagaaggttctattgaaacacagccacatccatctatatatgcaccatccatggctgcttttgagctacaacagcagagtagagtagttgcaacagagactacatagccagcaaagcctaaaatactttctacctggccctttacagaaaaagtttgttggcccctgctatagatcatcactgtcctaaaaaaggacacatttgcaaaattgtctgtgagacctggtatccttggctttcagtaaaaacatcagtatgtcgaagagacatctgcactcccatgtttattgcagcactaattgcaatagccaagatatgaaatcaacttatgtccattgacagatgaatggataaagaatatgtggcttgtatacacaacagaatactattcaaccataaaaaaagaatacaatcctatcatttgcagcaacatggatgaaactggaggacattatgttaagtgaaataagctaggcacagaaagacaaacatggcatgttctcactcatatgtgagagctaaaaaaaagatcacatagagagtagaatagtggttaccagaggctggggatggtggtgtggggataaggagagtctggttaatgaatttaaaaaattacagctagataggtggaatacgttctagtggtatatagcactacagggtgactatagttaacaagaatttattgtatattttgaaatagctagaatagaggattttgaatatttccaacacaaagaaatgataaatgctttagatgatcaatttgctaattatcctattttgatcatttcacattgtacacatgtattgaaatatcatactgtatgccgaaaatatgtataattattatgtatcaattaaaataataatttaaaatatatatcagaaaagtaggatacctatatggactgggatgtaaactcagtccttagaatgtcagctccaactgggcccagactctgctgtatccccacaagcacccagcacagtacctggcatctgagagatactcaataagggcttatatttgaacctttgatccataggaagcttcaggtaccctaaccaccatacaggggatagggggacctaaaaaaatgcaatatgagcattatgtgtgaagacctcaaacacaggtaggaaggaaccatctttgttgagcttttattacgtgctgggcactatcattgtgctttattgttttatttactcttttaagcaactctataaattaggtattcttattttcattttacaaatgagaaactgattcaaagaaggttcaagattcagagagtcaaataattttcccaaggccacacttgttaagaactggaggagctaggattcaaacacaggtctttctgggtacaaagcctatgtggttttcttttcttttctttttcttttttttttttttaacctctctgccatgggacttgctaaaatctcattcaaatttaagcaatctagttatatcattatttttgccatcactgttaacaaccacctcattattgtaaagatcaatacaaaggagaaaagacagggccattttcattgctttgtggaattctgcagacttcattgtcaaggctctcccgtgatagagcagacctgaaaacctggagcaatgcagttcatttccttgggctgtgtgattagtgacttggccactagctacccatgcacttgccagggattgctgtcgagggcagccattttgctcaccctaatgtaaattctcatgtcaagacctgagaggtttgagtctgtacatggtgaggcttcctgtttgaagttgatctgagagcttgttaacatacagatggccaggcctcaccccagagtctgattcagcaggtctgggaaggcctgagaaggtgtatctctaccaaacccccaggggctgccggtcctttgagaagcaaggctaagggaaggacttccctttacctttgagaagctctgactggtattcccacccacttcacatctcccatcagtagccaatccatcaagccttcccaaagccttaggggtccaggtctgcccttggcagcagaactcctcccactgacccctcggtgacatttgacattataaatcacccagccttcttaaaactctttcgtccatccccctgtttctgagatggggcccttccccccttccatcctggtctcctgcttctctgagtaatgtctcttcctctctgatgaccttttcctttacccacccaccccttaaaccttggggtgcatggctgtcttctcaccttcactgggggagtggccatgccatctcctcccacctcatccttcctgtcccagccacactctgtcttccgggggacttccaccagattctctgtcgttgccagcagctggcagccctccaaggaggctagtggagaacagctaacccagactgacttgggttctaggtgatacttcatgtgaccacaatcattaattcacagtaatgccaattaggaaatattctttatttcacacacaggcaaaccccaagatttcttatgaccttggcaagtggagtgtttcacaattgtgaattctggagaagttacaggcctggtggatatagtattgcccacacatgcaaatctgcccagcgcctaaacatccctagttgaaaataggcaacccagtcagaaaagagtcaagttttccctaaataggtttcaaagacatattaccaaaaacaacatcccacaagtcatctttggataatttcattcactgggtttcttcttgttatgtatggtattaggatatatcccataagtgttgtctttgaagtggccctaaatggctctctgccttctgcattaggtcgctatatggagagcctaccaacttaagctatgggcacacactgccatggtttttaatcctggttcaacctcagatctggtttagtaaatcgccgctccctggagattaatacatggctgcaaaggcattgtccttgcagtgtttttcagcctgggcagggtgagatgtgtctaggatgcgaggtttcagcatccggagatgaatggggggaggggacgcaatgtcacatttttcgggtgctctagtcctgttatatgcgggcacatgctctacgccagtctctgtccaccctcttgcccgggctggaggggttggcacggtcggcgtttctgattccttcctctgctgttggccatagactagggataagggaggtgagaagagagccacgggggtgcggtgctgagcagctgcggtcggtccagcctgttggtgatgtgcggagcccgccgccactctgggcatgggtaacgcgcagccccagcggtcgcgctacgggagaaggaaacacagaggtacaagaaatccggatccgggatcctccgcagcctccggcttgtctaagctcacaggccgggctttgtggctggctcccgcgcgccaccgagtttggggctggggactgagtcctgcagctcactgcggctggcagcaggggacggattatttttagcaggttccctttagcccggtggagctgggagatactcgcagagccaggcggctgtccgtggagcattggtgcagccgtgccttgctgccccggaggtttggctgccgcagtcctctccattcactgagctgtaaatcgaagctgtctacaccgacaaggctctcgatcccagcgtggccccagggctacgtcccgcccaggtctcccggcacctgatttcccagtggtcaattaggtgtctcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcgaggccagccgcgcgctagcccgagaggagatcccccttggtcgagatctgagagctgggtccccttggcagagctgagcgagggtgagctgacagtccaggtggaccgcgcatagctcgcaggggcaaagggaacagcgctggctttcaggggtcttttattatttttaaaagcatattgcagctgcagcttttaagtttgccgcctcctccctaccctgatcccgggttctggggcggggcggcactttcccacgctgcctaccctctgggtggaggggtctgcaggggctgcagcgcctggtgttgggtttcctgcagggggaatgaggattcgacggctctgtgagtggaagggcgccctgaggtttggccttttgagggcttctaagggctggggagaagtcgaggatcccgcttggtgccctctcctgttttcctgccctgccacttggtgttggatgacattttgcctgtgcaggggtttcactgtcaaggagctgtgatgctgtaaggcaaatggactgttaggatgagctggaagagaggggagtgagctggagcttttccttttgtggcagtgttaaccccatcgcccccacctctctggcgcacctgtcccctggggtcaccatctgtgcgcatgagtggggcagcctgacccactggccattccagggacagtgagccaaagctggacttgctcagggcatgctaggccaggaatgtgtgggcagtgaaagagcaacacccttcctcacccccctgcggggaagactcagcaggccccgccatgatggtgcacagtgttttgccatactgtggtatgctctggagttttggagctcttgttttatgaggcttttattttacagtttcttgcctcttggtgaccagtttgtttttcacagctgcttgtgagcaaggcaaagataacgagcatctaaaaatagccctgcagttggaggtacagcttggcttgaccccgctattagaggggtggggtctccgttaccagctccctgagggtgggccaaacttgggcccccagacagcctcagaccaggtccacacatccttcagagcaattcaccttcaggtctcaaggcaaggcagggatgctgagtgctggtccatgtgagaagggcagcagctctgagaagcctcatccattcccgggtgaggcccaaagccactgggctgcaaggctggaggatgggagcctggacaggggtccctcttttgcccccagccatggatatccatccctggctttacatcccctggttggatccagccatatgtatggggcttcctcctttgcactttaaagccaacaagcaactccctcacagtggagttcgttccagaatacagagggacaaaaggggccaggtggcactcaaaccatgccaacttcctactgtgttcatagcagctgggctactactctttcctttccaggtggaaacccctggacagttgggtgaggagcctcttcctggtcagcaggagggtggcgccagcctgtctgaagggggccgcctccagctgatggtgaagaggccgcctggaatggagataggaagggactgaggactttgcagtgattgcagtggaagcaggaagtgcaggtcttctgtgggtcctagattctgtgagcctgctaggctcccctcattatttattttcaaaagccttcatttcttccctgttcactttttctttcgtggtgatggtggtaaagtccagcttgaagaaaaaaggccccctctgttcttgatttggttggatgataggatttttattttttttggcaagaatgcattagcaattgctgaaaaatgtaaatgcctatttttttctccagtgaaataaatgaactaaacagcaagggaatgtaagggcaagcattctctgttcaagatggaatctaccaagtgattttctcctctctttcaaaatgaattttgattgaaaatttttacctttattttctgtatgtcataactataatcactgggcaactattaagatagagatcgtgactggggggaaggaagagaccaggaaacagcacctttgagatatccatcattcctctagtcttctagtggagacttgcacacagttgctagtttatctttaaaatttccaccatctttgtgttccccatggaagacaaaggattaatgatgatgaaatgtagtataaggccagtgcaacagtggccaagtttggccagcttagaagagtagatatgggaagaccacgggttgagatttcagttttttaagaacatcattggcttggctcgacctgtaccaaataagatatcaatgatcccttggtcttaaatagaaagggctgcttcctcttgaagatcagaacctaaaccagcaattgactagagacccacagtgagcatattggtcagggaaggataaacaccataataggtgagccccaaatttcagggtttaacacaatagcagtttatgtcttacataatgtcaaaccagctttttgtcttgtgattataaggaacctagtctcttctcttcttatgaatctaccattccctagggccttgaagcccctgctgggtcttctgcatccagaagggaaaacaagaacatggaagattatcctggaagcagcacctctcactcccacccacattccatggccagaactcaatcacatggccacatctaactgcaaggggactgggaaatctagtctgtgtgcagtttgtgctatggcagtacactctctggcatggaggggccctttttaagctctactttgagattggactttggctctggacaagtcatatggcaaatacagatctccatcttaaaaatggtggtaattccacctcctctttcctgtctcaaagggatttggaaagatgtagcaacataaaaggctcctacagggaccatctggtccaacctctgtaggcaaggtcattatcattttcctcaatttatagagaactttccccatataacacagctggtttatggcagggctgaaatcatacctagatccccttctcttggcttagtgctccttctaccatgctatgttgaccctggcatcttatgaaaacagttatataggatattgtttctgaaagctgacatgctttcataatgtgtagtcattaaaagtgacttcatatgatttaaaatccaagtatgatcttcttctggttcttactgtataatcacttataatcaggcaaagaataaccagacactaatctatgccctgcacacatatagctcatttaatcctcacaataagcctaggaggtagaggttattattatccccattttacagatgaagaaactgaggcacagagagaataaataacttgcccaaggttttacggcaaacaagtgacaaatttgggattcgatcctgggcactatggctccagaatccaaccctggactattttaccatactacctttctgatctggtagactccttctccagccctttctgagatgtccaattgggacatttttaatttcctttttaagtgagtgaccttgaagatccatgaggggagtcatttgtaaatttgctgaggcatgtctttgagcctcaagcatataaaatggatacacaggattgagctactcagctagtgaagaagctcagctcccaacctccagctccaacagcccaatgaagctttttttttctttcaagatttttgggatagacactactgtgtagtccgttaccactgtgaagtaataaaaatgtctgtttctttgtgaaaagcagccgtggtcaaccataacctttggtgcaagattaagaggcagttgacttggtaggggcaggcaaggccatcatagtcacttaactctggaagaaattgctttttgtggttgtttatctattgttgcaggagaaaccacccccaaaatttactggcttaagatacaagccaatctattggttcaaaattctgcaatctgggaaaagctcaacttgacagctctgctagtcttgctggtggttggtcagatggtatgtcacctgcaggcaaggttcagctgggtcactgggctggctgtgcttatgtctctttctgggtagtctcagggattctccctctccacatagtctttcccagtggtctttccatgtgatcactccagcagggtaactggatttcttacctggcaactcagagtgcccaagggtgcaaaggcaggagcttccaggttttcttaggttgggcctgtgtcttgttttaccaacagaatgaggcaagtcacaggcccagcccaaacctcaggtaagggaattgaccaagggcataaataacaggagacctggaagtagacatccacaaaggtaaagtctgaagcttctgtatttacaaagttgaggattcccaaagatctcaggaggagttgatggtacattaaaatgtaggttagataaaatccattccttttgctccaatggagcaagactattatattaatagatgcttgattctttcttcatcctgaaactaacgaatcatttatgccctacggaagcatcaaggctgtagatgtgactgcccaaagagaaggggaacagaagtgtgtgacttctgctctcttgccgctgccatactgtctcaaaggtatccattttttaaaaggtatcaatacctatcctcagacataaactaaggatagtttctgaaaaggcaggagcataccaattggatgagaagacaagaatatttattttttctttttattatacttttaagttctgggatacatgtgcagaacgtgcaggtttgttacataggcatacatgtgccatggtggtttgctgcacccatcaacccatcatctaggtggtaagccccgcatacattaggtatttctcctaatgctatccctctccccttgccccccaccccctgacaggccccggtgtgtgatgttcccctctcgaagacaggaatatttctaatctccatttacttttctctggcaagtcacacattccgaggggattcagcatgcacaacaggagtccctgcctgcctcaggaggtagagctgctctcctgcagaaacaggctagtgggttcaatccattgggactccatttcagattattttccccaggcttctgagtcactgtagtcagtgagggtgcagtggctactttgattcactgtctacccctcttcatcagggctcaagcacttattccccaagcactcatttgccagggctaggcgcggtggctgacagctcacagctgcatccctctttgggaattgtccttccctgaagaaagtcaccccgtctaaggtcacattccttccaagggcagcactcatctgatgaatggtcaatacggtagtataaaggcccactcaccttgcctcaactcaggacaattctacagggccatcccagctctagagctccccatgggatgggctgagcctttgttgtgactctcctagcccaacttctcgctctgcccagccctgcttaatccatttcctccacaggtgttgccccagagaacatttcctgatatgcttcccacaccccaatttctgtctcaaagcttacttccagggaactttcctggaggtcaagtgaaggaggggttatagattgggctacttcctactacaggctgggccactgtgggcacacacagaagtgggacgtgcagcctgggccttccccaaacttccaattgagaagacatgacaagcacttaagtgacagcatgagaagttaagcaaacataatgtaccagagtcacaagtaagtctgatgcctcaaggattttcccctcctcatactaccccttacaacatcccccaaagttgtattttgtgtttttttaggggatggatgattcatgacattgattatatggttaacaattgtgcctaagtgctctcccacctgattatttcttcctttgggcatggcactggcaatcaaaatttatctttcaaattaaggctataattatattttgataaagatctagcaattcaatgagaatgaaattttgagggttgccaggatacggatgactctgggttatagagaagggtttgcatgcagaatactaataggtggttcagcgctcttatctagacctttccaatagcgtctgataatgcaggcccatcaagtactgtttctctgctattattctagcagaataaaagtgatgaaagatataagcagggttttatgaatgaaaaggtgattcatcagatgtcttttggtctatctcaccacagttaagaaatacagtaataataatgtggtgttacctcaaaatctaggagacaaaaagctttctcttatttccttgcctcctcttttattgtaaatagaagcaaaatgtcttagatattgggttattgtttttcattgggaatagggacctgtgtttgcaatggtgttgactcccaggaaaatagaaacagtagaaattggtatgatgttatattttgacttttctttacttttcctttccattttactctgattattattcattcattcattcaacaaatgtggactccctagtattgtgcaggctctgcttgaggaatctaagaaagtttaaaatggataaccatgcatggaaataataaataatgacacaacacagtagcatccaacatgtcatttcgtggcatggaggggagagggaaggagtaatattttttgttaagtgagatgtaatttacatacagttgagttatgcataagtcttaagtgttaagttcaatgagctttgacatatacatccatgtaacaacctcccaaaacaagatataatgcatttccatcatcccaaaatgtcttcagtactcctttccagtctctctcccacaccttttggcaaccattattctgatttctatcatatagattagattcacctgttcaagagcttatataaattgaatcataagtatgactttaaaaaatgtccagcctttttcattcagcatagtatttttgaaatttatccatgctgttgtatgtatcagtagtttattctttttattgctaagcagtaatccattgtaagaatataccatactttattcattgacttaggctgtttccagtttggggatattatgaataaagcttctaagaatattcttgtacaaatctttgtggatttacattttttgtttctttttggtaaatatctaggagtgaaattgcttagttatagggtaaatgtatgtttagttttataagaaactggcagagattcttcaaaaattgtatcagtttgcactctcatcaccagcatatcagggttctagttgttctgcatcctcatcaatacttggtatgtcaggagccattctaatggatatgaaatggtatctcattgtggttttcatttgcatttctgtgatgacaaataatgctgaacaccttttcacgtgcttagtagacattcatatatcttgtgaggtgtctaattaagcctttttctcatttttaattctttgtctttttattattgatattttttatttgtagtagctcttcatatacactgagtaaaagttctttgttagatatttgtattgcaaatatttactcccagtccttacctgccctgttttttaatagtgttctcttgataagcagaaatttttaattttgacaaagtccaattatcaatgttttcttttatgactagcctcttttgggcacggtcagaacaatctgcttccctcaagttcatgaatattatttcatacattttcttctaggagttttatggttctagcttttatgtttaggtctatggtccttccctaattaccggttgtgtatggagtaaggtagggtcaaaattcatttttccccatatgtatatttagttgttccagaaccatttgtaaaaagaaaaccagaaaactccttcctttctcccatggaattgacttaacgcctttttcaaacaatcagttcaactgtgtatgtgtgggtctatttctgaattctctgtgctgcttcattgatctataatgtctactttcttgccaaaaccacactgtcttgacctctgtagatttatagtaagtcttgaaatcagatagtaaaaatcctccaaatttgttctctgtcaagattgttttagctattctagaacctgtgcattttcatatacattttagaatcagcttgtcaatttcttcaaaaaagcatggtatgattttgattggcattcatttgaatatatggatggatttggagagcatggacatttttaacaatgttgtatcttcaggccctggatatgctatagcttttgatcatataggtcttctttaatttctcttagcaaagtttgcagattttagtgtagaggacttgtatattttctgttagatttgtttgtcctttgtatttgatatttgtgatgctatcataaatggtattcttttcatttcattctctaatttttcattactagtttatatataataatacataaataatatataatcaattatatttatatgtatgtatatataaatgcaattgatttttatatattgacctttttgtatccagcgacttttctaaattcactctttagttctagcagttttttgtagattccatagggtttttaacctacacaatcatgttgtctaaataatgacagtattcttcttttttatcttttgtcttattacactggtgagagtgttttttaaaattcttcccaatcttaagggaaatcaacatttcaccattaagtatattacctatagattttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagcagagacggggtttcaccgtgttagccaggatggtctcgatctcctgacctcgtgatccacccgcctcggcctcccaaagtgctgggattacaggcgtgagtacctatagatttttcagagatgcctgtcatcaggtttccatattaggattatatagacttcatacaatgagttgggaagtgttctctcctcctctattttctagaaaaatttatgtaaattggtattatttcttccctaaatgttggatggaattcactggtgaagccatctgggtctggaattttccttgtggtttttattaagaattccatttctttagaatttacaggactacttgtattttctgtttctcctgtgtcccttgctaagtttttcaaggaattttctgtttcatctaagttgttaaatgtatcaatactgtaggctagagtaggcagaaaaaccaaacatatcacctgaagtaggactttgaagagaagagattggctagacaaggaggggagtcctggggaaagaatggtgtgagaaaagacatggggtgtgggattaccaatggtgtgggttgtttaatatggattatccccatctggttgtagtggaagttttgggtaaagaagaagtggaaaatgatgatagaaagataccttggagccagatcaatgacaaattgtggagtttagatcttatgtaggaaatgaaaaacccctatattattttcaaacaggggcacggcctgcagaaatggtattgagggaaatgatttagaatgatggattggtgaaaggagaagggtagaggtaaatgcaactcttttagaatggtgcagtatgcagtggtaagcactgcctaggtgaaacaaatttgataaagaatggagctaggaccaagtagggaaaggcctctgagtatttctctgtacacaacgtggtgttatgcacctagtacaaacttatcacactcttaatattttctctgttcccatatccatctcctcacctggacatccagctcctctgggaaaagaccccaaggtttatctatgctaaagtactagtgccagcatgcagtacacacttagttaataccaagtgaatgaatgaaagctgaaaatatgaatgagcaactggatgaatgaatgagtgaatgaatgaatgaatgaatgagcaggcaggataaaaaactggattcatcaggataggataggctatgctatgataacagataagccaacaaagctcagtgctttaacacaataaaagttctcttccttccttacacaaagtctggtgtaagtcatgtaccctcctagcagcacgcgaaaagagagaacaaaggctcttgggaagtttggttaaggatccagcctggaagtggtgtacatcacttctgcctacatctccttagccaacactgagtcatttggcccccatagaactgctgagaaagctgggaaatatggatgtggaatggaaatttggtaaacactaaggacacttagaaaggagcaaaagggagctctaaaacctatttgttattgcttccagcctgagagaaagctaagtcctagagatgttaagggacttattgaggactccccatacggattacagattacttctgccaatagagctcagactctctggcctgcctttcaggctttaatatttataatctcgtggctcacttattgctaactaatttttagaagccaactcctccaagaggaactgtgagcagaacgaagcactaatagactctgccgttggttacgtggtagctccagccagaagcacaaatggagagaggcaggatatgggttaaggcagggagttttgaggataaacctcccaggagtcagcaaagcagtcctgctttgggaggcatctgtgctaagctcatgccagctgcctaaagagaactccacatcgtctgtgatctggagtctcctgttcaggatcaaactagctgcctccacagggcctggaatgcacggcgagggctctgtggctttggaaaatgctgccgaggtgtctcaggtggagccaaagatgtgaggggaagcacctcatctgccgcaggagggtaaactagatggaaggaggttgtgttcctcagccagatgtaggtattgtttggttttcagagtggtgtgagcatcacagatgatgaaggccaagcacatgggatgaagcttggcctaaggcgagttctcaggagaaggtgttggcaataggaggataaccatggagcaggagaaaagaagcctctcatctttcttagatttggcaaggagagggggcatcaatgacaatgcatagagcctgctgccttcccctggaggcagcttccctaagcggggtcatggacagtctcccagctcccctgcaccaatcagtggttccacatcagacttttctgcctcacatttttttttcctttttaaaggtacagttaagggccaggcatggtggctcatgcctataatcctaaccctttgggagacaaggcaggcaaatcatttgagcccaggagtttgagaccagccctggcaacatggcaaaaccccatctctctaaaaaaaaaaaaaaaaaaaaaaattagccaggggtgttggcacacacctatagtcccagctactcaggaggctaaggcgggaggactgcttgggcccaagaggtcaaggctgtagtgagctatgatcacgtcactgcactctagcctgggtgacatagtgagaccttgtctcacacacacacccacacacaaaagtacagttaaatagagtgaaattaagaatacaaaaaaaaatgacagaactctcagaaaatgagccatcagagaaatgagaagtgagcatattggaggaaatcatgaaagaaaggattaaaggagatactgtaactgtgaaatgaggaaagtaagacctgttctaatgccctttgcctcactccttctgttcctgcattctggctttgctgttcctcaaacattcaaacaagatctgaccttgggtcctctgcacttgctgttctttctgcttggaattctcttaccacacattttcacacagctcaccccttcactggatcaggagcctgctcaaatgtcacctttgcagagatgccttgcctaactactatcttagtttgaattcccccagaagtagaccctgagacaaggattcaagtacaagtagtctatcagagagatgaacccaagtaacacagcaggggagtggggaagtgagagggagaagggaaaggatctaagaaaggtatgctatcaagcagccaccgtgtgggtagctgtgcctcagtcctgctgaggaactctgggagatagtgtagaacacacttcagagttatcttgaccacagaggagggcatctgttactgctccagtgcgtgccctgtgtgtgggccaagcattctcccattgtcagaggggaaaaaatcacccttaggcagagggtcttggggaatcatgagaagcagccttctgactgttgaagtgaatgctgaaggcacattggcaaggcaagaagcatctgccacaacatcctctctaaaatagcaaccccatcacgctttatcaccttgttccactttctgacttcacagaatttacgccacctgacagtacatctgtatgcttatttgtcatctatctctcccagtagacagcaagttccaggaagacagagaactcatatgtctttcagtgcctcagacggagatagtgggtgtttggtaattatttgttgagtgaatgactattcagagaaagactgaaactcgttgacatcaatattatcctcagcacatgaaagagtgagagaagcagggcagaaatcagttgcaggaacgaacgtaagcattggacaatgagggccatagtagggtcttcaatatgaatggataagaacgttattccagtttcctggtctgatgtttctggggacttaaagatttcatctttgccatggccataacagctattattttttgacctatataccaaatggaaacaacaacaacaacaagagtttctttgcaggctgggaaatttaatatatccaaaagagggcaccctagtcttgatccactagagggctcaggccaaggacaacagggaaagaaatgtgaacgggacaaaggaaggaagtagggagagagagtgatggagaaagtgcggttcagggaagcaggtggcaaaggaagggcctaacaaccttggagtcctcactaaaaatggaatattcaactgggattttattaactttgagatgagcttttggggacctattcaagtaaacacaacccaccccaaagccccaaatcctcacttgttactgtaaaggcctgttagtcccatagttcaggccctgaatgctctgctccaggcccctggcttgaattcaccccaggaagaagaaacttctgcagtatgttgttgctgaaaaggcagcttgcctgggcagccccagtagatcctgctctctgtggcttcgcagaaaaccccatcacaaaggacactggcatttctagaatggacttgagcccatagctactattgaaagaagactcagaagtacacaatgggaagctgacacaatggtgaaagggatgggaatctgggcatctctgtgtgccacttgtccccagtggcttttgttctggaaagaacagacttttctgtgggtggataaaaggcaaataaatgttgtattcaccaaacctattggtttgacagcttttaaaagcaagttacaaaaagtcagaagagtggccaaagctcattcttaaataaaatgagattcccaagttgtgtttaggttccaattgccttctcttcaatacctttatcttttcatgtaaacattcttgccctgatatttaattcctcacagaactgacagaagaagcctcataaccacccactaacaggggtctgtgctatgtctacacaggactgaatccgcacatttaattgaattcactggcaacttttgggaaacatccagttagaggactggtttatgggttgtgtaagtgtaatgaaataattaatggttctcatttgttactggaatgaccagattagccagctgtttttgcaatgtcaaattctgtcaaaaatgcttgtgtctggagttgaagatccattgttagaacagtcagtgtgaccctacatgtggtttgggccattgcttgggttcaaaacagacctttagtctgatgacactgactcattccattcggtttgcaggttggtgtcatctgcaatttcacctctattccaattgctgcatgggtttgagggcttaaaaaaataacacacaaaaaagtacttccttactctttgaggttatggagtagcccgttccttttctgatcatgatctttggccaagttggtctggcctggatgtctctgagtgagtgaactctgcaacgaaagtcactctctggggctgaagggtgcccgaaggccagaggtggtgttgggttgggtgacttcctgagagggtgctgggaaggcatctgagcatgggctgggccacaggcactcccagttcctaatgcactgcctgaggatcctccctgaagagaaatcaaactcaccctttgggccaaccaggtgcttgcagctttcactggcaagtcttggcaaggggtgtgttagaacaaagagttactccacctgcagattccaagagctaatttgaaggttgagttagagaagaaaaagcaaaagaggggagaaaaaaagccagcactcagcagagctgcagcagaaaagcagagccccatttagtgtaccctcctgcacaatcttcatttctgtggatgccccaaagcaactcctaattcagcctgactcctatgcatcaggctttcaaggaaaagcttttgttaatactgactgtaaattgagggggtggctttagcaatgttttctgaagaacaaaaactttggcagattatttctgtagcacactggtgtatttaacaacattagacaaccttattagttcatagaggaagcatttatgcagtacctactatgtgtccaacactgtgcttgatgctgaaatatagagaataaatactccttgccctgaaaaagcatctagtttgacagggaaacaagcaattaaaacagtgtatgggtggtcctgtcttgttaacccaggtccccgattcagaactgatcaccatttagggaggggctgtgataggattacatttgtataatagtagtctagaaatcatgtcttctcagcaaactaaaagaggaaaagatgaaaacattggtcttccccttacctaaaagttccaatgacttaaagggacataaaagcatccattgacatgatagagcagtgaaagcagaagcccacttctggtaagagctggtaagataccaaagcactggaagggcgagcctctaactgcactcttgccatctgagttgagagggatgggacatacaggaaggaaaaactaaagaaaagcacataatcaaacaatgatacaatagaagccatgtcctaggctaaatagggaccaaatgagtactcatagcaatgatatagcgagttcattgaattagtgtaccattagctgctgtaacaaaccccaacatctcagtggcttaataaaattcaggtttattcctcacttgcatagtgtccaaaatgggttttgcctcattggtgggtagctcttctcctagctggaattgaaggatgcagattccttccatcttaggaatctactgtcttcagtagatgacttctaaggtctctgtactcatcttcatcaagaacatgaaaggggatgtgtgggaggtttcaatgggccaggctggaagtggtgtgtgtcacttctgctcacattctaccaggtggacctcaccatatggcacacccaactgcaaggaaggctgggaaatatagtttagctttgtgcccagaaagaagaggaaacggctttggtgaccagtgaagccagatggccactctgagctacaggaagaggtcattccactagctttcagctccatgtggacagggaccctcactccctctccttggtgtctctgatgcctacacttgagaatctcaggccttcctggtcagtaggtcgccattgtcatttcctcaatgccgcacctcccactattcttactctctttcacatctccctgttttagttcatcagagtgcttatcactaccaatgacattcttccttattaatcaatttacttactggcttttgtcctacctggaagtaagttccataaggacaaggacaatggcgcatgtcatgtccaccattctattgcagtgcctagcacagtggttggcacatgggaagtccttaataactcattgatcaatggatgaatgaaccaactgggccttgggaggtcttggatggcttcacaaaggaggtgcaactcgagcttggtattgagtagaatttgtctgggaggagagatcaagtaaagaaaggacagattaaaaggagacaaaaaggaccacaagatatacagattgaaccatttatggaattgagccagatccattcaactcacgtttgagcacctattacacacaggtcagtgttctagaccattgcttagctggaagatgaaacacacacacacacacacacacacacacacacacacacacacacacacacacacacacacaagaaagctcgtctgagccagggactaagacacttccctttacataagagggttaggcttcagctccacatcccggccaccaaggccctccactgaaccacttcagtcttcctttctggggtgaacatggtctccccacaccaatatctgctcctttgtggggaagtgatgtggggcagaaagatcttgggccttggaatcagatgtatgtgcttccagtcctgcctctatggccctcgagcaagcaacttaacctttctgtgcctatacagtaagttggagataatgaaatgttcatcctgggtttatcatgggaaccaaataagattagctatattgagggcctaacctgctgtgtggttcatggacatgctcactaagtcatcttcatcttcttcctaagcagctccctacctgcgcctctctgattcacatgactcctggccaagccacagtgaactactcctgggacctatatcaacagactcattctaaccttcatattaggttggatcacaggaaattgctaatattaaaaaatttttgcctcaaaagggaaattccaaatggtttaacctaacgctttagcatatgctgatctctcccagcatttgctgatcctatccagcccttaaccctcctcctacttcaatgttacctcttccctgcaccccttccctaaccagagagcatgtcttttgaacttgtgtggcagcccacttgatcctaccttggattatcacctaatttgtctaatatggctaccaggttataaactgcttgacggcactgacggtgttcctttctctttaaagcacctctgcacagtcccttggacataataagaggtgacatgtttcctttcccagacccaagtgtgattagctggggcctccagtacactcggagggattggggtcaagctttgctgatgatcctccgcaccatgccagccagcaccggggcccaaggcacttattctccaatgcgaccctctagaatcagttgcctgttataactttgctctctcttctcccctcatctctgtctgcctcaaaccaaccggagaagagaagcacaaaatgccttgaacttgggagggggaaatagggtgtcatttatctggcttgagcgattattgagtttttggctcttcatttgcttacttaagagttgtaacgttgaaccacatgaaattgccaatattcaactattttgacctacaaaaatgtcaatttcatagggttcaacctagtttttagtatttggactcaggcacaatcactcaggggtgaagctgtctgatccctgtgtgtggtctactcaccaactccttggtagagagatccccatggaggctactcatagcttctgatgggcctgtggcctttagtagattctgtcattgcttgtggagtttccatcataggctctggattcaaaaagggctagttcatatttcccttttccctgcaggtgccaacatatgtgtttgatctctgggataaatgccaagacctccagacttgagttttcaagtcttctggagatcaaaggctctcctcatcactgtgtgggcttctctgtgctgttactcaacaaagcaaggccagctcctgcaagggccagtggcagagttcacgagtcaaggaaggaaggggaggagctcctagttttcgaaatactgcaacatgtggagcagatgaatgtgaagggaaggaaggctttatgtttttctcaaataaactggaaacttaaaatgcaggaactttacatgaattttagttatttattaactagatccacctgaatgggatggccaggagcctttcatagttttctcattttatgtacccaaaggaatacacaggaccttagcaatcattgcactcaacaccttcagtcatttcatgtgacttccaaacaaagtaccctttactgtacattgctagtagaaaatatcctaatgacaaatgaaaaacaaaaagaaatctaaaactgaattaagttgtcttattgtagtcattttgcaactattcaaataagtaattatgccattaggaatcaagattttcagcacaagagaaaatagatcaattataaaatcaaggaagttaaattaaaatctgtaatcttagatttgaattggcaataatgttttaaactcatgatttattttcaccttctgaaacttacatattttctagtcctgtctactgaagaagtctagaaccaatgacaacctagcaacgatgaatacccctaccatgcagaatgtggtctctaaagtctgtttcctctgagaggagtcagggcttcttcaagaaagggctgattctaggtctgaggcagcaaatgtgcaagatgaacgtaggacacctcccttgacaccactgcacactcagctagactcaagctaattgagtctcacaagagaacccatctcttctgacaccagaatgaatccattatgggttaagtatttgccactcatctagctatgtctattatagagagcacataactcattacaaatacctaggcttttgggatggaaatgtccttggaaaagaatgtcttttggcttgcaggctcatgtatttatatcttctttgttggcccaataaagagcatcacttctctgctacctgcaaagatactaattagcaagtagtgattctaagtaagtgtagtggaggtggtatgtggggccttttgtaagtattttaaaattttccatcatcacttatgctctctaagtagattttaagagactaacctccacctaggagaagggatttattagcatatataattggatgtcatgtgctaattaccttactgcttcacaatctaaccaagccaagggcatctgtccaagaggacagaagaggctccatgcgccatattggaaaatagaaccctttttttcttatatccagtggctgagtgcagtggttcttgaataaaatggcgattttcacatgctttttctgacctgcctgtcccactccagctccattttctttcctgggatgtcagaggcacccatgtttatgatacctcatcttagtttgaacaggagtgaagcgattttaacatgtcatactcatcttcatgggtgcattgcctcctttcttctctatttttcccatggagagagcctgctctcaagaaactatgagtactaaaggatgatactcacggtcttccctgtaatcagcctcacctggttcatctcaaataatggaaacagatttgtgtcattcaccaaggagttttatttttaacccttgttaaacccataactatttgtttcgctctcctgaaagagcaaattccttatttccgatcagtattatctttctatacttttacttgtttgcaaacttgcaacactgacagtgtctcttcagggggtgtggggctgatgaagtaaggattgggtcaagcccccatttctcctaccctggtttaagctcaggcgtggaagccttgaaaactggcacaaatgtttcatgacttggtgatgggctggtcattttcagtacaggttgctgaaaagcaagcactttactgctatctaagagcacagtggcccttctggtaaagctaaccttggagttgaactaattattagattgaactattgagatagttttttaaggtcaagatggttgaatatcaccaatttaatatgcttcaatctaatacctaccttgttacctggcctctgtggtccactgactggcaacatcagcatccccctgggacttgttagaaatgcagattctcagatcccatccgagacctacagcatcaagatttctggcagtagaatctgttttaacaaagtctccaggtgattcctatgcatactggagtttgggaagctccattttaatctattatgttaatatttaagtctgcctttgagggcagccttcttagttccccaatggtgtggtttgtatccatacagcctcacatacaatgatggttcctggttaagaacaaatatttccatcagcattgttgaggcaggatggtacattttgacaagaacaattatgaatcctctgcctattgtgtgctctgtggaatggtagcttaaacagtacaatttctagctttgccaagcgactgccaccttagtgtctggtgtttttaaaaggatgtaccttgctgatatatatatatatcaaacactaggccatgtgtacatctaagatgccagtctgctccccatcctttgattagggagctggactctggggttagctgtgtcttgatagcctctgttcaaactggccaaggaaaggacagcccagttcatgctaaggagagcaaaatctccagtctggcccatagcatactcacaatcacatggagaatgtggcctcgacaggggtttttaaagagagatgctccttgcggtctgtgttataactgggagctaatccaaatccaatgctgggagaatgggtaaataaactacagtgcacccacctggtagaacattatacagctgttaataagtattgaggttgattcacaaaggaaaattctttcatttcgttttatttttgagacagggtctcaccctgccacccaagctagaatgcagtagcacaatctcagctcactgcagcctccacctcccaggctcaagagatcctcccgcctcagagtacctgggattacaggcgcatgccaccacaccaagctaatttttgaggttttgttgttgttgttgttgttgttgtttgtagagatggggttctgctgtgttgcccaagctggtcttgaactcctgggttcaagtgatctgcctgccttggccactgcgtttggccaaattcttttatttttaaaaagcagtatacaatagagtatatatgctatatctcaactatttagaaacgtacttgaaaaaattgcttggaaacatgctagcatgctaacagtggcctttggtgacaggattaagagtggctttttgttgttcttttagacttttttgaatgactgtgggtgtgtgtgtgtgtgtgtgtgtgagagagagagagagagagagagacagagaattagtctgttctcacactgctataaagaaatacctgagactgggtaatttataaagagaagaggtttaattggctcatggttctgcaggccgtacaggaagcgtggcagcatctgttcctggggaggcctcagggagcttttactcctagtggaaagcaaagcggaagcaggcttcttacatggcaggagctggactgagaggggttggggagaggtgccacacacttttaaagaaccagatctcatgagaactcactattgcgacggcagcagcaatgggggtggtgataaaccatgagaaaccacccctgtgatccaatcacctcccaccaggccccacctccaacactggggattgcatttcaacatgagatttgggtagggacacacatccaaaccatatcaaagagagagagagagagctgtattttaatctttgtagccctttcactactacataatagacatttaataaatgcttgaaagaaataaagaataaatgaatactacctcataagcacttggagtgacagggatcctgtcttagccatctgtgtgtcccctagttcctagcccagaactttgcaaaagtagctgctcaatacaagtgagtgggtttgaatgaaggcccagactcccagagctgctggacatgtcaactttatctaatacatttttcctgctgaaaaaccaagtttgtactgcacctgagtcagtgctttctataaatcagagactcttctaaaatatcatcaggccctagaatgtgtactatctctctaaggttgtgccctcccccactcactttccccacccctgcaatttttctttgttttaccacattcccctctctaccccttctctctaacctcttttgataatgccatccatcccctctctagacccctgtgaatgagaatttcttctttgtattgaatctaaatgtcttctattgcaatcctgtggataaatgaaacccatagttggtgcaaaaccccacttgagctatttgtgccaatttcatttccctgccaaagtatacagggagtcattaacaagtaacaaaagcaatcaaacacatttccttcaagaatttacatgggacaatgcctggcattgtcagggatctcaagaagtataagctgtggctcctcttgtcagaggcataaggatgtggctgcagatgtgtatggcaatctaagatagtctgtgaggagtgcaaatgagaggtgggaaacagtgagtggcccagcagcttgggagtgggaagtagaaggcttttgttgaagatgaggcttggagggtagatagatggcaaacagtgcaggcattctaggtatacaagccaaccaaggtaaccaagttgggctctcctttttccctgatccaatcctcttatgagttatttgctctggaaaactcagaatgcaaaagagacagaacacagggaaggaaaggagttcagatatttcatatactgaatacctgagtacactgaatacccagctatctatctttaaccagaatgaagaaagggggggggggtgtgcgtttccactgctgtagcaaaggttttccatcaatgtcatctttccctgatgatatgtatactctaagtctcaaagtggcttatagttgttactggtaaatgggcagggccctctcttgcagccatagtctcctcagagcagctcttggcgggtgtgtccttctgtaaataaacacaaggcaaaccctggcttctgtggctggttcatctcaacaactgctctctgagctgaagtgcacctggaattttaaaataaaaatggatggaatgtgtactatccacaggtgagaagtgttttttttcccctcctaaagacaacctgataaatgtgaaaggtagaaaataatgactgagagatatgaagggtgcagaagctaggctgattatccccatgggaggaagaggctgctgagggaagtgcatgggcctgggctcagaagacattggctttggtttttgcctctgccaaaaatcagctctgtgatctagggtcaaatattttaatctcagttttctcatcagcacatgaaaggagtggcctaaacagtggctttcacagtgttttgactgctattcagagtaagaaacacatttttacatcacaacccagcatacacacacacaaacacacacgtgtgtgcacatgcacatgtgtgacacaagtgatagcttcacaaaacaacactgcatgcagtgctcttgggtattttccagtctgctctattttatttcattgtttctgtttgtttgttttttaattatactttaagttctggggtacacgtgcagaacgtgcagttttaaaatgctagtcttgacctgctaaatggatttcacaatccactaatgtgccatgctcttgcagcttgaaaaaaaaaatacagaagtccaaatttctgaggtcccttccattagtagaatccaatgactctgctagatgcctaaaggaattttcttaaaacaatagctgagctgtgacagatgactatgtgcttacattctggaggaggtgtctggtatagaacatggcagcagaatgacctgaagataaacaagtaaattacaaactgctgctaagaagaatgtctaggactgcaactctgccactggctcagagagttaggatcgctgagtcattacactaaatgctgtccaagtcaatagatggcagagacttggggacattgaacctgtcagagaggtcacaggctccccagttgtgggcagtcttctttccagtttccagaaatgagaccctcaaagagtgatctttagtagcctcatctttgtttatacttcactcaacaagaagacaggcaaaataaagcaaaaagaaccttggagagctccagactttcctcttgtgaatttggaccctgatcctggcctcccaatcttcttttgttttcagcccaggaaagggaactaatatttattaagcagtgacacatgccaaggatgttgttacttaattggagcctgaaccactgcatgaaggctctgtgattcccctttcatagaagacttgctctggatcacactgatgctgtgatccatctttccatccaagagcccaagctctttccaccagcccatcctgccatagcttaactacagagtctgggtggattttggtgactggcatcaaatggagggcaggacaggacagggcagcacatcactcagagatcaaaaagttcaaacccctcctttgtaaagatggggaacttgaatccaggaaaggttcaacgacttgcacaatgtcacatggtgtcagaactgcaactagaacccaggcttctactggtctttccacaggatgttggacattaaaacaaccatggtaacagcaataattaaacagtcttcctggtatgaagcatcgttttgttttagaagctgggaaaactatttctaggggaaaaattgttctagatccttttagcgtacaaataaacacacagatatgttctcctgttctgtaagtgttggaatgtttcaagatgctggaatttgttaagagacctagatctttctgatgctgagaggtgaacatgagacacctcatccatagtggggaacaaatctgaattattatggttctacagaacaggaagcccagcaaggaaagactctgggaaactggctctggctttgggctgctctgcaggtgacaggagccttggtggtccttgctctccttgtactttaccctgttccttcctccaaactgccaagcagagtgggcaaggggatggttaccgaggaagaaagggcaggcaggaataaatgggttcacttggtgaaatccccttcccatcctcccaatagatctgagcactcaggcagcagcaacagacaccttagggaaatttcccattttgcctaccaagctgatggctcctgaggattggcttcagcatagcagggacctggagaacaaactggctatgtatctgtgacactgacaatttcaggtgcttattaattgattgatatgccaacacactcctccctgtcatggggcaccagaacggatggtttgtggagggatgtgttcctgcccacaaagctatgtgttgggggtggctgtggtggtagaagggcaggaagaagattagcaagatgtgggtgggtaaatgtgtctgcaggcactctgagaacgtttaaaaatttttcttccctcccttgaaggggtacaaattccatttctgagtcattttgtgcatttttctgaaaatttcaccacatgtagcagtcaaactttgatctcagctgtcacctcccccttcttaaggaagaaggagtagcaggggagaaagccagtgtggggtggggatgtgaggtaaggaggctttctaggaagggaggccaagaataagcattttgcactgctcccgggggcataaagctgtaaggcaatgggatgctcacaaggctaggaaagagagaatcaaatgagtagcacccctaacagggcaggggagatggggttagagaggctggggcaagactaagtttgcccctgatttttaccccttcccagtcgttcataaaaccaagcttcctcctgctcttagaaacgggcctagtctttccaagagagtggcagccactagttttccttaatgtctaagttagctcatttcagaggaccccagtgaccatatccatccttccaatacattactatgaatcaagatcttgacaattccattatctccagtgtttgacaggggaatgaactaagatcagtctataaagacttttcattgccctgtggacatttcctgcgatggcattttctttcagcagtttgcttttgtggttatctgtttgtggtgttgtctttctgatataatagaacacatcttcccaacctcctgctaggcactttctggaagagtcactcagttcttggttatacctgatgctatggatgatacagagagtagcagttctgaatctttgttctttattttgaaaagcactagatcctttttatgtggcagatggcccattctcactcccctaccccatcacccttagcttagggaaacttatttcaatattggtttgggaaagagtggcagcttagaagccaaacagagatggtttctgatcccaggtcttctacttaccaggtggatgacttagcaaatttacttactttctctgagttcccatttccttatctataaaataggggcaatattttcctctttgagttgtgtgcgggtaccatgatattattaatataatgcacctggcttagaacttggcatatggttggagcttcccacaagagcttgtagtcttagatgagggaaatgatacatccaaaaaacctttttcctgttgtggaggataaaaatgacacatagagccttatttcctgttgtaacccttgtcattatcttcccctttcttggggagcagtaacagaggggaggaattgacaagacaaagcaagtgactgactctagagaagtagataaagtagtgggagtgtgcattagtgatatggtttggctatgtccccacccaaatctcatcttgaattgcacctcccataattcccagtgtcatgggagggacctagtgggaggcaattgaatcatgggggctggtttttccaatgttgttcttgtggtagtgaataaatctcgtgagatctgatggttttataaaggggagttcccctgcatatgctctctttgcctgccaccatataagacgtgactttgctcctcttttgccttctgccatgattgtgaggcctccccaaccatgtggaactgtgagcccattaaacctctttcctttataaattacccagtcatgggtatgtctttattagcagcatgagaatggacagactaatacaattagttttctattattatttctattattgcatagcaaatcattgcaaacttagcaccttaaaacaacacctatttattatctttcaatttccatgggtcaggagtctgggtatgagttgactgggtcctctgctcagggttaactgggctgaaatcaaggtgtcagctgggctcatcccatctcatctcatctcatcttaggcccagagttctctttcaagttcattggttgatggcagaattcagtttcttgaagttgtaggagtgaggccctcagctcctagaggccacctgccattccctgccacatgtccctctccacaacacgacagtttgcttcttcaaggccaataggagagcatctctgttgctttttgtctcttttaagtattaactcaggattatactctctcttttgattaactcaagtcgattgagtacagaccgtaaaacccttttcgacttgtaatgtaactaagtcacaggttcttcccacactcaagggaaggggattatacagggtatgtgcacaagaaggcaggaatcttgggaatcatcctaaaattctgcctatcacacagtggcccctggacgtatgcaaataaacagaggaaaaaccttcttgctttgctttgttccatttttatgagaacaaacattcctagggcactaagcctgctatcttgcataacttagccatggtgagattgttaaaaagggaggaaaagggagcatggtgaacccgaagatgcagggcagccttacaatggcagtggagcagctcacgaatgaatggattcaactgtggttgaactgttacttaggaaaaggaatagattttttaaagaaggaaaagggggacagttttccctggaagagctccattagtggctgtctgcctgcctctagtggacacgtaatactagttaatgctctgtgaccaaatgacgtcactgagagcaaaggcattaaagagttttcctcctttccctgtctaagagatagacaggatggtggcaactgatgagtgaaatgttcacctgctaatgtgtggcagaaatccgatatagcttctcaatggagaaagaaaaagattttggaaagaaaaaggtgatgatccctggccctgcaggttgtcattgtgagggttggttcttcccaggagccatgactaggctgcccatgctggaactcatgcattactctttgtatctgtgaattcacagtcccaagcagcaggcagagtttagcagcccaggaactcagcactggcttgcccaacaagcacagtagaaatgtgtttagggtatcagcaaagcatgggcaccaaaaaatgctttttttttcaggtaacttgatatttaatatttaataatgagggaagagaatttgctgaacatctttacactaattttatgatatgccaattgattctgaaatttgggatcacctgctgcagaaaggtggacgtggaggagtgaggactataacctttttggcgttcaaggcctctagagtcttgatgcctgagaccatccctagggaactgtataataccaaaataggaaaagtcttccagtgtcattgctcccaaactatttcatccaggcagaatcacagttaaaccattttgcacaaagccagagaacaaatgctttatgagggtcgggattcctgtgtgttttgttctgtgctgtgttccaacacctagcaccatgcctgagactaagagctacttgggaatgttccatgggtggatggatgtttccattttcagcagcgtcttcccttccctcatgttgcccaactcctttcactcctacaagatcccaaggcatcatcagaagacattttgtgtttctcaaacctgcctgatgataaaaataacttttcatgtaatatagattaccaggcctttcttttggaaattctgattcaaagtctaggttgatgcccaggaatctgtgtttttgacaagcacttctgatgagccttttcttcagatgaacattaagataaataggaggggctcaggttttccccacacaagaattaaagagccatggccacttgacctggtttctgaggggctgtcaaaagttaccaccctaagcctctggtcagcagtgctgagggaatgagggactagaagagtcttctggtctacctcttagtcaccttggcccagccctgtatcctggctcccaccttcctgaaaagacgagcctaagggaaggggtgctcagaagcccctctacttctaggactgcccacctggcttcttgcccattctttccacagacatgctttctgttctgtcccttctcccagctgtcatgagcacatgaattcatggtcctctctgttgggtttggtaacgacctctgccccattgggtaggagttgacttttgcatgcagggagagcctgatttctcagtcaatcccccattactgaaccagagtggaaagagatgagactgggaggtggggggagcagggtgggcccaggacaggagtctggatctggatagtgtgtctggagggtaaagcagactgggccagttcatgccattcccgaggctgacaggctacccaggtgcttgtgaggtcctctttgcagccatttcttagtaaaaatcctcctggttcctaacatctgcttccagcagaatttctgtttaactcatggagagttccatcctaggatccctgtgtacatgaagaagatgagagtgagttaaatgctgtgtttgggggaaggaagccttccttccttgatctcttggatgagttgcaaaaactcatcttgcatctgcagtttccctcccttaatactcattacctctatgatggtttctttaatgcgtatgctcacccctgggtgaaaccaaggaagagcaatgctttgaaagatgacaggcaatggagccggtaggtgtagggcatgataaggataccttggggacgggaccacaagggacagaggcagggcaaggtataggccgaagttcaggtggacagcaggggcggcgtgcagaactacagctctgaggccctgcggccagaaggctggagctgaggcagcctttccattcatctctgaggctttcctccacatttttcagaaacaggacccccatctccacccccaagcaggctagccaggggcttgtcagtgttgatgagcgactgtgccaagggtgaggaatgaaggtacggagaggaaattagctagtcataggtagacggttggtgtcttggagcctcccgtgcctcggctcaggggcaaaagttgtccctatcagtatcataaatgccaaacctttctccggccttgagttagttcttaatgtgaatgcagtagtctggacttccactccacccagactttactcctgtcctcttccccaccccagggttggccaaaagcacaacttaaagccactgatggacaacgccctgtttcttgtcttgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagaggtgacagatcctgggcttgggggcttttgcgggagacaactcggaggttgtcccatccaggtgtcctctgtcccatcagccccaacacacccccttattatagcaagtactttgaaatgctcccgtttctaccctgaaatgaaatccatgggtaatatgcccaacccatacacataagaaaaaataatattatggtctaaatatgataataaagagaaattaaaaggaaattattgataataatatctatttcaatatgcaaatgctcaggcatgacctcactagaagacatcatgaagcagtcagatgtctgcacttgtcaaaagcaagtctggattaagtacagaccttcagaaactattccgaggggcaggagggcatgaccataaaaactggtacattcagtatatattagatatgggcaaaaaataaatactttggattagaatgaaaagggaatttggcttgactcataaataggcactaggtttttcccctataagagattctgatggaacatttaaaattgtgtgagacctgggacacattttcattgaccatcctctgcattatgggatggctgtcatctttggctcccatccaatcattgtaacaattagaatgatcccctagagggctcttctgcttctcttgagaaccagtgatcggtctaatgcccccattctttagtgggacacgcggaggcctagaaaggtgaggaaacttgctcagggtcacacatagcaggttaggtgtggtaccaggacccaacctaagcctctgaaatgcctgccagagctcttttcctccttgccatacactgtgtctcatggaaataggtactgatgtttacatgtctctcacagtcctgagaaagctagagataggctcatagcagtcaaaataggaatacagttttttcttacactggttgcttttcagtgccttaaaaccattctaattaggacaaggggaataaaaagtagcttcattgttttagagccccctaaattgggtatcagaaggggacatgtcagctttttttggcctttagattcttgctatggagatagatggtgtctacacattcaatgtctttcttccaaattccctacactcttttaagaaatggcattttgcaaaagtattaaaatgcaagtaaaatattttaatgtcattatcaaagtggagaaacaaaatggtgatattgttttcatcttatttattccacatttgtataactcctgccttttccccatccttatcttcaatagtttgttgccttcaattatcatcttttttccctcctcatcttttttcccttcctcatctttttttccttttaatgaaagagctaacctcctaatatccctaaagcaattgtttctaaaaattttccttggttattaggggaagacattgtgacacttacaatgaagagtgatgatcagtatcctgtagaagcatctttggcatacttaccattcacttcaattttatagttggctaagaagttcttttttaacttaagccaccttctgaaaatctttctttccacacttgccattcctttgcagcctggattaggcacccttcccataatatcctgtgcatcctcccatcctgccacttagaatcttataatcaaccactatgggcctgttttaccaaccaaccactaataagccattaatctatgagcaactcaagggcaaggatgatatcttattaatttattttattcaaagcacttagcatgaagctgacatatagtaggtcctcaatgaacatttgtggaactgaatcaagttttgcaaaaaactggttgaacattgagggcacaggatgactataaaggaatctgatcgttctcaccaaatcctttctcaggtcccatcattagaaatcttgggtaacattagccctttaggtataattatttttatccctttattttattaataagtcatccctgattaggattttatggattccaccagataacaccaagctgctcgtaaactatcacatttcactgctttgtcaggtttagacttaaagcagaactgaagaacagcaagtgccgatatcaattttctctgaacttcctcctgtggggcggtgagagagggatgtggggcctcctggggtttggaaggaagactgtggagatgcgttttaccctccacagactggcttgttttgcggttggctcaatagcatatcttgggtgtagtagttttaatagcactgcagagagccataaacaagaattatagccatcatggaattaaaaacatgcagtgtagaattaaaattagaaagtgactttttttttaaccttgtccaagaaacacaatagcatactgctgtattcatcagcataatctgcttctgccatctggtggccatgaataatactgacctatcagacaactgccatgctcagcaaatgctgcagtgagcatccctgtaggttctctatttggacagctggaatagccttgcttccaccatgagggagtggataatgaaacacagacaaatgaggctgtggtgacagcagctctgtgcttcttttggaggtgagactgtaaggagagagctggaggaccaagattaaaacctagaaattggctgccttcaagatctgcttgatagcaaaccccccaacaaattttattgaaggcaagggagtgttgtagaacctaagagtcaaaaagcaataacgtatgctgcccacaaggaatccctggtctagtggagagacagacaagtaaccaggtaatttcaatacagtgatagggaggctaagaagaaatgtaccaagtcatttcatagagcttcagggagggttttgtggaggatgtagcatctacatgtatttcaagttatttaggctctgattactttttttcccccttagtaattctttaatgctcagagccagtaatggctttatgtgatgctatcatttatgttcataaatcatggagagagagattcataagcaactataaatagataattatattttatatttcctttcctttcaagttggaggctgcagcataagtttcattggtctaagggaataaggagcaagattccactgcagtttcaggctgtagtggactaatgttctccctacctcagcaccagaaaaaggtattattagggagccattaatctagcctgcctactcccagcctagagcaaagaaagatatatgtttaagattgtgtaggaggggagcgattgaatggaaaattgagttgatgtctcccttccaactactcccctcctttcacttcttcctaaccagtaacacctgtaagtgactcttctgtacggatttaagaatgtaaacacttttccttgtgttacccatttagaaaagcccactgtttgcttgcataatgatggtggcattggaggtgggcactttaacaaggaagacatttatcttaaacagccttcggataaacattgactttggaggcagtttagcaaagactacctacatggttttgaagactttgctctgattgcttatgggagccaacatttgtcagaagaatcccaagcaaagggagatggggaatactatcacatcttctagacacagacactacgttcaggcagcgaggcacacggacagccaagtcagacatggatagaatcagaaagttcaagagtgctcagttcctagtttagggggcagcacattgaatggggcaaagaaaatggagccagcattgggcaggcctgtcagaaacaagtaacaggacctagaaaagcgcatggcagtaaaggcacccaccacagcccattcgaaatacagagaaatgtaatacattctaattttaaaagactagactttaatggaagcataaattcactctcagtcactcagcaaacatgtgatgtaaatactcccaacatgagttatttccaggtaccaacagttgaaaaatggactcacacaaattcctgaatatgtagcaatcagctcccctgagccagtgacagccagctcccgtacccagtgggtgggccgggcagctctgttttgtctgtgcctactttccactccagtactgatggcagcaaatcttccactatgttctcaacttttgttgttgttgttgttgttgcttatgttgttttgaaataagtcacactgaactcagaagtgagccctcttgtacagattatgagatggatccactgaaatgtatgcatccaatttcatattaatagtaagtgaaagttcaattaaaaaccattctgaaaatcttatttggtattcaaattagctaaagtaatgaaaactcacttttttttttttttacagccttttgctaacactcccaaggggaaaagagaaattgaaaatgccaagtgtatttcagtattactgctttttctccttctcagaacaccggagccggagcgatcgccgagagcaaagagcagctgcccccctttccattgcagctcctccactgccagcctaccctccagctcacagccagaggaggcgtgagtttaaggaccgtcactttttaacggtaagtttggtggccacctgcagccctatgcttgctgctgaggaaacatcagtttgtctgggagtcagtttcctgcctcccagtgagagaggctgggctggctaagagctcaaatcatgggcatttgggaacaaattaatttcccttcctttcattcctgaaagaaacgcctcttttttggaatacagacatattttttagttaactggtagcacaatgcagtaaagcaagaataattacagactaaaatcaggaaaaaaaatacatacttcaaacctcggttcttctgcttgcaagctgaaggattcaggataggttacttatgttctttgccctcagttccctcatctgtaatatagggatattaatagtacctggtttatagggctagaggattaaatgagataaggcatgtaaagtgcttagcccaatgactgactgatacagagtaagacctcaagaaatgttaaccacagctgccactactgttattactggtaaagtgacagcatggctgacttggtggggtgaactggtaaagaacttaagtgatacgaaaaattaccatttgaagagtaatcatgtcatcatttcatgctttcccattctccaaaggaggctagttctccagggtaacttaataccatggtgacgtcatcgcctctggggctttcagccctgaccagatggatgtggctgtaactcagcccaagccctcaagcatgggtcacagatgatgaagctgagcccatctcaaaacacctgcaaatactatcagcagccactacaaacacatcaccgcagatgtgccttctggggcctcagtggggacaactgagcactttgtgcctctgagcaggcatcattgaagtgagggactatggcttttgtgaccaaatcagcccacactgcctgtctgaatgtctgcattcctgctgtcttgtcattctggttcaagacccaaagtctaaagaagttacaatagtgtgggtacgagttaaggtttttattagaaattaaaattgcgtgtatgactctaaattgtgcactcttacggcttttacaatatgcaagagagatgcaaaatatttgggtcacatggtgccaaatatccagccaaaaacagactttatctaaatgaacccacatgatataacatccagataagaccttgagtgataatggacaaaatataaaaacatttttcctatttgtagctggactgcaggcaggtccttcagtgctcatcaagtgcacactgagcgccgtgttgcacttactacattgctgcactgcagcccaaggataagaaaaggagacaagggcctcttagggctttctagttcttcagatagagcagtttcacatgctagtgatttgtcataaagcagaagttcttaagcagctcaaatctgcttgctgaggcatttgcttttaatgaggcattttctgcataaaaatgctaaaatattttcccattcattataacatgttttatggctaattaagttggttttcttggaagggggaggtgaaagagaagaattttgagcatttacagaaattacataaaaatataaccctttctcatgatctgcataatttttaataatgtctaaatactaaagtaagactataggaaaaggcttaaaatgacgaatagcaacgagagtacatcatttacttacccaacaaacatcaataagagaagactatggattacacttaggtaaacttcagtaagtttgtccatcccaaatgataatacttagtatttctaagtaattttaactgttttatttgttcaagagtttgggtcactacaaggattagaagattttcatttgagttatatcccttaggcctggatagaacatagttcaagctcacaagactgtatattgctgaaagacaaatggctgcaggtatagagacaggaaatttgtagtcaaattgctggatagacacattttcttagacaactctcctttcatgtttgagatttggtgaaggcatgcttttcttcctttaagaaagcattcataatgagattgacatacagtcttctgcaactctgcaggctattgtactgtaccttggtcattaatggcatggaccatgaagctaaactgcctgactttgaataccagctctaccacttgcgagctgtatgaccctggcaagttagtcatttcagtgtcttggggatagaagtagatagtacctcatagccttggcatgagaattgaacgtggtaatacatgtaaacagtacctcatacataagcactacataaacatcagatgttattattattattagccaatcaattccctgaagtatctataatatggtgataagatcataggtccaaccgtgtttaaatcccagcactacaactttttggatgtgtgacttggaaaaagctattgtatctttctgactcccagtctctttatctgtaaaatggggataatatcaactttacaaggttgttaaggaggctaaatatgatgttttagaaataagattaaactatgtatatgtatttgtgcaagtgcctagcacagtgcctaaaatacctgaatgtgagtctatattcaaaatcgtttacaataaaattcttaccatcaaatgaaaagcctataacatatactcacatataagactagaggaagtataaattgttacactctttctagagggcaaaactctaaatattcataactttgatccagcaattttacatctaggaattcaccccaaggcaataatcagtgtatgcaaagatttattcactagggtgttcatcaaagcactgtttacaatgggaaagttaatcacaaatatcccaaatgtctaacaatagggacttagtttaatgaatactaatataactataggatagaatacaatatcaaaaatagtgttagagaagaatatttaatgacatgggaaaatgtatattttattatcagggatttttacatagtttataaatttgtgtatagtataatctcaaaaaatgtcaacgagtgtatatgtatgtgtacatatacatacgcatagggggaaaaggctggaaggttgtatatctgtgattcccaaactgtgtgctgaggtgccttagggcactgcagtgaactcctaagggtgccgtgggatattttaaaatttcaagggacaaagtgtcatctgtctggtggcatctggtgatggctccaaagtaacctcataactcctacaagtgagaagagaggatgcttggtttcttgacatttaatttgtaccaaaagttctccagggggaactcacaggaaacaggacaagccaatttagcataaaaccctaaaccctttgttagctgaaaattcaaggagtatctctaattaaagcccatctaagagtccttacttatcaagggtggcaaaggaggtcatttcagggaaaagcttccttaaaaaaaaaaaaaaagggggggggtatctattccatcctgctggattttgaaattctatagccagagattagtttaagatcatttatttgggacatgaagttactgtggacctgagctacagagaagagatcgaaacaaacgtcacgaaatcaacacttgcacatagcatctcaaccttttctttaatgcaccacagaaactacagctttaggctggtaaaggatctgaagagttatctgggcctagctaggaaccaaatgtaaaaagtttgtagtaaaaatgttcccaagggcaatatgaaagagaaattgcctgggatcaacttctgtccacatgaactcttggctgcagactgacttgttaagtgtcagaatactgattatttagggaaaggtagggagaggaaagggttcccggagaggtgtgtttgtgtactaaacaaaaacccagttactgaaagtcatttgcctccaggcagaatttctgggtaatttttctaccttgtctaggctgtggtcaaattgagaatggcaaatgtgtatcaaaacaggagcgtttgccagagctgtaacaggtagcctgttccctgcaaatccaaccatgtgttttcactcttggtactaaccattagaagtagtctacacagcctttctttggtaagaaacaatacttttatgtgctcaaaaactattagacttagacttacagtgctgatggctggaaagtagcctgtttgaggcaattgaatacataggttttttggtggatcgaaatatacactgagactcccaggtagctgactataatggtgataccctaggtccccatctcccattatttcctccaaaaatgatatagaacaagaagggaaaaataaaactacacagaaaaacacaccatcagcataacttgaggacagagaattcccaaacatcaaattgactgttaagtaaaagagagaaaacaccaagtctcagcatatttcctcctgttacaaggtgagggagggcagattcagaaagccacatggaagaaatgaactagcagtgggtcctaagattgatctaaaaccaccaccagaaaaattgtctgccctaagtctgaaaaatactacagattttttcagatagacacaaactacaaaaaagggcctaaaagtatgcatattttacaggagcagttttctctatataaagcttctgggggagacaaaagacaaacaggaagggaaatctgcccttcagcaattgggagtgaagaagaaaagaggcaaaaaggaaatttctaggaccctgcaagacaaaataaaaccaaaaaattcaaggacacgcaggagttgtatgtgtccttcaactcctgcctcaccaccaaaacaaacaaatacactaaaatatttgaacttcaacaaactgacagaagatggtgccattaaactagggatcttgtgaaacacaccaaagccacacaaatgagtaagagatagattagcagatccacatagagtgattgcaaaaggtcaatgaaagaatatatgaagcaagggttttatgtccaaccatgctgttcatcaagtatagaaaagcaattttcaacatacaggaacttagagaattttgcacccatgagtcctttatgaggcatctaccacaggacaagcttcatccaaccaagggataattggggaaatgtcagcaaaaggatgggtagcatacattttaatacatgtaaatgtagatctaaaactaaaagtacagtggagatgaagatagaaaactaaggtgcaattttaaatgttgtgacaacagagaatgatacaactaaaaatgagagaagggagaggtaaagaagaaaatagaataagctaattgatcactgtctaggcaataagtggctgttaaaggataccaataagaactagttaaccagatagtaaaggcttgaataataaaacagaggactaaggacattaaaatggtataagaaaaaagaagactactagcaaaaaaaaaaaaaatacaaatcttcctaaataccaaaaaattgttttatataaacagagaagacaacacatcttacagaggaagaaacataacaaatataacaaaatacacataattataacatttatcagagtttagtcatatcaatgaatatgagtgagcttaatttgcctatttaaaaacttttcaatttggctcacaaagcaaatccaactatatgctctatacattaaacacacacaagatttttatttattaattaggtcctgattatttgaaaaaacatgaccaagaaaaagagagagaaaacacaaataaaataagcaatgacaggaaaaaataccactgaaacaaaagaaattttaaaaattataagagactattttgcagacctctgtgcaaataaatttgaaaacctagatgaaatggataatttcctagaagagtaaaaattgccagaattggcgtcattagaattggtaagcttaaacagactgatttccatgggagaaccagaagaagttattaaggagccatgccactaaaaaacatcaggcctagatggtttcccagaggaattctactaaaccttcaaagtccagatgttcccaatgctctataaattgtttacaaacattgaaaatgaagcaaaacttccctattatttcttttatggagcaagtataacattgacacctgaactgataaagacagtcagaccaatatcactcatgattattgattcaaaaatactaaattcaacattagcaaacagaatataacatcatattatattaggagattaatatactgtgaccaatgggatttattctaggaatggaaggttggttcaatattaggaaatctattagtatcatatatcatattaacagatctaggaggggaaaacccatatggttagctccttggatactggctaagccttaaacaaaattcaatatctatttttaattagaaatgcccctaatgtttccatacatatgtatatatgtatgtatatatatctaatgttagagaaaaccccatttacagcaataacaaagaagaccaaatacttaggaattaatttaccagaaatgtgtaaaacttatatgagaaaaactttaaagcactccttaaagacacaacattagactttttcaaatagaaagacatcccctgttcttggatagaatgattcaacactacaaacaaatcagttctctctaagttacttaataagtttaacacaatttcaataaaaataccaataagctttattttatggagttagatacttatgggaaaacaaacatataagactagccaggaaaacactgaaaaaggaaacctagccctaccagacattaagatatagttaaagcctctataattacaatattgtggtattggcacatgaatagacagatatatcagtagaataaaacacaaagtccagaaagagaccagagtatatataaaaacattcaataaaggcaacatcacaaataactgaggcaagagatggagttttttaatgatgctggaacaactgcatagccatttggtgaaaggaaaaatttgatcagtgtttctcaacctcagcactgttgacattttgggccaaacaattttttgttgtggggaccatcttgtgcattgtgcaatgtttgccagcatccttagcccctcccctcacttgtgacaactcaaaatgtctccagacactgcactatgttccctgaggggataaaatcacctctagttaaaaatcatttaatgggatgcatactaccatacacaacagtaaactccaaatggatcagggacctaaacctaaaaaatgaaaccacacaagtactagaagaaaatatgcatgaactattctttgacctcagtccagggaaacactttctaactttggctaaaaatacagaggaaagaaaagaaaaaagaaaagattgatgcatttaaacagtaaacatttttgcatgcccaaacaccgtaaaggaaatcaaaagacaactgaaaaactgggagaagatatgtgcaacagaaaaagggctaatacctctaattgataaatacctcttaaaaactgagggataaagaaaagagcaaaaccttggaagaaaaattgaggaaaagatgtgaacagacaattcagaaaaaaatataggcatgtttcttcaactgaagaaaaattgttcaagctcactctcaattagaaatgcaggccagagcattatgcagcctgtaatcccagcattttgggaggctcaggtgggaggatcacttgagcccaggagtttgagaccagcctgggtaacatggtgaaaccccgtctctacaaaaaaatacaaaaattagctgggcctgatggtgcatgcctgtagtcccagctactcaggaggctgaggtgggaggatcacttgagcttggggaggttgaggctgcagtgagctgtgatcacaccactgcactccagcctgggtgacagaggagactgtctcaaaaaaaaaaaaagaaaagaaaaaaaagaaatgcaaacaacactgaaattccacatattacctatgagactggcaaaaattaaacaatgtaacaatgtattctgttagtgaaactggagaaacaagcactctcatacattgctggtggaaattcaaacgtggtccaacctaactgagggcaatttggcaatatctaaccaaactacatacgcacttaccttttgcttctgcaattctactacagatacacctccagtaatagaaaaaggttatttttttcagcattgctaacaattacaagatgttggaaacaacccaaatacctatacatagaagagtgatggagtaaaagaagcaggaagacctttatgaactgataaggagtgatttctaaggcatactcttaactgaaaaaggcaaagcccaaaaaagtgcctacagtatgctacccttcatgttagaaagaagggtatatagtcatatagcacataataatgtttctgtcaacaacagactgcatatagtctgctgggcccataaaattataatgtcatatttttgctgtaccttttctatgtttacctgtgtttagatatacaaatacttcacattgttttacaattacctactgtattcagtacagtaacatgccacacagatttgtagcctaggagcaataggctctaccatatagcctaggtatgtagtaggctgtaccttctaggtttgtgtaaatacactctaagatgtttgcacaagaaaattgcctgaggacgtatttctcagaatgtatcccagtcataagtgatctataactatataagaaaatatacaagtagccacttatttgcataaaagaaagagtccattctgctgtgacacaacatatgcatccctaaaaatctccacactgtacaaaattgcacaataaaaaacaaagggcttatggagaaaatgggagttaggggcacaacattcaaaaatttcttccaatgacaacacacacagacacacacacacacaaataggaacctaataaaatacaatagcacagttatacacattgtgaatggttaaaaaatacacaaatactgcaataaattggcacttcacccagaaaaagtcctgggggtgcctagggattgggcaacagaagggccacagcttgtgagttactgggaaggactggaaggaaggttacctgaaaccggagggaaggtcataacaccaggtgtgggcaggtgtggctcctaatatgtggagtgaactgaggtggctggtagatatttgatatgtgtgtgtgttatgtactcttatgcagctcagttcagctgtgtgcagttgctgtgttcatctagagagtctcaggttatgctcaaatgtgaatacctaagatatcttaggtattcaagtgatacctaaggtatcaatcacattggaacaatcaatcacattggaacaaatttgaatcaatatcagtcacattgatatcgatcacagtggaacaaacttgaattttcaaaacatgcgttataatgaaattgactgtacaggaaggaaaaaccagaaataaatgagatggatttccctacgggggatgagtgggagtggggtagaaagaatgggaggatgggatggtggtggcaggttcaagggggatggcatttctctgagtatattttttgggttatagctcaggtaatgttttatatatccccccataaataaataattatcatcaaccaggatgtgaggagaaccccaaatggaaaacaaacagcaccaaataaacctaactacattacaaatgaataacaaccaccctgaaagaggtggggaagaaaatagctaacctttaataactttggaaagcagtatttttgtttcattttaaccacaaatatttattgatagattaatgagtataattttaaatggaacagtaaggcataactgtggattaaaacaccttgcttcatgcctgtaatcccagcactttaggaggccaaggcaggcggatcacttgaggtcaggagtttgttcgagaccagcctggccaacacggtgaaaccccatcgctatgaaaaatacaaaattagccaggtgtggtggcaggtgcccattaatcccagctacttaggaggctgaggcaggagaatcgctggaacctgggaagcagaggttgcagtgagccgagattgcaccactgcactccagcctaggtgacagagtgagactgtctcaaaacgaaaacaaaaacatcttgctatacaaccaaaaggggaaagtcatacacttaggaattttaaatatgcaagtcaaagagcctttgaggtaccccacagatgactatcagataattcttcccttttatacaattcctatattacatcacttgatcacaaagttaaaattttactttaaaaggaatccctcattcattcacacttgagtcatcccacctggccactcccctgcttcccaccccttccccatccctttaaggtggtattctttagccattcccttcctgaataattgtgtgggtcaggcacggtggctcatacctgtaatcccaacactttgagaggctgaggctggtggatcacttgagctcaggagtttgagaccagcctgggcaacattgtgagacctctgtctataagaaaaataaaaaaagaaagaaagaaaggaaagaaaagaaaaaatagtcaggcatagtggcgcacacctgtagtcccagctactcgggaggctgaggtggaaggatcacttgagcccaggaggcaaaggctgcagtgagctgagatcctgccactgcactccagcctgggtgatagagcaaaactgtgtctcaaaaacataataaaaagaagaattgtgtgtccgttttccttcttaagcaaggaagcaagcaaacaagtaagcaatgagtcagagaaagtccaccaagggcagatttatgaatgaagagacttacacagacagatgttaggatgacagcaacctgattacttgattcagtgaagtctaaactaagctgactctagcaaagaagctgcactggcttgctcagaggcctatcattccacctcagattggccacaaatgcgagactccatgtttctaagggattaacagtggtctacatgagaagccaggaagccaatataaccaggcagctgatgctacaatacatttgatgctttagatctccattaggagctgactatagcttccagcataatcatttgccacatgtaaaatccttcaagatactgaggacaatctttaaatctcagataggatcaattaggaatttccttaacagtaatctatttgaaaatgtgaagtggaaagcattccagtgcacataacattgaggcataaaccatgctgcagaggtgtgaatgcaggaggctcaatagagtgcccagcctccttgttcaaaaagccatgagaaagcccccaggcatattgtcagagcagccattgtggtggcaatggtgtccccaaactaagcaaatcagcaggcatatggctattttctgaagaaccaacactgcactaacaagagtagccatgtagatatgtgtgtggagaatcacaggccagagagagagaatgacctgggcaagccacctagaacacttggttgtacacctcgtgcctttcaagaagagcatctccactaggtgcagtggcacgtgcctgcagtcccagctacttgggaggctgatgcaggaggatcgcttgagcccaggagttggaggctgcagtgagccatgatggcaccattgcactccagcctgggtgacagagtgagactctatctctaaaaaaaatttaaaaattaaaaaaaaatttttttttgagatggagtctcactctgtcacccaggctggatggagtgcagtggtgcgatctcaacttactgcaagctctgcctcccgggttcatgccattctcctgcctcagcctcccgagtagctgggattacagttacgcgccaccacgcctggctaattttttgtatttttagtagatggggtttcaccattttaaccaggctggtctcaatctcctgacctcgtgatccacccgcctcagcctcccaaaatgctgggattacaggcgtgagccgccacgcccggccaaaattttttaaaagaaaagcatctccatcaagcagacctttgatgactgactgggcagaatggaggggactaagagatggtcacattcttctgagagaagtgttggttcctgaaaagctcccagagagacaacatcccagaggcccatttatgagtgaacgtaaataaaaacttccagaccacagaactttcttgccaagtcagaaatatattcaataggcacagcttggggtgccacgtggaacagagggaatttggggggttaataaaaatcagggaggctaaaagaccaagtgcagttgctgcattcacacccctgttgggtgacagaagcaggaagcaaaggacatatggacaagattgaaggagcatgcggaagcctacagtctagtccagtgaaagagcttggcctggttccccctctcactttctcagactggatggatatgtggcgtcagcagcagaagagtggagataacatttagaaatggagaaccagtgaattcaggctgaagagaaatagactgggtgtactattctgtaatgccctgtttgcatcaaaggcaggcttgtgttgaccgagcacatctggagtcgtcatgcatcaatagtagcattttgggagacggggcatgatggggtagaggtggggctgttggacaggaggactctcaagttccagttgttaaatactaaagagcatggaacagtttagtctcagttcttcagtcaagaaatcagatgttcattttctgttctatgtccaccttctccaaaaacttaaaacatcctgtgaaagatattgcatcatccccatcccagttagcctcctggatggttctgtctgtgatgatgcccagtcgctcatctgagttattccctctgaccattatgcatagctcctgtaacagctcactgcaggagatgttgtctaacatctatccaaatcatataattaaaaaccaaagtgaagtttgctgcttcagctgtcaagtggttctggtccattcacatctttgctcctttcgtaatcatcaatgggtcagaaatgagccaaggttcttatgaatccacagaagttcagctggtcctccccatcttaaccaagtgaccaaagttaatatcaccagtaagagaacacacctgtacatggacctcctgatgtgatgcattgagataacacttctgtgagagacccttgtcaaaaaatatgttgcctcaatctaatcatgagaaaacatctgacaaaccccaattgaaggacattctataaaataattgaccagtactctttgaaaatgttaaggtcatgaaaaacaaagactcacgcctgtaatcccaacactttgggaggctgaagtgggaagattggctgagctcaggaatttgagaccagcctgggcaacatagcaagacctcactctacaaaaaaaaatttttttaattagccaggtgtggtggtgcatgcctgcggtcccacctacttaggaggtggaggtgggaggattgcttcagactgggaggtcgaggctacagtgagccatgattgcaccactgcacttccgcctggatgacagggcaagactgtctcaaaaacaaaacaaaacaaacaaaacaaattgaaggggattgaggaaatttgacaactgaatgcaatgtgcaatcctggattggatcctggttgaggaaaaaggcatcaatgggaaaactgacaaaatttaaataaggtcaatagattagttaatagtatttatcaatgctaatgacctggtttcaacagatatactatggctatgtaagcttttccattaggaaaagatgggtaatgagtaatgggaacactgtgctatttttacaacttttctttaagtctaaattatttcaaaatagaaacacacacacacacacacacacacacacacacacagttggcgccatggacatttcacagtttctgggttggcacttacaccgctagtgcttctgatggatatatgacttcaggtgaaggtgagttcacgcaagaaatgcttagtgcagagcttctttagtttatataacaaaatctagaagatcacagagaatctgatataaggtgattaaaagctgtcacggtattgagcactttggctccacgcacactgtcatagcatagattcccatttcagactatggagtcagttagccatagcagttcaccctcacccgctgctgaatggaatgttcagctcattggttctcatcagtcatgtctctcagtccaggcctggatctgcaaatacttgggacatgcacttgctcttctctttcgcaagcctaaggcagacattcctattcaattacagcactgttttccactgagtccacacagccactactcaccagggttagcacttgagttgaaacatctcctttttctgctttcaccctgcagtagagtccatgaggacccttgaagcccaagtccttgcttagattctgatatctggacagataggcaaggaggtcacccttccttaaatgtagtgggatgccagcagtctcaacaagttttcctctccaagcctcatcagaatgatcgaggggtgggatatctgatggtctctatggcagtggatgaagatacttggtatgagacggagcccctatggcaaaagttgatttggttccagaggaacactaagacctaaatcctcatcatcaggatcaacagtgaattcatttcaacatattgcctttacagttgtattgtttgccagacttgataaaattagccaggagcaaaatatcagggattctttgtcatttcacagcctgataatccagggattttaaaataaaagactgatgtcaaaacaaacctttctttttaccaaggatgtgtctttgaagggcaggggacattccaactgccttattgggaaagaaatgaaggaagtcactcaaactaggacccagaccatcttagtcttagtcatagttcagagctataaacaatgaccatgtttactctcccattttctatcaggaagaaaaaaacgggtcttatgagaaagcagcttctgagaaaaatcaaagtaacttacagaggagctagccaggagagaagatcaaagactagagctggcaggaagggtgtttcaatagtacttgaccaagagtacaagagtactataaagaccttctcactgccttgttttctttcccatccccagccccgtcttctcttgttcatcctcttccatccttccctttctctgtgggttcatttaagattttcagttttccattggtttacaatagagttgggattgagaaacgctgatcaagcctcgcctttgctatacaagagttagacatatccagacttgtcctagacaagtctattttacctttataaattgtcttcatagttttacaagctctctcagacgtattctgttgttttattaacttctgtctaaaatagttctgtccatccaaattaagtctttcttgctttggcttaggtgttctctgtatctcagataatttgctcctttaaaccagttaaggaaaatactaaccttgctatgcgaatctctgacatacaaattattctgtgatcccaaaccttcagctcctccattctgcccaaagaaataagttcaaatccttagcccaactctccagactttctacaattgggtcctaacttacctttcgagatagatttcccacaaatcctttgcacggaccatagacctcagccaacccaaactacacatgcttctccagaaaacctcctgtactctcgaaacaatatctccacttgaaatgccctttctcccattgtcttctcattgactccttcattttgaaaaaaattaactgaatgcctactattaataagtactagaaggatacaaacacgaatgagacataatctgtttcatccagagtacatggagactagaggcaattctattgtattgacttgaaggtgtgaatacctaactggtgtatggtgttggaatggggtggggtggcaggattaaacttcatgggaaacatagtatttgagaaggccttggaggatggggtagaattttgatatgaacactgggaggaaaaggattatagactgaggaaactatgagaggcaggagatggagtgtatacacatgagttcaaatactttgctttggctggtaagaaaaggggtgtgtcaatagagggcactggctataatgcttcagtaggccagatattgaaggatcttgaatgccagactagaaagtttgaatttatgccataagcctagcaaattattgaagggttttgggcacaaaaataacagtgacctgaaggagctatgctttatgacaatatcagggtatgtgtgtataggattaatttcctcaatctctagagattgctttttggtttagtagagagaggagcgtttgatgttagtgtcaggtataagattgcagaagtggtgatgcctatatacctcccatttaactcacctgtttggtctttggagaagagagatggatcttggagactggctataaatagctggtgactttagttgtatctgctgttcacatgtggtatttttcttgaagtaaatcagcacaacacctggcctatggaatgatacagctattgaccacaataaattcttttcccctctatacccattttcaaggctcaccagaagcagtttgcttttgagatcatgtcagctctcctctctgccataacataagctgcagagatcattgtcatcttgacaccccacatcacgctggttcatattgtcctgattggactcagaacaggaagcagcaaggaccttagataccttagtcaagagcaagccagagggtaaaagcctggttccatgtgctttatcagtcaggctccagtcaggaaaacagaaaccaagccagctattttcacaaagggaatttaacataggtacattattattacaagactgacagggcaaatgggaaactgaggtgacactgagatagtaacagcagcaagaagctaacattcccagggctggaggaatggaaggaaggggttggagttattggagcagcctgcggtactagaactcagacctctggagagtaaccgtggcctggctggtgctggtgcctcaggagctctggagctcagaagcttctgaggaactgggacccagacctccgagtatggggtgctgcctgccaggtgctaatgcatcagaagctccaaagaaggaccacacacagctggaatctagaaaggggtactggacggctgggtctgactagcatctctgacaggggccataatgaggctggttctgggagtgaggaaacagatgagggctgaaaccaattgccatagctgggggcaaaggaccactgctgggacaatgctaacagaaacagtgagtgccaagaagtaagtcccttcttcctcttccagccttctaatctccctcttgcgctcccactggaagaacctaacagggaggagctggcaagaaagaaatgtttgcaaagtcccagcagggcacagaataggttcagaactgagaaacaatagcttaatagccagcacaatagctaatgaaaacattagccaatgagtctggttcatattaaatactgtgagaaatagagaaaactccttagttttggaattctttctttctcttttaaatattggcctggctgtggaactgtcaataaaagtacttgtgtatacacatcattacagaatattctcaggttgacattctgttgcatgcctgagacttttttcactgttcaaaatataggcagacaatggaacaccactcacaataaaaaggaatgaattattgataaacacaacaacttggatggattgcaaaggcattattctgggtgaaagaaaccagtctcaaatggttacctagtgtataattccattcatataacattttcaaaaagacaaaaccatagagatggagaacagattagtggctgacaggggtaggggttgggggaggttgtgactataacagaataccacaggggagttttgggggagtaatagaacagttctatgtcctgattgtggtcatggttacaagagtctatacatgtgctaacattaatagatctgtactcaaaacaaataaaaaggggaaaacagtaaaggcagaatgtgcatggtttgtgtgtgaggtcttacattttttgctttttaaaaatttgcagtgatgaggtcaattatggctctgctgagctttagccacagctggcctgagttagcagtgcaaaggttcccttggagtgggcctgagtgtgtgacatttctgcagttaccacacgcctctgacttccccagctgagggccatggaggagtgctgctgtcacttctgggctgttctgttgactcacatttccagcttctctgatatgggtgagggtatttgcactgtttgtagcagttcaaagattctttcttccctgcacttcaaagcctggcctgccttttccttactcatgtcttttatttggttctagcaacctttgagggttgatggaactgagtggcccttggcagtggctccactaattggcaaagctgaccacaggggatgaataagatactggcatcaacatcacagtgatcatggtccagtgggccctgttttgtgttcttgacagtacagagcaattcctgggaataaatgactgtgctgaccagccagcaggaagcattctccatcctgggctccctatagccctcttttccattcatgtggggactattttccacaaatgttccaaaacataattggttatgctttgcacatttaaaatgcttcattaataggatgtgattaaacaaagtgttcttgaactttaaaatatataaaattattttgcattccattaccctaagaatttttgttccattccagctgagatcaaaaggagagagagagatgctttgcagtcacacattctctttcagaaagcctctttttgggtgaaaactgcaccattgtcatcgccattcaagctttgctcactagggacagttgtcacaccccaaacatctaccaacaggataggatttaaaagtgaatgagcatgtactcttttggtgtcttggctgcttatgctacatatacttttttgagattgatgttattgtgtagttttccattgtatgaatataagattgcacaatctgtttatccattctgctgttgggagatagtcaggttgtttctagttgtggggtattgtttgtttgttgacttttatgaataaagctgctataaactttataagtattttataagtatttttgtgcaagttttttgtggacatattcatttttcttaagtctatatacctgagatggaattaaagggtatacatatgtttaagattagatactgccaaatagtctccaaagctacaccattttacactcccaccagcatttatgagcattccagtcactctacatctttatcaacattaagtgttattaatctttttcatcttagcccctctagtccacagtgtggtttccttttgaattttcctgacgagtaatgatgtcaagcaccttaatatatgcttattggccttttgtgtgtgtgtatatatatatatatatatatatatatatatatatatacacacacacacacacacacatatatatatgtaaggtcttattcttgttttcaaatgtaacacatttgtatacacacacacacacacacacacacacacacacatatatatatatatatatattgcaaagtgcccctcaggagaatcaagaaagtggtgatagctatatctctcagggaaaggaagtaaaggtatgatttggaaaagcagacttatcaataagaggatattccccaggcctgaataacaatgcttttttgtgttttaaataaatattaatgtatatggtggttaaagaaataactcagtaggcacctgttcccaaatatccctctccacaaccattacccagaacttcgccacggtgattggaataaatcactgtggattgggtttttcatgatttgttgtcagcaccctaataagggtgcattttgggcttctttctaaccttgaagctggctgaaaggttagcgtgaagggtttaggcacttggggttaaggatggcatgccaggtgggagtgctgcattcaggtactttgggtaagcatgaaggctctgactgctgaggagagagtggtgacaaaggtcaaacccagaaagggaagaagccttaaaacagagaaagcataggatgtgccttaaacttctgcctacctcttcattgtgtttacccatgattgttcaccttgatgaatgtcggagttgaggagaggggaagagggaagcacagggtgaatgtagaatgatgttactaaacatgttgggaagacaagagcacaatgccaacctttgggagattttgagacagtctcaagggaataaaaaagtactacataattgtagcaacaagaatgacatgtgaagaaggcattgtcaggcttcttgaagcctttgagaaagatcaaaggagttcatatttatatatgatacatccacaaacactcctgcacaggaaaagctgaggccaataggacacagtatgtgcacaaatgcaaggatttggtttaaggacaaacgagccccatggtagagtgaaaataaaagcccatatcacctcactagaaacccagtgtggtttgcaatggacatctttgctgtaaggtcttattcttgttttcaaatgtaacacagcatccagcctccagtaaatatttttcatgtttaagacagcatgatagcaataaatcagctctgaaagtcaactgctataagtgccatgtggtatcagttagatcacaaaccaaagccaatttttcaaaacatttcctgctggaatacccacaacattttaacagatgtattttgggctgtttcgaaagaaaataagcccccatcagcatataaaatataactcaaaagaaagtaaaatatggagtggagggattattttttcttttggtagtaagagaaagattggggatcatcttgaaacccttggggaagtgcttgttcatagccacgaaaggggagaaattaacttttctcacacacatacctcaagaaagactggagtttgaaaaatcttccttcattatataccaaagacatttatttggctgcttttgagcataatgtttgttatttcttattctgaacactggtcataagtataattctggcttttgttgaagcaactcatgggaagctagggaaaggatttgaggatatgactgatgaggccagcagggacagagatgaagtgaaggcatcaaaagaatcatcttttgtcagggacaagatgggcatggctggtagttgctgattataaaatgctgcaagttggagtctgaagcttttcaaaatcagtggtagaagggccagaataggagtctggaaaaggaggaggaaattactcttttttttttttttgtatttttcttcaacagtatattatgaaaaatctcaaaggtacagagaagttgaaagacttgtacagtgaatatgcatatatatacccatgagggagaaattatttttaaactgacggtttgtttccactggggccaattttgatccacatcaaataaatgatcttgaatgaatgaatgaatgcctaacacacctcctaccacacttattctggggaaaccaaagttgttcactgccactcttgtactgagtgatgattccacaatcaggagtcccctgtggatctgcttccattatctgttgttttggatgcttcctgctcatgctgtcttatctcctcctgtgctttgctgtctttgaccttgtactggatgttgtactgaaaaattatatgtgggtggcaataatttgatgttatttctctagaagagaatttttgtttgcttatgccaggcacgtgagcatgttagctgtacaacacatatttattgagcgctattgaggcagtaaaaatagagttatgaacaagaaatggttagtctttctctgaataagcaacgagattcatttaaacagttgtggaagaataatttagttcatataagtttgatcagcatccagctttccctaaccttatccatcagcacccattaaggcgtggcaggctgagccatgcagagatgccctgaggtagcagttctcttgcagttgtatttcttagataatttagaaaaaatatatactgtgaactgattattgcattcattatataaaagtgtaatcagaaatactcagaacaatcttacttcttttgactaaacatccaggaaagaggatgctttattttatttttaaggtttttaaaaaaatatttcaatggtttttagatacaggtggtttttgattacatgagtgagttctttagtggtgaattctgaaattttagtgcacccattcacccaagcagtgtacactgttacccaatatatagtctttcatccctgaccttgctcccaaagtcccctgccccaagtccccaaactccattatatcactctgtatgtttttgcatcttcatagcttagctcccacttataaattagaacatatggtgtttggttttccattcctgagttacttcacttagaataatggcctccagttccatccaagttgctgcaaaggacattatttcattccgtttaatggctgagtagtattccatggtgtatatttaacacattttctttatccaatcgttggttgatgagcatttaggttggttccatatttttgcaattgcaaattgtgctgctataagcatgcatgtgcaagtgtctttttcatacatgacttcgtttcctttggatagatacctggtagtgggattgctagatcaaatgatagttctacttttagttgttttcaaattttatttaacttttattttaagttcagggttacatgtgcaggtttgttatatgggtaaacttgtgtcatgggggtttgttgtacagattattttgtcacccaggtatgaagtctagtacccattagttatttttcctaatcttctccctcttcccccctctaccctcccatagaacccagtgtgtgttgttcccctctatgcggagggccctctaaaatactagactaaggcagttactaattaatggcagaaatataactgtatatttatatacttatagctcattttaatattataaacttaaatactctgaatctgcagaccatctgcagggactctagagcttgtgtctaagtggaggaaccaaagaacacaatccctccacatccaagctccagagtacctagtttcaaccctcacaagctggaggttggagctactatcaatatagtggagagaccaattagctgaggaggaatctgctatggagtgtaacccaaggagaccttaactctccatcacaatgaccacaactgaaaagtctgtgctttctctgaacttgccatccttagtcattgtcaggtgtgacctcatgcttatttaatggggtgggtgggtttctcaaacagatgaaaaatgaagtccactcctcacccctcactactggaaaaaatattcaacaggagagctgacttaggagatttaagacaaactaccataatttatgtattaacattaatatcattctgcagtttctgacggtgtgattttttgaaaatactttcatgagacaccaaagcttttggtttctttgaagtaggttcctttcccatgtaggctttgctatcaggctaccttttttcctacttaacatgagttttctctctcatttacacaccctggtttcttacttgagacttccacatcattgtctgtggctgatttttaggagagaaccaggttagtgtctgaactcggaccacatatatcacatctgtcaaaatggtcactttcagcaagggagccatagaccctacaaaatcattagtcttaaataagatctagatcaaaattaactgggcccgaggaggagacatttgctttgcttaaacattaatgagcaactctttcagttaaaacttagaaaaatagaacagaattagacaccaagctttccccacaaaaacgcatgtctgccataggcttaagaataactaggcccagcatccatccttgcttccatcagaggaagcaaggatcactggcagtttcctctacttgtttccacctgtttgcatgaagatggtaagtcccttggattctgaggaatttacttcctcctgagatcttgagcattccccttactctttttttttttttttttccctccgagacagagtcttgctctgtcacccaggctggagtgcagtggtgcaatctcggctcactgcaacctctgcctcccaggttcaagcaattctcctgcctcagcctcccgagtagctgggattacaggcatgcgccaccacgcctggctaattttgtatttttagtagagataaggttccaccatattggccaggctagtctcgaactcctgacctcaagtgatccgcctgccttgggctcccaaagtgctggaattacaggcatgggccactgtgcctggctgccccttactttctttggggttcccatcactgctaaaacacacagagacaatatcattcaggtgcacaaatattttgatgagttcttacagtgatgcatcatggaagactgaaaggcaaatcaaatgtggcctctgacctccaggaatttgcaatctaacaaatgaaatagacacatccagggccaattcctgttccattaaagccatgctgtaggataagtgctataatagaggcccagctgaatctaaagctgatatggcttagagttttaaaagtttcagtggccttctcagtagatcctgaagaggggattctggttaccagattattctccagataggactggctatataatttctggggtccagtgaaaagtgaaaatgaagaatcctttattcaagaatttcaaaacagtgacagcacaacctgaaaccaagtatgggggccttctgagtgcagggccctatgggactgctacacagatcacacactcatgaaattggccctgtctccaaatgtggtctatgaataggagaaagaagtaaattttgagcagtctagagaaggaaattacacatagagaattttcttccaagtagttcacaaataaataaataaataaaatcactccaacgaaagcaaataattcaatcttctccaaattagcaagtggtgttggaatctaaaacataacaaagttacagtttgcaaagacattttcacagatatttcacagctacaaggtaagtacattaataataataattgttgtagtagtagctggcactaatgtacagcatttattaagtgccacgattcttctaagtctattacatatactttactcatttaatcctcaaaacagccctggagggaaaattctattatttctctatcttactacagatgaggaaactgaccttggggaggttgaggaattgcccctggccacacagaaaataagtggtggaggcaggatttgaattcagacagtctagcttcagagtctgtgctcttaaccactatttatgctacctctgaaaaaataaagataggaaggaaaggaaggagggagggagggtggtgggagggaggaaaggaagaaaggaagagagggaagaagaaggaaggaagggaaggaaaaaggaaggagagaaggaagaaaggaaggaaggagagaaggaagaaaggaaagaaggagagaaggaagaaaggaaggaagggagggaaggaaaaaggaagaagggaaggaagggagggaaggaaaaaaggaaggagggaaggaagaaaggaaggaaggagggaaagaagaaacggagggaggaaagaaagaaggaaggaagaaattaggaaggagggaaggaaaaaaggaaggaagaaggaaggaagggaagtaggaaaggaagaaggaaagcaaaaaggaagaaggaagggagggaggcaaggagggagagagggaaggaagaaggaaggaaagagggagggaagaaggaagaaaggaaagaaggaaggaaggagggaaagaaggaaggaagggggaaggagggaaggtaggaagggaaagaagaaaggaaggagggaaggaagaaaggaaggtaggaaagaaggaaggaggaagtaaggaaggaaagaaggaagaggaaaggaaggaagaaaggaaggaaagaggaaggaaggaagaaggagggaaggaaggagggaaggaagaaaggatggagggaaggaagaaggaatggaagaagaaaggaaggaagaaaaaaggaaagaaggagggagggaaggaaggaagggaaggaagaagggaggaaggaaggagggaagaaaaggaaagagggaaggaaggaaagaaggaagaaataaggagaagaaaggaaggaataataaggagaaggaaggaataatgagaaggaaggaggaagggaaagaaggaatgaaggaggaaggagggaaggaaggaaggaaggaagttatcccagtatattattttattaatatcatagatttggcctaaccagtatacactgtgttgtgtgcacgtttttaattttttctttttttgcatttcatgttcatagtttaacagcacccgttcgccctcccccactgaatgttgccacatgaccccgtggagtagaaaggtattggttctgagaacattccttcacggccctatcccactctgtccagacactcttccttttttccctcttttaactttatggaaaactttcttgtttctaactaacggtttttctttaaaatcaatttaaaaagtggtattttcctaacttgaattaaatagaatataacttagacagtcatgccatttgcctttttcccccattcactgccccccactctgcaaactgcatcacctaacactactcttggactttgtagtctggcagaggaaccttttcctatatttaatttatcagaactgtaaatgttcagcttctcaaatcaaaaaggagaacaagacaaaaggattctctggcagccaatcgtcctgtcaccattaaataaaaagtgcttttggctgctggtcagagcttgtagtcaggtcactatcctgtcgacactttgcagtccattgttattcaaggaaggaatcgcctacaaaatgaagcctctggtggtggggggtttctctttattgctcattctctctctttgtctccctctttctctctctctctctcaatcagtttctctctctctctctctctgtatgcaccaaactttttttctttttggaagttacctaggaaacaaagtcttttgttctcgaactttatttgagctattcgcttcgctgggaatctgcacaaaagctgaagagagaaagaaggttgcaatattttactaaaacgttcatgacgaacatatttttcccaaggggggagtcatatcctgttgggtgtgttggggggatttgcagaaacctctgacaaggtaagtaaatgctgggggtgagtttagacaagtggcattggaatcagctctttaaggggacttgagaacagttcatttgacaataggtgaaatcctctgagtcaacagggcatgatatttccaaatgtaaagatgggaaaattttttttgatgatcctaattttagggcagaatattattaaagtcttactgggataacagcaaaagatatttattttatacagatacccaccttcctccaaattgtgtaaaaaataaataaaactaggttgagtggtgaaaactgagtcttttaatcatctagtttagaaacccaaccctgaaatcaaaactgggatggagctttttaaataatctgggctaggagcccaaccctgaaataaaagttagacaatattgatatttatcaaaagtttggatggagaattttccaatgtcatgtagaaatcaaagcccctaactatacagctggaggaaaagtctcgcaccacaaagctgaaaagaaagtaaactaggactctttcacctttcctaatttgaaaaataaactcactggaatatttccccccagtaacagcatgtgtattttccgctatcgttggtagggggaaattcttcacttttgcttttccatgtgcatacaagtgttcatgaaactgaatttttaaaatgttattaaaaaatgccgtagtcctggagtgaaattaactcctcatgttttaatgtggcttctcagattaggttggcttgtccttcaggtgatgggttctggaatgtctcctgactccaggttttctgaaccttttcataggtgtctaactcatcttcttcctttgatcctagtcatctagagatctcaaaacttttgatagaaatttatggtgagatagcttgaaagtggatctgtctttcattggagtaaagactcaattttctttggtgtaaagtttggggatttctggctaccttgtctctcctgttaattccatttaacctgagaagcatgtttatttagcccatttctttccttttgtgttgcttgactattgaaataatacttgtaattagttgtgcttactaactatttctaggaattcttcctttgtcctaagggcctatttctgacctcattttttcttctctaaactaggaaattccttatatgtgtgcttatgtataaactatgatggctgaacctgattgtactttgtttgcagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggtatcgttctggttttttcttaggggcagtcgggtcagaatattctgtgtattaaatatgttcaaaatctgtgctgctaagaataccattttgtaaacaagtaatgcctttttgtcatcaaaatacaaacccagaggatgttcgatatgcttttgtcaggttttgaacatcaatttacatgttttccgcgggccacttgttatgtaaattatggacagtttctttttgaaaaaaatcaccaaatagctctttggccatagctgactgaaataatggagaaagcggcagtgattaatcatatgataatgatgtgtggcactgcaagaaagaaaacagcaaacccaggcttctcaaactgcaagtaatggtcctgtaggccaactagaaaatctgttttcatgcttccttggatgaaggtaggctttttaaaaaagactgttaagacttctgtattgatttgggggatttttgacctaaaaatatatggatacagagatgaaggctgaattctattttaaaaccagcaaggctgtcttcctttcactctctttttttctcctcctgtgtactgagagtgtgaatattagtctagatagaatggaagcatagccagacctttctgaaaaatttattggcagcagttataaattccacaattggatctagtaatcttagtcgtaagtaaaataatgttataaaatattctaactttcaaagacataaatggtctatccattgggctttcttacatctctaatagttacattttaacttatttgtatattgaaaatttcaaaacagccatgttatgactgattttcatattggtaccatgtgactaaagattgcatgtcacttgagatgcatgttgcacacagctatcattaaccccactcagatttctctcaaataaagtggggaagcaaatggaccagatatctgggacagatattatttttttcctgagaaaaaaggagtcctagttcatgggtctgtggtgagttgggagttaattttcctgatgacctattcaacttgtaagataaattattctaaagatgtgcccctatctgatctccacaatctaaatgggatgtattaggggagttcagctgccaaaatggatcattttggcaccctcttaagctaattttcatttctggaaacctctgattattagcagcacgtgcttttttcatggcactgtaagtaaaatctcattttcaaatttagtgctatgattatgggccattattttatgattgagggaaagggacactttttccttctgctttatttcaggaactctctgattaaaacttagatcagatgttgatttcaagagctttaatgagaacattgttaatgatgtccacataacacaaaatgtctgcgtctatatataatgcattctataattactaagatcagaatgaaggattttaattttgggttggaactaagaaaaattccattagtaagaattctccaataatattgtaattattcatcatatgatatctcatacagatttttcaaagtgagttctagaaactgttggcactgtgacgttaaacagaactcaactctttcattatacagctgaaccaagacttgacacaccacccagccccatgcttaacaatcaggataaatgatgaggtgaccaaattccaaagcacggcattgtgactttctgaggcaaagctcactttgaaaaatccatggtgcagacaagagtttgagttcctcacctcccctctcatcattctagttgtgatgggactgcatgtaatgttgataatgtgattatggagagagaaactaacaagcaccatggtttgccctctgtgtttacaaaaacaaacctatgggataaagactggcaattccagctttacagttggtatagaaggtggatccatttaagtgcagaactggggactgccttgtatgtttattttatattgaaaagacatctcatgctaaaccagaaagcattcagtttagtaaatagaagaaagtagacagagttgggtgatgatttaaaaaaacaaatccttagactgttgagtttcctcacagcaaaagaggtgtgtgtgtgtgtgtgtgtgtgtgtgtgtgtgtgtgtgtgtgtgcgcgcgcgtgcgcgcatggggaatgcaagaaggtttggaccataagagatggagggaacaaaacctcacaaagacggcttttaatgaagaaatgggtcaggatatgttagctgagctaattcaggttatcatcctggctgctgatttactatgcaaaggtatcagcttcagagagcccagaaatagatcagtaaatagtagtaactaaaggttataaatccttaaggagccatttctatgtgagagggattttttggatgtctttttctcttctctttcttttgatttttcttctttgcttgtttttgttggcagtgcaaactgttgtggagagctgcatttagaagtaaagcttaatgtactgcagcataatttaaataagagctgaataacagctcccttatatttgttcacaggcttaacccaaactctttccttacttcccgtcaaaaatatcactgtgttccaagtaaatgaaaatttgtttgccatttctaaagctaatgagacctatttgtgggttgcaggagttggctttgacagagaggctagtatacgctgctctctggttcattcacaatcggtactacagcggagacgaaaattgaggaggaggaaaaccatctcgggtatccccagaagagttcaacaagaaataggtgtgatatcaaaaaatgttaatggttaacattcctccgcctagtacagatgatagggagatgaaatagaaaaatgattaaacattttaacttgtagaggttttaaaatggtgtctatttgttttgtattcagcaagccaggtggtattactttttaactctttattcttgactgtgaagatttgaccttatagatttaggcatatacattcaggtcttacggctgaaatgtaatacttagctgatttttgaaagttttattaaggtagaaattgtgaataaaaagtagcaggagtcaatgaaagttttctttttggaaaattgtaacttaatttaagagagatatactttcatgtcattaattattttaaaaggtaaattccaggcatatgcaatgaaatattgaatattgataatatgatacctttggtgacaatgtttctgtttagtggatttaaaatatctctgcctatgatttttaaaaaattattagggtatcatctcttgcaaataagatttttatttctaataatgagacctatgatttttatttcatcatgtttatattacaaaataaaaatgaagagtagtggccaaaaagataaaatgtactttagtttttaaaagtagtcacttattgtggcaaattaacgtgatagtgaagagagggataattcacaaaagacataaaagcatatcttctcttggtatgtatatatacatatatgagggggacgtgtatatacaccctaaagcattttaactctcacctaattctatatattgattttttttctgttaaagaaaaaaaaaaacagctctaacctgccagcccacagatctacagacatagctcagaatgtctgttggtctgctgatatagaaaatatctcactgtgctttccatgtgccctagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaaggtcagtcactgataactttgtcataaaggaaatgtgtctcatggcacttcctggaattttttcttatgttcccaataatacggtacagccctgggtgttggtttccctccactatttctttgcacttattaaaacaattgagataaaagcttttgttactgggtgagtaagctttgacaggtatctctctcatttttaaaaaatggcagcaaggtaatttctgtttgtttgtttgtttgtttgtttgttccctgagtcagtgaagtacagtagcgtgctgggtaacttcctcttaaagattcttctgttcttattttaagaatcatcaccgagtgatgactccatcatttcaccacttagtgaagactcccaagctgaagcagagggtgtgttcgtgtctccaaacaaacctcgaacaactgaggatttatttgcagtcattcacaggtgaggcaacattaccaagtcccccaaaacaaaaggtacaacaaaggttttgccccttcaggtacttctcacaaatgcaaatacaggaaagctttttgtaattgtaatacattcagcaaaaacaaaagcaagcaaagaataatttttccaaatcaagttgatagactgatatgcaagttgggaaataggatctttatatagagtttgatagacctcgattgagagacttttgtaagagtggctttatttttccccaggaaaagacattctggaacaagtttttatgtgaaaacaatctgtggttaagtgacttggagtgaaagctcaaactctagtgtaatctctgacttttgaatactttcttgaacctaaaaaatatgatcaaagctgtagtcatacaccagcagagacaaacagaagttgattcaccatggatgcaccaaaatctcagaaatcaccactaaagaacttattcatgtaaccaaataccacctcttcccccaaaacttattgaaataaaaaataaaaaactcacattgtaccctataactatatacaattatttgtcagcttaaaataaaataaaacttagagaacacacacacacacaaagttgatcacaaaacagtctcaagtttgagaaaagacaatacgtgttcctgtccattttatagctcagaacaagtaataatttctctgtttttctttcttcttagaacttaaatttctttaatagtactggccttcatccccaaaattaatgcccatattccatgaatacaggtcttttgggttgcttttccaggacagtgttgtgtccatgctgcaaaggcatatttcctcatctgcccccatgagcccttgtgatccatggtccatatttgcaaaaattattccttatagctaatgaccaaagaacagaacaggaactagcccttggacacctaatctacatataactgagctagccaatcatgatttgccatgcctcctcctttcacaaacacaactgtcttcttagacctcgggaacctagatggaactcccaagagatacaacttggggattgtcttttctacctcataaagttatcatttttgaaacaaattcatcgtaagcagcttacaatctttttctcctggaattctactttttataggaatttctgttttctgttgatgtggttctctcataaagaaggagtactgctgttcaacaattgttttaaaaggagccaatcagaaacaccttctatgtataccttagcaggcatacttctctactcagagggtgaagaaccattagtttcttttccttcacccctgtgcctagtctaagctctgattatatttccctcacccccacagtttatcttcaatcccaggaaaaattactaaactgctatgtaagttaaaaagttactcccaaaggaccaaatgctagtgtatggaatagtggacaggacgtaaatagtggggtcagaaagacctggatttgaatcccaactctgccacttcctatgcagtcttgagtaagttaaaacctctggacctactcccttattgcacatgggaatgcctatagctcacgtatttgattttgatgataacattttttgtgtttagaatatggtaggtgctaaaagccattgttagtttgaaagccctaacttagtggagtgccagacactgccatatacaagatatcaaccacagaggtttctgtgaaccaaaatcaagcatatctacacttgtgaagttcacattttctctaccatatgaatctttaagttgatgaaagtgcatgctgcctatcaatgaactgagtcatactgaagatccaccaaatttatgcctgctgatttaccaaagaaaatcaataatatgatgatgggagtcaaggttcaatagatgtattgagtttggtaatcttagacttgcatttgtgcagggtttacttatttatctatttacttgtttatttacatcacagcaaaaagaattattttgttttcttgcgagcttacagtatacaaagctttaagagctccagagatggtctgggatttcaattccccacagagagctggcttactgcttaatatgctcttgatgctcttaggaagctataggaaatgatacttgcagcccaagatgaattgacttaaaacgtcatttaattatgtttttatatggagggattttaaaaggtagaatagtataatgtctgctgacatatccatcatccaggattatcaactgtcaaactagggccaatcctgtcccacccacacctccatccacttgctttctctggtattatttggaagccaatcccagacatcagatcatttcatctgtattgcagagacagagttaataagaaaaagttatagtctttcaccccctggaaccagaagtatagtttagttagcagtatagtttcttccttttttttttttttttttttttttttttgaggcagagtcttgctctgtcgcccaggctgctggagtgcaatggcgtgatctcagctcactgcaacctccgcctcccgggttcaagtgattctcctgcctcagcttcctgagtagctgggactacaggcatgctccatcatgcccggctaatttttgtatttttagtagagacggggtttcaccatgttggccaggatggtctcgaactcctgacctcaagtgatctgcctatctcggcctaccaaagtgctgggattacaggtgtgagccactgcgcctggctgttagcagtatagtttcttaaacttttacaaagtatcctctagaacctctagcctccacattagccattatctgaaatgatcatctctagaacctaatttgtgtcctggttatcagagaatttctctcagactgtgggtgctacaaggacaaggaacatatcttacttttcatctctatagccctaatgcttagtatcccatcatataggacaggctcaaaatgcactttagacagatgtgtgaatgcgactgaatacttcagtttcataaaaacgtgaactgagtgagatgtttgccccattttctccttttctcaaagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtcttaaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaattaaa

SEQ ID NO: 3137 - DNA, 60656 bp, human
ggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggtgagtgtgcgtcggcgccccgggagccccggtgccccccaatgcccagccccggggtggccgcaccagctcgggctttctgccatgttaggcaccgagcaacgttctcgctgcatttttgcgtgcgtttcagtggcgccttttgctgcggagggagttattgcttctctccgcggtggctttttcggggttggggttgtgctctgtgtgtttgcttgtttgccatttaaagcccgactattgttcaggataagctccgcctgggtggggaaatggcatcccaccacagttgctggcgaggggtagaaatgttgccaaacagctgctgctttgtgtttccctatcagaagtccttggagtaggtttggggcacgacggatggatggagagagggatggggcacggaagaagaaggtggctttggaggagcgggttgttacccacaccatggcactcactcagtctccctttctgcctgccaaacttttatgaatattccttttgtggcagagggaagcttaatgaatttagcccagttttccaaggaaaaagcaacccagctttaacaatggtttgagaacttaatcaatgaaaaaggcaggagaggaggacaaggaggcgccgacaccatatcgggtatgtggctgctgcttgcagagtcaggtaggggagaggtggggagggcacggcgcagcgtctgggtgaccgtgttcccggaactgttggtagctctcacctgtgcccgctggtgccacccaccgtcgtgcccctatgtcgtgggctgttcagaacccagcgatggggtttgaggggcggcttgcggcagtgcgcgggccggcccccctcatctggcgtttttaaggatgtgtaaatattttgctgaggataagtgacatcaacagaatgatattccgcagagcccgggtgtgcagcgatgataaatagatatggccaaacaaagttttgataaccgcgtattctcatggctctgtctgtttcatttgggtctttgtttttgttggtttagcattatctcgcatcctctggtgtgatccctttatttaactgattcttggaagcttctctttagaacagagagaaaagcagccagcagggagaaaacaattcttagccttgcaagcatcaggcaaggttttctgtgcttttcccagggaatctttcccaccgttttctggatgtctctcttgctcctttggagtcatcagaattggttgttggtggaccgagagacttgtgacaactttgaaaatgtggtgtggacatgcctttgttacagtagaggggtggcaaggtgggagggggacaatacggaaggggacagtatggaggctagttttcttctcaaacgggaacatgagaagccaggggtgggctggaaggcagagaattgtaagatggtggcatcccagtttctctgcctcttacaagcccagagaagccacctgcccccacacccccacatacacacagtctccttcaaatgggcactcgcttctcgtcctgacagatgcccactagaggcatccccagggcagcccaggcactatgaaccaagtcagactggaacttgggggtagtgactactttggcaccagcccaggggaccattcagccacccgagggggttcctttatgatgaaaaaaagccaagacctccagtggtgatgttttgcccaggaaaacctgttcatctgaggaacaaatgaaaagacagttttccaagcgatgccgatcgctggggtgagaacacggtttggtgggcagctggggaagaactgtaagacacatttcaaaatcttgtatccagaatacagagtccctgaaacaggaccatctgaactacaagaaagaaaaatcaaagactggaaggtgtgtgaggagctgttgctgggagtgctctagctgtaatgacccagaagctgaggataggactggcctcccaaatccattgatccagaatggagatactctggatgtgcagaaagccctgcacagcgtgctccaaatttatgataagaaaataggaaacgtctgttctctggcttctcccctaagcttagaattttggagaggatggtagtggagggaaataaattgggaagggaactaacatgtattgttggcctctgtctgctaggcacttcacatgtggtaaaccttctcagccaccctgtgatggaagaattattttacagataaggaatctgaggctcagataaatttccagttgtgtatctgatttcagactttggtggttatgatttaaaggggcaacatgtccctattcccctgctccaggtctcttatttatttctcttaacctgtctgaacctcagtttccttacctacaagatgggaataatctttcccatctcacatagacgttgtaaagattaaagtgggacacgtcagcatggaaccacgaaggactaaaactggagtatgacaccaggaactccaggcccctaaccaaacatacaaatctctggatctcttcctgctggatctttcagcccctccaccttggcaaaatctggtacacagttggtggggattggggggaaggtggaagcccaccagtgggcaacccagtcacccacagtgcatacttatgtgccaagtagatagatccgaaataccctgtgtcagatggacagactgtaccctttcatcttggagtccccaccacccaactgttgcttaataaatgagagttgagtgactaaatgatggcactgatggagtgaatggcagtggggagggggctgtagatcattgttaagggagacccagcaaggagagatccagagatttgtacgtttggttgggggcctgaagttcctggtgtcatattccagttttagcccttggtagctccatgctgacaagccccagtttaatctttacaaaatccatgggagatgggcaagattattcccatcttgtaggtgaggaaactaaggctcagaaaggttaagcaactaactcaaagtccacgagggaccaaaggctgggtgaggtatttttaactagaaactgtctcaaataaacaaacactctataggaaaatgaggagggaacttgctatgcaaatgtatcgttaaagcaagccccgtagcccccttccaaccaggtggtagtcttcaaactcctagaaattctggagccaccgagggagctgggctttgaatctatgtatgaggagctcctcaatgctgcctccctgaacagaatatgagggagacctcagagaatgagggggaaagatggctaattgcactcttcccacacacaaaagcctgcgtgggattctgaattaagcttgatttggggatcagggtgacatccttgctgtagagttggcagctcttgtctttggagaatgcctctgattaccacttctccctcccacctgatcgtctgcccgggtgcccatcatctcattctttccagactcaaagcctttccttcatggctcacaatgttgatgagcctcttgagtctgccacttcactgtcctctgatggcagctggtgagaagctgattttggcggccaggttagtacttctggagttcacacatgaccctcctctctcctgccaagaacacacacacgaacacacatgcacacacagacacaggcacacataatttgatcacgtttctgtatctgcttcaccaaattagattcaaacccagaattgttattggaagaagtatgtgactttggtgttctctcccagcccctgccctgaacagaccagaacagctaagatggaggcagcttagccagcagatgtcttgagccatgatcatacttgctggccttcccactgctgtggggcagcaccgcaaaacatgggcatggtctgccttcatccgtctgggctgctataacaaaatcccataggctgggtgacttataaatgatagaaacatatttctcaccgttctggaggatgggaagtcaaagatcaagataccggcagattcagtgtctggtgagggcttttttcctggttcagagatggcatcttcttgctgtgccctcacatggtagaaggggcaagtgacctctctggggcttcttttacaagggcactcatcccattcatgaaggctccactctcacgacctaatcaccaaccaaatgccccacctcttaataccatcacgttggggattaggatttcaacacaggagtttggaggggacagacacattcagactatgcatggtcccagggcctttcataaaagcccattttaatctctactgagacatagggctgggctccttgaacatcccaatccttgtaattccaatttctgctgtaattagctccaacaactcagtaattctagagaactttggagcacactctgctcacacctgtcactcctcttcccacaactttttggtcttccagcacagcactgtctaataaaactttctatgatgatggaaatgtcacatgtttgcactgtcccacacactagccactagccacatgcagccatagagtgcttgaaaagtggttggtccaaattaggatgtgcattaaatataacagatgcatgggatttctgtgacttaatacaaaaaaagaatccaaaatagctcattaataagctttgcattgattacatggtaaaatgataatattttgaatatattagttaaatatgatagagtattaaaattagtggcttcttttatttttttaaatgtgactacaaaaaaaatttaaattacataaacatttctattagacagagctgctctggagcaaactaaccaacctcgtgacttcagcctccagatgttctggggacataaacgctctccatctcgatggcaggtgggaggcagggggctgagtcagtagccacagcagcctggcatcaagcgattttgattttcagtagctcaggtgccatgatggaggttccccgtggaaactagccatgagcatgttggctcagtctcatgctctatgaggaatgtgggacccagaaacccaatagaatgggcacaggcaggactggcttgaatgaaatggctctttcctttcctcgaccccacccaccccacaggccggtgtccttgtccatcggagaattccttgacacctgctctagtagcagcttaaagtactatccatcccagggatttgtgcttggagagtaatgtcgccagtagacaccctcatgctgacagtgggttatttagggccagggccagccttaaaggagagaaaataaaaaagagaatgcacactgtcatttcctgacagcttgatgagaacaagagcaaggacataaataaaatttctgcgagggagacagaataaatgcaaggaaggtcaatttcacacaaccatagcacagcagatgaagaaacctggccaaaggagagttcagggaggtagaagaaggattttggctggcactatggtatcatcacatcacatcatttctgggtccttccctaggcactggtcatggcataaatagacggaaagggatgggataatgaacttgggactgcagtgatttacaggtcaggcgcctgtggctctggctcctgagggggctgccctcacaggggacccttggctgacccccttgggctcctcagaaggagttggttttgtttcacatggcagaagcagactgtttactggagcacaggaagaatccgacattctggcgaaaaataattcattaacagccagggtattaccagttccctggaaaagctcctccagctgcactgtagcaactgttctttttcagcagcagaatcgggccgtgctggcagccaagactgggtgtgtttgggcgtttttattgttgttgttatttttgcctttgtgtgtatggccacttttcccttataattcagagaaagaaatggaggcctggaagggttgaaatggtgtagctgtcagccattctttccttcgtgctttaagcctggaagctccaggctgactgtatgaacataggtttttcctgatcaaagcccatccccaaagtgggggcactgcagaaccacatagaatgttctaggatgaaaggaattttagggaactgaaacacctgttcttaagattctctgaaagcaattggctgaagaatccctccccacccccgtatgcacaaccaggcagaaagtcctatcttggccgtgtggaattcttttgcttactattaattggcacaatggggccaaagtatgtgattcatcatcctagttttgagggcatttggaaagccaggcaagcataaccaagagaatgggctgcatgttttgctcactaaggaatgattgaatctacagtaaatacaaggaaagattcaggaagctttttgtgctctggaaaaatatgtctttttaaaaaaataaggtttttgtctgcctgtttgttttttaatgcctcatgctcagaagtgtgtgcccagctagcaaaaaacgggaaagaatagcatttccttgttttagtttttttaaaactctaattgcagtttaggtaagatacagtgtattgattttggttttgtatggaacataactagataatcattttattttatgagatattaatttccacccatttagactgatgaaatatgcatttaaaatatcccatacctacccccaccatcatcacaatatttctttaatgttcctagattcagatggagaacctatttcatttatatggaaaaggagtaaatatgttagtcaacatatatgtaaacctgccttagattttgaaaaaaatgggatcctttccctttttttaaaaaaaaaatgaatgttaaaggccaagcatatttggctttatctggagcatggtttcttcaccttggccctgttgacattttagaccagagaattgtttgttgcaggggactgtcccatgcaccttaagatgttcagcagtatccctggcctccacccactagataccgttaacaccacatcctcctaccctagaccttgccaaatgtcccctctgggacaaaattagccctgttgaagaccacttgtctagaccaaaatttaataagtactttgtgtttttttggaaaattccatttgacataataaaagacacaattttccccctctgacttttataaatacaattcatgggcatgattaattaacggttggaagtgggtcatgtgcgtgatttaattctaaggttggtggaagggtctataagattgtataagcatagagactttttcaaggcaggcaattttataagtcataggtgattggggggcacattgtaagaactagtggcttctctggtttttcataaagagaacaggtttattcctccctaatttctttttcatatgcacctgattccaggcatgacttcaaagtcagcaggcatcttcccccacccccagcccctccccactgtcatttctccggtagcatcttaagcccgagccaattgatttagccatttagtgtacttgtgagagctctgctcgtaatattgtaatggactcatttcagattgtagcagccctttacccaccactaaattccatgttttccagtactattgagagagaaagtcaacagtactttctcggtagatggatcatttttcgtaatgattgaaattcaggtagcccccatcacccctggcaattttgtttccttttacacacatttgtttccttgaagcaattctccttcaggcagctagcacctggtaatgcctacaggcagcaacagcagatgaaatgttgccaccaggacaagccctcagccatattctttctggtagtcccttgaaaggctagaaaggagggtcatgccttacacaaggaaggtgtcatgcgggcaaaccatgccctgcccatacatggaaatggaatgggtgtttggggggcagggagagggcagagaagtggatcactcattatacagggaaagtgttccccagttagccctcccctgccagcctctgagagtgatatgggagcaggggatgctggtgaaggataggggcagttgttcagtgcagaagtcaacataggccacttcattttgcagccatccaaggtaggctgaccttttccaaagagtgtcatgtgtaggattcccttgcatactagccagtgaggaaaaatggaaaggtgagcattgagggatttggcaagccagcgacacttcattggtgagttccagcatctcttgaagagtagttgaagtcttccttgtcgccatgaagagagaggcaacaagctggtagggatccacagtgtgctgggctcaggcggataaataattgatttgtagcacgtgacacttggacattctaagttgccagtccgttgcaggccaggattcaggtgatggttgcaacactgggagaggaaataggatcataaatctgggcgttggaggccagtttcgtggtgcagaggccactggggccaccgctgtgtgtgcagaagcaaacagacagatctgagtggtatgttgttcctcaaaataatggcaatggaaatggctgtgaaaaacatttaggaacttgtcataaaaatgcaaacagtcttccttctatagggaaaagctaaataaaccctattgcagctgtattaagtagaaacagatttgaaaatcgggtgttttttttgttttgttttgtttctgagacacttatttatagcaggttgggcagaggctgccactatctttcgagactccggaagagtgttttccagatggtccttgctgtttttctctttattaagcttagctaaacagtgctgtgcttggaaagggtcatagaaaccagtgttactttttttcagattacaatggtcattgattggctagcaatcaatggatgggaatggattgagcctgtgccgatgaatttcctattgcattttataaacaagaaaaatgtcaaggaaagcacagaatagggatactctttcgactatgcacatcaaagctttgaaaaccatacagagttacatttcctattaatttccatttaaattttgttctaaaataatgctcccctctttgtgaaagctctacaatgttaccgtttcctttccaacatctaaacaatgtccagatccatttcagattgagcaattagctctggatgcaatttccttttatgaaaaaaagaatcactagccctctagaccaaatataaaattattgaatgtgaaaatatcaatatggggccatttgttctaagatcctttttggtctatcactggcattttaagaaggttagaaaaggccaattctgccctgcccttccatgttcgacacagccacaccagaaaccccaagctttgtttgtgctcatagaggctgagcagctggatttgaggtcatcagggctgaagcttacagccaaaactgcaaggggaaacatcttagaatgtcccataagccagtggtccccacagaccaggtttgcagaccactgcctgtatcggacaggatttctgccccctcacagtgaagtggaagaaaagtgaaaatgcagtaaatttattttgtttaaagctaaaccttttccactttacaaaactgccctgtattccaaaatgatctttcccactgtccttggtgtgaaactttctcttacgacttatcaagagatagtggatgacatttgtattttgacatcttgatttaacaaagtcagaagttttctaactcatattggatccttcattttaaaaatgctactcatccataacattcaaaagtctgaggttcacccaggaggcccaagtagacctggaaggggaggctttgttatgattcctaagccagaaacagcaacctgaggaaggatcctgggaccgcttccctgagtcccttctttactcagctcttctgacccctcactcatagagagctggctttgtcctaagcccacgtgaagaatggaattgcttctttggaggagtttgagggggcaaaactggcctcttgaacatgaacgcacaagcgtgcagcctcaatgctgagagcctgggccctttatccctgactcccaatgtcagcgccattgccggttctcgtgggcttgacccccttcaccctctcctcagccatgcccactgctgtcatgagcacaggcctcaaaaggctccccggtgtgaccctgttctcctcactgctctgcatgatttgttgcattgctcccccagctgccgttccacaggcctgcatcagcttcctcctgctaaagcacctctctagtcttgtcaccctagctcaagaacattcagtggccccttattccctaataaggttgaataaaagtccacatatgaagccctttctactttcccagcccatttctcctgtcctagagcttcgactggcattcagtaaggcatcatgggagggcgtctacaggttttacaacttctctgtgctgggttttgtttgttttctcatatgaggggagatttccaaaaaggttatggggtatcttggacatctttctagatgaagaaaatggaaggcttgagtttaatgtgagagagaaagagagagaagaaaagaaaaaaagagaagaaaaggaagcctttcacaaaatgaggctttctggtttcaagaattgcagccttactacaagtctcttaccactctgggtcaggataccacctttctggcctgccagcaagtgggtattgcttcagaattacactactacttatcctgttgagaactgagccacttacccaagctttggaacgtacaactcaaacatagtggaacgggtccatcctagccaatgcagaatgtccattctgttaggaaacatcctccaatgactgctcatgaaatcataaaagcaattatattacctctcatttatcaagctcctgctataggctggacagtggtaccaagtgatttacatatattattttatttccagctccataacaaccatatgaggtaggtatacgtattatgaactctatttcacagagaaggaatcagaggcttggatacgtttagtaacttacacaagatcacaccacttacaggaggtggaactgggattctgtacagcgtggttcagtagaactttctgcaatgatggaaatgttatgcacagtccagtatggtagccactagctacaagtaagtggctgaggaagtggattttactgaatgtacactttggtagcagctctagaatatgcttgtttcaccgcaccattccgtctgtctgctctctgcagactttacatctctcttcctccctctagacaaaacacagctctgctttttctcagaggcctgtagccagcagttctcaagggcaagtgtgcattagaattgcctctgtacctcagggagcagtggtcgctggctcaagtcagcagggagaagcttccttcccactgctgtcctgaagagcttaccctctcgtcgtcatcccagctttatttgggcgactgttagatttggtcacttccttagcaattgttcttgaatgcattcattttaatttgggatcttttgggaggaagagggtggagagccagttgcgggtgaaggaagaagcatgggctctaggaactgcctgaccaccctagcaatctagggcaagcccaggcagagaggcccatttgctgtccaatttgctgttctctgtaattaaacagggcagaaaagttgactaggaaagagtgagacagacagataatgaagctgggttttcccccacccctccatgcccctacacttatttcttcaccctaattaaagtctttgtccattttggagggcaaaagccagcctccctggggcaggggtagaggtgagggggtgtgagtggccaggaggccagggaaggtctggaaaggtccctggaaggagattgtgatgtcagccaccttaacacttgatctccatttcagcagtgctaagaatgttcttgtttttttttttttttagatacaggtggaaagaagtagttgaggttactcaccaaagcagctgttgagctgtttttcttatgaatatttgtaaaatgaaagagtggtatggaatatttttttctgagtatgcacaaatcttctgttttcccccacagagactaagcttttttcttttctctctgtctctccctcccctaccctttttttttttttcattttttgttttatttgagagcagaaatcatgtgtctttttttgtggcttggtctcaaaccaacattcattctcttgagccaggcagcacttcctaaagctcattttaatcacagtctatgacagtccagccctccttggctcctggcagcacttagatgctgataatagattgaacaaaaaagtgctaacacacaagtttccctcagtttgtctgtttccaaaagtaagtctccaaaggcatgaagttaagtcctcttttgcattattatagaggctctgtccccattaattggtgttgaaatgtaaattccttgggcttttaatacttccattttcctaccacttagctctctgccatctacccatgagcggctcagtaaataccagcatgtagtgggtcccagagctctggccctctctggtctttgtcaccatcatcaccaggggctgaggcctgctttcctctagtcagccaaacccgctgttaactccactgtggatatttggacaggaagctcttcattcccccatccatatggatacttatttgctgccttcaaattcgttgctttctgcagagggctatgccaagtgctccacccttccccttcattccttttgaccacttctgtggctgggggcaaaggactccatgttctccaaacctaagatggagttgaaccactgcagggctttaatatatgtgctttcacttcaactacacggtcactttcagaaacagctattttcatttgtgggatgaagaaacagaggcagcaaaagggccagttctgagtgatgagcagaaaaggtgggcagggcccacatcataatgggtcttgtgtgccttgataaagaccttggacttcatcctgagcagttttcaggaggcttttgaggtgacctagtttatgtgtttggtctttttcccagtggagatgtactggagggtgggggatggggacggtggagggaatgaagaccaaaaaggccctgttgcagtaacccagaaagagaggcaaggaagaaccgaagtagaggagtgcagcggatggggaggctagtggctggattcagaaagaatcttaggaggctgcctctctgaggcttggtgatggctttgtattagtctgttctcatgctgctaataaagacatacttgagactgggtaatttataaaggaaagagatttaatggactcacagttccacatggctggggaggcctcacaatcatggtggaagactaaggaagagcaaagggacatcttacatggtggcaggcaagagagagcttgtgcaggggaactcccatctataaaaccatcaaatctcttgagacttattcactaccatgagaacagtatgggggaaaccactcccatgattcaattatgtccacctggccctgcccttgacacatgcagattattacaattcaaggtgagatttggatagggacatagccaaatcatattaggctgatagacagactaaatgatgacagcaccctggtttctgtcttttgggccccctggtgggtcaggaaactcagaagaagggagagagtgggtatctgggcctcccctccccctgcagccaggcctaggtgagtagtcagaaaatcttggtatggcctaggcaatcctattctgagccctcagttctgaaggaaatgcaatgaaaacaaattgatgggtcagaagagccttttgaagccattctggggacaaaaacaaaacctgacagacatagtcaacagccaggagcaccttcagtccgcagctttaaatgcacttcacaaatacatacgctttaaataggtcagactctgtaagcaggaggggactttgggtgagcctgctggttcaggctttgactgggcccagctaggggagaggggtttagctggtggcctgctgctagcatgaccacccatcctgtcctcatttgcctgggattgagagggtgcttaagacacaggactttcagttttaaaactcggacagtcctgggcaaaccatggtgagtgagtcaccccacctgccaggggaaatgttgcaacatggatggctgagctgattggaaccaaagcagtggagatttacttccacctgaactggcatcagtatggggatgccaccacagagaagaaaaggagcttgggaatagaaaaggcaagaacatatccgaaaccctttccaatagcttctctggttccaactgaagcacttctcttaaaataggagcctgagatccttaccctgtcttcctggaaactagaccgccctatgccattcttgttatcccacccatctgatgcctgtctagatatttcagttgaatttcagatgagtgaacaaatccttcagtcctgctggaatctgggacttgaaagtccttaactggacatggaaatatgttaaactgagtcttgagtgagaaaaacactttctttacataatgcattcctacgtccttaaaatcatgattagaaaagactttttatttttctaggagcagcaagatgcagactcttgtgtagcagtagaccattcagattttaattttgcaaagcaactgtaatcctccattattcatcactctactgaaaccaaatttaaaaaattttaagttttcaaaagcttcctttctccacccccatcccaaagatttctcttgcaaagcaaacctcagtaaataaacaggcaacatgttgtaaatggtacaaagtggagagcttggagtaggaagctaatgaaagggatttttcctgttgggtcctggtgcaagccttcaggtacattcagaaatacaaagagaaatgcagagtgaggtgacacactcatcttaggacaccagtgacagggaaaagcactcagagtttattctcgtggtggcacctgaactctcaacaactagaatatggagggtggtctaggaggaattcagttcagggaaataaaagcgaaagggaaaactagaggaagatgtgaaaaaggcaagaataagattcctcggccatggccatgtggttcagatagttgagaaccaccccaaatgggacttaggtctttggaaagtgccctcaatgataccctgccctcctaaaatgagtctgagagagaaaatgagtcttcttgttcatttgtggcactctgtaccactgtatgaggagtagatattagaacttaaataatagcatcagcatttttaaaaggttgtctatttcacacacacttcaaataggtcaatttttaagcagtagggtgacatggtttattctttccttggtaatgtttggtttttaaagccagctatatggatgggagatgtgttaaaaattatctaacacaaatttttatttgtggatttttgtctaaaattcttacatacatacacaaaattgcatatattattaagtgtacatcttgaagaattttcacaaacagcacaccgatgtcaccagtgccctgaaggagacacagactgcaccagcccctggaagcttcttcatgccctcttcattatcctcaccaacaatagccactatcttttaacagcatagatttgttgtatcacatgcagggatttttaaatcatagctttgtgtatgagtaccaaaaaaatccagtcctgtgatttgttttgatggagagggtgggagcagaaattttgtaatggttttctttctctggctgctgtgagttaggcttgttaaacaggaagtttccaagctgggttcttgctggtatagggtttggggcaggctggtctcttctgcccaagacaatgcccaggctgcaagccagtaacctgttcttggcaccacctgggccaaaggcagccaccaagcttgctttatctgccttattaaagcctctgtcagagcttgcaaagacacatgtctgggagcaccaagaataggacaatataatggctgggagtcctctgaatcaactggccttctggaaggtaaggccaggcacagcgactaaaacagcaatagcatatccaacgaggacatttttctccaacttccaaatgagagtatgattgatgaatttctcttcttcgtaggtttcattgtatttttctatgtgcattctgcctccttttctttttgctgcaggaggcaaaaagtgggaaggtgggaatcaagctatggaacatacatcgtaatgtgtctggagcggcatcagcaaaggacttatttgttctcctgggctgtggagtgccgagtgattgaatactcgccaagctgtcagttttatgaaacaaattccctaaccctcttggcccagagctttgctctgcctgaaatggaaaagaaataagttttaatagaaaactcattgcaaaaatctaagataagattcccaagcaacttctctcctaagaataaaatgaaatattgaagaaagcatttgatggggtactcttagggaaccttatttctcagttcttagttaacaaaccatgttaataaaaatatttagactttcgtgatgcataatgcatttttattcctagtgagctggcctgtttgtatacacagatgtttcctgtggcccttctatcatagcttctattttttctgaaacaatatttctagcaggaaatagaatcttatgttaagaacctaagcccctcacagaccctgttagtttgagtgaggatattttcatttctagatttaatacttgagggagtagggtcagaatctttttttttattcaagaacatggaaaatacttttaataaaaagataatgcaatgaatccactgtatcaagacattagacagttcttccttggcttctagattagacctgatcagttcatccaggcacattcattgctgaagggttggatggcttttctgtctccattctcactgtcaaagctgccatgagtaatgtctgccctttcatgcaaaccttaggtgtgttcaactgggttttacagattttccagagcattgttctcacagagctgcagtttcctttccagcaccaggagcactgtcgcaacacagctcacgagctcagtttctctgccactcgttggagtgcatggaaatgcattacaaacaaaacccacaggcaagtgtgctaaggaaggaaatgagattttacacatcagcactttaaaaaaaaaaaagatgaacctgtcttaattgaaaaatggcataatgccctaatgaaaaatcaagtttcaggattcagtccctaatatctcagtgatgagtgcatatttcctcctgtggctactcctgcgagtgagttctgaaataatcaggcagtgtgttgaaataagatatcattgggtgttactataggagtgaggcatagctgtctggctgacatgctggtcaccgcctacgtgccaggagagaaagggatgaaacacaggaatccttctcttctggctttttggagttttattttctttaccttggtagtaaatcttgtttttctatgatcataaaagtagacatacttactttaaaacatttacaagtatgagaagatagcaagaagagaataaatatcattcgcattcttaccacccagagattgccactatcaccattttggttcatgtcctcacagtcttttttttttttttttttcctatacatatattctttatcttctccaggagtttggagctttacaattcaaagtcttcttgtgcttaaattgattttctcaaaactttgccgatcatttatgtttccctaatcattaacatcaaaaatgaaaaggtacctgttttattacttctcatgggtgacaaagaaatttttagcatatttatttctcttcttctactgactgtcatatcccccaagcatgtggaacctagcagttccttaatataaatgttgaatcaatgaatgaatgacgacagtttatcctcatattactcccagggggtgagcatcagctcctgagactaacgccttccaccatcctttgctgcctctccctcgcagtgagactaagcctccctctgtccactgggtctgttctccctggttttccatggactgtgggcagtaaggggatgcaatggaaagggatcgccctttagagtcaaaggggccaaattctcaggtctaccaactactacataatgggacgagtgtcttcatctctctggcctcagagatgccaactgtacagtgggtggcagtgatacctgcctgtcaggatgagtgacaagtatgcaagatgcctagtacacaggagagatccaacgtctgcagctgctagtactttgcccactttctttctaatgacagcataaataaagagcccttggggccctagagcacttcctttctcttcacatttccagtcgtttcatctaatgagccataggaagatttctgatgagttacttgatgcttctgtgccaagtaaatcagagaaataaccaagaattgagtggcctttttaataatctgtttcttgtgcttcttctactgccatcgcacgtgcttccactgcagcaggtgtctggctgcattgtaattgtgtgttcacacagctgactcccccacgacacagtgaatgtgtcttgcatcttggtatcctcaacccgggacccacagtgctcataattgaggagttactcaatatatattgattgaatggatgaatgaataaatgaacaaatgaatagtatcgtattgtacacgtattgtccctatctcgaccacacacatggactttctgcaaaccatattgtagaattaaatcgtaagccttctgaacctgtgatgtaagcctctgacagacagacatataagtactggttctgcaaagtgcgagcttaagggaaaaaatgatatttccttttagttgccatgattaatccatggattcactggttcgcatgtgaggttctttagtggagtaggagtgacaatgtatgcatggtacagcttcttgtctgcagcttttagtttgagttagatgcgtgttggcatctctttcacacagaatctgaggagctggcatttatttttgacagcatctcaaatcttgtgaaagtcagagcttggggctggcattgttttttagtagtatctcagacggtggcaggacaaccttgatgataaaaaagaggcttaaacagatgtcttcttagagttcttccaaaaaactaaaagttcagcaaaaaaataataaaaaaaaaagcttctgaacttctagagcaaagacttctttgagcatcagctatttgcagactggccacaaataaacactcacaaacaaagtcatagggatttgtttccctctctaattcactacggtagtgattgctggttagtccccaaaacctgttttgtttatcttcctaggtacccagatagactacatttcccagtctctcttgcagttgtatgtgtggccatctgcctgagttctggtcaatgggatgtgagtagaaaggatgtgtgcacctctggtccaaccataaaagctttctaggttttcctccaagctcttctcttatccactggctgtctgggatggagtgaagtcccaaggtcaccttgaaagccacagttaaagatggcagagcctcttctgcctagggaaggccatttcatggaacaaaactgccagatctggagcccccaccctagacagttacataaacaagacataagctttcattattgagcaattacaagttaggagcaattcactaggtaacttatcctaccttaactaagtcatgctccttgggttttttttttaagcagccgatagttttcaaaggccttttatgtgcctggaattgtttgtgttactaatcctttcagtagccctgcaaagattccttattttacaccgatagatgcaactccaagtaggaaggggatgagcattttgtccaccactgtcaccccaggattggcacagagggtggcattgagtaggctctcaatgaggcttgttgatgatggataaaaggaaggttcaacaaggcgaagtcacatgcccagaccccatagctagaaaatgctgaactcactggcctcaaggtccagctgcctctgagtattggtaatccaagattttaaaaagaatgggtgaagggccagtgatggacacttagaaaaaaatgtttttgtctctttctgactgaaaaaagtaacacatatttaaaaataaaaacattatagatatctgaaacaaagacatgaatagtgctctgtaatattatcagagaaaactggtacatgcttggttttattctttaagttcttaacacacacacgtgtacacacatgctcactcaacaaaaattagttcatgttacatgtagaaaatatagaaaatctatattctctcctgccaaatgacttcttcacctatttttcccttaaatagtttccttggacatttttttccatgtcagaacagaccaacctgtgtcctcctttgcaaggactgggtaatatttggtgtaataatctgggataattaactaagccaattccctctcagttgacatttaggttgtttccagtcttcataacacaaaagagctgtgataaacctgcttgtgcatttatctttgggggagattcctgagagttaaatggtgcatacgctgatgggaatttttcactgtcttccacacatggagacctattttctgcagaaggtccagatggtcaacagatattgaaatggactcagtggagttcttcaagttaaggtaacaacagcagaaaaagggttttccaggatctcagaaggctgcagctatggcagtccatggcaaagactaacagcaaggaggcgccagcatcccaaattgagaggatggcaccttctggatattggctggtttctctgcattcccctggcaacgaagtcagcattatctggaaggtcagggctgatctgggcccaggatggacactgttccacactaagaagggaagcaagtctccttactgcgaagggggcagtggccagtaggacagagaaagagagagggaggaggatggtgcatagatgtcgctgcagggttcctgtcagggctggagctgaaggttgcaggacactcactccacagaaccaggcagaaacctgatgtgcccagacagcttttggggtgagcaggcagctccaggcagatgtctttgtttgcaggcacagctgcgtgcactctgagatgttcctgtccatgagggatgtttctggaatgatgatgatgatgatgatgacagtggctgtggttggcagcgggaagaaggaggtgattacccaaacagcgctggcattctaagagttggccctgagagggcaggggctgcctccactctgtgtgtttatgatcccttgtggtatgagcatgtgatgtgtgctttgcgtgtatgcaggtctgtgcagtgtgatgtggttgagtatgtgagtgtgccgtgtatatgatgtgtgatgtgtgcagtcccatgtgtgtgactgtgtgaggtgtgttgcagcagcagtgtgggacgtgagtgcatgtggtgttgcagggtggtgggcatggagtgtgtgtggatgtgattcaatgcatgagtgtgctgtgttttgtgtgtgtgtgtgtgtgtgtgtgtgctgtgtgtgtgtgtgtgtttgaggcggtcctgattaaattcccccaaactattcatgttgcgcaccaaagacctctgggctcatgttgagtttttccttctgtcttctctgtttcctgtggcaaaaatgccaacttcaccaagagaaccctctcaaacattttctccctaaggagaccaagctctaggcaagggcttaagtttccactggtcacagttagagaaagacagagagagacagtattctctagagctgtcctattttattttattattctttcaacttattgttatattagtctatcttacctttttatagaggtgtatatgtaacacatacagtaaagtcacagagtacacaaatcttatgtgctgatgggttttaagtgcatgtgtattcacccgtataatcataccccagatcaaaatagaatacagtcccagcaccctgaagagctcccttgagcccatttctagtcaatatctcccaaaggcaaacactattcttacttcggtatcggtagattagttgtgtctgctctagagtttcatatgaacaggatcatgcagtataggtagtctttttgtctggctgttttcacttagcataatgcttatgagattcatccatgttgttggttgtgtcagtagttccttcctttttattgctgtgtagtatcttattgtatggatgtattacagtttgtttatccattctcctgctgacggacatctgggtggtttccagttcagggctattgcaaataaagctgctacaaatattcttgaacatgtctttttgtgtccatatgtagatctgtcttaatgttgcctgtgatagcatttgacaaagatagagcttgcaaaaaataaccccctgccaaaaatcaaacaacaacaataacaaaacccccaacttaacccagcaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggtaagtggggatctttggtagggtcactggctgcttcaggatttgtgagctgtgttttgggctccaatgccaagatttcccattagaagccctgtaaggctgggtgcagacaacttctaaagatacccaatttacttttagggaactcagaccttgggaaaatccagcctgttgcccatccacaggatgtcagtaaggatttcagagagtgaagaaagagaaacaaacaggcttgcacctgcacactggtgggctttggtcttttgggtgtctgcagcagctcgctcttcgactgattatctctatagtggaagctatcttggctgacccctacctcctgggtactcacctccacctatctgtgtgctcacttcgaacccctgcagctctctcctccaagacttcagtactggccctggaagcatgcttagcccaggcacaggacaagcaagaggctctggagcatatgtcaccaggagcagccctcaactgatgatgcaatgtaactggaagacagatgccgctgttttctctccctcagtagggagaaacctgaggttaactcccagtgggacttagccccagttgctcatggcagtcagctgcttattaacgcatcctgaattgtttgccttcctttcctgcctcacttctctattgttccatgggtgctgcctgtggtccccttttacatacactgtatgcactcagatcttggtcacagggtctgcctttgggggaatccaaatttaaccatgctcctccccaaggaaaaatgctttctggcacatacactaattttgtctggggattttgcaaattccatgacactgtctgcatcgcctggtttggggttcagcaaggccttcgtcagatatctttgctgtggagaagcttgtgatcaggggccaactcaggggaggaccataataaatacagatggcccccaacttaacgatgttcaacttagaatttttttcacctttacaatggtgcagaagtcatactcgttcgctagaaattgtgcttcgaatacctgtacagccattctgtttttcacttttagtacagtattcaataaattactgagatagtcaacactgtattataaaatatgcttgctgttagattattttacccaacaataggataatataagtgttctgagcttacattagggttggctaggctacgctatgattttggtaggttaggtgtatgaaatgcatttttgactacaatattttcaacttatgacaggacataaccctatcgtaagtgaaggagcatctgtagtacttaattttcaagctacaatgagggcagacagcttggtcccattgctccctgtccttgtcactcccgatactgtttgtgcacgatagacatgtaactccaaaaagatgtgaggaaatggaatcatttaagatacaggggttgcaggggtgggagttgaggggtgggtattgttacttaaggtgattctcagatactctgtatctctgaggaaaatggcttatcataaaatacagtgtgaaaaggaaaagacaaaaattgtatctgtgccatgataggttgtttcctgtaaaaaataaaacaataaagttaaatagttttgatttgttgggggcataagagtcctgaatgaatttttccattttttctaatttttccaaaattcagttgtaacataagcatgaatatttttaaaagaattccaggatgaatctttttagggagaaaaaccataatgcacaaagcagtttgtccagtttccttttcatcttttcttggaggggtatttttccacataagaaagggaacagaggaaggaggtggggcttagggcagtaggatataattagctataacatttgatgatttgagtttgagtttgtggttctggggggataaacacacggacctatctcagtggggctggggtgatctgaaggcctacagcatttaaagagggcaagatgtcaaattgcagatacagatcttggttgatctgtgtggagggcacagctggtgcaggaagggctggggagcagggaatatgaaggcacagataaactcaggctatccaagagttgggaatggtagagggaggagtatggttttggttttgaaggattccctttggcctgtgcccttcattgcctggggcaaatttagaagcacacaagctgtttaagttacattctattaacctttccccagcggctgtatttgcctcgtctgatcccgcaccatgctacacacattttctaatcgttttactgtttcactgattgcagaattagaagcatccactgtctggtaaaagtaggtcagggaagttcctgacttcgctatgttactaatagatttctgaatggtagcgtatgggcgccttaatgtgacatttgagcggaagaacaatggtgatcactcactgacgattttgtgcttgaatcgttcttttctccaacatgaacacatgttggggaggtccccgagattacaggtgccagtgaaaagtaaatgaggcactgatatgttcatttgaaagcaaatcagtgcttttatctgggcctgatctctctaggcctccctcttcttgtggctctctgccattgcctttctcatcacaactctcctccctgagccaccaccataaaaaccttttctgtaacccctgccatatgaaatagtattacatacgcgacctctttccatcaacccaccgccttcccctcctgtaagctaccttggaatcccacctctcttctcttaccctgccttctcctcaacctcctttttcctcctgttgggtgttttattctcttcccatatgatccaagcttaaggatactgtgggcctcacagaatccatagaaaatgaaactgcattgccttataatcaactacgaaatccttaggttgtccccaggaaaaaagtaaagcgagtcaaattataaagacctagacgttgtcaaattcaccacatgggcattgctattgtcaagtaatgatttagataggcacgctgtgtgtatctcgcttgctgtcttctttaaaaaaaaaaacgaatcatttttgcttaaactacttcttccttctagctccagactatggtgatcataattatgtccgaccaaaacatattgcttgtgtgtgttcatgtttaattggaaaaatgacaacagtgatttctttgaagtctcatactcacccagagctaccctgccagtgggtgttctagtatccagaatttcttagaggaggaggaagaataaatcaccataaaatgatacaataaagtcttttaaaataacaaccaggtagtaaattaacatatacacgacctttgaaatgattatgtatggggaagttgaatccagcaaacagctggctgggtgcctgcctttgactaataggctgagagatacagctgctagaaagatatttgagagtaagccctaaatgcagaaatcttttattaaaaaaaaaatcagcttcctcatttgacaaactctaatttcattgggattgacagcattgcctttgtcgagcatacatttaacaaatgagattgaacaaccaccccactcagttttatctaatttaatttgacagccaaagcaggtaggtagaataatgtacttacagaggaggtaagaatgttttccccagggttaaatgacatgcctgacatggcttgctggatcaagctcaaagcaagtatctcccccattgcttttgtatttttgttttgttttactttttaaattgaggtataaagtaagtaaagcgagttcatcttaaatatacaagttgataaatttttgcctatgtgtacgttcatataaccaccacccaaatcaagacatagaacatttccatccctgcaaaacattcacttcccaatcattatttttctcttcttctggctcaaggtaaccactactctgacttctaacagcaaagatcagttttgtttgcttttgaacttcagttttgttttgtttctgagacagagtctcactctgtcacccaggctggagtgcagtggcatgatctcagcttactgcaaccttcacctcccgggttcaagtgattctcctgcctgagcgtcctgagtagctgggattacaggcgcacaccaccatggctggctaatttttgaatttttagtagcgacagggtttcaccacattggccagcctggtctcgaactcctggcctcaagtgatctgcctgcctcagcctcccatagtgctgagattacaggcctgagccaccatgcccagcccgaaattcatatgaagtgtatcagacagtatgtacttctgtgtctggtttcttttacgcagtgtaaatattcaagattcatccatgttgttgcattgtatcagtaattcattctgttattgctctgtaatattccattatatgaatataagactgtttatgtattattgatggacatttgggttgggttgtttttggcttttcccttgccttcagttttatgttttctggatagtctatagaagggcatcctagaaataagcaagaatgatgtgcccgtgggtgaacttgtttccaactggtggcaaaatccactcaccactgcataaacaagcgttctggatcctgagtggcaagactgtcttgggttatctttcccttaagactcaagtgagcttcatgttcccttatcacatccccagcataattgtggggtaaggagggacctcagcgcctagcctccattaaccctaatatgggagaaaagaaggtgagctttagaaaccgacaggcagggggacctggggtgggtttgcaggtggccaggaaaggagagcagcagtttttcatctggagtgcacaggtatctggcatcacgcccacctttgggcagactcagggacacagcttaaattggggcatctctcctgatcattctgacacctgcccattttctgaatctgggaaataaagtaaccattattgcctctcataaagaagctgaccaggcagtgtggctaaggtagtcatttgtcgttgggcagaaactgggcacaaagggatgtcaccttagaaggctgccccctccctccagctgatgggtgaggcgagcagctgtatgtacaggtgcgacagggttgggaactactgggaggcgagggtgggtctgcaacctggatctggtggtgcagaaacgaaaagagatcagttgtttaaaccttcccggtttgcctgggactgccctggtttaagtgctgaaagttccagggcctgggaagcccctcagtcctgggcaaaccaggacaattggtcaccctacaagagggagcccttttcactctgttatcagtgcatttcagttaataaatattattagccttctattacagaccatgcaccttgcaaggtttgggggatagattggtaacaacaagacagtggtgatctctgcccctccttctggagtacttcctatagcaagaaaggtaggatttaaacaagtgattacaatacagtgcaatgcttgctttgattagagacaataaggcaatgagtgctttaattgggaaaattctggaagctctggaagcaggtgggaaagacaatccactacaagttcatgatttccttagcatatccacaaagttctagggctgctcagaaaagccatttgcagcaaactctgatgcactcataacagctatcaacaaagagggtggaggatgataaggaaatagacagatttaggtctattgatgtaatccctttgtgctgcttacattcccaacacgtagccacatttcttctcccacttcgacagtccttactggctggtgcaaaacattcagtgtgtagtgaacaggagtccttggcattgtccgtgcccataaattcagagtgacaagcatgccttggaaaaccttcttcaagttttcagatcatgtagataaaatggggagaggggtgaagatgatgttctggggttaataattcagtatgtttgtaaacagggctccagggtggaaaacttagtgccagattttctgcgtgttgttttacaacagaacagcatgtacttgtaagtatctaaaactaatggacatgtactcttgcctaagaggcccagttattgttttttgttttttgtttttttaaaaaaaagctttttaatgtactagaaatatatggcagctgttgtaagagctgaaaggcccgcccaatgcaggttgacagatgtccatatatccatattatatattaaaaataccccctgaatattttactttctaccagctatcacacagatccaataaaacaaaacaaatctcccagaactgaagcccttatctccatggaaaagtccaaacatttattccagtatcagagacacagccaaacaagatgtgtctcgaattttagagtccctttcttgccttcctcagcccagagggtgccagtgatgtttgtgtaaggtatgtccttttatggatgtttgtagaaaagatgaggatggatggtttttctagaggatagttctcattgttttcatcatgtgttagaaatagcacagatacattgggtcaatttctttttcttctttctctacctttatcatcattcaattaaaacaaagatactcacaaactattatttttctatcatatgggaatcaatgcccaacttacctgttctgagtactgaccctttggaggttcccaactattatgcagctttttctagcctagcttgtgacaggttgtggaggtataacacccccccacacacaccccagatgacctctgagctttcctttgcaaggaagcaataatggagacttatccatgagggatgaagtgcctcttcccttcacagtttgaccatgccttcctttgtagcttgttcagctcggcttgtcctgatttatgtttttttgccatctggtttatttctcttgttgttttgtattgttttaagtgtgctccaggccatctttaactgagtctttaaaaaaaaaaacaacaacaaaaaaaaaacaaatcataggagtgtcatttgaaggttagggatgaaagagaagtttaaaatgggactctgatcttccctgcaaagtccagtagctaaaaataaagttccttttactttgctgattatgtaatagaacacgttctcagatgtgaatgctatggaatgtcacagttgttcagagaatatttttttgggttttcctaaatggaggtgcaagagttctctcaaataattgaattcattcagttagctgttgaggacctactgtgtgcaagccactttgctagacactattgtggaccactttgtgatgctgatgagctgtaaccagaggcagtacttgcctttcctttggtctaacctcagttttcattctattacaccatataactctttctaaagaaaaaatgatgtgcgagggaagtggagagggagttattttgcaaaaggaaaggatagagttgggcaagggcagtgtttgtttgaaaaggggaaggttctctctgggtactgggtgctgtctgtgttctgggaagccatgaaatatcagtgacctggataactatgtttaaaccatgttcttattaaaaccagcagtcctggcttacccagacaaagaaattctgaaacaattttggaaatacattcacaagagtggaattcataaatggaactgtacagccatcagctgcactgtttagacataaagttggatgagcaaagggggaattttacaagtatggattcaaagcttttaaatgaacttgcctaattggtagtagtgatgtagagcatcttgctggaaggaaaacaaatctcatatctaaaaatgttctcttagatgtaaaagcaaatgcagcctcaaacaatgcttgcgaaacatcttggttaaggattttggaagagatttaaggatcatgggttgttgcctggcacttggtgaactgctccacacaatttagaaaccctgtcaagaggttcctaaatccagctgaccttagaatcacctggggagagtttagaacttgtacatttctggaccccattagatgcatgaggttgggctcttgggagtcagatggagaatctgtgagctcagagggatccccaggtgatttcaatcattagccctgttttgagaactgctagcctaatccatttctctggacagcatcctatccacaccattacagaccttttttttttttttttttttttccatacagatggccatgaaatcacatctcagcacatgcctttgactctggattgcacatgtattcattagctgaagcccaattttaaaatccaatcaactctatgattccttgaaatgactgcaaatcaagtcacatccagtgctcctcaggtttatttttgttcattattattctactgagtgctcaggacattctactgctcctgagttggtgagctagaggcataaatagcttttggatccctcgggtgtcgagatggttaaaaggataaatggtgataagtgaataaaagggtgaacattggcaagtgaacaaacaaaaatttgataaggctctactctaagccacatgcagtgtgaggcccttgacggcctcccccaccaaccctcccagtatctttatgggggtgtctcaaaccccgttttacacatgggaaaagcggagtgataatcccaggccacaaagctcagggacagagccagcaatcaagcctgggccttctgggtttaccataccacgtaattcccccactcgctcccatcctaaatctgatcctgagttttcttcattttatcatccataaagagcattctaaattctcttgtgctctgccctggggtccagcttgggctcatcaaggtccgcttacttctccagagatccccataatctatttggaggagtagcacagttctactctgatttggcatgttttagaggaatcaaaggtagggccattcatttttgaattatacataggtttcccttcatctctagaatgtaattaggcaaaagggcttgaggaataccaaatgccaagccaagagcattaagaagctgccaaaggaagcgggtattagcaacctctgttatgtgccatgtgggccagagctgttcttagcttctcggcaggagggagaggctgtggttccaggaatcaggagagagagggaggcaagcaggaaggtctttgcctcttccctgcagattttgtagtggagcagctggcatttctcggtgattcacagatgggcctgcctttgatggccttaccacctttcttattaattttctgataggtagtctctggaccaagaccagggtgacccacccgtagcactactaccatttgggaccagattattttgtgctgcgggggcctgtcccatggcttgtaggatgtttagcagcatccatgacctctacccactcagtaccagtagaacctccccacctcccacaagttagggacaaccaaaaatgtccctatacattgccaaatgtcctcttggcaacagggacagaattgtaccaggtttagaattgctggcctagaactatagtagaaacatgaagggaaaaagagatctcctgcaggggtagggatactgggttggaaatggacccccaagcttcaacctccccaccttccctcagcctgcagaggtggcaccaaaaagtggtatatgaagtatgtgagacttaacccagcgatctcttaaagggtaaatacccacttgccccattcacccttttcccatgctgccatcccacccacctgttcttggtacatggtgctggtgctgtggcagtagacactcttgatagcttgggctggtggttaagagcatagattctggagccaaggctacaataagttcacgttccagctctgcaactgagtagcaagttccctgttctttgcatgcctcagtttctgcatctttaaagtagtaataataacagcatctctcttttgggggtgtttgtgaggcttgaatatttgtaaacatttagaagagtacctggcactgtgtatacacagtaagcactgtgtataaaagtgtattgtaaataaaacataaatagtattgtgaagaagttctgttaaatacagccactcaacaaatgtttattggttgtcgaacaaggccccacccctaccctcctggaactcagagtttggttatgggccaacagtaacttgggcggggttctgagccatgattctgtgtggcctgcaaggggatcacagagtttactccctccctctctgcactaagggctgctgtagaagcagagcccactgccctggccatgctcttctatgtagtctcaaagtcaagttctccatatcccagtgggcaggccatctggccttagctccccaatgcagtgcctcttactcatcataagtcaaatgctgctttactctgcatcaactgaacattccatgtgacaatgactcaactctctatatcttcagctgtagccaaaataaatggaatctatgcattagtttgttttcacattgctataaagaactactcgagactgggtaatttataaaggaaagagatttcattgactcacagttccacatgactggggaggtctcaggaaacttacaattatggtggaaggcaagggggaagcaaggcacatcttacatggcaggaaagagagagcatgaggggggaagtgtcacaattttaaaccatcagatcttgtgagaactcactcactatcacggaaaccagccccgtgacccaagcacttcccaccaggtccctcccttgacatgtggggattacaattctaaatgagatttgggtggggacacagagccaaaccatatcaattcactattcaatatttggtagcacctctgtaatgaatttgaggtatatcagtctttggacacactagttgggaacattgtcctccctccttcactctcttgctccctccctcccttccttcctccctccaaataaatattcattgagcattgtctatgaaccaggtattattctgggtgctgggtgaggtctctgctcctagagacccaacattccaggttaagtagaagagacagactataaacagaaaacaaaggaaaaaaaaagatagcttgcaaatgtgataggtgctgaaggaaagacacaccgagactgatatgagagaggaaaactgggatggaggtggtgactgttccaaatggtcatagaaccttctctatctaagaaggctgttctgatttgagacttagctgagaaggaaccagttgtgagaagggcattccaagccaaggaaatggccagtacaaaggccctgaggcaggaaagagtttggtaccttcttggaatgggttaaagtggggccagatcagatagggctttgtagggcttggcttttattttaaagtacaatgagatgccttggagagttttatgcagacaaataaaactatttgatttatgttttaaaagaaggagggaatagtcactgtgtcaaacactgctgagatgagtaagatgagggccaagagaatctctcagtggatctggccacatggaggtcaacgtgacctctgtggagaagtagagggcagctgttctctttgccttttggttttagaacatatggtttcaccaaggaataggcacttgtatttgaagggatcaataattcaataacatttcttaatactgctttggtcagttttcagggaattacttggttttattctttcttcagtaagacttactgtaatggtcacaatgatgtttgtagtggtgatgtcatccttggtatctaagacatcactacctgcccaccatcaacccccttgatgatttcccagtgtgggacagtaccagcccagccacacatgcacagcccctggaactctgtgacattcatgacccatgttcattgcagaatggctggctgaggccaagggctgcctgtgactcaggagaactatctaggccctttataaatgggccaggcagggcacagagggttgacctcagccttctcagtgccatgttctcatggttgtcccctatgtggcttttcacttccaaagtccatccagccccttaaccttgcctgaacttttaagcccaagaatggcagaaaatccctcagaataaatccttaaagaggcatttgacagagcatatagaaacttacacttggtaaaaagtgaccatagaaaaaatctgtttagcacaagcttaaatattactgtgctttttatgcggtctcccgcagcattttggaaccgggccatttttcctgagtgatcgtttcctttgatttttttccccccactgctttgattttgtaacacaagaataatattttttctggaccaaatttcttataagtggtcttgcccagggaatgatgattctattttctcttaagtaccaagaagtacatacacatacaagcacatttaatagcttcagatgggatggtttgactgtcaaaggcatatttgcaaaattctgttcctgttgattccagcccctgattcaaagccccaccattataatgctgttgcagacacagtggagaaagcccttcatcacctgcacggtagatgcaggctgttcttcctctcttgaggagcaagccctgagtcttgatgaatggattccctctaatgtgtaatgccttcaagatggactcaaaggtaaatccatcccatttgcagaaagggaaggttcctaacttccccaagttaataaccatctgcagtgttggacaaggcttcaaattgctgacacctttgttcataccagctggcaagattgggtcacataattaaccacacaggggcacattttgcagttaactcatcctaggggggctgctctgctcaaaatcagacattggactctgccttactgtgattttttttaaaggcctaactgactggctggcaggactttcctgtcagctttctcctacctagaagagtctctttcatgcttaggccactgaattctggagtctgcactgagttcttaactgaaagtctgtgcaaatcccaaatcctaatgaaagaaaaaggtatggtccttgtctgagggtgcccctctctcgcctccccgtggaaatgggattgcaagagcaccattgccctagagtgtctactcttcacttctatagcccttggatctccctttaatcagcgctgcaggcacttgggagaaaatccagctagggcctgcatttccttgaggtgattccaaaaagtagattttctaggtcagtggatatgaatgattttaaattgccctctagaaagtttttaaccaatttacttccttatttgcagacatttgctatgcagctgtattcgtttgtttcttcgttcgttcattcattcgtttatctatttattcatctattcattcacttattgattcagcaccaagactgtataccaggcactgtggacctgtaaacaaatattaattgattcctgccctgggtggggcttggtgggttttctctttgtctctttgaagagaattgagattgtgtctgggcctcctgaagactggccaggataagctatccatttacgtagtggtgaacggggatccagacttgggaggagggttgctcacccctggctgcacatcagaaccacctggggagctctaaacaaatcctgatgcccaggcccaaccatggatgattttgatttcactggccttgggtgtggcctgggaatctgggtcgttcaaacgagatttggtgggttcagggtggtatggctgtagacttatctgggtctttcaaagctacctgatcaaagtctcttgtgcagctagagttgattgtccctctccaccctttatcctagagagtctagcctgatgaaaatcctgcatcaggtccccaccacctctgctcttgaccttacacttgtcactttagacttgatgatagttactgttccaccgcacatcttgcctactgtgggccatgggaggccagcaccatgccaggcttatgtttgaatagactgaccattgccatggaaaagctgctgagaagaaaaaccatccctcttttcatcttatgtattgtttatttatagtttcaaatataatcctcgccttatttatttaggattccacagtgaagctcatttggctccctatcttttgttataataacaatagctaacccctactgagtatttaccatgtgccaggaactgtttcaagcatcttgcacatgtgaactcacctacccttcttaacaaccctgcggcatatacactgtcatcactcccattttacagatgaggaaactgaggcatagagaggctaaaggagtttgtcagtgttcacacagccagtcagtggctgagttgggcatctacatctcatttcatttaagtgaggcctcttctttacaagtcggaaggacttctcttggatttattatgcctttgcattgtattttctttctcaaaacagaacttcaggggacgagtgagtgtacacctatgagatctatcagcatccctatgctctcacagtggcagagtggcttaggacagagagcttaggaagagaatcattcaacagcttgagtcactttcgttgcatccattggaccaagttgtcttgatcttgtggagacataagtaactaaaagtagacggttcttacctgtgccaagggcaggcaggaccctctgcagttagcactctcacatctgcatacttttagaattgtcctcataagaaaaaggagagactgagaaaagcctagccatgattcagaaacagcctgaattcatctgtctttgaaagtacctagaacttctcctctgctcattcttctgggagaaatcagaggctctcggaagtcagtaattgtgatctcttgagtcataatttctgcagttgtatcagagcctaatgtggggatgcaagatggaaacagcacatggggctgttgccatagacgaggcagagagtggaggggctgaaatctcctggaaggaagggattagctgcccaaagaagaaaacagatttgagaaatccatttaccctgaaggtttaatagggaatgcaggtcagacttactcaaatgtctttagtcacgggtctctctcctgtttttatcttgtacccagctcagagtttcaaaagagagggggtaagtgaacctttaaaccccgacgttaatatttacatccacaatattaggaataagaattcttgtcatctattgaactgaaggaatggtattaaaataaatgtaaaattattaatcgtatatttctcagctattaagacaaactcttgcttgtgcttgtatgatcataacacccaactcagatttctaagaatgtcactagcatgtgtttggtttttctctaaagaattaatattgcctatgataagaaaataatttggaaatattcacatggatttttgacatggccctaaggaattagccattaaagaatttcagaatcctaattagtcttcaaataatcttttgcatggtaaagatcttctgcttggaagaacactatttcaatatactgtttgtcacttcattacctgaaagctgcttggaggcattttgtggaatgaaaatcatttgagggcccagagggtcaacacaaaggtgcacagagccttgaattctaaccgtaaccctgcccctacctagatgcgtggcctaggccaagtcaccttttctgagcctttgtttccccagctacaaaatgagttgtactagtctttgtaaaaatggaaattagaaagccatatgtcatctatcccctgcctttctttcctaccactctgaaatttgttagctcctctcctccccttctccaacctctctctctcgcggtctctctctctctctcttacacacacacacaaacacacacacacacctccttagagtgctggaatgtcattttgccatgatgccatggtgtctcctttcctttttcagatctttgctcaacaagaggccttccctgatcaccctcttcaaagcaggcccttccccacaccctgctccctgtcactctcagtccacttactctgattgactttcttcttagtgcctagcaccatcagaaagtataagaagacaacatggtgctggcacaggggtggacagagggactgatgaaatagactggaaagtccagcgacagacctacatgttgttgagtcgggggacagttcacacgtttattttattattttaaattggataatattaaaaagaaacaatttttagaataaaaccaaaaaagtggaccatgtatagaacattgtcatgatccaaggataatgattatgcaaattcggtacacttcggatccaaaaattaaaaagaaaaaaagaatgctaatttaaggttgggcacagtggctcacgcctatagtcccagctacttgggaggctaaggtgggaggatttcttgagcctaggagttggaggctacagtgagctatgattgccccactgccctccagcctgggtgacagagtcagaccctgtctctaaatgtctctatttttttttttttttacaaaagaatgctgatttggctggagaggattccttcttcagctgagaggttggcatagacaatctgcaaagacccttggagcccaaatatgattctgtgttcagcattcactaggcttcaggcagtttctactttgccagtagtaggtgtcattttccccattttgcaggcaaggaaactgcagctcagagaggccgagtcactttcccaaggccacacagttcttaagaggtcagaaccaggatatgtgtgcaggcttgactcacaagctcattcctgtgccatagagcacaagcttctgctggctatttgaaggtgtatgggtgtgactttggccagcctcttactagggaaatagaatattcctctccagcatgcaaaataggaggcctttgcctttaaggaacttctgactttccacttcagtcggagcttttatgggtgccgcatcccagagacccacagaggaggtctcagtagcagcactttgaagtctctcccacagggccccctcagttgagcacaattgttgtccaaagaccaacacattttggctcttgcttgccttaatactccctctccgttcccaaatacaaaaacattggcatttcttggaaagtggttttggctcaaagcctgctatctatcccacactctcaagccagcttcctcagggcccctgttgctttatttcattgagtgtttgtgtttgggggctgatgttgctgcctcctttgtaaggggcctcctggcaggtgcccagagaagtgtcctcaccagctaaccaacagtcttcactgcagctcccctctccacactgggctcagtagtggtgaaaacccacaatgcacacatgcagaaccactgagggtttttctcctttctgtggttattcaatagtatttttaatatctcttttcttgaatcaagggataattaacctaaattcataagtggtcagatggatacattttgtacacacctttgtaaccacctgaaagaggctataaaacagtcttgtcaccccagaaaaggcccttcaggctcctttccaattcattccctctcctccctccctggagcaaccactttctgatttctagcattgtaagtatttttgcctgtttttcgactttgcgtcaatgaaatcttacagcatgtgcacttttgtatctggcttccttccttcaacatggtggttttgagatgcaattgtgccattacctgtagcagcagtgcattgctttttattgctgagtagtattccacagtttgggtgtggcatttacctgttgaccaacatttaggttgcttccattttgtggttctcatgaataggactgcaatgaacatctgagtacaagtcttttatgaatataggttttcatttcttttgggagaatacccaggagtggaatggctgacaacagggcaggtagttactgaacttttctagaaggtgtgagacagttctccaaagtggtggtgccattgaccagtggtggacaatcgtttcacttgcaccatagcctcaccaacttttggtgtttctagtcttttaaatgtttagctgttgtaatggatgagatatggttgcttagttgttttttaaggacattttaaagaattttccagcatgtcagtcaatgccagctcagacactgaaaaggtcccataggagggaaaccaggtgttaaatgtttagggacaggaggtttctactaatcatccctgtccctaaagcagagtctttccagccctgagggctgtctgtgggctgcctcagggcaagctcaaggccgaagccctagagcggggaactagggaaggggaaggaggccagcaagagagtcagagtggagaagaggagggcccctgcgcagggaacactctgaatcacactgtgatagccacaggacaagtctcagggcaaatggtgtggcacgccacacagacactgatcgtctaacgtgtaagcagccggcaggcacagaacagcccgtgagcctgctcagggagtcccagccggcttgtcctctcagctgctctgaccattcaaggcagatatgacaacatttccgaggcagaattttgttaccgtctatttggcataggcaactggaaatcctccaaaatccagttgccaggcatggaaccagttaggtggcaagcatcagaaccattgggagccatccctggaagtgccagctatgggctttcctggattctccaaccatgtcctcacaagcgtgaagcctgcctctaaaatatttcagccaatccgtatatcttgaaattgagtattatgaattttaccctttttaaaaatagccatcatgctaaagagcaagccatcaatttcaccacttaaaaaaaaaacacacatttctagcattcctggtgctcttgagtattgatggagatgaagagataactggaactccagtagcagcctcaggatgggagcttccagattagaacttgagcttcccctccatggggtgtgcacttgctagcagaatggtggctaactgggttaggggttcacctaagtcagacagaaaatgtcccactgtaggtgccagtgtattttaagttacagacaccatagccctgagtcatgtacctctggagccagagagcttaggcctagggagaattttatcaaccttggtttagggggtgggaggctgggttcaagtcagctctgacgtttattgcagggcttgaggtgggtctggggttcttgatctataaaataggggcaatctctgcttacctcctcaggtggttgtgaaggttacagaagatacttggatgggccctttgcacacaagagcccccatggtgtcagtttggtcactccaagatggcaaggacccagtgtgtttagaaccagcatttgggagaagaacccagtgcaggaggaggatgcttttgaatgggcagtctttgcctagaaaatcaattatatagggcaccaagggagaaagctggccctaggttcttgagccatagatgctaactctcctaaaggactatctacagggacctttcctatagaaaatccagtgtggggagaaggtagaaatccaggcctccctgctctgcaaaccagcaaaccatcaaagggtacaaggagataagggggttgcagtcctagcagattcctctggcgagaagccaggtgtgccaacttcccaggtatgtttgcctgtgttgtgccagggacctgctgcttctccctcccacaacccccaccttctcacatgggtgagggccacctgagcagctgtggggctccagggagtgaagctgctgaaaaccctgccttttcctgctccctggaggcagctcccttatccctgccagctctgtgaatgccaatgaaacagactctttcagtggatatttatgcagttacagagcaaagaatggtcctgaccccatgtaaatacactgattcaagtcaggaagagcagccaagggtgttcagtgaatttactgcagaaaagctagcacgtggaagcttggaattgggctgtgagtacttgggctgcttctaaggttctggtttgaaagccactggtatgaaagccagtgggttctggggtgctctgagcttggtggaagtaaaagagtgggagctcccaacaagcagagagaagcctgcctgcccccagcactgtgcacagggtgggtcccaggaagctctgcattacttaaggtaatgctagctttgcttactgacacattgcaagagtaccgtggctcaaacacaatagaagttgatttctcactcacttaaagccccaaatggtttttcctgatggcaggcggcccttccccctgcaagccgtgattcaggcatgcaggcccttccatcctgtggctccactatcttcaacagggagcttctaaaaggtccttttgcatcaagctgaggggaaggggaaaagggttggagcatcacatgtggaaggaagctttgtaggatccaggcctggaagtggtgcccctcactttcaactcacgttccctttgctagaactcaggcacatggccacacccaactgcaagggaggctggaaaatgtagtccaggaagaagatgagatgggtttggtgaacagctggccagtcagccacagatgaaatatttctgggaagcacgggaatgaacccctgcctgggatgcaagctggaccagaggcatgggaagtgagaattgagctccaaaaagaaaagggagcacctatttcaagctgtgtccttcatgggccaatattcgctagctgcagtggtaatggtggagagggaagtccaagcagggctgggccaagacagcaaagctaggcagacctgcctgaggtgcagatgcaggctgagaaatcctaggttctggtcagagaccgaagacatctctacttcttccttcctgcctttctctactcccacctgctctctgcacgcaaccaggaacctttgctcctttgctgtctctcttccatctcctccagaagtgccttccctgcagtgaacgttgtgcatgttctggaaagctctgaccctccctcccatcaaaacaaccattcccggggattcacagctcagttcctgggggtggggagttggcgggatgggaagcaacaatccaacaaacccagtcacaccaaggtggtaccagtctgctggggatgcttagaaactgagatgagaaaataaatgtgaaatacctagtggggagcatggtaaatgcttagtaaatggtttattatcaacttgtcagtgtgcgtgtgagagggagtaagtgggggtggggggaagagagagagagagagagaaagaaaaagaatgaaagaaagaaagaaagaacaagaaagaggaggaggaggaggaggaggagctagcaaagccctgcaaattaaacggttttatcttttcctcccaacctaatggctcactagtgaattgatggcttcctgctcgtcagggcctgagagaacatcaagattgtgtcggttgagttgtcagtcctttagggcacaaggttaattgatgggtgattctgaacaccctttaaaagagctactaggttggtgcaaaattaattgcagtttttaccattgaaaggaatggcaaaaaccgcaattacttttgcatgaacctaatagataacccctctaatgtttgaagcactcttgactctccgctaagcctcaccagccctgggcttcaggcacctaacctactagcctgccccagacacacctgtcctcttctgcctttccttctgtcctgcacttttggaaaaccctcctccattccaccatctcctgcgccaaaatcctactcatgtggcaaggtccagttcacaggtcagctgcaacaataaagatttgatgactggaattcagagggaaaaaaatacctgaggtggaacaggtgaggagggagaatcctgatttaaggatcccccttgactattagagggacaacaggtggcttcactcctacttggccactctgtgtgtgtgtgtgtgtgtgtgtgtgtgtgtgtgtgtgtgcacgtgtgcacatgtatgtgtgcaaacacatgcattctggaactcttcccccaataaaataggaaataatacctataatcgttattgctaactagccagatgttatacagccgatctttttccttcccccaccccaacttcgtattgtttatgctatattagctccaaccatgatacttgctttaggacacatacagtgagtttttagggacttcaaaagcctcaccaaccctaagattctgcggaggatgttgttctgcttttgacaaaacagaattccagaaagaagcttccctgtctaaaagatgagtactcttcaccctctctttcctgcattgtctgtacttctcgggtcgaggttattattattattattattattattattaggcagcatgcagctgatgaagtgaagtagtgtttatttattgatttttggtccccgagttggaacacaagatcaccagaaaagaaactccctctgtgactcatcccaggaacatcttgcattccagccagcacaaatatgattcaaagaactttctggagggccccagttatattttagcaaaggaacacattagctatgctgaccatctcttgaacgttttgcttttggaaagatagtcatctctggccccctcgtgtgtcttgttttttttataagatcttgagtcacaccccttttgagctgattcccctgtagtgtgagcattgttattataaaggagtgtcttcttcacaggggttacagaaggtaccaccaactggggaaacatttggtcatggtggcctaaattaatgacatttcgatattcacataagcattgagactttccaggccatggctggtgtagcagacatttgtcggtgtcctgccatttcctgcccagactggcctcttatacaccaaatgctacttactgcaaacatccatgatgctccctaaaggtgtgagtttttggtttttggtttttgtctcaggagcacactagatctgcatgctgggctagctggaagtgccaaggaatgactacatcctccaggagcagcccttggccagtgatggatgggggcgggtgaataaacagcccaacttcctagcctctcggttgagatgactctgaggtctccccagtggaattgagcttcagttgcccacagtggtaacttgtttgataaattggcttccttgctttccctgtctcaccacttcactcctctactggtgttgtctgggatcttctcccaaataaattactttcagttaatccttgcctcagggtctgtttgtgggggagcccaagctaagacaactagctagttgagttcaccaaaacccaacagcctcctctcttcactccccttgccctgttcatcaccatcgttagtaatgattcaaagcacataataggtgatggtcatgaagttgccattgtggctgtagcgctgcagtagggtgttgtgcatgggagtgcagtcctttgagagccctaacttctgcatggaaacctggtaagacagaaaccagcgtttcaggaggtagccagttcagtaacagggccctggacaactttggatgctgctaaaatctctgcaccagggaggcacgtactcaggaggttcatgttgggtgagcaataagtgtttgctgattgtgtctgtaaaggaatgaataattgactcacattcatgtccttccttagttctgagtgcttaagggtcaaggtcacgcccctgccccctttatttgatctcaggtgccttccaatgggccccgcaaacttaatcatagttgtcggttcttatctctatggagagatttcaagacagctaggaaggttcctccccatgaccagtatctgaaatgactcaattatagtttcatttctttgtccatagctttattactggctggattatctttattataccaataaaggaacataatacttcagccttatcagtcatgcacctcattgagaatgagtttatcagcttctttctggaaaacccaattttgatgggagaaatctaataattctgactatccaaggagagattggaggagctggcgggtaggcaaaaataaatattagacacagaaagaaggtacatttagatttttttcctgggactgataactcagccaagccacaaggggatgtgcttgatgattttagaggcataggagaagttctgcccaaatttggagcaccttccctaagtacttgcagtactcagacttgtaaacaatgctatattttattttttttaccatgtcctcactgtgctaagaagttccagtcctgtctctccctccaccctgctgtcctgcaaccaagctattgtaggttacagcatccccttgtggccagctaagtaactctcattcagtgttttcctcacagctttcctcagtttctctgtgttctttcactcttctgttatagctaaccaatctttcctttggacctacatgaacttttgaatcttctctccttcgactcttgcctagttacctcaaaaaggctctttgctttctctctccctcttatccttaccctcatcctctccgcttccacttcttccatgtttttgtgagtgagaaaatgagcttcatcgccactgaaaagtaggagaggagagctacttaagctctcgtgcaaaggagaaggaaaactgaaggatatgaagtgaaattatgtgcggtcaatcagcagtaacttccgaacccttgaaagtgctcatgagtccatattcaagatacaaaaggttctggccaccttttctttctcccccaggctttcagtctgaatgagaaacagatttgtgtatttatttgtcttcccactatatttaatttctaacattgggagagcattgttttctgttttcacttcaaatgctcatttcagctatgttgggtgttaggtgggtttttgtgggctggcctggaaaccttcccgtcaggtgtaacaccaagcttatggtaagtgccttcttagttcctagtagctgatttttacatgaatctttgaacaaacagggttgcgaatgaataaagccattcaggtgcaaagggagcatgggtgatactactcaagatgctcacaagaaatatggccggtggatctgatgatgccaatgatgccaatggcacaatgatgatgatggcactgacaatgagaatgatggtgaagatgaagactgtatcgacagtgctgacaacaataatgctaatgacattgatgatggtaccagtgatgatgatgacaatacaataattgccatgatttactgagcactttctgtgtgtcaggcactgtgccaagtacttcacttagcttatctcctttaatcattacaaccacccaatgtgacaggtttttttttttaatcattttacacagagagaaactgaggctgagaacttacttgccccaggtcacacagctagcaaaattaggcagagctgaagtttgaacctaggcctgtctaagttcaaagcttatactcctaaccactctcatagggggcccagggcccagggtgaggctgacactgtctccatgccaaagggtggcaagggattcacatgcattagaagaaggggaaaatctgaactccagttctttgtacttcagaaatctgcaccccttccttccagtgacccctcagagggtctatttctggcacactggtctctggaaaatgtcctgctaatgacacaggattataaacagtctttttcccagaacaaaaatttaacctttgtatctcaatctaattagaagtattttctcttccagaggcaggttttttcctcctctttgttccaaatttaagaggtttctttgttgccagaaaaatgtccaaaaaccgtagctctttaagatgatagaccttggcccaagaccttaaacgtgacctgagctcctgcatgagatggctgttccagcagcagcacctgagggtgcttggggttctgggtgtccaaccgaactgtagggcattggcccaatgcagggatgggcacttgctgactctcacagtcccctgtccaggtgagtgttccctaccaccaccagcagctctttatgattttcttctgtgatgctgaggtttgccaagacctgaggaaggcagttcattcctgttagtatcaggagcagccatctctagaaaatatacatttgttcctttccttagagagatccttgcatgaatatcaccccttccagctgtctagggactggcattcttaccttagagacttactcctttacctctgcaggaaatgtgagccttaaaggagccctgttaaaagcagataatcctgggataatatggatttggttaatatcttcagaatggagccaagagagatggcaacctgcctacaaagaaagtggtatcaggttggaggaataagagatgcatgcctggcacacagtaggtgcccacatcatttttgaaagaatgaataaaaatgaatggccacaaatctagttccatactgtagccctgcagtcaggcccgtgtgggcccccaaacccatcatagatcctttgcgggcaggctgaaggtagtaggggcttggaaaaccaggcctgggagctggtggcgtcctccctccaattcctccttggtgctcccacttgcccatcctttggggcccacagcaattcctcctccggcagctcctgggaggctaggtttgactcctccccagcaggcaccactggctccaaggaggcctgagtgagagtagggcagtcccccatgttacaaaagaggaaactgagtcccagatgtataaaacaacattccaacagtcatgaaaagttcatgtgtgtcctgaatctcttcatttcaatgacttatcttttggatatcactgagtcaaggcatgggggtgttctttttttgagcaagctcctcacctgtcaaactttttgacattttgttggttgaataaagccatcccacatactttggcgttagatgctggttccaatagagatgttctaatcttgggtgactgactgtgctgactctatagctcgtgtgttaaactcaagtgctcctcaacatcctttgaaatgtgaaacagaggcaacaggtggggtaatgtgcctttaaggaaggagaacgggtctgggagtcagtgtactctatgctgtgtgaacttgagcaagtcacttctcctctgagcctcaggttcctgttcttcaaaacaagaggggtggggccgggcacggtggctcatgcctgtaatcccagcactttgggaagtcgaggtgggaggattacttgaggccaggagttcaagaccagcctgggtaccatagtgagattccagtctcaacaaaaataaaagtaaaaatcaggtgggcattgtggcacacacctgtagtcccagctacttaggaggctgaggcaggagggttgcttgagtcttggaggttgagggtgcagtaagtaatgattgcacactgtactccagcctgggcaacagagtgagactctccccccaaaaacacaaaaaaacccagaaggggtaggttgggccagtaacactaagacttgttaaggcaggggcaccctggaagtctccctgggccctgagagcttcatttctcctgctgagttgtaacgttttcattctcacactcctattagaaaaaaaaaattttgagcactccccttaacacacacacacatgcacacacatatataattagatttatatgccttcctatatttattacatacactataaaataaaaaacaggaattaaaaagattagatgataaaacaaacataaataagttttatgatacctcagggcatgaccttacctcctctcactgggaagaccttgggccctcctgctgtttatggccagtttctgacgcttggctccacttctcctatttttcacaaatatcagatcagagataatatttgtactctgtcctccctaacagatcttccccgtagccactgtccgtcctcatgaagtttagtcccagttgcaatgtttgtggtcactactgttttcataaatgaattagcgtgtcagggaactcatctgtaaagctaatctgggcattcatattcccttcagagggctgtgtagacctctggatgtaaaaggcagtcgaccataaggcaggtgactattttgtgtattcctcatattttaaccaatttgagactacattcatgtggtaattatgttcacagctttggtaaaaaggacctgtactgatgtttaaagcttagaaaatttaaccactggggcaagtaattgacaattattataccctatggggagaggaaaaccagttgttacccagttggaattacttcttagatatttagtgcatctcaagtcccgaatggtaaaaccatgtacatgtagaattaaatgatgaaaattatgcttttcttacttggctcatagagagtggctggtgatttttatgcagaattaggttagtcattgaaggtttggtttaagtactgaatggaaagcacaaaatagactcagaatagggcattgatggaaggggcaagattcttagcagaggtctctgggaagtcagccttgcaagagggagagccatctcacgtcttcctgggggtgagggcacatggggagacactgcgggggccgggggggaagaggagggagtttggtgtgttgatagcctcagtcttttctgggaagtaagaaggaagatgggcgattgagaaggtcagcagaccagcagtcgtgtgctctggcctttagattaagggtccgcaacctcactgtacattagaatcacctgctgcatcctagaataattaaatcagagtcttaggggtaggacctaggcatggttttttttttaagttccagattactccaatgaatagcaaaatctgagaaccagtggtagaccagcacttctcagactttaatgtgcatacacatctcctggggccctgtttggaaggcagattctgattcagtgggtctgggctgtggcctgagatttgtatttctagcaagatcctgggtgctgctgctgctgctgctccaaggaccccactttgagcaacaagggcatccaggggtattcaatcttttggcttccctgggccacattggaagaagaattgtcttggaccacacataaaatacactaatgatagctgatgagataaaaaaaagaattgcaaaaaaaatctcataatgttttaagaaagtttacaaatttgtgtgggccgcattcaaagccgtctgggccgcatgcgacccttgggccgccagttggacaagcttgggtagacagtcctactttgactagaaataattgatagccgtctccatgctccatagaaaccaaagctgttgatattttacaattggaaaacccatatcttgagaaaattttcagcatatgttttaagatgtgattgttgtaggggaagaaacttaccttgatagatggcttaatttaaaaagcaaaatacttgacctctaatttaggctattctccaagtcctaaaatccacctatttgttggttgcgggcatctaacactgacccatcagagcctcccgtggctggtgaaggtgagtggctgccatgttctcccaccatggcacctgcgggtctgaccctctgctcttcccgaaacaagagcctggtgacctctgtaagaagtggccttgtgtaagttttagtcagcctttttgagttgcagcttactcatcaataaaaagagtcggcaagagacttgagatgtcagctttaatgtccctgcccaccttgacactccatgagtgtataaatggtgtgcctgcgacaagagggtgaggatgagaacaccaggctcaggaaggcttaggcgttcatttgtgcaccaattcatccagaagatatttcctcagcacctactagtgccagatatgaggtgggagactatcccctgctcctggagaaagaagtaaataagaaatcccagtatgggctgggcagagtcaggactagacaaagtcaagttggggtcctttgggagcccagtgagggtgggggatgatctcagaagaagcaactttagagctgaaccccttaagtcagacagatgagcaggagttggctgggtgaaggctgaggtgggagagagctccaggctaatggtcagaccctagggagaccggcctctggtataattagatctttgcaataattagatgaggggttcagataacagttctgtgaccccatgatatggtttggctttgtatccccacccaaatctcacggcaaattgtaatctccagtgttagaggtaggggcctagtgggaggtgattggaccataggacttcccccttgctgttcttacgatagagttctcaacaaaatctgcttgtttaaaagtgtgtggcacctccccccacctcttgccggccacgtgaagatgtgcttccttccccttcaccttctgccatgattgtaagtttcctgatccccagaagcagaagcctgtatggcccacagaaccgtgagccaattaaacctcttttcttaataataaattacccagtctcaggtatgtctttataggagtgtgagaacagattaatacaccccaaaagtctgcaagcagagctagtctcccagtccctccctacctcctcatctgtcctgggccctgagtcttttccccactgtctccatacagggggcacatgggctacatgggggtgaggccctagcaactggctgcaaaccaagatggtgaggtctccagggtctccagcaacttgcagatccaggttgcctgcttcctacccagccacactgccactgtttactgacctccactcccacacccctggggataatggggacaggtggaatggatgggtgccctcatttaaacccatttgaaaatgttttgcaaaacgcaaacgaaatgttccctgtcacctctgaagaaattcatgccccctgggcttgagcatcaaccggctcctttgatgctccttgatttgaagaggtcccccacccaccctaggcccaagctaatcagcagcttgtctgagtggggagatgggcctccaccttctctccagtcactatctggctacttggcttgtcctcagggacacagactcaccctttgaacccacaattcatgagatagttttgtattcttagggcatcgccgaggcttccagtattagcccctgcagcagcaacacccactatgctcccactggatgcacccagaccacctcagctgctgactcagagtcagagtggggtgcttgctggcaggttgaacagcaagaggaggagatgtagtgagaaagaccgaacgaggctttctgggaggtgggagggtgcatgatgaaggccaagttcatgttcctttgcctgggtgtcccaaggccagcgccatacttggtggggactaggtggaggcaggcaagcctgtctcagggccagcagctctctagagaaaagcccagggctactctcaggcctgctttggctgagtagtcaggcagatctggagctgtcctgttgaaggaggtggaagtgaggtttgggccaggggtttttcccctttgccctgagatcctgcatactgctcccctctacccacaccttggcctgtcctctgtccttcatcccactgggcctcagcgtttttcccagagacttgagtcacagcaggggatgcaagggcctctctgtagctcattggtgctgagatgccctccaacccatgtgacatctgtctctggaaggcaggctggggacaggtgagtaaccagaagtaggctgagaggatggaggcccctcaagccctccagtaacagaaccatagccacttcgggctgcagtccccaaggacaggaggaactccggtgaccagagggacagacgaggccccttgtgggggaaaaaagaacaacagttcaatgactttactgggaaggacctggcctccactttgaagaaatgtgatgctctcatactgtttcctgcatgcctctgcaggcacatgcactcggtgttgaaggagaggctgtggggactgcttttcccaggaaacaaaatgcatggaggggcgtggccttcacagctctcccagtcgaagggaagcctgggaagcccagcctttatgtacctttaggctagttatttaatctccctgtggaatcagtttttccaccaacaaaatgggcataattgtaagacccctctggctgggttgttctcaacagagggcctggcaaatggtagatgctcaatgagttgtagctcttgccatccatgggaggaacaggggcctgagggaggccgcctgccctggcaaagtcctcttttcactttctgagcaggactgttctgggaatgttagcaggcctagaccaaagccaggcagggaagggactgaggtttcacaggaaatgatgagaactggtacctaagctgaaggtgtgtgcaaggagcaggtggaggaggcatccagaagtttgtcttctttcctttgggaggggattgagagaagcagacagggagggagagaagctgccatttctgcgagggtggagagatgcagctgttatgagaaagctgtctcacagctggataatcctaaccccacaggaagaccaaatgtggcacagaacatgtcttgacttctgtagctgcccttgtcctcaccagtcctactgcagcttcccttcagccttttcttacccttccccaagggttctggccactgtgagggacaaggatctggccttaggttctcagggccttcatggggctttgtgcaagtggccaacaaatatttgtcctgctgatgtggatgcctctcctggcataacgttgatgcgtttgcatgctagcagatctctgatcaaagacgtgttgcctccactagagtataatgtccatgaaaacaagaacctcgtctgtttcactcaggatgagtgaatgaatgaattcatacatgcatgcatgaatgaatggtgtattagaggccaggtgcagtggctcacacttgtaatcccagcacttgggaagccgaagtgggaggatcacttgaggccaggagttcaagatgatcccggacaacatggtgaaaccccatctctactaaaaatacaaaaattagctgggcatggtggtgtgcacctgtagtcccagctactcgggaggctgaggcagaagaatcacttgaatccaggaggcagaggttgcagtgagccaagattgcgccactgcgctccagcctgggctgcagagcaggactccctctcacaaaaaaaaaaagaaagaagaaaaaagaaaaaaaaaaaaaggcatgttggaggcatggcatcttctgggctgaatcaggattcactcctaaagaaccagacccttcagctagggcaagccccctcagcctccctggggccaggctgcctcccaactctgtcccaagggggttactggccagcatgctgggtcacctcatggcttccagagggagacacgctctggatcctgccaaaggtgtggcccaccagtcattctccacaaagttgtttgcacagcatcctttccctccccccttctcctcctgcctcagagaaactccttgttctgtgcatgtgacacattctgattgcctggaaataccacagagttgttcatttgttaaagctgccttactgtagtgagacatcatttgcttatttcttttcttttcttttcttttttttttaaaggagtctcactctgtcacccaggctggagtgcagtgatgcgatctcggctcactgcaacctccgcctcctgagttcaagccattctcctgcctcagcctcccgagtagagtagctgggactacaggcgtgcgacatcatgcccagctaatttttgtatttttagtagagatgggatttcatcatgttggccaggctggtctcgaactcctgacctcaaatgatctgcccacctcagcctcccaaagtgctgagattacaggcatgagccactgcacccagcctcgtttgtttatttctagccccatggtgtgctgggccgcctctctttctttggaggttgtgttggtaatttcggggtgaggagaggaggacgagctgaccacaggactaaagtctaggcagttgggatagatgaggtaaaaaatctcagttgcccaaggcctgcccagtgaaactgaggattattgaattattattgagcccaaccagactccaaggctgctcagatccctgagttagacatggtgcctgccttctccatggtaacgaggccaaatatggacaggtttccatggagagccctatcgcatctgcagccctgcttccaccaggaagcacacgcgctaggtgcctttggcctctcaggaggtggccagaggtctgtgggaggtgccgaggacattgagaaagtgtgcctgacctatgaggattttcgtttccaacaagtgttccatctccccagccctaggctcaccaatgccctcttcctcttggcagctagatattaggagaggccacagatcagatagatgagctgattggggaagtgacagtggacccaatgaccattcatgcaagtcatcatcgatcttcaccttgccctggggaacggattttgctgttactgggagaaatgggaatgtcattggtcagagggagacagagagacaactgtaatgacccttgtgcttatcaaacctcttttggaagaatgattgctacagagtatttaaaatgccattttccatagtcatagcatattcacatgtgacaaggcattatttttttccttaaaggaaagtaagtcttcactgcttatttgaatttgaacaagtcaaatttctacatatcttaactgtctgacatagcaacttggactgaaacttcgtttttgttgaaggccaaacatataagctgagaattaggcttaaaaaatgcctggtttaacctcacttggctatttactgattacatcatctgcatttatagcttaatcatctgttaaattggggttctccacgcacacaggatcatgtggttgtgtttgtatatattaggagatatctataacctgaacatatacatagagagatgggttatgctccctggttaactaaaacgtggaaactttctaaagatgtgagagagctcttaaggcaattataaatagtcttttaaggaagattcatattgtatgttctgtgttgcaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcac

SEQ ID NO: 3138 - DNA, 61185 bp, human
agcgactcggtgacagcggcgacggcggctcccaccgcggcgcacccccttcaggcggccggcggcgaggccagaccggagagttccagcacactcgaccaccccgcggcttcctggaggcggcggccgcgattgcgaggtagtggccgcggcgcccccgtgcgggccggggtcacccccgccctccccgcgcggagctgccaccgggacgcagggggcgcgccgggctgggcgcgcctggcggggcccggcgcccggggaggggcctgctcccgggggcaggacggcgcccggaggccggggccggctgggagggccgggcgggggcggggacgcgggccgaggccgccgcccgtgtggcgcgccggggccccgctcccgttcccggcgccgcgcactggccggcggggccggggactgccggggaggcggcgccggccggcggggcgggggccccgaagtgggtttcgggccgccgcccgcactggcatcgggcgcagagggcggtgcacggcggactccgcgcccaggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggtgagtgtgcgtcggcgccccgggagccccggtgccccccaatgcccagccccggggtggccgcaccagctcgggctttctgccatgttaggcaccgagcaacgttctcgctgcatttttgcgtgcgtttcagtggcgccttttgctgcggagggagttattgcttctctccgcggtggctttttcggggttggggttgtgctctgtgtgtttgcttgtttgccatttaaagcccgactattgttcaggataagctccgcctgggtggggaaatggcatcccaccacagttgctggcgaggggtagaaatgttgccaaacagctgctgctttgtgtttccctatcagaagtccttggagtaggtttggggcacgacggatggatggagagagggatggggcacggaagaagaaggtggctttggaggagcgggttgttacccacaccatggcactcactcagtctccctttctgcctgccaaacttttatgaatattccttttgtggcagagggaagcttaatgaatttagcccagttttccaaggaaaaagcaacccagctttaacaatggtttgagaacttaatcaatgaaaaaggcaggagaggaggacaaggaggcgccgacaccatatcgggtatgtggctgctgcttgcagagtcaggtaggggagaggtggggagggcacggcgcagcgtctgggtgaccgtgttcccggaactgttggtagctctcacctgtgcccgctggtgccacccaccgtcgtgcccctatgtcgtgggctgttcagaacccagcgatggggtttgaggggcggcttgcggcagtgcgcgggccggcccccctcatctggcgtttttaaggatgtgtaaatattttgctgaggataagtgacatcaacagaatgatattccgcagagcccgggtgtgcagcgatgataaatagatatggccaaacaaagttttgataaccgcgtattctcatggctctgtctgtttcatttgggtctttgtttttgttggtttagcattatctcgcatcctctggtgtgatccctttatttaactgattcttggaagcttctctttagaacagagagaaaagcagccagcagggagaaaacaattcttagccttgcaagcatcaggcaaggttttctgtgcttttcccagggaatctttcccaccgttttctggatgtctctcttgctcctttggagtcatcagaattggttgttggtggaccgagagacttgtgacaactttgaaaatgtggtgtggacatgcctttgttacagtagaggggtggcaaggtgggagggggacaatacggaaggggacagtatggaggctagttttcttctcaaacgggaacatgagaagccaggggtgggctggaaggcagagaattgtaagatggtggcatcccagtttctctgcctcttacaagcccagagaagccacctgcccccacacccccacatacacacagtctccttcaaatgggcactcgcttctcgtcctgacagatgcccactagaggcatccccagggcagcccaggcactatgaaccaagtcagactggaacttgggggtagtgactactttggcaccagcccaggggaccattcagccacccgagggggttcctttatgatgaaaaaaagccaagacctccagtggtgatgttttgcccaggaaaacctgttcatctgaggaacaaatgaaaagacagttttccaagcgatgccgatcgctggggtgagaacacggtttggtgggcagctggggaagaactgtaagacacatttcaaaatcttgtatccagaatacagagtccctgaaacaggaccatctgaactacaagaaagaaaaatcaaagactggaaggtgtgtgaggagctgttgctgggagtgctctagctgtaatgacccagaagctgaggataggactggcctcccaaatccattgatccagaatggagatactctggatgtgcagaaagccctgcacagcgtgctccaaatttatgataagaaaataggaaacgtctgttctctggcttctcccctaagcttagaattttggagaggatggtagtggagggaaataaattgggaagggaactaacatgtattgttggcctctgtctgctaggcacttcacatgtggtaaaccttctcagccaccctgtgatggaagaattattttacagataaggaatctgaggctcagataaatttccagttgtgtatctgatttcagactttggtggttatgatttaaaggggcaacatgtccctattcccctgctccaggtctcttatttatttctcttaacctgtctgaacctcagtttccttacctacaagatgggaataatctttcccatctcacatagacgttgtaaagattaaagtgggacacgtcagcatggaaccacgaaggactaaaactggagtatgacaccaggaactccaggcccctaaccaaacatacaaatctctggatctcttcctgctggatctttcagcccctccaccttggcaaaatctggtacacagttggtggggattggggggaaggtggaagcccaccagtgggcaacccagtcacccacagtgcatacttatgtgccaagtagatagatccgaaataccctgtgtcagatggacagactgtaccctttcatcttggagtccccaccacccaactgttgcttaataaatgagagttgagtgactaaatgatggcactgatggagtgaatggcagtggggagggggctgtagatcattgttaagggagacccagcaaggagagatccagagatttgtacgtttggttgggggcctgaagttcctggtgtcatattccagttttagcccttggtagctccatgctgacaagccccagtttaatctttacaaaatccatgggagatgggcaagattattcccatcttgtaggtgaggaaactaaggctcagaaaggttaagcaactaactcaaagtccacgagggaccaaaggctgggtgaggtatttttaactagaaactgtctcaaataaacaaacactctataggaaaatgaggagggaacttgctatgcaaatgtatcgttaaagcaagccccgtagcccccttccaaccaggtggtagtcttcaaactcctagaaattctggagccaccgagggagctgggctttgaatctatgtatgaggagctcctcaatgctgcctccctgaacagaatatgagggagacctcagagaatgagggggaaagatggctaattgcactcttcccacacacaaaagcctgcgtgggattctgaattaagcttgatttggggatcagggtgacatccttgctgtagagttggcagctcttgtctttggagaatgcctctgattaccacttctccctcccacctgatcgtctgcccgggtgcccatcatctcattctttccagactcaaagcctttccttcatggctcacaatgttgatgagcctcttgagtctgccacttcactgtcctctgatggcagctggtgagaagctgattttggcggccaggttagtacttctggagttcacacatgaccctcctctctcctgccaagaacacacacacgaacacacatgcacacacagacacaggcacacataatttgatcacgtttctgtatctgcttcaccaaattagattcaaacccagaattgttattggaagaagtatgtgactttggtgttctctcccagcccctgccctgaacagaccagaacagctaagatggaggcagcttagccagcagatgtcttgagccatgatcatacttgctggccttcccactgctgtggggcagcaccgcaaaacatgggcatggtctgccttcatccgtctgggctgctataacaaaatcccataggctgggtgacttataaatgatagaaacatatttctcaccgttctggaggatgggaagtcaaagatcaagataccggcagattcagtgtctggtgagggcttttttcctggttcagagatggcatcttcttgctgtgccctcacatggtagaaggggcaagtgacctctctggggcttcttttacaagggcactcatcccattcatgaaggctccactctcacgacctaatcaccaaccaaatgccccacctcttaataccatcacgttggggattaggatttcaacacaggagtttggaggggacagacacattcagactatgcatggtcccagggcctttcataaaagcccattttaatctctactgagacatagggctgggctccttgaacatcccaatccttgtaattccaatttctgctgtaattagctccaacaactcagtaattctagagaactttggagcacactctgctcacacctgtcactcctcttcccacaactttttggtcttccagcacagcactgtctaataaaactttctatgatgatggaaatgtcacatgtttgcactgtcccacacactagccactagccacatgcagccatagagtgcttgaaaagtggttggtccaaattaggatgtgcattaaatataacagatgcatgggatttctgtgacttaatacaaaaaaagaatccaaaatagctcattaataagctttgcattgattacatggtaaaatgataatattttgaatatattagttaaatatgatagagtattaaaattagtggcttcttttatttttttaaatgtgactacaaaaaaaatttaaattacataaacatttctattagacagagctgctctggagcaaactaaccaacctcgtgacttcagcctccagatgttctggggacataaacgctctccatctcgatggcaggtgggaggcagggggctgagtcagtagccacagcagcctggcatcaagcgattttgattttcagtagctcaggtgccatgatggaggttccccgtggaaactagccatgagcatgttggctcagtctcatgctctatgaggaatgtgggacccagaaacccaatagaatgggcacaggcaggactggcttgaatgaaatggctctttcctttcctcgaccccacccaccccacaggccggtgtccttgtccatcggagaattccttgacacctgctctagtagcagcttaaagtactatccatcccagggatttgtgcttggagagtaatgtcgccagtagacaccctcatgctgacagtgggttatttagggccagggccagccttaaaggagagaaaataaaaaagagaatgcacactgtcatttcctgacagcttgatgagaacaagagcaaggacataaataaaatttctgcgagggagacagaataaatgcaaggaaggtcaatttcacacaaccatagcacagcagatgaagaaacctggccaaaggagagttcagggaggtagaagaaggattttggctggcactatggtatcatcacatcacatcatttctgggtccttccctaggcactggtcatggcataaatagacggaaagggatgggataatgaacttgggactgcagtgatttacaggtcaggcgcctgtggctctggctcctgagggggctgccctcacaggggacccttggctgacccccttgggctcctcagaaggagttggttttgtttcacatggcagaagcagactgtttactggagcacaggaagaatccgacattctggcgaaaaataattcattaacagccagggtattaccagttccctggaaaagctcctccagctgcactgtagcaactgttctttttcagcagcagaatcgggccgtgctggcagccaagactgggtgtgtttgggcgtttttattgttgttgttatttttgcctttgtgtgtatggccacttttcccttataattcagagaaagaaatggaggcctggaagggttgaaatggtgtagctgtcagccattctttccttcgtgctttaagcctggaagctccaggctgactgtatgaacataggtttttcctgatcaaagcccatccccaaagtgggggcactgcagaaccacatagaatgttctaggatgaaaggaattttagggaactgaaacacctgttcttaagattctctgaaagcaattggctgaagaatccctccccacccccgtatgcacaaccaggcagaaagtcctatcttggccgtgtggaattcttttgcttactattaattggcacaatggggccaaagtatgtgattcatcatcctagttttgagggcatttggaaagccaggcaagcataaccaagagaatgggctgcatgttttgctcactaaggaatgattgaatctacagtaaatacaaggaaagattcaggaagctttttgtgctctggaaaaatatgtctttttaaaaaaataaggtttttgtctgcctgtttgttttttaatgcctcatgctcagaagtgtgtgcccagctagcaaaaaacgggaaagaatagcatttccttgttttagtttttttaaaactctaattgcagtttaggtaagatacagtgtattgattttggttttgtatggaacataactagataatcattttattttatgagatattaatttccacccatttagactgatgaaatatgcatttaaaatatcccatacctacccccaccatcatcacaatatttctttaatgttcctagattcagatggagaacctatttcatttatatggaaaaggagtaaatatgttagtcaacatatatgtaaacctgccttagattttgaaaaaaatgggatcctttccctttttttaaaaaaaaaatgaatgttaaaggccaagcatatttggctttatctggagcatggtttcttcaccttggccctgttgacattttagaccagagaattgtttgttgcaggggactgtcccatgcaccttaagatgttcagcagtatccctggcctccacccactagataccgttaacaccacatcctcctaccctagaccttgccaaatgtcccctctgggacaaaattagccctgttgaagaccacttgtctagaccaaaatttaataagtactttgtgtttttttggaaaattccatttgacataataaaagacacaattttccccctctgacttttataaatacaattcatgggcatgattaattaacggttggaagtgggtcatgtgcgtgatttaattctaaggttggtggaagggtctataagattgtataagcatagagactttttcaaggcaggcaattttataagtcataggtgattggggggcacattgtaagaactagtggcttctctggtttttcataaagagaacaggtttattcctccctaatttctttttcatatgcacctgattccaggcatgacttcaaagtcagcaggcatcttcccccacccccagcccctccccactgtcatttctccggtagcatcttaagcccgagccaattgatttagccatttagtgtacttgtgagagctctgctcgtaatattgtaatggactcatttcagattgtagcagccctttacccaccactaaattccatgttttccagtactattgagagagaaagtcaacagtactttctcggtagatggatcatttttcgtaatgattgaaattcaggtagcccccatcacccctggcaattttgtttccttttacacacatttgtttccttgaagcaattctccttcaggcagctagcacctggtaatgcctacaggcagcaacagcagatgaaatgttgccaccaggacaagccctcagccatattctttctggtagtcccttgaaaggctagaaaggagggtcatgccttacacaaggaaggtgtcatgcgggcaaaccatgccctgcccatacatggaaatggaatgggtgtttggggggcagggagagggcagagaagtggatcactcattatacagggaaagtgttccccagttagccctcccctgccagcctctgagagtgatatgggagcaggggatgctggtgaaggataggggcagttgttcagtgcagaagtcaacataggccacttcattttgcagccatccaaggtaggctgaccttttccaaagagtgtcatgtgtaggattcccttgcatactagccagtgaggaaaaatggaaaggtgagcattgagggatttggcaagccagcgacacttcattggtgagttccagcatctcttgaagagtagttgaagtcttccttgtcgccatgaagagagaggcaacaagctggtagggatccacagtgtgctgggctcaggcggataaataattgatttgtagcacgtgacacttggacattctaagttgccagtccgttgcaggccaggattcaggtgatggttgcaacactgggagaggaaataggatcataaatctgggcgttggaggccagtttcgtggtgcagaggccactggggccaccgctgtgtgtgcagaagcaaacagacagatctgagtggtatgttgttcctcaaaataatggcaatggaaatggctgtgaaaaacatttaggaacttgtcataaaaatgcaaacagtcttccttctatagggaaaagctaaataaaccctattgcagctgtattaagtagaaacagatttgaaaatcgggtgttttttttgttttgttttgtttctgagacacttatttatagcaggttgggcagaggctgccactatctttcgagactccggaagagtgttttccagatggtccttgctgtttttctctttattaagcttagctaaacagtgctgtgcttggaaagggtcatagaaaccagtgttactttttttcagattacaatggtcattgattggctagcaatcaatggatgggaatggattgagcctgtgccgatgaatttcctattgcattttataaacaagaaaaatgtcaaggaaagcacagaatagggatactctttcgactatgcacatcaaagctttgaaaaccatacagagttacatttcctattaatttccatttaaattttgttctaaaataatgctcccctctttgtgaaagctctacaatgttaccgtttcctttccaacatctaaacaatgtccagatccatttcagattgagcaattagctctggatgcaatttccttttatgaaaaaaagaatcactagccctctagaccaaatataaaattattgaatgtgaaaatatcaatatggggccatttgttctaagatcctttttggtctatcactggcattttaagaaggttagaaaaggccaattctgccctgcccttccatgttcgacacagccacaccagaaaccccaagctttgtttgtgctcatagaggctgagcagctggatttgaggtcatcagggctgaagcttacagccaaaactgcaaggggaaacatcttagaatgtcccataagccagtggtccccacagaccaggtttgcagaccactgcctgtatcggacaggatttctgccccctcacagtgaagtggaagaaaagtgaaaatgcagtaaatttattttgtttaaagctaaaccttttccactttacaaaactgccctgtattccaaaatgatctttcccactgtccttggtgtgaaactttctcttacgacttatcaagagatagtggatgacatttgtattttgacatcttgatttaacaaagtcagaagttttctaactcatattggatccttcattttaaaaatgctactcatccataacattcaaaagtctgaggttcacccaggaggcccaagtagacctggaaggggaggctttgttatgattcctaagccagaaacagcaacctgaggaaggatcctgggaccgcttccctgagtcccttctttactcagctcttctgacccctcactcatagagagctggctttgtcctaagcccacgtgaagaatggaattgcttctttggaggagtttgagggggcaaaactggcctcttgaacatgaacgcacaagcgtgcagcctcaatgctgagagcctgggccctttatccctgactcccaatgtcagcgccattgccggttctcgtgggcttgacccccttcaccctctcctcagccatgcccactgctgtcatgagcacaggcctcaaaaggctccccggtgtgaccctgttctcctcactgctctgcatgatttgttgcattgctcccccagctgccgttccacaggcctgcatcagcttcctcctgctaaagcacctctctagtcttgtcaccctagctcaagaacattcagtggccccttattccctaataaggttgaataaaagtccacatatgaagccctttctactttcccagcccatttctcctgtcctagagcttcgactggcattcagtaaggcatcatgggagggcgtctacaggttttacaacttctctgtgctgggttttgtttgttttctcatatgaggggagatttccaaaaaggttatggggtatcttggacatctttctagatgaagaaaatggaaggcttgagtttaatgtgagagagaaagagagagaagaaaagaaaaaaagagaagaaaaggaagcctttcacaaaatgaggctttctggtttcaagaattgcagccttactacaagtctcttaccactctgggtcaggataccacctttctggcctgccagcaagtgggtattgcttcagaattacactactacttatcctgttgagaactgagccacttacccaagctttggaacgtacaactcaaacatagtggaacgggtccatcctagccaatgcagaatgtccattctgttaggaaacatcctccaatgactgctcatgaaatcataaaagcaattatattacctctcatttatcaagctcctgctataggctggacagtggtaccaagtgatttacatatattattttatttccagctccataacaaccatatgaggtaggtatacgtattatgaactctatttcacagagaaggaatcagaggcttggatacgtttagtaacttacacaagatcacaccacttacaggaggtggaactgggattctgtacagcgtggttcagtagaactttctgcaatgatggaaatgttatgcacagtccagtatggtagccactagctacaagtaagtggctgaggaagtggattttactgaatgtacactttggtagcagctctagaatatgcttgtttcaccgcaccattccgtctgtctgctctctgcagactttacatctctcttcctccctctagacaaaacacagctctgctttttctcagaggcctgtagccagcagttctcaagggcaagtgtgcattagaattgcctctgtacctcagggagcagtggtcgctggctcaagtcagcagggagaagcttccttcccactgctgtcctgaagagcttaccctctcgtcgtcatcccagctttatttgggcgactgttagatttggtcacttccttagcaattgttcttgaatgcattcattttaatttgggatcttttgggaggaagagggtggagagccagttgcgggtgaaggaagaagcatgggctctaggaactgcctgaccaccctagcaatctagggcaagcccaggcagagaggcccatttgctgtccaatttgctgttctctgtaattaaacagggcagaaaagttgactaggaaagagtgagacagacagataatgaagctgggttttcccccacccctccatgcccctacacttatttcttcaccctaattaaagtctttgtccattttggagggcaaaagccagcctccctggggcaggggtagaggtgagggggtgtgagtggccaggaggccagggaaggtctggaaaggtccctggaaggagattgtgatgtcagccaccttaacacttgatctccatttcagcagtgctaagaatgttcttgtttttttttttttttagatacaggtggaaagaagtagttgaggttactcaccaaagcagctgttgagctgtttttcttatgaatatttgtaaaatgaaagagtggtatggaatatttttttctgagtatgcacaaatcttctgttttcccccacagagactaagcttttttcttttctctctgtctctccctcccctaccctttttttttttttcattttttgttttatttgagagcagaaatcatgtgtctttttttgtggcttggtctcaaaccaacattcattctcttgagccaggcagcacttcctaaagctcattttaatcacagtctatgacagtccagccctccttggctcctggcagcacttagatgctgataatagattgaacaaaaaagtgctaacacacaagtttccctcagtttgtctgtttccaaaagtaagtctccaaaggcatgaagttaagtcctcttttgcattattatagaggctctgtccccattaattggtgttgaaatgtaaattccttgggcttttaatacttccattttcctaccacttagctctctgccatctacccatgagcggctcagtaaataccagcatgtagtgggtcccagagctctggccctctctggtctttgtcaccatcatcaccaggggctgaggcctgctttcctctagtcagccaaacccgctgttaactccactgtggatatttggacaggaagctcttcattcccccatccatatggatacttatttgctgccttcaaattcgttgctttctgcagagggctatgccaagtgctccacccttccccttcattccttttgaccacttctgtggctgggggcaaaggactccatgttctccaaacctaagatggagttgaaccactgcagggctttaatatatgtgctttcacttcaactacacggtcactttcagaaacagctattttcatttgtgggatgaagaaacagaggcagcaaaagggccagttctgagtgatgagcagaaaaggtgggcagggcccacatcataatgggtcttgtgtgccttgataaagaccttggacttcatcctgagcagttttcaggaggcttttgaggtgacctagtttatgtgtttggtctttttcccagtggagatgtactggagggtgggggatggggacggtggagggaatgaagaccaaaaaggccctgttgcagtaacccagaaagagaggcaaggaagaaccgaagtagaggagtgcagcggatggggaggctagtggctggattcagaaagaatcttaggaggctgcctctctgaggcttggtgatggctttgtattagtctgttctcatgctgctaataaagacatacttgagactgggtaatttataaaggaaagagatttaatggactcacagttccacatggctggggaggcctcacaatcatggtggaagactaaggaagagcaaagggacatcttacatggtggcaggcaagagagagcttgtgcaggggaactcccatctataaaaccatcaaatctcttgagacttattcactaccatgagaacagtatgggggaaaccactcccatgattcaattatgtccacctggccctgcccttgacacatgcagattattacaattcaaggtgagatttggatagggacatagccaaatcatattaggctgatagacagactaaatgatgacagcaccctggtttctgtcttttgggccccctggtgggtcaggaaactcagaagaagggagagagtgggtatctgggcctcccctccccctgcagccaggcctaggtgagtagtcagaaaatcttggtatggcctaggcaatcctattctgagccctcagttctgaaggaaatgcaatgaaaacaaattgatgggtcagaagagccttttgaagccattctggggacaaaaacaaaacctgacagacatagtcaacagccaggagcaccttcagtccgcagctttaaatgcacttcacaaatacatacgctttaaataggtcagactctgtaagcaggaggggactttgggtgagcctgctggttcaggctttgactgggcccagctaggggagaggggtttagctggtggcctgctgctagcatgaccacccatcctgtcctcatttgcctgggattgagagggtgcttaagacacaggactttcagttttaaaactcggacagtcctgggcaaaccatggtgagtgagtcaccccacctgccaggggaaatgttgcaacatggatggctgagctgattggaaccaaagcagtggagatttacttccacctgaactggcatcagtatggggatgccaccacagagaagaaaaggagcttgggaatagaaaaggcaagaacatatccgaaaccctttccaatagcttctctggttccaactgaagcacttctcttaaaataggagcctgagatccttaccctgtcttcctggaaactagaccgccctatgccattcttgttatcccacccatctgatgcctgtctagatatttcagttgaatttcagatgagtgaacaaatccttcagtcctgctggaatctgggacttgaaagtccttaactggacatggaaatatgttaaactgagtcttgagtgagaaaaacactttctttacataatgcattcctacgtccttaaaatcatgattagaaaagactttttatttttctaggagcagcaagatgcagactcttgtgtagcagtagaccattcagattttaattttgcaaagcaactgtaatcctccattattcatcactctactgaaaccaaatttaaaaaattttaagttttcaaaagcttcctttctccacccccatcccaaagatttctcttgcaaagcaaacctcagtaaataaacaggcaacatgttgtaaatggtacaaagtggagagcttggagtaggaagctaatgaaagggatttttcctgttgggtcctggtgcaagccttcaggtacattcagaaatacaaagagaaatgcagagtgaggtgacacactcatcttaggacaccagtgacagggaaaagcactcagagtttattctcgtggtggcacctgaactctcaacaactagaatatggagggtggtctaggaggaattcagttcagggaaataaaagcgaaagggaaaactagaggaagatgtgaaaaaggcaagaataagattcctcggccatggccatgtggttcagatagttgagaaccaccccaaatgggacttaggtctttggaaagtgccctcaatgataccctgccctcctaaaatgagtctgagagagaaaatgagtcttcttgttcatttgtggcactctgtaccactgtatgaggagtagatattagaacttaaataatagcatcagcatttttaaaaggttgtctatttcacacacacttcaaataggtcaatttttaagcagtagggtgacatggtttattctttccttggtaatgtttggtttttaaagccagctatatggatgggagatgtgttaaaaattatctaacacaaatttttatttgtggatttttgtctaaaattcttacatacatacacaaaattgcatatattattaagtgtacatcttgaagaattttcacaaacagcacaccgatgtcaccagtgccctgaaggagacacagactgcaccagcccctggaagcttcttcatgccctcttcattatcctcaccaacaatagccactatcttttaacagcatagatttgttgtatcacatgcagggatttttaaatcatagctttgtgtatgagtaccaaaaaaatccagtcctgtgatttgttttgatggagagggtgggagcagaaattttgtaatggttttctttctctggctgctgtgagttaggcttgttaaacaggaagtttccaagctgggttcttgctggtatagggtttggggcaggctggtctcttctgcccaagacaatgcccaggctgcaagccagtaacctgttcttggcaccacctgggccaaaggcagccaccaagcttgctttatctgccttattaaagcctctgtcagagcttgcaaagacacatgtctgggagcaccaagaataggacaatataatggctgggagtcctctgaatcaactggccttctggaaggtaaggccaggcacagcgactaaaacagcaatagcatatccaacgaggacatttttctccaacttccaaatgagagtatgattgatgaatttctcttcttcgtaggtttcattgtatttttctatgtgcattctgcctccttttctttttgctgcaggaggcaaaaagtgggaaggtgggaatcaagctatggaacatacatcgtaatgtgtctggagcggcatcagcaaaggacttatttgttctcctgggctgtggagtgccgagtgattgaatactcgccaagctgtcagttttatgaaacaaattccctaaccctcttggcccagagctttgctctgcctgaaatggaaaagaaataagttttaatagaaaactcattgcaaaaatctaagataagattcccaagcaacttctctcctaagaataaaatgaaatattgaagaaagcatttgatggggtactcttagggaaccttatttctcagttcttagttaacaaaccatgttaataaaaatatttagactttcgtgatgcataatgcatttttattcctagtgagctggcctgtttgtatacacagatgtttcctgtggcccttctatcatagcttctattttttctgaaacaatatttctagcaggaaatagaatcttatgttaagaacctaagcccctcacagaccctgttagtttgagtgaggatattttcatttctagatttaatacttgagggagtagggtcagaatctttttttttattcaagaacatggaaaatacttttaataaaaagataatgcaatgaatccactgtatcaagacattagacagttcttccttggcttctagattagacctgatcagttcatccaggcacattcattgctgaagggttggatggcttttctgtctccattctcactgtcaaagctgccatgagtaatgtctgccctttcatgcaaaccttaggtgtgttcaactgggttttacagattttccagagcattgttctcacagagctgcagtttcctttccagcaccaggagcactgtcgcaacacagctcacgagctcagtttctctgccactcgttggagtgcatggaaatgcattacaaacaaaacccacaggcaagtgtgctaaggaaggaaatgagattttacacatcagcactttaaaaaaaaaaaagatgaacctgtcttaattgaaaaatggcataatgccctaatgaaaaatcaagtttcaggattcagtccctaatatctcagtgatgagtgcatatttcctcctgtggctactcctgcgagtgagttctgaaataatcaggcagtgtgttgaaataagatatcattgggtgttactataggagtgaggcatagctgtctggctgacatgctggtcaccgcctacgtgccaggagagaaagggatgaaacacaggaatccttctcttctggctttttggagttttattttctttaccttggtagtaaatcttgtttttctatgatcataaaagtagacatacttactttaaaacatttacaagtatgagaagatagcaagaagagaataaatatcattcgcattcttaccacccagagattgccactatcaccattttggttcatgtcctcacagtcttttttttttttttttttcctatacatatattctttatcttctccaggagtttggagctttacaattcaaagtcttcttgtgcttaaattgattttctcaaaactttgccgatcatttatgtttccctaatcattaacatcaaaaatgaaaaggtacctgttttattacttctcatgggtgacaaagaaatttttagcatatttatttctcttcttctactgactgtcatatcccccaagcatgtggaacctagcagttccttaatataaatgttgaatcaatgaatgaatgacgacagtttatcctcatattactcccagggggtgagcatcagctcctgagactaacgccttccaccatcctttgctgcctctccctcgcagtgagactaagcctccctctgtccactgggtctgttctccctggttttccatggactgtgggcagtaaggggatgcaatggaaagggatcgccctttagagtcaaaggggccaaattctcaggtctaccaactactacataatgggacgagtgtcttcatctctctggcctcagagatgccaactgtacagtgggtggcagtgatacctgcctgtcaggatgagtgacaagtatgcaagatgcctagtacacaggagagatccaacgtctgcagctgctagtactttgcccactttctttctaatgacagcataaataaagagcccttggggccctagagcacttcctttctcttcacatttccagtcgtttcatctaatgagccataggaagatttctgatgagttacttgatgcttctgtgccaagtaaatcagagaaataaccaagaattgagtggcctttttaataatctgtttcttgtgcttcttctactgccatcgcacgtgcttccactgcagcaggtgtctggctgcattgtaattgtgtgttcacacagctgactcccccacgacacagtgaatgtgtcttgcatcttggtatcctcaacccgggacccacagtgctcataattgaggagttactcaatatatattgattgaatggatgaatgaataaatgaacaaatgaatagtatcgtattgtacacgtattgtccctatctcgaccacacacatggactttctgcaaaccatattgtagaattaaatcgtaagccttctgaacctgtgatgtaagcctctgacagacagacatataagtactggttctgcaaagtgcgagcttaagggaaaaaatgatatttccttttagttgccatgattaatccatggattcactggttcgcatgtgaggttctttagtggagtaggagtgacaatgtatgcatggtacagcttcttgtctgcagcttttagtttgagttagatgcgtgttggcatctctttcacacagaatctgaggagctggcatttatttttgacagcatctcaaatcttgtgaaagtcagagcttggggctggcattgttttttagtagtatctcagacggtggcaggacaaccttgatgataaaaaagaggcttaaacagatgtcttcttagagttcttccaaaaaactaaaagttcagcaaaaaaataataaaaaaaaaagcttctgaacttctagagcaaagacttctttgagcatcagctatttgcagactggccacaaataaacactcacaaacaaagtcatagggatttgtttccctctctaattcactacggtagtgattgctggttagtccccaaaacctgttttgtttatcttcctaggtacccagatagactacatttcccagtctctcttgcagttgtatgtgtggccatctgcctgagttctggtcaatgggatgtgagtagaaaggatgtgtgcacctctggtccaaccataaaagctttctaggttttcctccaagctcttctcttatccactggctgtctgggatggagtgaagtcccaaggtcaccttgaaagccacagttaaagatggcagagcctcttctgcctagggaaggccatttcatggaacaaaactgccagatctggagcccccaccctagacagttacataaacaagacataagctttcattattgagcaattacaagttaggagcaattcactaggtaacttatcctaccttaactaagtcatgctccttgggttttttttttaagcagccgatagttttcaaaggccttttatgtgcctggaattgtttgtgttactaatcctttcagtagccctgcaaagattccttattttacaccgatagatgcaactccaagtaggaaggggatgagcattttgtccaccactgtcaccccaggattggcacagagggtggcattgagtaggctctcaatgaggcttgttgatgatggataaaaggaaggttcaacaaggcgaagtcacatgcccagaccccatagctagaaaatgctgaactcactggcctcaaggtccagctgcctctgagtattggtaatccaagattttaaaaagaatgggtgaagggccagtgatggacacttagaaaaaaatgtttttgtctctttctgactgaaaaaagtaacacatatttaaaaataaaaacattatagatatctgaaacaaagacatgaatagtgctctgtaatattatcagagaaaactggtacatgcttggttttattctttaagttcttaacacacacacgtgtacacacatgctcactcaacaaaaattagttcatgttacatgtagaaaatatagaaaatctatattctctcctgccaaatgacttcttcacctatttttcccttaaatagtttccttggacatttttttccatgtcagaacagaccaacctgtgtcctcctttgcaaggactgggtaatatttggtgtaataatctgggataattaactaagccaattccctctcagttgacatttaggttgtttccagtcttcataacacaaaagagctgtgataaacctgcttgtgcatttatctttgggggagattcctgagagttaaatggtgcatacgctgatgggaatttttcactgtcttccacacatggagacctattttctgcagaaggtccagatggtcaacagatattgaaatggactcagtggagttcttcaagttaaggtaacaacagcagaaaaagggttttccaggatctcagaaggctgcagctatggcagtccatggcaaagactaacagcaaggaggcgccagcatcccaaattgagaggatggcaccttctggatattggctggtttctctgcattcccctggcaacgaagtcagcattatctggaaggtcagggctgatctgggcccaggatggacactgttccacactaagaagggaagcaagtctccttactgcgaagggggcagtggccagtaggacagagaaagagagagggaggaggatggtgcatagatgtcgctgcagggttcctgtcagggctggagctgaaggttgcaggacactcactccacagaaccaggcagaaacctgatgtgcccagacagcttttggggtgagcaggcagctccaggcagatgtctttgtttgcaggcacagctgcgtgcactctgagatgttcctgtccatgagggatgtttctggaatgatgatgatgatgatgatgacagtggctgtggttggcagcgggaagaaggaggtgattacccaaacagcgctggcattctaagagttggccctgagagggcaggggctgcctccactctgtgtgtttatgatcccttgtggtatgagcatgtgatgtgtgctttgcgtgtatgcaggtctgtgcagtgtgatgtggttgagtatgtgagtgtgccgtgtatatgatgtgtgatgtgtgcagtcccatgtgtgtgactgtgtgaggtgtgttgcagcagcagtgtgggacgtgagtgcatgtggtgttgcagggtggtgggcatggagtgtgtgtggatgtgattcaatgcatgagtgtgctgtgttttgtgtgtgtgtgtgtgtgtgtgtgtgctgtgtgtgtgtgtgtgtttgaggcggtcctgattaaattcccccaaactattcatgttgcgcaccaaagacctctgggctcatgttgagtttttccttctgtcttctctgtttcctgtggcaaaaatgccaacttcaccaagagaaccctctcaaacattttctccctaaggagaccaagctctaggcaagggcttaagtttccactggtcacagttagagaaagacagagagagacagtattctctagagctgtcctattttattttattattctttcaacttattgttatattagtctatcttacctttttatagaggtgtatatgtaacacatacagtaaagtcacagagtacacaaatcttatgtgctgatgggttttaagtgcatgtgtattcacccgtataatcataccccagatcaaaatagaatacagtcccagcaccctgaagagctcccttgagcccatttctagtcaatatctcccaaaggcaaacactattcttacttcggtatcggtagattagttgtgtctgctctagagtttcatatgaacaggatcatgcagtataggtagtctttttgtctggctgttttcacttagcataatgcttatgagattcatccatgttgttggttgtgtcagtagttccttcctttttattgctgtgtagtatcttattgtatggatgtattacagtttgtttatccattctcctgctgacggacatctgggtggtttccagttcagggctattgcaaataaagctgctacaaatattcttgaacatgtctttttgtgtccatatgtagatctgtcttaatgttgcctgtgatagcatttgacaaagatagagcttgcaaaaaataaccccctgccaaaaatcaaacaacaacaataacaaaacccccaacttaacccagcaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggtaagtggggatctttggtagggtcactggctgcttcaggatttgtgagctgtgttttgggctccaatgccaagatttcccattagaagccctgtaaggctgggtgcagacaacttctaaagatacccaatttacttttagggaactcagaccttgggaaaatccagcctgttgcccatccacaggatgtcagtaaggatttcagagagtgaagaaagagaaacaaacaggcttgcacctgcacactggtgggctttggtcttttgggtgtctgcagcagctcgctcttcgactgattatctctatagtggaagctatcttggctgacccctacctcctgggtactcacctccacctatctgtgtgctcacttcgaacccctgcagctctctcctccaagacttcagtactggccctggaagcatgcttagcccaggcacaggacaagcaagaggctctggagcatatgtcaccaggagcagccctcaactgatgatgcaatgtaactggaagacagatgccgctgttttctctccctcagtagggagaaacctgaggttaactcccagtgggacttagccccagttgctcatggcagtcagctgcttattaacgcatcctgaattgtttgccttcctttcctgcctcacttctctattgttccatgggtgctgcctgtggtccccttttacatacactgtatgcactcagatcttggtcacagggtctgcctttgggggaatccaaatttaaccatgctcctccccaaggaaaaatgctttctggcacatacactaattttgtctggggattttgcaaattccatgacactgtctgcatcgcctggtttggggttcagcaaggccttcgtcagatatctttgctgtggagaagcttgtgatcaggggccaactcaggggaggaccataataaatacagatggcccccaacttaacgatgttcaacttagaatttttttcacctttacaatggtgcagaagtcatactcgttcgctagaaattgtgcttcgaatacctgtacagccattctgtttttcacttttagtacagtattcaataaattactgagatagtcaacactgtattataaaatatgcttgctgttagattattttacccaacaataggataatataagtgttctgagcttacattagggttggctaggctacgctatgattttggtaggttaggtgtatgaaatgcatttttgactacaatattttcaacttatgacaggacataaccctatcgtaagtgaaggagcatctgtagtacttaattttcaagctacaatgagggcagacagcttggtcccattgctccctgtccttgtcactcccgatactgtttgtgcacgatagacatgtaactccaaaaagatgtgaggaaatggaatcatttaagatacaggggttgcaggggtgggagttgaggggtgggtattgttacttaaggtgattctcagatactctgtatctctgaggaaaatggcttatcataaaatacagtgtgaaaaggaaaagacaaaaattgtatctgtgccatgataggttgtttcctgtaaaaaataaaacaataaagttaaatagttttgatttgttgggggcataagagtcctgaatgaatttttccattttttctaatttttccaaaattcagttgtaacataagcatgaatatttttaaaagaattccaggatgaatctttttagggagaaaaaccataatgcacaaagcagtttgtccagtttccttttcatcttttcttggaggggtatttttccacataagaaagggaacagaggaaggaggtggggcttagggcagtaggatataattagctataacatttgatgatttgagtttgagtttgtggttctggggggataaacacacggacctatctcagtggggctggggtgatctgaaggcctacagcatttaaagagggcaagatgtcaaattgcagatacagatcttggttgatctgtgtggagggcacagctggtgcaggaagggctggggagcagggaatatgaaggcacagataaactcaggctatccaagagttgggaatggtagagggaggagtatggttttggttttgaaggattccctttggcctgtgcccttcattgcctggggcaaatttagaagcacacaagctgtttaagttacattctattaacctttccccagcggctgtatttgcctcgtctgatcccgcaccatgctacacacattttctaatcgttttactgtttcactgattgcagaattagaagcatccactgtctggtaaaagtaggtcagggaagttcctgacttcgctatgttactaatagatttctgaatggtagcgtatgggcgccttaatgtgacatttgagcggaagaacaatggtgatcactcactgacgattttgtgcttgaatcgttcttttctccaacatgaacacatgttggggaggtccccgagattacaggtgccagtgaaaagtaaatgaggcactgatatgttcatttgaaagcaaatcagtgcttttatctgggcctgatctctctaggcctccctcttcttgtggctctctgccattgcctttctcatcacaactctcctccctgagccaccaccataaaaaccttttctgtaacccctgccatatgaaatagtattacatacgcgacctctttccatcaacccaccgccttcccctcctgtaagctaccttggaatcccacctctcttctcttaccctgccttctcctcaacctcctttttcctcctgttgggtgttttattctcttcccatatgatccaagcttaaggatactgtgggcctcacagaatccatagaaaatgaaactgcattgccttataatcaactacgaaatccttaggttgtccccaggaaaaaagtaaagcgagtcaaattataaagacctagacgttgtcaaattcaccacatgggcattgctattgtcaagtaatgatttagataggcacgctgtgtgtatctcgcttgctgtcttctttaaaaaaaaaaacgaatcatttttgcttaaactacttcttccttctagctccagactatggtgatcataattatgtccgaccaaaacatattgcttgtgtgtgttcatgtttaattggaaaaatgacaacagtgatttctttgaagtctcatactcacccagagctaccctgccagtgggtgttctagtatccagaatttcttagaggaggaggaagaataaatcaccataaaatgatacaataaagtcttttaaaataacaaccaggtagtaaattaacatatacacgacctttgaaatgattatgtatggggaagttgaatccagcaaacagctggctgggtgcctgcctttgactaataggctgagagatacagctgctagaaagatatttgagagtaagccctaaatgcagaaatcttttattaaaaaaaaaatcagcttcctcatttgacaaactctaatttcattgggattgacagcattgcctttgtcgagcatacatttaacaaatgagattgaacaaccaccccactcagttttatctaatttaatttgacagccaaagcaggtaggtagaataatgtacttacagaggaggtaagaatgttttccccagggttaaatgacatgcctgacatggcttgctggatcaagctcaaagcaagtatctcccccattgcttttgtatttttgttttgttttactttttaaattgaggtataaagtaagtaaagcgagttcatcttaaatatacaagttgataaatttttgcctatgtgtacgttcatataaccaccacccaaatcaagacatagaacatttccatccctgcaaaacattcacttcccaatcattatttttctcttcttctggctcaaggtaaccactactctgacttctaacagcaaagatcagttttgtttgcttttgaacttcagttttgttttgtttctgagacagagtctcactctgtcacccaggctggagtgcagtggcatgatctcagcttactgcaaccttcacctcccgggttcaagtgattctcctgcctgagcgtcctgagtagctgggattacaggcgcacaccaccatggctggctaatttttgaatttttagtagcgacagggtttcaccacattggccagcctggtctcgaactcctggcctcaagtgatctgcctgcctcagcctcccatagtgctgagattacaggcctgagccaccatgcccagcccgaaattcatatgaagtgtatcagacagtatgtacttctgtgtctggtttcttttacgcagtgtaaatattcaagattcatccatgttgttgcattgtatcagtaattcattctgttattgctctgtaatattccattatatgaatataagactgtttatgtattattgatggacatttgggttgggttgtttttggcttttcccttgccttcagttttatgttttctggatagtctatagaagggcatcctagaaataagcaagaatgatgtgcccgtgggtgaacttgtttccaactggtggcaaaatccactcaccactgcataaacaagcgttctggatcctgagtggcaagactgtcttgggttatctttcccttaagactcaagtgagcttcatgttcccttatcacatccccagcataattgtggggtaaggagggacctcagcgcctagcctccattaaccctaatatgggagaaaagaaggtgagctttagaaaccgacaggcagggggacctggggtgggtttgcaggtggccaggaaaggagagcagcagtttttcatctggagtgcacaggtatctggcatcacgcccacctttgggcagactcagggacacagcttaaattggggcatctctcctgatcattctgacacctgcccattttctgaatctgggaaataaagtaaccattattgcctctcataaagaagctgaccaggcagtgtggctaaggtagtcatttgtcgttgggcagaaactgggcacaaagggatgtcaccttagaaggctgccccctccctccagctgatgggtgaggcgagcagctgtatgtacaggtgcgacagggttgggaactactgggaggcgagggtgggtctgcaacctggatctggtggtgcagaaacgaaaagagatcagttgtttaaaccttcccggtttgcctgggactgccctggtttaagtgctgaaagttccagggcctgggaagcccctcagtcctgggcaaaccaggacaattggtcaccctacaagagggagcccttttcactctgttatcagtgcatttcagttaataaatattattagccttctattacagaccatgcaccttgcaaggtttgggggatagattggtaacaacaagacagtggtgatctctgcccctccttctggagtacttcctatagcaagaaaggtaggatttaaacaagtgattacaatacagtgcaatgcttgctttgattagagacaataaggcaatgagtgctttaattgggaaaattctggaagctctggaagcaggtgggaaagacaatccactacaagttcatgatttccttagcatatccacaaagttctagggctgctcagaaaagccatttgcagcaaactctgatgcactcataacagctatcaacaaagagggtggaggatgataaggaaatagacagatttaggtctattgatgtaatccctttgtgctgcttacattcccaacacgtagccacatttcttctcccacttcgacagtccttactggctggtgcaaaacattcagtgtgtagtgaacaggagtccttggcattgtccgtgcccataaattcagagtgacaagcatgccttggaaaaccttcttcaagttttcagatcatgtagataaaatggggagaggggtgaagatgatgttctggggttaataattcagtatgtttgtaaacagggctccagggtggaaaacttagtgccagattttctgcgtgttgttttacaacagaacagcatgtacttgtaagtatctaaaactaatggacatgtactcttgcctaagaggcccagttattgttttttgttttttgtttttttaaaaaaaagctttttaatgtactagaaatatatggcagctgttgtaagagctgaaaggcccgcccaatgcaggttgacagatgtccatatatccatattatatattaaaaataccccctgaatattttactttctaccagctatcacacagatccaataaaacaaaacaaatctcccagaactgaagcccttatctccatggaaaagtccaaacatttattccagtatcagagacacagccaaacaagatgtgtctcgaattttagagtccctttcttgccttcctcagcccagagggtgccagtgatgtttgtgtaaggtatgtccttttatggatgtttgtagaaaagatgaggatggatggtttttctagaggatagttctcattgttttcatcatgtgttagaaatagcacagatacattgggtcaatttctttttcttctttctctacctttatcatcattcaattaaaacaaagatactcacaaactattatttttctatcatatgggaatcaatgcccaacttacctgttctgagtactgaccctttggaggttcccaactattatgcagctttttctagcctagcttgtgacaggttgtggaggtataacacccccccacacacaccccagatgacctctgagctttcctttgcaaggaagcaataatggagacttatccatgagggatgaagtgcctcttcccttcacagtttgaccatgccttcctttgtagcttgttcagctcggcttgtcctgatttatgtttttttgccatctggtttatttctcttgttgttttgtattgttttaagtgtgctccaggccatctttaactgagtctttaaaaaaaaaaacaacaacaaaaaaaaaacaaatcataggagtgtcatttgaaggttagggatgaaagagaagtttaaaatgggactctgatcttccctgcaaagtccagtagctaaaaataaagttccttttactttgctgattatgtaatagaacacgttctcagatgtgaatgctatggaatgtcacagttgttcagagaatatttttttgggttttcctaaatggaggtgcaagagttctctcaaataattgaattcattcagttagctgttgaggacctactgtgtgcaagccactttgctagacactattgtggaccactttgtgatgctgatgagctgtaaccagaggcagtacttgcctttcctttggtctaacctcagttttcattctattacaccatataactctttctaaagaaaaaatgatgtgcgagggaagtggagagggagttattttgcaaaaggaaaggatagagttgggcaagggcagtgtttgtttgaaaaggggaaggttctctctgggtactgggtgctgtctgtgttctgggaagccatgaaatatcagtgacctggataactatgtttaaaccatgttcttattaaaaccagcagtcctggcttacccagacaaagaaattctgaaacaattttggaaatacattcacaagagtggaattcataaatggaactgtacagccatcagctgcactgtttagacataaagttggatgagcaaagggggaattttacaagtatggattcaaagcttttaaatgaacttgcctaattggtagtagtgatgtagagcatcttgctggaaggaaaacaaatctcatatctaaaaatgttctcttagatgtaaaagcaaatgcagcctcaaacaatgcttgcgaaacatcttggttaaggattttggaagagatttaaggatcatgggttgttgcctggcacttggtgaactgctccacacaatttagaaaccctgtcaagaggttcctaaatccagctgaccttagaatcacctggggagagtttagaacttgtacatttctggaccccattagatgcatgaggttgggctcttgggagtcagatggagaatctgtgagctcagagggatccccaggtgatttcaatcattagccctgttttgagaactgctagcctaatccatttctctggacagcatcctatccacaccattacagaccttttttttttttttttttttttccatacagatggccatgaaatcacatctcagcacatgcctttgactctggattgcacatgtattcattagctgaagcccaattttaaaatccaatcaactctatgattccttgaaatgactgcaaatcaagtcacatccagtgctcctcaggtttatttttgttcattattattctactgagtgctcaggacattctactgctcctgagttggtgagctagaggcataaatagcttttggatccctcgggtgtcgagatggttaaaaggataaatggtgataagtgaataaaagggtgaacattggcaagtgaacaaacaaaaatttgataaggctctactctaagccacatgcagtgtgaggcccttgacggcctcccccaccaaccctcccagtatctttatgggggtgtctcaaaccccgttttacacatgggaaaagcggagtgataatcccaggccacaaagctcagggacagagccagcaatcaagcctgggccttctgggtttaccataccacgtaattcccccactcgctcccatcctaaatctgatcctgagttttcttcattttatcatccataaagagcattctaaattctcttgtgctctgccctggggtccagcttgggctcatcaaggtccgcttacttctccagagatccccataatctatttggaggagtagcacagttctactctgatttggcatgttttagaggaatcaaaggtagggccattcatttttgaattatacataggtttcccttcatctctagaatgtaattaggcaaaagggcttgaggaataccaaatgccaagccaagagcattaagaagctgccaaaggaagcgggtattagcaacctctgttatgtgccatgtgggccagagctgttcttagcttctcggcaggagggagaggctgtggttccaggaatcaggagagagagggaggcaagcaggaaggtctttgcctcttccctgcagattttgtagtggagcagctggcatttctcggtgattcacagatgggcctgcctttgatggccttaccacctttcttattaattttctgataggtagtctctggaccaagaccagggtgacccacccgtagcactactaccatttgggaccagattattttgtgctgcgggggcctgtcccatggcttgtaggatgtttagcagcatccatgacctctacccactcagtaccagtagaacctccccacctcccacaagttagggacaaccaaaaatgtccctatacattgccaaatgtcctcttggcaacagggacagaattgtaccaggtttagaattgctggcctagaactatagtagaaacatgaagggaaaaagagatctcctgcaggggtagggatactgggttggaaatggacccccaagcttcaacctccccaccttccctcagcctgcagaggtggcaccaaaaagtggtatatgaagtatgtgagacttaacccagcgatctcttaaagggtaaatacccacttgccccattcacccttttcccatgctgccatcccacccacctgttcttggtacatggtgctggtgctgtggcagtagacactcttgatagcttgggctggtggttaagagcatagattctggagccaaggctacaataagttcacgttccagctctgcaactgagtagcaagttccctgttctttgcatgcctcagtttctgcatctttaaagtagtaataataacagcatctctcttttgggggtgtttgtgaggcttgaatatttgtaaacatttagaagagtacctggcactgtgtatacacagtaagcactgtgtataaaagtgtattgtaaataaaacataaatagtattgtgaagaagttctgttaaatacagccactcaacaaatgtttattggttgtcgaacaaggccccacccctaccctcctggaactcagagtttggttatgggccaacagtaacttgggcggggttctgagccatgattctgtgtggcctgcaaggggatcacagagtttactccctccctctctgcactaagggctgctgtagaagcagagcccactgccctggccatgctcttctatgtagtctcaaagtcaagttctccatatcccagtgggcaggccatctggccttagctccccaatgcagtgcctcttactcatcataagtcaaatgctgctttactctgcatcaactgaacattccatgtgacaatgactcaactctctatatcttcagctgtagccaaaataaatggaatctatgcattagtttgttttcacattgctataaagaactactcgagactgggtaatttataaaggaaagagatttcattgactcacagttccacatgactggggaggtctcaggaaacttacaattatggtggaaggcaagggggaagcaaggcacatcttacatggcaggaaagagagagcatgaggggggaagtgtcacaattttaaaccatcagatcttgtgagaactcactcactatcacggaaaccagccccgtgacccaagcacttcccaccaggtccctcccttgacatgtggggattacaattctaaatgagatttgggtggggacacagagccaaaccatatcaattcactattcaatatttggtagcacctctgtaatgaatttgaggtatatcagtctttggacacactagttgggaacattgtcctccctccttcactctcttgctccctccctcccttccttcctccctccaaataaatattcattgagcattgtctatgaaccaggtattattctgggtgctgggtgaggtctctgctcctagagacccaacattccaggttaagtagaagagacagactataaacagaaaacaaaggaaaaaaaaagatagcttgcaaatgtgataggtgctgaaggaaagacacaccgagactgatatgagagaggaaaactgggatggaggtggtgactgttccaaatggtcatagaaccttctctatctaagaaggctgttctgatttgagacttagctgagaaggaaccagttgtgagaagggcattccaagccaaggaaatggccagtacaaaggccctgaggcaggaaagagtttggtaccttcttggaatgggttaaagtggggccagatcagatagggctttgtagggcttggcttttattttaaagtacaatgagatgccttggagagttttatgcagacaaataaaactatttgatttatgttttaaaagaaggagggaatagtcactgtgtcaaacactgctgagatgagtaagatgagggccaagagaatctctcagtggatctggccacatggaggtcaacgtgacctctgtggagaagtagagggcagctgttctctttgccttttggttttagaacatatggtttcaccaaggaataggcacttgtatttgaagggatcaataattcaataacatttcttaatactgctttggtcagttttcagggaattacttggttttattctttcttcagtaagacttactgtaatggtcacaatgatgtttgtagtggtgatgtcatccttggtatctaagacatcactacctgcccaccatcaacccccttgatgatttcccagtgtgggacagtaccagcccagccacacatgcacagcccctggaactctgtgacattcatgacccatgttcattgcagaatggctggctgaggccaagggctgcctgtgactcaggagaactatctaggccctttataaatgggccaggcagggcacagagggttgacctcagccttctcagtgccatgttctcatggttgtcccctatgtggcttttcacttccaaagtccatccagccccttaaccttgcctgaacttttaagcccaagaatggcagaaaatccctcagaataaatccttaaagaggcatttgacagagcatatagaaacttacacttggtaaaaagtgaccatagaaaaaatctgtttagcacaagcttaaatattactgtgctttttatgcggtctcccgcagcattttggaaccgggccatttttcctgagtgatcgtttcctttgatttttttccccccactgctttgattttgtaacacaagaataatattttttctggaccaaatttcttataagtggtcttgcccagggaatgatgattctattttctcttaagtaccaagaagtacatacacatacaagcacatttaatagcttcagatgggatggtttgactgtcaaaggcatatttgcaaaattctgttcctgttgattccagcccctgattcaaagccccaccattataatgctgttgcagacacagtggagaaagcccttcatcacctgcacggtagatgcaggctgttcttcctctcttgaggagcaagccctgagtcttgatgaatggattccctctaatgtgtaatgccttcaagatggactcaaaggtaaatccatcccatttgcagaaagggaaggttcctaacttccccaagttaataaccatctgcagtgttggacaaggcttcaaattgctgacacctttgttcataccagctggcaagattgggtcacataattaaccacacaggggcacattttgcagttaactcatcctaggggggctgctctgctcaaaatcagacattggactctgccttactgtgattttttttaaaggcctaactgactggctggcaggactttcctgtcagctttctcctacctagaagagtctctttcatgcttaggccactgaattctggagtctgcactgagttcttaactgaaagtctgtgcaaatcccaaatcctaatgaaagaaaaaggtatggtccttgtctgagggtgcccctctctcgcctccccgtggaaatgggattgcaagagcaccattgccctagagtgtctactcttcacttctatagcccttggatctccctttaatcagcgctgcaggcacttgggagaaaatccagctagggcctgcatttccttgaggtgattccaaaaagtagattttctaggtcagtggatatgaatgattttaaattgccctctagaaagtttttaaccaatttacttccttatttgcagacatttgctatgcagctgtattcgtttgtttcttcgttcgttcattcattcgtttatctatttattcatctattcattcacttattgattcagcaccaagactgtataccaggcactgtggacctgtaaacaaatattaattgattcctgccctgggtggggcttggtgggttttctctttgtctctttgaagagaattgagattgtgtctgggcctcctgaagactggccaggataagctatccatttacgtagtggtgaacggggatccagacttgggaggagggttgctcacccctggctgcacatcagaaccacctggggagctctaaacaaatcctgatgcccaggcccaaccatggatgattttgatttcactggccttgggtgtggcctgggaatctgggtcgttcaaacgagatttggtgggttcagggtggtatggctgtagacttatctgggtctttcaaagctacctgatcaaagtctcttgtgcagctagagttgattgtccctctccaccctttatcctagagagtctagcctgatgaaaatcctgcatcaggtccccaccacctctgctcttgaccttacacttgtcactttagacttgatgatagttactgttccaccgcacatcttgcctactgtgggccatgggaggccagcaccatgccaggcttatgtttgaatagactgaccattgccatggaaaagctgctgagaagaaaaaccatccctcttttcatcttatgtattgtttatttatagtttcaaatataatcctcgccttatttatttaggattccacagtgaagctcatttggctccctatcttttgttataataacaatagctaacccctactgagtatttaccatgtgccaggaactgtttcaagcatcttgcacatgtgaactcacctacccttcttaacaaccctgcggcatatacactgtcatcactcccattttacagatgaggaaactgaggcatagagaggctaaaggagtttgtcagtgttcacacagccagtcagtggctgagttgggcatctacatctcatttcatttaagtgaggcctcttctttacaagtcggaaggacttctcttggatttattatgcctttgcattgtattttctttctcaaaacagaacttcaggggacgagtgagtgtacacctatgagatctatcagcatccctatgctctcacagtggcagagtggcttaggacagagagcttaggaagagaatcattcaacagcttgagtcactttcgttgcatccattggaccaagttgtcttgatcttgtggagacataagtaactaaaagtagacggttcttacctgtgccaagggcaggcaggaccctctgcagttagcactctcacatctgcatacttttagaattgtcctcataagaaaaaggagagactgagaaaagcctagccatgattcagaaacagcctgaattcatctgtctttgaaagtacctagaacttctcctctgctcattcttctgggagaaatcagaggctctcggaagtcagtaattgtgatctcttgagtcataatttctgcagttgtatcagagcctaatgtggggatgcaagatggaaacagcacatggggctgttgccatagacgaggcagagagtggaggggctgaaatctcctggaaggaagggattagctgcccaaagaagaaaacagatttgagaaatccatttaccctgaaggtttaatagggaatgcaggtcagacttactcaaatgtctttagtcacgggtctctctcctgtttttatcttgtacccagctcagagtttcaaaagagagggggtaagtgaacctttaaaccccgacgttaatatttacatccacaatattaggaataagaattcttgtcatctattgaactgaaggaatggtattaaaataaatgtaaaattattaatcgtatatttctcagctattaagacaaactcttgcttgtgcttgtatgatcataacacccaactcagatttctaagaatgtcactagcatgtgtttggtttttctctaaagaattaatattgcctatgataagaaaataatttggaaatattcacatggatttttgacatggccctaaggaattagccattaaagaatttcagaatcctaattagtcttcaaataatcttttgcatggtaaagatcttctgcttggaagaacactatttcaatatactgtttgtcacttcattacctgaaagctgcttggaggcattttgtggaatgaaaatcatttgagggcccagagggtcaacacaaaggtgcacagagccttgaattctaaccgtaaccctgcccctacctagatgcgtggcctaggccaagtcaccttttctgagcctttgtttccccagctacaaaatgagttgtactagtctttgtaaaaatggaaattagaaagccatatgtcatctatcccctgcctttctttcctaccactctgaaatttgttagctcctctcctccccttctccaacctctctctctcgcggtctctctctctctctcttacacacacacacaaacacacacacacacctccttagagtgctggaatgtcattttgccatgatgccatggtgtctcctttcctttttcagatctttgctcaacaagaggccttccctgatcaccctcttcaaagcaggcccttccccacaccctgctccctgtcactctcagtccacttactctgattgactttcttcttagtgcctagcaccatcagaaagtataagaagacaacatggtgctggcacaggggtggacagagggactgatgaaatagactggaaagtccagcgacagacctacatgttgttgagtcgggggacagttcacacgtttattttattattttaaattggataatattaaaaagaaacaatttttagaataaaaccaaaaaagtggaccatgtatagaacattgtcatgatccaaggataatgattatgcaaattcggtacacttcggatccaaaaattaaaaagaaaaaaagaatgctaatttaaggttgggcacagtggctcacgcctatagtcccagctacttgggaggctaaggtgggaggatttcttgagcctaggagttggaggctacagtgagctatgattgccccactgccctccagcctgggtgacagagtcagaccctgtctctaaatgtctctatttttttttttttttacaaaagaatgctgatttggctggagaggattccttcttcagctgagaggttggcatagacaatctgcaaagacccttggagcccaaatatgattctgtgttcagcattcactaggcttcaggcagtttctactttgccagtagtaggtgtcattttccccattttgcaggcaaggaaactgcagctcagagaggccgagtcactttcccaaggccacacagttcttaagaggtcagaaccaggatatgtgtgcaggcttgactcacaagctcattcctgtgccatagagcacaagcttctgctggctatttgaaggtgtatgggtgtgactttggccagcctcttactagggaaatagaatattcctctccagcatgcaaaataggaggcctttgcctttaaggaacttctgactttccacttcagtcggagcttttatgggtgccgcatcccagagacccacagaggaggtctcagtagcagcactttgaagtctctcccacagggccccctcagttgagcacaattgttgtccaaagaccaacacattttggctcttgcttgccttaatactccctctccgttcccaaatacaaaaacattggcatttcttggaaagtggttttggctcaaagcctgctatctatcccacactctcaagccagcttcctcagggcccctgttgctttatttcattgagtgtttgtgtttgggggctgatgttgctgcctcctttgtaaggggcctcctggcaggtgcccagagaagtgtcctcaccagctaaccaacagtcttcactgcagctcccctctccacactgggctcagtagtggtgaaaacccacaatgcacacatgcagaaccactgagggtttttctcctttctgtggttattcaatagtatttttaatatctcttttcttgaatcaagggataattaacctaaattcataagtggtcagatggatacattttgtacacacctttgtaaccacctgaaagaggctataaaacagtcttgtcaccccagaaaaggcccttcaggctcctttccaattcattccctctcctccctccctggagcaaccactttctgatttctagcattgtaagtatttttgcctgtttttcgactttgcgtcaatgaaatcttacagcatgtgcacttttgtatctggcttccttccttcaacatggtggttttgagatgcaattgtgccattacctgtagcagcagtgcattgctttttattgctgagtagtattccacagtttgggtgtggcatttacctgttgaccaacatttaggttgcttccattttgtggttctcatgaataggactgcaatgaacatctgagtacaagtcttttatgaatataggttttcatttcttttgggagaatacccaggagtggaatggctgacaacagggcaggtagttactgaacttttctagaaggtgtgagacagttctccaaagtggtggtgccattgaccagtggtggacaatcgtttcacttgcaccatagcctcaccaacttttggtgtttctagtcttttaaatgtttagctgttgtaatggatgagatatggttgcttagttgttttttaaggacattttaaagaattttccagcatgtcagtcaatgccagctcagacactgaaaaggtcccataggagggaaaccaggtgttaaatgtttagggacaggaggtttctactaatcatccctgtccctaaagcagagtctttccagccctgagggctgtctgtgggctgcctcagggcaagctcaaggccgaagccctagagcggggaactagggaaggggaaggaggccagcaagagagtcagagtggagaagaggagggcccctgcgcagggaacactctgaatcacactgtgatagccacaggacaagtctcagggcaaatggtgtggcacgccacacagacactgatcgtctaacgtgtaagcagccggcaggcacagaacagcccgtgagcctgctcagggagtcccagccggcttgtcctctcagctgctctgaccattcaaggcagatatgacaacatttccgaggcagaattttgttaccgtctatttggcataggcaactggaaatcctccaaaatccagttgccaggcatggaaccagttaggtggcaagcatcagaaccattgggagccatccctggaagtgccagctatgggctttcctggattctccaaccatgtcctcacaagcgtgaagcctgcctctaaaatatttcagccaatccgtatatcttgaaattgagtattatgaattttaccctttttaaaaatagccatcatgctaaagagcaagccatcaatttcaccacttaaaaaaaaaacacacatttctagcattcctggtgctcttgagtattgatggagatgaagagataactggaactccagtagcagcctcaggatgggagcttccagattagaacttgagcttcccctccatggggtgtgcacttgctagcagaatggtggctaactgggttaggggttcacctaagtcagacagaaaatgtcccactgtaggtgccagtgtattttaagttacagacaccatagccctgagtcatgtacctctggagccagagagcttaggcctagggagaattttatcaaccttggtttagggggtgggaggctgggttcaagtcagctctgacgtttattgcagggcttgaggtgggtctggggttcttgatctataaaataggggcaatctctgcttacctcctcaggtggttgtgaaggttacagaagatacttggatgggccctttgcacacaagagcccccatggtgtcagtttggtcactccaagatggcaaggacccagtgtgtttagaaccagcatttgggagaagaacccagtgcaggaggaggatgcttttgaatgggcagtctttgcctagaaaatcaattatatagggcaccaagggagaaagctggccctaggttcttgagccatagatgctaactctcctaaaggactatctacagggacctttcctatagaaaatccagtgtggggagaaggtagaaatccaggcctccctgctctgcaaaccagcaaaccatcaaagggtacaaggagataagggggttgcagtcctagcagattcctctggcgagaagccaggtgtgccaacttcccaggtatgtttgcctgtgttgtgccagggacctgctgcttctccctcccacaacccccaccttctcacatgggtgagggccacctgagcagctgtggggctccagggagtgaagctgctgaaaaccctgccttttcctgctccctggaggcagctcccttatccctgccagctctgtgaatgccaatgaaacagactctttcagtggatatttatgcagttacagagcaaagaatggtcctgaccccatgtaaatacactgattcaagtcaggaagagcagccaagggtgttcagtgaatttactgcagaaaagctagcacgtggaagcttggaattgggctgtgagtacttgggctgcttctaaggttctggtttgaaagccactggtatgaaagccagtgggttctggggtgctctgagcttggtggaagtaaaagagtgggagctcccaacaagcagagagaagcctgcctgcccccagcactgtgcacagggtgggtcccaggaagctctgcattacttaaggtaatgctagctttgcttactgacacattgcaagagtaccgtggctcaaacacaatagaagttgatttctcactcacttaaagccccaaatggtttttcctgatggcaggcggcccttccccctgcaagccgtgattcaggcatgcaggcccttccatcctgtggctccactatcttcaacagggagcttctaaaaggtccttttgcatcaagctgaggggaaggggaaaagggttggagcatcacatgtggaaggaagctttgtaggatccaggcctggaagtggtgcccctcactttcaactcacgttccctttgctagaactcaggcacatggccacacccaactgcaagggaggctggaaaatgtagtccaggaagaagatgagatgggtttggtgaacagctggccagtcagccacagatgaaatatttctgggaagcacgggaatgaacccctgcctgggatgcaagctggaccagaggcatgggaagtgagaattgagctccaaaaagaaaagggagcacctatttcaagctgtgtccttcatgggccaatattcgctagctgcagtggtaatggtggagagggaagtccaagcagggctgggccaagacagcaaagctaggcagacctgcctgaggtgcagatgcaggctgagaaatcctaggttctggtcagagaccgaagacatctctacttcttccttcctgcctttctctactcccacctgctctctgcacgcaaccaggaacctttgctcctttgctgtctctcttccatctcctccagaagtgccttccctgcagtgaacgttgtgcatgttctggaaagctctgaccctccctcccatcaaaacaaccattcccggggattcacagctcagttcctgggggtggggagttggcgggatgggaagcaacaatccaacaaacccagtcacaccaaggtggtaccagtctgctggggatgcttagaaactgagatgagaaaataaatgtgaaatacctagtggggagcatggtaaatgcttagtaaatggtttattatcaacttgtcagtgtgcgtgtgagagggagtaagtgggggtggggggaagagagagagagagagagaaagaaaaagaatgaaagaaagaaagaaagaacaagaaagaggaggaggaggaggaggaggagctagcaaagccctgcaaattaaacggttttatcttttcctcccaacctaatggctcactagtgaattgatggcttcctgctcgtcagggcctgagagaacatcaagattgtgtcggttgagttgtcagtcctttagggcacaaggttaattgatgggtgattctgaacaccctttaaaagagctactaggttggtgcaaaattaattgcagtttttaccattgaaaggaatggcaaaaaccgcaattacttttgcatgaacctaatagataacccctctaatgtttgaagcactcttgactctccgctaagcctcaccagccctgggcttcaggcacctaacctactagcctgccccagacacacctgtcctcttctgcctttccttctgtcctgcacttttggaaaaccctcctccattccaccatctcctgcgccaaaatcctactcatgtggcaaggtccagttcacaggtcagctgcaacaataaagatttgatgactggaattcagagggaaaaaaatacctgaggtggaacaggtgaggagggagaatcctgatttaaggatcccccttgactattagagggacaacaggtggcttcactcctacttggccactctgtgtgtgtgtgtgtgtgtgtgtgtgtgtgtgtgtgtgtgcacgtgtgcacatgtatgtgtgcaaacacatgcattctggaactcttcccccaataaaataggaaataatacctataatcgttattgctaactagccagatgttatacagccgatctttttccttcccccaccccaacttcgtattgtttatgctatattagctccaaccatgatacttgctttaggacacatacagtgagtttttagggacttcaaaagcctcaccaaccctaagattctgcggaggatgttgttctgcttttgacaaaacagaattccagaaagaagcttccctgtctaaaagatgagtactcttcaccctctctttcctgcattgtctgtacttctcgggtcgaggttattattattattattattattattattaggcagcatgcagctgatgaagtgaagtagtgtttatttattgatttttggtccccgagttggaacacaagatcaccagaaaagaaactccctctgtgactcatcccaggaacatcttgcattccagccagcacaaatatgattcaaagaactttctggagggccccagttatattttagcaaaggaacacattagctatgctgaccatctcttgaacgttttgcttttggaaagatagtcatctctggccccctcgtgtgtcttgttttttttataagatcttgagtcacaccccttttgagctgattcccctgtagtgtgagcattgttattataaaggagtgtcttcttcacaggggttacagaaggtaccaccaactggggaaacatttggtcatggtggcctaaattaatgacatttcgatattcacataagcattgagactttccaggccatggctggtgtagcagacatttgtcggtgtcctgccatttcctgcccagactggcctcttatacaccaaatgctacttactgcaaacatccatgatgctccctaaaggtgtgagtttttggtttttggtttttgtctcaggagcacactagatctgcatgctgggctagctggaagtgccaaggaatgactacatcctccaggagcagcccttggccagtgatggatgggggcgggtgaataaacagcccaacttcctagcctctcggttgagatgactctgaggtctccccagtggaattgagcttcagttgcccacagtggtaacttgtttgataaattggcttccttgctttccctgtctcaccacttcactcctctactggtgttgtctgggatcttctcccaaataaattactttcagttaatccttgcctcagggtctgtttgtgggggagcccaagctaagacaactagctagttgagttcaccaaaacccaacagcctcctctcttcactccccttgccctgttcatcaccatcgttagtaatgattcaaagcacataataggtgatggtcatgaagttgccattgtggctgtagcgctgcagtagggtgttgtgcatgggagtgcagtcctttgagagccctaacttctgcatggaaacctggtaagacagaaaccagcgtttcaggaggtagccagttcagtaacagggccctggacaactttggatgctgctaaaatctctgcaccagggaggcacgtactcaggaggttcatgttgggtgagcaataagtgtttgctgattgtgtctgtaaaggaatgaataattgactcacattcatgtccttccttagttctgagtgcttaagggtcaaggtcacgcccctgccccctttatttgatctcaggtgccttccaatgggccccgcaaacttaatcatagttgtcggttcttatctctatggagagatttcaagacagctaggaaggttcctccccatgaccagtatctgaaatgactcaattatagtttcatttctttgtccatagctttattactggctggattatctttattataccaataaaggaacataatacttcagccttatcagtcatgcacctcattgagaatgagtttatcagcttctttctggaaaacccaattttgatgggagaaatctaataattctgactatccaaggagagattggaggagctggcgggtaggcaaaaataaatattagacacagaaagaaggtacatttagatttttttcctgggactgataactcagccaagccacaaggggatgtgcttgatgattttagaggcataggagaagttctgcccaaatttggagcaccttccctaagtacttgcagtactcagacttgtaaacaatgctatattttattttttttaccatgtcctcactgtgctaagaagttccagtcctgtctctccctccaccctgctgtcctgcaaccaagctattgtaggttacagcatccccttgtggccagctaagtaactctcattcagtgttttcctcacagctttcctcagtttctctgtgttctttcactcttctgttatagctaaccaatctttcctttggacctacatgaacttttgaatcttctctccttcgactcttgcctagttacctcaaaaaggctctttgctttctctctccctcttatccttaccctcatcctctccgcttccacttcttccatgtttttgtgagtgagaaaatgagcttcatcgccactgaaaagtaggagaggagagctacttaagctctcgtgcaaaggagaaggaaaactgaaggatatgaagtgaaattatgtgcggtcaatcagcagtaacttccgaacccttgaaagtgctcatgagtccatattcaagatacaaaaggttctggccaccttttctttctcccccaggctttcagtctgaatgagaaacagatttgtgtatttatttgtcttcccactatatttaatttctaacattgggagagcattgttttctgttttcacttcaaatgctcatttcagctatgttgggtgttaggtgggtttttgtgggctggcctggaaaccttcccgtcaggtgtaacaccaagcttatggtaagtgccttcttagttcctagtagctgatttttacatgaatctttgaacaaacagggttgcgaatgaataaagccattcaggtgcaaagggagcatgggtgatactactcaagatgctcacaagaaatatggccggtggatctgatgatgccaatgatgccaatggcacaatgatgatgatggcactgacaatgagaatgatggtgaagatgaagactgtatcgacagtgctgacaacaataatgctaatgacattgatgatggtaccagtgatgatgatgacaatacaataattgccatgatttactgagcactttctgtgtgtcaggcactgtgccaagtacttcacttagcttatctcctttaatcattacaaccacccaatgtgacaggtttttttttttaatcattttacacagagagaaactgaggctgagaacttacttgccccaggtcacacagctagcaaaattaggcagagctgaagtttgaacctaggcctgtctaagttcaaagcttatactcctaaccactctcatagggggcccagggcccagggtgaggctgacactgtctccatgccaaagggtggcaagggattcacatgcattagaagaaggggaaaatctgaactccagttctttgtacttcagaaatctgcaccccttccttccagtgacccctcagagggtctatttctggcacactggtctctggaaaatgtcctgctaatgacacaggattataaacagtctttttcccagaacaaaaatttaacctttgtatctcaatctaattagaagtattttctcttccagaggcaggttttttcctcctctttgttccaaatttaagaggtttctttgttgccagaaaaatgtccaaaaaccgtagctctttaagatgatagaccttggcccaagaccttaaacgtgacctgagctcctgcatgagatggctgttccagcagcagcacctgagggtgcttggggttctgggtgtccaaccgaactgtagggcattggcccaatgcagggatgggcacttgctgactctcacagtcccctgtccaggtgagtgttccctaccaccaccagcagctctttatgattttcttctgtgatgctgaggtttgccaagacctgaggaaggcagttcattcctgttagtatcaggagcagccatctctagaaaatatacatttgttcctttccttagagagatccttgcatgaatatcaccccttccagctgtctagggactggcattcttaccttagagacttactcctttacctctgcaggaaatgtgagccttaaaggagccctgttaaaagcagataatcctgggataatatggatttggttaatatcttcagaatggagccaagagagatggcaacctgcctacaaagaaagtggtatcaggttggaggaataagagatgcatgcctggcacacagtaggtgcccacatcatttttgaaagaatgaataaaaatgaatggccacaaatctagttccatactgtagccctgcagtcaggcccgtgtgggcccccaaacccatcatagatcctttgcgggcaggctgaaggtagtaggggcttggaaaaccaggcctgggagctggtggcgtcctccctccaattcctccttggtgctcccacttgcccatcctttggggcccacagcaattcctcctccggcagctcctgggaggctaggtttgactcctccccagcaggcaccactggctccaaggaggcctgagtgagagtagggcagtcccccatgttacaaaagaggaaactgagtcccagatgtataaaacaacattccaacagtcatgaaaagttcatgtgtgtcctgaatctcttcatttcaatgacttatcttttggatatcactgagtcaaggcatgggggtgttctttttttgagcaagctcctcacctgtcaaactttttgacattttgttggttgaataaagccatcccacatactttggcgttagatgctggttccaatagagatgttctaatcttgggtgactgactgtgctgactctatagctcgtgtgttaaactcaagtgctcctcaacatcctttgaaatgtgaaacagaggcaacaggtggggtaatgtgcctttaaggaaggagaacgggtctgggagtcagtgtactctatgctgtgtgaacttgagcaagtcacttctcctctgagcctcaggttcctgttcttcaaaacaagaggggtggggccgggcacggtggctcatgcctgtaatcccagcactttgggaagtcgaggtgggaggattacttgaggccaggagttcaagaccagcctgggtaccatagtgagattccagtctcaacaaaaataaaagtaaaaatcaggtgggcattgtggcacacacctgtagtcccagctacttaggaggctgaggcaggagggttgcttgagtcttggaggttgagggtgcagtaagtaatgattgcacactgtactccagcctgggcaacagagtgagactctccccccaaaaacacaaaaaaacccagaaggggtaggttgggccagtaacactaagacttgttaaggcaggggcaccctggaagtctccctgggccctgagagcttcatttctcctgctgagttgtaacgttttcattctcacactcctattagaaaaaaaaaattttgagcactccccttaacacacacacacatgcacacacatatataattagatttatatgccttcctatatttattacatacactataaaataaaaaacaggaattaaaaagattagatgataaaacaaacataaataagttttatgatacctcagggcatgaccttacctcctctcactgggaagaccttgggccctcctgctgtttatggccagtttctgacgcttggctccacttctcctatttttcacaaatatcagatcagagataatatttgtactctgtcctccctaacagatcttccccgtagccactgtccgtcctcatgaagtttagtcccagttgcaatgtttgtggtcactactgttttcataaatgaattagcgtgtcagggaactcatctgtaaagctaatctgggcattcatattcccttcagagggctgtgtagacctctggatgtaaaaggcagtcgaccataaggcaggtgactattttgtgtattcctcatattttaaccaatttgagactacattcatgtggtaattatgttcacagctttggtaaaaaggacctgtactgatgtttaaagcttagaaaatttaaccactggggcaagtaattgacaattattataccctatggggagaggaaaaccagttgttacccagttggaattacttcttagatatttagtgcatctcaagtcccgaatggtaaaaccatgtacatgtagaattaaatgatgaaaattatgcttttcttacttggctcatagagagtggctggtgatttttatgcagaattaggttagtcattgaaggtttggtttaagtactgaatggaaagcacaaaatagactcagaatagggcattgatggaaggggcaagattcttagcagaggtctctgggaagtcagccttgcaagagggagagccatctcacgtcttcctgggggtgagggcacatggggagacactgcgggggccgggggggaagaggagggagtttggtgtgttgatagcctcagtcttttctgggaagtaagaaggaagatgggcgattgagaaggtcagcagaccagcagtcgtgtgctctggcctttagattaagggtccgcaacctcactgtacattagaatcacctgctgcatcctagaataattaaatcagagtcttaggggtaggacctaggcatggttttttttttaagttccagattactccaatgaatagcaaaatctgagaaccagtggtagaccagcacttctcagactttaatgtgcatacacatctcctggggccctgtttggaaggcagattctgattcagtgggtctgggctgtggcctgagatttgtatttctagcaagatcctgggtgctgctgctgctgctgctccaaggaccccactttgagcaacaagggcatccaggggtattcaatcttttggcttccctgggccacattggaagaagaattgtcttggaccacacataaaatacactaatgatagctgatgagataaaaaaaagaattgcaaaaaaaatctcataatgttttaagaaagtttacaaatttgtgtgggccgcattcaaagccgtctgggccgcatgcgacccttgggccgccagttggacaagcttgggtagacagtcctactttgactagaaataattgatagccgtctccatgctccatagaaaccaaagctgttgatattttacaattggaaaacccatatcttgagaaaattttcagcatatgttttaagatgtgattgttgtaggggaagaaacttaccttgatagatggcttaatttaaaaagcaaaatacttgacctctaatttaggctattctccaagtcctaaaatccacctatttgttggttgcgggcatctaacactgacccatcagagcctcccgtggctggtgaaggtgagtggctgccatgttctcccaccatggcacctgcgggtctgaccctctgctcttcccgaaacaagagcctggtgacctctgtaagaagtggccttgtgtaagttttagtcagcctttttgagttgcagcttactcatcaataaaaagagtcggcaagagacttgagatgtcagctttaatgtccctgcccaccttgacactccatgagtgtataaatggtgtgcctgcgacaagagggtgaggatgagaacaccaggctcaggaaggcttaggcgttcatttgtgcaccaattcatccagaagatatttcctcagcacctactagtgccagatatgaggtgggagactatcccctgctcctggagaaagaagtaaataagaaatcccagtatgggctgggcagagtcaggactagacaaagtcaagttggggtcctttgggagcccagtgagggtgggggatgatctcagaagaagcaactttagagctgaaccccttaagtcagacagatgagcaggagttggctgggtgaaggctgaggtgggagagagctccaggctaatggtcagaccctagggagaccggcctctggtataattagatctttgcaataattagatgaggggttcagataacagttctgtgaccccatgatatggtttggctttgtatccccacccaaatctcacggcaaattgtaatctccagtgttagaggtaggggcctagtgggaggtgattggaccataggacttcccccttgctgttcttacgatagagttctcaacaaaatctgcttgtttaaaagtgtgtggcacctccccccacctcttgccggccacgtgaagatgtgcttccttccccttcaccttctgccatgattgtaagtttcctgatccccagaagcagaagcctgtatggcccacagaaccgtgagccaattaaacctcttttcttaataataaattacccagtctcaggtatgtctttataggagtgtgagaacagattaatacaccccaaaagtctgcaagcagagctagtctcccagtccctccctacctcctcatctgtcctgggccctgagtcttttccccactgtctccatacagggggcacatgggctacatgggggtgaggccctagcaactggctgcaaaccaagatggtgaggtctccagggtctccagcaacttgcagatccaggttgcctgcttcctacccagccacactgccactgtttactgacctccactcccacacccctggggataatggggacaggtggaatggatgggtgccctcatttaaacccatttgaaaatgttttgcaaaacgcaaacgaaatgttccctgtcacctctgaagaaattcatgccccctgggcttgagcatcaaccggctcctttgatgctccttgatttgaagaggtcccccacccaccctaggcccaagctaatcagcagcttgtctgagtggggagatgggcctccaccttctctccagtcactatctggctacttggcttgtcctcagggacacagactcaccctttgaacccacaattcatgagatagttttgtattcttagggcatcgccgaggcttccagtattagcccctgcagcagcaacacccactatgctcccactggatgcacccagaccacctcagctgctgactcagagtcagagtggggtgcttgctggcaggttgaacagcaagaggaggagatgtagtgagaaagaccgaacgaggctttctgggaggtgggagggtgcatgatgaaggccaagttcatgttcctttgcctgggtgtcccaaggccagcgccatacttggtggggactaggtggaggcaggcaagcctgtctcagggccagcagctctctagagaaaagcccagggctactctcaggcctgctttggctgagtagtcaggcagatctggagctgtcctgttgaaggaggtggaagtgaggtttgggccaggggtttttcccctttgccctgagatcctgcatactgctcccctctacccacaccttggcctgtcctctgtccttcatcccactgggcctcagcgtttttcccagagacttgagtcacagcaggggatgcaagggcctctctgtagctcattggtgctgagatgccctccaacccatgtgacatctgtctctggaaggcaggctggggacaggtgagtaaccagaagtaggctgagaggatggaggcccctcaagccctccagtaacagaaccatagccacttcgggctgcagtccccaaggacaggaggaactccggtgaccagagggacagacgaggccccttgtgggggaaaaaagaacaacagttcaatgactttactgggaaggacctggcctccactttgaagaaatgtgatgctctcatactgtttcctgcatgcctctgcaggcacatgcactcggtgttgaaggagaggctgtggggactgcttttcccaggaaacaaaatgcatggaggggcgtggccttcacagctctcccagtcgaagggaagcctgggaagcccagcctttatgtacctttaggctagttatttaatctccctgtggaatcagtttttccaccaacaaaatgggcataattgtaagacccctctggctgggttgttctcaacagagggcctggcaaatggtagatgctcaatgagttgtagctcttgccatccatgggaggaacaggggcctgagggaggccgcctgccctggcaaagtcctcttttcactttctgagcaggactgttctgggaatgttagcaggcctagaccaaagccaggcagggaagggactgaggtttcacaggaaatgatgagaactggtacctaagctgaaggtgtgtgcaaggagcaggtggaggaggcatccagaagtttgtcttctttcctttgggaggggattgagagaagcagacagggagggagagaagctgccatttctgcgagggtggagagatgcagctgttatgagaaagctgtctcacagctggataatcctaaccccacaggaagaccaaatgtggcacagaacatgtcttgacttctgtagctgcccttgtcctcaccagtcctactgcagcttcccttcagccttttcttacccttccccaagggttctggccactgtgagggacaaggatctggccttaggttctcagggccttcatggggctttgtgcaagtggccaacaaatatttgtcctgctgatgtggatgcctctcctggcataacgttgatgcgtttgcatgctagcagatctctgatcaaagacgtgttgcctccactagagtataatgtccatgaaaacaagaacctcgtctgtttcactcaggatgagtgaatgaatgaattcatacatgcatgcatgaatgaatggtgtattagaggccaggtgcagtggctcacacttgtaatcccagcacttgggaagccgaagtgggaggatcacttgaggccaggagttcaagatgatcccggacaacatggtgaaaccccatctctactaaaaatacaaaaattagctgggcatggtggtgtgcacctgtagtcccagctactcgggaggctgaggcagaagaatcacttgaatccaggaggcagaggttgcagtgagccaagattgcgccactgcgctccagcctgggctgcagagcaggactccctctcacaaaaaaaaaaagaaagaagaaaaaagaaaaaaaaaaaaaggcatgttggaggcatggcatcttctgggctgaatcaggattcactcctaaagaaccagacccttcagctagggcaagccccctcagcctccctggggccaggctgcctcccaactctgtcccaagggggttactggccagcatgctgggtcacctcatggcttccagagggagacacgctctggatcctgccaaaggtgtggcccaccagtcattctccacaaagttgtttgcacagcatcctttccctccccccttctcctcctgcctcagagaaactccttgttctgtgcatgtgacacattctgattgcctggaaataccacagagttgttcatttgttaaagctgccttactgtagtgagacatcatttgcttatttcttttcttttcttttcttttttttttaaaggagtctcactctgtcacccaggctggagtgcagtgatgcgatctcggctcactgcaacctccgcctcctgagttcaagccattctcctgcctcagcctcccgagtagagtagctgggactacaggcgtgcgacatcatgcccagctaatttttgtatttttagtagagatgggatttcatcatgttggccaggctggtctcgaactcctgacctcaaatgatctgcccacctcagcctcccaaagtgctgagattacaggcatgagccactgcacccagcctcgtttgtttatttctagccccatggtgtgctgggccgcctctctttctttggaggttgtgttggtaatttcggggtgaggagaggaggacgagctgaccacaggactaaagtctaggcagttgggatagatgaggtaaaaaatctcagttgcccaaggcctgcccagtgaaactgaggattattgaattattattgagcccaaccagactccaaggctgctcagatccctgagttagacatggtgcctgccttctccatggtaacgaggccaaatatggacaggtttccatggagagccctatcgcatctgcagccctgcttccaccaggaagcacacgcgctaggtgcctttggcctctcaggaggtggccagaggtctgtgggaggtgccgaggacattgagaaagtgtgcctgacctatgaggattttcgtttccaacaagtgttccatctccccagccctaggctcaccaatgccctcttcctcttggcagctagatattaggagaggccacagatcagatagatgagctgattggggaagtgacagtggacccaatgaccattcatgcaagtcatcatcgatcttcaccttgccctggggaacggattttgctgttactgggagaaatgggaatgtcattggtcagagggagacagagagacaactgtaatgacccttgtgcttatcaaacctcttttggaagaatgattgctacagagtatttaaaatgccattttccatagtcatagcatattcacatgtgacaaggcattatttttttccttaaaggaaagtaagtcttcactgcttatttgaatttgaacaagtcaaatttctacatatcttaactgtctgacatagcaacttggactgaaacttcgtttttgttgaaggccaaacatataagctgagaattaggcttaaaaaatgcctggtttaacctcacttggctatttactgattacatcatctgcatttatagcttaatcatctgttaaattggggttctccacgcacacaggatcatgtggttgtgtttgtatatattaggagatatctataacctgaacatatacatagagagatgggttatgctccctggttaactaaaacgtggaaactttctaaagatgtgagagagctcttaaggcaattataaatagtcttttaaggaagattcatattgtatgttctgtgttgcaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcac

SEQ ID NO: 3139 - DNA, 61286 bp, human
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggtagtggccgcggcgcccccgtgcgggccggggtcacccccgccctccccgcgcggagctgccaccgggacgcagggggcgcgccgggctgggcgcgcctggcggggcccggcgcccggggaggggcctgctcccgggggcaggacggcgcccggaggccggggccggctgggagggccgggcgggggcggggacgcgggccgaggccgccgcccgtgtggcgcgccggggccccgctcccgttcccggcgccgcgcactggccggcggggccggggactgccggggaggcggcgccggccggcggggcgggggccccgaagtgggtttcgggccgccgcccgcactggcatcgggcgcagagggcggtgcacggcggactccgcgcccaggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggtgagtgtgcgtcggcgccccgggagccccggtgccccccaatgcccagccccggggtggccgcaccagctcgggctttctgccatgttaggcaccgagcaacgttctcgctgcatttttgcgtgcgtttcagtggcgccttttgctgcggagggagttattgcttctctccgcggtggctttttcggggttggggttgtgctctgtgtgtttgcttgtttgccatttaaagcccgactattgttcaggataagctccgcctgggtggggaaatggcatcccaccacagttgctggcgaggggtagaaatgttgccaaacagctgctgctttgtgtttccctatcagaagtccttggagtaggtttggggcacgacggatggatggagagagggatggggcacggaagaagaaggtggctttggaggagcgggttgttacccacaccatggcactcactcagtctccctttctgcctgccaaacttttatgaatattccttttgtggcagagggaagcttaatgaatttagcccagttttccaaggaaaaagcaacccagctttaacaatggtttgagaacttaatcaatgaaaaaggcaggagaggaggacaaggaggcgccgacaccatatcgggtatgtggctgctgcttgcagagtcaggtaggggagaggtggggagggcacggcgcagcgtctgggtgaccgtgttcccggaactgttggtagctctcacctgtgcccgctggtgccacccaccgtcgtgcccctatgtcgtgggctgttcagaacccagcgatggggtttgaggggcggcttgcggcagtgcgcgggccggcccccctcatctggcgtttttaaggatgtgtaaatattttgctgaggataagtgacatcaacagaatgatattccgcagagcccgggtgtgcagcgatgataaatagatatggccaaacaaagttttgataaccgcgtattctcatggctctgtctgtttcatttgggtctttgtttttgttggtttagcattatctcgcatcctctggtgtgatccctttatttaactgattcttggaagcttctctttagaacagagagaaaagcagccagcagggagaaaacaattcttagccttgcaagcatcaggcaaggttttctgtgcttttcccagggaatctttcccaccgttttctggatgtctctcttgctcctttggagtcatcagaattggttgttggtggaccgagagacttgtgacaactttgaaaatgtggtgtggacatgcctttgttacagtagaggggtggcaaggtgggagggggacaatacggaaggggacagtatggaggctagttttcttctcaaacgggaacatgagaagccaggggtgggctggaaggcagagaattgtaagatggtggcatcccagtttctctgcctcttacaagcccagagaagccacctgcccccacacccccacatacacacagtctccttcaaatgggcactcgcttctcgtcctgacagatgcccactagaggcatccccagggcagcccaggcactatgaaccaagtcagactggaacttgggggtagtgactactttggcaccagcccaggggaccattcagccacccgagggggttcctttatgatgaaaaaaagccaagacctccagtggtgatgttttgcccaggaaaacctgttcatctgaggaacaaatgaaaagacagttttccaagcgatgccgatcgctggggtgagaacacggtttggtgggcagctggggaagaactgtaagacacatttcaaaatcttgtatccagaatacagagtccctgaaacaggaccatctgaactacaagaaagaaaaatcaaagactggaaggtgtgtgaggagctgttgctgggagtgctctagctgtaatgacccagaagctgaggataggactggcctcccaaatccattgatccagaatggagatactctggatgtgcagaaagccctgcacagcgtgctccaaatttatgataagaaaataggaaacgtctgttctctggcttctcccctaagcttagaattttggagaggatggtagtggagggaaataaattgggaagggaactaacatgtattgttggcctctgtctgctaggcacttcacatgtggtaaaccttctcagccaccctgtgatggaagaattattttacagataaggaatctgaggctcagataaatttccagttgtgtatctgatttcagactttggtggttatgatttaaaggggcaacatgtccctattcccctgctccaggtctcttatttatttctcttaacctgtctgaacctcagtttccttacctacaagatgggaataatctttcccatctcacatagacgttgtaaagattaaagtgggacacgtcagcatggaaccacgaaggactaaaactggagtatgacaccaggaactccaggcccctaaccaaacatacaaatctctggatctcttcctgctggatctttcagcccctccaccttggcaaaatctggtacacagttggtggggattggggggaaggtggaagcccaccagtgggcaacccagtcacccacagtgcatacttatgtgccaagtagatagatccgaaataccctgtgtcagatggacagactgtaccctttcatcttggagtccccaccacccaactgttgcttaataaatgagagttgagtgactaaatgatggcactgatggagtgaatggcagtggggagggggctgtagatcattgttaagggagacccagcaaggagagatccagagatttgtacgtttggttgggggcctgaagttcctggtgtcatattccagttttagcccttggtagctccatgctgacaagccccagtttaatctttacaaaatccatgggagatgggcaagattattcccatcttgtaggtgaggaaactaaggctcagaaaggttaagcaactaactcaaagtccacgagggaccaaaggctgggtgaggtatttttaactagaaactgtctcaaataaacaaacactctataggaaaatgaggagggaacttgctatgcaaatgtatcgttaaagcaagccccgtagcccccttccaaccaggtggtagtcttcaaactcctagaaattctggagccaccgagggagctgggctttgaatctatgtatgaggagctcctcaatgctgcctccctgaacagaatatgagggagacctcagagaatgagggggaaagatggctaattgcactcttcccacacacaaaagcctgcgtgggattctgaattaagcttgatttggggatcagggtgacatccttgctgtagagttggcagctcttgtctttggagaatgcctctgattaccacttctccctcccacctgatcgtctgcccgggtgcccatcatctcattctttccagactcaaagcctttccttcatggctcacaatgttgatgagcctcttgagtctgccacttcactgtcctctgatggcagctggtgagaagctgattttggcggccaggttagtacttctggagttcacacatgaccctcctctctcctgccaagaacacacacacgaacacacatgcacacacagacacaggcacacataatttgatcacgtttctgtatctgcttcaccaaattagattcaaacccagaattgttattggaagaagtatgtgactttggtgttctctcccagcccctgccctgaacagaccagaacagctaagatggaggcagcttagccagcagatgtcttgagccatgatcatacttgctggccttcccactgctgtggggcagcaccgcaaaacatgggcatggtctgccttcatccgtctgggctgctataacaaaatcccataggctgggtgacttataaatgatagaaacatatttctcaccgttctggaggatgggaagtcaaagatcaagataccggcagattcagtgtctggtgagggcttttttcctggttcagagatggcatcttcttgctgtgccctcacatggtagaaggggcaagtgacctctctggggcttcttttacaagggcactcatcccattcatgaaggctccactctcacgacctaatcaccaaccaaatgccccacctcttaataccatcacgttggggattaggatttcaacacaggagtttggaggggacagacacattcagactatgcatggtcccagggcctttcataaaagcccattttaatctctactgagacatagggctgggctccttgaacatcccaatccttgtaattccaatttctgctgtaattagctccaacaactcagtaattctagagaactttggagcacactctgctcacacctgtcactcctcttcccacaactttttggtcttccagcacagcactgtctaataaaactttctatgatgatggaaatgtcacatgtttgcactgtcccacacactagccactagccacatgcagccatagagtgcttgaaaagtggttggtccaaattaggatgtgcattaaatataacagatgcatgggatttctgtgacttaatacaaaaaaagaatccaaaatagctcattaataagctttgcattgattacatggtaaaatgataatattttgaatatattagttaaatatgatagagtattaaaattagtggcttcttttatttttttaaatgtgactacaaaaaaaatttaaattacataaacatttctattagacagagctgctctggagcaaactaaccaacctcgtgacttcagcctccagatgttctggggacataaacgctctccatctcgatggcaggtgggaggcagggggctgagtcagtagccacagcagcctggcatcaagcgattttgattttcagtagctcaggtgccatgatggaggttccccgtggaaactagccatgagcatgttggctcagtctcatgctctatgaggaatgtgggacccagaaacccaatagaatgggcacaggcaggactggcttgaatgaaatggctctttcctttcctcgaccccacccaccccacaggccggtgtccttgtccatcggagaattccttgacacctgctctagtagcagcttaaagtactatccatcccagggatttgtgcttggagagtaatgtcgccagtagacaccctcatgctgacagtgggttatttagggccagggccagccttaaaggagagaaaataaaaaagagaatgcacactgtcatttcctgacagcttgatgagaacaagagcaaggacataaataaaatttctgcgagggagacagaataaatgcaaggaaggtcaatttcacacaaccatagcacagcagatgaagaaacctggccaaaggagagttcagggaggtagaagaaggattttggctggcactatggtatcatcacatcacatcatttctgggtccttccctaggcactggtcatggcataaatagacggaaagggatgggataatgaacttgggactgcagtgatttacaggtcaggcgcctgtggctctggctcctgagggggctgccctcacaggggacccttggctgacccccttgggctcctcagaaggagttggttttgtttcacatggcagaagcagactgtttactggagcacaggaagaatccgacattctggcgaaaaataattcattaacagccagggtattaccagttccctggaaaagctcctccagctgcactgtagcaactgttctttttcagcagcagaatcgggccgtgctggcagccaagactgggtgtgtttgggcgtttttattgttgttgttatttttgcctttgtgtgtatggccacttttcccttataattcagagaaagaaatggaggcctggaagggttgaaatggtgtagctgtcagccattctttccttcgtgctttaagcctggaagctccaggctgactgtatgaacataggtttttcctgatcaaagcccatccccaaagtgggggcactgcagaaccacatagaatgttctaggatgaaaggaattttagggaactgaaacacctgttcttaagattctctgaaagcaattggctgaagaatccctccccacccccgtatgcacaaccaggcagaaagtcctatcttggccgtgtggaattcttttgcttactattaattggcacaatggggccaaagtatgtgattcatcatcctagttttgagggcatttggaaagccaggcaagcataaccaagagaatgggctgcatgttttgctcactaaggaatgattgaatctacagtaaatacaaggaaagattcaggaagctttttgtgctctggaaaaatatgtctttttaaaaaaataaggtttttgtctgcctgtttgttttttaatgcctcatgctcagaagtgtgtgcccagctagcaaaaaacgggaaagaatagcatttccttgttttagtttttttaaaactctaattgcagtttaggtaagatacagtgtattgattttggttttgtatggaacataactagataatcattttattttatgagatattaatttccacccatttagactgatgaaatatgcatttaaaatatcccatacctacccccaccatcatcacaatatttctttaatgttcctagattcagatggagaacctatttcatttatatggaaaaggagtaaatatgttagtcaacatatatgtaaacctgccttagattttgaaaaaaatgggatcctttccctttttttaaaaaaaaaatgaatgttaaaggccaagcatatttggctttatctggagcatggtttcttcaccttggccctgttgacattttagaccagagaattgtttgttgcaggggactgtcccatgcaccttaagatgttcagcagtatccctggcctccacccactagataccgttaacaccacatcctcctaccctagaccttgccaaatgtcccctctgggacaaaattagccctgttgaagaccacttgtctagaccaaaatttaataagtactttgtgtttttttggaaaattccatttgacataataaaagacacaattttccccctctgacttttataaatacaattcatgggcatgattaattaacggttggaagtgggtcatgtgcgtgatttaattctaaggttggtggaagggtctataagattgtataagcatagagactttttcaaggcaggcaattttataagtcataggtgattggggggcacattgtaagaactagtggcttctctggtttttcataaagagaacaggtttattcctccctaatttctttttcatatgcacctgattccaggcatgacttcaaagtcagcaggcatcttcccccacccccagcccctccccactgtcatttctccggtagcatcttaagcccgagccaattgatttagccatttagtgtacttgtgagagctctgctcgtaatattgtaatggactcatttcagattgtagcagccctttacccaccactaaattccatgttttccagtactattgagagagaaagtcaacagtactttctcggtagatggatcatttttcgtaatgattgaaattcaggtagcccccatcacccctggcaattttgtttccttttacacacatttgtttccttgaagcaattctccttcaggcagctagcacctggtaatgcctacaggcagcaacagcagatgaaatgttgccaccaggacaagccctcagccatattctttctggtagtcccttgaaaggctagaaaggagggtcatgccttacacaaggaaggtgtcatgcgggcaaaccatgccctgcccatacatggaaatggaatgggtgtttggggggcagggagagggcagagaagtggatcactcattatacagggaaagtgttccccagttagccctcccctgccagcctctgagagtgatatgggagcaggggatgctggtgaaggataggggcagttgttcagtgcagaagtcaacataggccacttcattttgcagccatccaaggtaggctgaccttttccaaagagtgtcatgtgtaggattcccttgcatactagccagtgaggaaaaatggaaaggtgagcattgagggatttggcaagccagcgacacttcattggtgagttccagcatctcttgaagagtagttgaagtcttccttgtcgccatgaagagagaggcaacaagctggtagggatccacagtgtgctgggctcaggcggataaataattgatttgtagcacgtgacacttggacattctaagttgccagtccgttgcaggccaggattcaggtgatggttgcaacactgggagaggaaataggatcataaatctgggcgttggaggccagtttcgtggtgcagaggccactggggccaccgctgtgtgtgcagaagcaaacagacagatctgagtggtatgttgttcctcaaaataatggcaatggaaatggctgtgaaaaacatttaggaacttgtcataaaaatgcaaacagtcttccttctatagggaaaagctaaataaaccctattgcagctgtattaagtagaaacagatttgaaaatcgggtgttttttttgttttgttttgtttctgagacacttatttatagcaggttgggcagaggctgccactatctttcgagactccggaagagtgttttccagatggtccttgctgtttttctctttattaagcttagctaaacagtgctgtgcttggaaagggtcatagaaaccagtgttactttttttcagattacaatggtcattgattggctagcaatcaatggatgggaatggattgagcctgtgccgatgaatttcctattgcattttataaacaagaaaaatgtcaaggaaagcacagaatagggatactctttcgactatgcacatcaaagctttgaaaaccatacagagttacatttcctattaatttccatttaaattttgttctaaaataatgctcccctctttgtgaaagctctacaatgttaccgtttcctttccaacatctaaacaatgtccagatccatttcagattgagcaattagctctggatgcaatttccttttatgaaaaaaagaatcactagccctctagaccaaatataaaattattgaatgtgaaaatatcaatatggggccatttgttctaagatcctttttggtctatcactggcattttaagaaggttagaaaaggccaattctgccctgcccttccatgttcgacacagccacaccagaaaccccaagctttgtttgtgctcatagaggctgagcagctggatttgaggtcatcagggctgaagcttacagccaaaactgcaaggggaaacatcttagaatgtcccataagccagtggtccccacagaccaggtttgcagaccactgcctgtatcggacaggatttctgccccctcacagtgaagtggaagaaaagtgaaaatgcagtaaatttattttgtttaaagctaaaccttttccactttacaaaactgccctgtattccaaaatgatctttcccactgtccttggtgtgaaactttctcttacgacttatcaagagatagtggatgacatttgtattttgacatcttgatttaacaaagtcagaagttttctaactcatattggatccttcattttaaaaatgctactcatccataacattcaaaagtctgaggttcacccaggaggcccaagtagacctggaaggggaggctttgttatgattcctaagccagaaacagcaacctgaggaaggatcctgggaccgcttccctgagtcccttctttactcagctcttctgacccctcactcatagagagctggctttgtcctaagcccacgtgaagaatggaattgcttctttggaggagtttgagggggcaaaactggcctcttgaacatgaacgcacaagcgtgcagcctcaatgctgagagcctgggccctttatccctgactcccaatgtcagcgccattgccggttctcgtgggcttgacccccttcaccctctcctcagccatgcccactgctgtcatgagcacaggcctcaaaaggctccccggtgtgaccctgttctcctcactgctctgcatgatttgttgcattgctcccccagctgccgttccacaggcctgcatcagcttcctcctgctaaagcacctctctagtcttgtcaccctagctcaagaacattcagtggccccttattccctaataaggttgaataaaagtccacatatgaagccctttctactttcccagcccatttctcctgtcctagagcttcgactggcattcagtaaggcatcatgggagggcgtctacaggttttacaacttctctgtgctgggttttgtttgttttctcatatgaggggagatttccaaaaaggttatggggtatcttggacatctttctagatgaagaaaatggaaggcttgagtttaatgtgagagagaaagagagagaagaaaagaaaaaaagagaagaaaaggaagcctttcacaaaatgaggctttctggtttcaagaattgcagccttactacaagtctcttaccactctgggtcaggataccacctttctggcctgccagcaagtgggtattgcttcagaattacactactacttatcctgttgagaactgagccacttacccaagctttggaacgtacaactcaaacatagtggaacgggtccatcctagccaatgcagaatgtccattctgttaggaaacatcctccaatgactgctcatgaaatcataaaagcaattatattacctctcatttatcaagctcctgctataggctggacagtggtaccaagtgatttacatatattattttatttccagctccataacaaccatatgaggtaggtatacgtattatgaactctatttcacagagaaggaatcagaggcttggatacgtttagtaacttacacaagatcacaccacttacaggaggtggaactgggattctgtacagcgtggttcagtagaactttctgcaatgatggaaatgttatgcacagtccagtatggtagccactagctacaagtaagtggctgaggaagtggattttactgaatgtacactttggtagcagctctagaatatgcttgtttcaccgcaccattccgtctgtctgctctctgcagactttacatctctcttcctccctctagacaaaacacagctctgctttttctcagaggcctgtagccagcagttctcaagggcaagtgtgcattagaattgcctctgtacctcagggagcagtggtcgctggctcaagtcagcagggagaagcttccttcccactgctgtcctgaagagcttaccctctcgtcgtcatcccagctttatttgggcgactgttagatttggtcacttccttagcaattgttcttgaatgcattcattttaatttgggatcttttgggaggaagagggtggagagccagttgcgggtgaaggaagaagcatgggctctaggaactgcctgaccaccctagcaatctagggcaagcccaggcagagaggcccatttgctgtccaatttgctgttctctgtaattaaacagggcagaaaagttgactaggaaagagtgagacagacagataatgaagctgggttttcccccacccctccatgcccctacacttatttcttcaccctaattaaagtctttgtccattttggagggcaaaagccagcctccctggggcaggggtagaggtgagggggtgtgagtggccaggaggccagggaaggtctggaaaggtccctggaaggagattgtgatgtcagccaccttaacacttgatctccatttcagcagtgctaagaatgttcttgtttttttttttttttagatacaggtggaaagaagtagttgaggttactcaccaaagcagctgttgagctgtttttcttatgaatatttgtaaaatgaaagagtggtatggaatatttttttctgagtatgcacaaatcttctgttttcccccacagagactaagcttttttcttttctctctgtctctccctcccctaccctttttttttttttcattttttgttttatttgagagcagaaatcatgtgtctttttttgtggcttggtctcaaaccaacattcattctcttgagccaggcagcacttcctaaagctcattttaatcacagtctatgacagtccagccctccttggctcctggcagcacttagatgctgataatagattgaacaaaaaagtgctaacacacaagtttccctcagtttgtctgtttccaaaagtaagtctccaaaggcatgaagttaagtcctcttttgcattattatagaggctctgtccccattaattggtgttgaaatgtaaattccttgggcttttaatacttccattttcctaccacttagctctctgccatctacccatgagcggctcagtaaataccagcatgtagtgggtcccagagctctggccctctctggtctttgtcaccatcatcaccaggggctgaggcctgctttcctctagtcagccaaacccgctgttaactccactgtggatatttggacaggaagctcttcattcccccatccatatggatacttatttgctgccttcaaattcgttgctttctgcagagggctatgccaagtgctccacccttccccttcattccttttgaccacttctgtggctgggggcaaaggactccatgttctccaaacctaagatggagttgaaccactgcagggctttaatatatgtgctttcacttcaactacacggtcactttcagaaacagctattttcatttgtgggatgaagaaacagaggcagcaaaagggccagttctgagtgatgagcagaaaaggtgggcagggcccacatcataatgggtcttgtgtgccttgataaagaccttggacttcatcctgagcagttttcaggaggcttttgaggtgacctagtttatgtgtttggtctttttcccagtggagatgtactggagggtgggggatggggacggtggagggaatgaagaccaaaaaggccctgttgcagtaacccagaaagagaggcaaggaagaaccgaagtagaggagtgcagcggatggggaggctagtggctggattcagaaagaatcttaggaggctgcctctctgaggcttggtgatggctttgtattagtctgttctcatgctgctaataaagacatacttgagactgggtaatttataaaggaaagagatttaatggactcacagttccacatggctggggaggcctcacaatcatggtggaagactaaggaagagcaaagggacatcttacatggtggcaggcaagagagagcttgtgcaggggaactcccatctataaaaccatcaaatctcttgagacttattcactaccatgagaacagtatgggggaaaccactcccatgattcaattatgtccacctggccctgcccttgacacatgcagattattacaattcaaggtgagatttggatagggacatagccaaatcatattaggctgatagacagactaaatgatgacagcaccctggtttctgtcttttgggccccctggtgggtcaggaaactcagaagaagggagagagtgggtatctgggcctcccctccccctgcagccaggcctaggtgagtagtcagaaaatcttggtatggcctaggcaatcctattctgagccctcagttctgaaggaaatgcaatgaaaacaaattgatgggtcagaagagccttttgaagccattctggggacaaaaacaaaacctgacagacatagtcaacagccaggagcaccttcagtccgcagctttaaatgcacttcacaaatacatacgctttaaataggtcagactctgtaagcaggaggggactttgggtgagcctgctggttcaggctttgactgggcccagctaggggagaggggtttagctggtggcctgctgctagcatgaccacccatcctgtcctcatttgcctgggattgagagggtgcttaagacacaggactttcagttttaaaactcggacagtcctgggcaaaccatggtgagtgagtcaccccacctgccaggggaaatgttgcaacatggatggctgagctgattggaaccaaagcagtggagatttacttccacctgaactggcatcagtatggggatgccaccacagagaagaaaaggagcttgggaatagaaaaggcaagaacatatccgaaaccctttccaatagcttctctggttccaactgaagcacttctcttaaaataggagcctgagatccttaccctgtcttcctggaaactagaccgccctatgccattcttgttatcccacccatctgatgcctgtctagatatttcagttgaatttcagatgagtgaacaaatccttcagtcctgctggaatctgggacttgaaagtccttaactggacatggaaatatgttaaactgagtcttgagtgagaaaaacactttctttacataatgcattcctacgtccttaaaatcatgattagaaaagactttttatttttctaggagcagcaagatgcagactcttgtgtagcagtagaccattcagattttaattttgcaaagcaactgtaatcctccattattcatcactctactgaaaccaaatttaaaaaattttaagttttcaaaagcttcctttctccacccccatcccaaagatttctcttgcaaagcaaacctcagtaaataaacaggcaacatgttgtaaatggtacaaagtggagagcttggagtaggaagctaatgaaagggatttttcctgttgggtcctggtgcaagccttcaggtacattcagaaatacaaagagaaatgcagagtgaggtgacacactcatcttaggacaccagtgacagggaaaagcactcagagtttattctcgtggtggcacctgaactctcaacaactagaatatggagggtggtctaggaggaattcagttcagggaaataaaagcgaaagggaaaactagaggaagatgtgaaaaaggcaagaataagattcctcggccatggccatgtggttcagatagttgagaaccaccccaaatgggacttaggtctttggaaagtgccctcaatgataccctgccctcctaaaatgagtctgagagagaaaatgagtcttcttgttcatttgtggcactctgtaccactgtatgaggagtagatattagaacttaaataatagcatcagcatttttaaaaggttgtctatttcacacacacttcaaataggtcaatttttaagcagtagggtgacatggtttattctttccttggtaatgtttggtttttaaagccagctatatggatgggagatgtgttaaaaattatctaacacaaatttttatttgtggatttttgtctaaaattcttacatacatacacaaaattgcatatattattaagtgtacatcttgaagaattttcacaaacagcacaccgatgtcaccagtgccctgaaggagacacagactgcaccagcccctggaagcttcttcatgccctcttcattatcctcaccaacaatagccactatcttttaacagcatagatttgttgtatcacatgcagggatttttaaatcatagctttgtgtatgagtaccaaaaaaatccagtcctgtgatttgttttgatggagagggtgggagcagaaattttgtaatggttttctttctctggctgctgtgagttaggcttgttaaacaggaagtttccaagctgggttcttgctggtatagggtttggggcaggctggtctcttctgcccaagacaatgcccaggctgcaagccagtaacctgttcttggcaccacctgggccaaaggcagccaccaagcttgctttatctgccttattaaagcctctgtcagagcttgcaaagacacatgtctgggagcaccaagaataggacaatataatggctgggagtcctctgaatcaactggccttctggaaggtaaggccaggcacagcgactaaaacagcaatagcatatccaacgaggacatttttctccaacttccaaatgagagtatgattgatgaatttctcttcttcgtaggtttcattgtatttttctatgtgcattctgcctccttttctttttgctgcaggaggcaaaaagtgggaaggtgggaatcaagctatggaacatacatcgtaatgtgtctggagcggcatcagcaaaggacttatttgttctcctgggctgtggagtgccgagtgattgaatactcgccaagctgtcagttttatgaaacaaattccctaaccctcttggcccagagctttgctctgcctgaaatggaaaagaaataagttttaatagaaaactcattgcaaaaatctaagataagattcccaagcaacttctctcctaagaataaaatgaaatattgaagaaagcatttgatggggtactcttagggaaccttatttctcagttcttagttaacaaaccatgttaataaaaatatttagactttcgtgatgcataatgcatttttattcctagtgagctggcctgtttgtatacacagatgtttcctgtggcccttctatcatagcttctattttttctgaaacaatatttctagcaggaaatagaatcttatgttaagaacctaagcccctcacagaccctgttagtttgagtgaggatattttcatttctagatttaatacttgagggagtagggtcagaatctttttttttattcaagaacatggaaaatacttttaataaaaagataatgcaatgaatccactgtatcaagacattagacagttcttccttggcttctagattagacctgatcagttcatccaggcacattcattgctgaagggttggatggcttttctgtctccattctcactgtcaaagctgccatgagtaatgtctgccctttcatgcaaaccttaggtgtgttcaactgggttttacagattttccagagcattgttctcacagagctgcagtttcctttccagcaccaggagcactgtcgcaacacagctcacgagctcagtttctctgccactcgttggagtgcatggaaatgcattacaaacaaaacccacaggcaagtgtgctaaggaaggaaatgagattttacacatcagcactttaaaaaaaaaaaagatgaacctgtcttaattgaaaaatggcataatgccctaatgaaaaatcaagtttcaggattcagtccctaatatctcagtgatgagtgcatatttcctcctgtggctactcctgcgagtgagttctgaaataatcaggcagtgtgttgaaataagatatcattgggtgttactataggagtgaggcatagctgtctggctgacatgctggtcaccgcctacgtgccaggagagaaagggatgaaacacaggaatccttctcttctggctttttggagttttattttctttaccttggtagtaaatcttgtttttctatgatcataaaagtagacatacttactttaaaacatttacaagtatgagaagatagcaagaagagaataaatatcattcgcattcttaccacccagagattgccactatcaccattttggttcatgtcctcacagtcttttttttttttttttttcctatacatatattctttatcttctccaggagtttggagctttacaattcaaagtcttcttgtgcttaaattgattttctcaaaactttgccgatcatttatgtttccctaatcattaacatcaaaaatgaaaaggtacctgttttattacttctcatgggtgacaaagaaatttttagcatatttatttctcttcttctactgactgtcatatcccccaagcatgtggaacctagcagttccttaatataaatgttgaatcaatgaatgaatgacgacagtttatcctcatattactcccagggggtgagcatcagctcctgagactaacgccttccaccatcctttgctgcctctccctcgcagtgagactaagcctccctctgtccactgggtctgttctccctggttttccatggactgtgggcagtaaggggatgcaatggaaagggatcgccctttagagtcaaaggggccaaattctcaggtctaccaactactacataatgggacgagtgtcttcatctctctggcctcagagatgccaactgtacagtgggtggcagtgatacctgcctgtcaggatgagtgacaagtatgcaagatgcctagtacacaggagagatccaacgtctgcagctgctagtactttgcccactttctttctaatgacagcataaataaagagcccttggggccctagagcacttcctttctcttcacatttccagtcgtttcatctaatgagccataggaagatttctgatgagttacttgatgcttctgtgccaagtaaatcagagaaataaccaagaattgagtggcctttttaataatctgtttcttgtgcttcttctactgccatcgcacgtgcttccactgcagcaggtgtctggctgcattgtaattgtgtgttcacacagctgactcccccacgacacagtgaatgtgtcttgcatcttggtatcctcaacccgggacccacagtgctcataattgaggagttactcaatatatattgattgaatggatgaatgaataaatgaacaaatgaatagtatcgtattgtacacgtattgtccctatctcgaccacacacatggactttctgcaaaccatattgtagaattaaatcgtaagccttctgaacctgtgatgtaagcctctgacagacagacatataagtactggttctgcaaagtgcgagcttaagggaaaaaatgatatttccttttagttgccatgattaatccatggattcactggttcgcatgtgaggttctttagtggagtaggagtgacaatgtatgcatggtacagcttcttgtctgcagcttttagtttgagttagatgcgtgttggcatctctttcacacagaatctgaggagctggcatttatttttgacagcatctcaaatcttgtgaaagtcagagcttggggctggcattgttttttagtagtatctcagacggtggcaggacaaccttgatgataaaaaagaggcttaaacagatgtcttcttagagttcttccaaaaaactaaaagttcagcaaaaaaataataaaaaaaaaagcttctgaacttctagagcaaagacttctttgagcatcagctatttgcagactggccacaaataaacactcacaaacaaagtcatagggatttgtttccctctctaattcactacggtagtgattgctggttagtccccaaaacctgttttgtttatcttcctaggtacccagatagactacatttcccagtctctcttgcagttgtatgtgtggccatctgcctgagttctggtcaatgggatgtgagtagaaaggatgtgtgcacctctggtccaaccataaaagctttctaggttttcctccaagctcttctcttatccactggctgtctgggatggagtgaagtcccaaggtcaccttgaaagccacagttaaagatggcagagcctcttctgcctagggaaggccatttcatggaacaaaactgccagatctggagcccccaccctagacagttacataaacaagacataagctttcattattgagcaattacaagttaggagcaattcactaggtaacttatcctaccttaactaagtcatgctccttgggttttttttttaagcagccgatagttttcaaaggccttttatgtgcctggaattgtttgtgttactaatcctttcagtagccctgcaaagattccttattttacaccgatagatgcaactccaagtaggaaggggatgagcattttgtccaccactgtcaccccaggattggcacagagggtggcattgagtaggctctcaatgaggcttgttgatgatggataaaaggaaggttcaacaaggcgaagtcacatgcccagaccccatagctagaaaatgctgaactcactggcctcaaggtccagctgcctctgagtattggtaatccaagattttaaaaagaatgggtgaagggccagtgatggacacttagaaaaaaatgtttttgtctctttctgactgaaaaaagtaacacatatttaaaaataaaaacattatagatatctgaaacaaagacatgaatagtgctctgtaatattatcagagaaaactggtacatgcttggttttattctttaagttcttaacacacacacgtgtacacacatgctcactcaacaaaaattagttcatgttacatgtagaaaatatagaaaatctatattctctcctgccaaatgacttcttcacctatttttcccttaaatagtttccttggacatttttttccatgtcagaacagaccaacctgtgtcctcctttgcaaggactgggtaatatttggtgtaataatctgggataattaactaagccaattccctctcagttgacatttaggttgtttccagtcttcataacacaaaagagctgtgataaacctgcttgtgcatttatctttgggggagattcctgagagttaaatggtgcatacgctgatgggaatttttcactgtcttccacacatggagacctattttctgcagaaggtccagatggtcaacagatattgaaatggactcagtggagttcttcaagttaaggtaacaacagcagaaaaagggttttccaggatctcagaaggctgcagctatggcagtccatggcaaagactaacagcaaggaggcgccagcatcccaaattgagaggatggcaccttctggatattggctggtttctctgcattcccctggcaacgaagtcagcattatctggaaggtcagggctgatctgggcccaggatggacactgttccacactaagaagggaagcaagtctccttactgcgaagggggcagtggccagtaggacagagaaagagagagggaggaggatggtgcatagatgtcgctgcagggttcctgtcagggctggagctgaaggttgcaggacactcactccacagaaccaggcagaaacctgatgtgcccagacagcttttggggtgagcaggcagctccaggcagatgtctttgtttgcaggcacagctgcgtgcactctgagatgttcctgtccatgagggatgtttctggaatgatgatgatgatgatgatgacagtggctgtggttggcagcgggaagaaggaggtgattacccaaacagcgctggcattctaagagttggccctgagagggcaggggctgcctccactctgtgtgtttatgatcccttgtggtatgagcatgtgatgtgtgctttgcgtgtatgcaggtctgtgcagtgtgatgtggttgagtatgtgagtgtgccgtgtatatgatgtgtgatgtgtgcagtcccatgtgtgtgactgtgtgaggtgtgttgcagcagcagtgtgggacgtgagtgcatgtggtgttgcagggtggtgggcatggagtgtgtgtggatgtgattcaatgcatgagtgtgctgtgttttgtgtgtgtgtgtgtgtgtgtgtgtgctgtgtgtgtgtgtgtgtttgaggcggtcctgattaaattcccccaaactattcatgttgcgcaccaaagacctctgggctcatgttgagtttttccttctgtcttctctgtttcctgtggcaaaaatgccaacttcaccaagagaaccctctcaaacattttctccctaaggagaccaagctctaggcaagggcttaagtttccactggtcacagttagagaaagacagagagagacagtattctctagagctgtcctattttattttattattctttcaacttattgttatattagtctatcttacctttttatagaggtgtatatgtaacacatacagtaaagtcacagagtacacaaatcttatgtgctgatgggttttaagtgcatgtgtattcacccgtataatcataccccagatcaaaatagaatacagtcccagcaccctgaagagctcccttgagcccatttctagtcaatatctcccaaaggcaaacactattcttacttcggtatcggtagattagttgtgtctgctctagagtttcatatgaacaggatcatgcagtataggtagtctttttgtctggctgttttcacttagcataatgcttatgagattcatccatgttgttggttgtgtcagtagttccttcctttttattgctgtgtagtatcttattgtatggatgtattacagtttgtttatccattctcctgctgacggacatctgggtggtttccagttcagggctattgcaaataaagctgctacaaatattcttgaacatgtctttttgtgtccatatgtagatctgtcttaatgttgcctgtgatagcatttgacaaagatagagcttgcaaaaaataaccccctgccaaaaatcaaacaacaacaataacaaaacccccaacttaacccagcaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggtaagtggggatctttggtagggtcactggctgcttcaggatttgtgagctgtgttttgggctccaatgccaagatttcccattagaagccctgtaaggctgggtgcagacaacttctaaagatacccaatttacttttagggaactcagaccttgggaaaatccagcctgttgcccatccacaggatgtcagtaaggatttcagagagtgaagaaagagaaacaaacaggcttgcacctgcacactggtgggctttggtcttttgggtgtctgcagcagctcgctcttcgactgattatctctatagtggaagctatcttggctgacccctacctcctgggtactcacctccacctatctgtgtgctcacttcgaacccctgcagctctctcctccaagacttcagtactggccctggaagcatgcttagcccaggcacaggacaagcaagaggctctggagcatatgtcaccaggagcagccctcaactgatgatgcaatgtaactggaagacagatgccgctgttttctctccctcagtagggagaaacctgaggttaactcccagtgggacttagccccagttgctcatggcagtcagctgcttattaacgcatcctgaattgtttgccttcctttcctgcctcacttctctattgttccatgggtgctgcctgtggtccccttttacatacactgtatgcactcagatcttggtcacagggtctgcctttgggggaatccaaatttaaccatgctcctccccaaggaaaaatgctttctggcacatacactaattttgtctggggattttgcaaattccatgacactgtctgcatcgcctggtttggggttcagcaaggccttcgtcagatatctttgctgtggagaagcttgtgatcaggggccaactcaggggaggaccataataaatacagatggcccccaacttaacgatgttcaacttagaatttttttcacctttacaatggtgcagaagtcatactcgttcgctagaaattgtgcttcgaatacctgtacagccattctgtttttcacttttagtacagtattcaataaattactgagatagtcaacactgtattataaaatatgcttgctgttagattattttacccaacaataggataatataagtgttctgagcttacattagggttggctaggctacgctatgattttggtaggttaggtgtatgaaatgcatttttgactacaatattttcaacttatgacaggacataaccctatcgtaagtgaaggagcatctgtagtacttaattttcaagctacaatgagggcagacagcttggtcccattgctccctgtccttgtcactcccgatactgtttgtgcacgatagacatgtaactccaaaaagatgtgaggaaatggaatcatttaagatacaggggttgcaggggtgggagttgaggggtgggtattgttacttaaggtgattctcagatactctgtatctctgaggaaaatggcttatcataaaatacagtgtgaaaaggaaaagacaaaaattgtatctgtgccatgataggttgtttcctgtaaaaaataaaacaataaagttaaatagttttgatttgttgggggcataagagtcctgaatgaatttttccattttttctaatttttccaaaattcagttgtaacataagcatgaatatttttaaaagaattccaggatgaatctttttagggagaaaaaccataatgcacaaagcagtttgtccagtttccttttcatcttttcttggaggggtatttttccacataagaaagggaacagaggaaggaggtggggcttagggcagtaggatataattagctataacatttgatgatttgagtttgagtttgtggttctggggggataaacacacggacctatctcagtggggctggggtgatctgaaggcctacagcatttaaagagggcaagatgtcaaattgcagatacagatcttggttgatctgtgtggagggcacagctggtgcaggaagggctggggagcagggaatatgaaggcacagataaactcaggctatccaagagttgggaatggtagagggaggagtatggttttggttttgaaggattccctttggcctgtgcccttcattgcctggggcaaatttagaagcacacaagctgtttaagttacattctattaacctttccccagcggctgtatttgcctcgtctgatcccgcaccatgctacacacattttctaatcgttttactgtttcactgattgcagaattagaagcatccactgtctggtaaaagtaggtcagggaagttcctgacttcgctatgttactaatagatttctgaatggtagcgtatgggcgccttaatgtgacatttgagcggaagaacaatggtgatcactcactgacgattttgtgcttgaatcgttcttttctccaacatgaacacatgttggggaggtccccgagattacaggtgccagtgaaaagtaaatgaggcactgatatgttcatttgaaagcaaatcagtgcttttatctgggcctgatctctctaggcctccctcttcttgtggctctctgccattgcctttctcatcacaactctcctccctgagccaccaccataaaaaccttttctgtaacccctgccatatgaaatagtattacatacgcgacctctttccatcaacccaccgccttcccctcctgtaagctaccttggaatcccacctctcttctcttaccctgccttctcctcaacctcctttttcctcctgttgggtgttttattctcttcccatatgatccaagcttaaggatactgtgggcctcacagaatccatagaaaatgaaactgcattgccttataatcaactacgaaatccttaggttgtccccaggaaaaaagtaaagcgagtcaaattataaagacctagacgttgtcaaattcaccacatgggcattgctattgtcaagtaatgatttagataggcacgctgtgtgtatctcgcttgctgtcttctttaaaaaaaaaaacgaatcatttttgcttaaactacttcttccttctagctccagactatggtgatcataattatgtccgaccaaaacatattgcttgtgtgtgttcatgtttaattggaaaaatgacaacagtgatttctttgaagtctcatactcacccagagctaccctgccagtgggtgttctagtatccagaatttcttagaggaggaggaagaataaatcaccataaaatgatacaataaagtcttttaaaataacaaccaggtagtaaattaacatatacacgacctttgaaatgattatgtatggggaagttgaatccagcaaacagctggctgggtgcctgcctttgactaataggctgagagatacagctgctagaaagatatttgagagtaagccctaaatgcagaaatcttttattaaaaaaaaaatcagcttcctcatttgacaaactctaatttcattgggattgacagcattgcctttgtcgagcatacatttaacaaatgagattgaacaaccaccccactcagttttatctaatttaatttgacagccaaagcaggtaggtagaataatgtacttacagaggaggtaagaatgttttccccagggttaaatgacatgcctgacatggcttgctggatcaagctcaaagcaagtatctcccccattgcttttgtatttttgttttgttttactttttaaattgaggtataaagtaagtaaagcgagttcatcttaaatatacaagttgataaatttttgcctatgtgtacgttcatataaccaccacccaaatcaagacatagaacatttccatccctgcaaaacattcacttcccaatcattatttttctcttcttctggctcaaggtaaccactactctgacttctaacagcaaagatcagttttgtttgcttttgaacttcagttttgttttgtttctgagacagagtctcactctgtcacccaggctggagtgcagtggcatgatctcagcttactgcaaccttcacctcccgggttcaagtgattctcctgcctgagcgtcctgagtagctgggattacaggcgcacaccaccatggctggctaatttttgaatttttagtagcgacagggtttcaccacattggccagcctggtctcgaactcctggcctcaagtgatctgcctgcctcagcctcccatagtgctgagattacaggcctgagccaccatgcccagcccgaaattcatatgaagtgtatcagacagtatgtacttctgtgtctggtttcttttacgcagtgtaaatattcaagattcatccatgttgttgcattgtatcagtaattcattctgttattgctctgtaatattccattatatgaatataagactgtttatgtattattgatggacatttgggttgggttgtttttggcttttcccttgccttcagttttatgttttctggatagtctatagaagggcatcctagaaataagcaagaatgatgtgcccgtgggtgaacttgtttccaactggtggcaaaatccactcaccactgcataaacaagcgttctggatcctgagtggcaagactgtcttgggttatctttcccttaagactcaagtgagcttcatgttcccttatcacatccccagcataattgtggggtaaggagggacctcagcgcctagcctccattaaccctaatatgggagaaaagaaggtgagctttagaaaccgacaggcagggggacctggggtgggtttgcaggtggccaggaaaggagagcagcagtttttcatctggagtgcacaggtatctggcatcacgcccacctttgggcagactcagggacacagcttaaattggggcatctctcctgatcattctgacacctgcccattttctgaatctgggaaataaagtaaccattattgcctctcataaagaagctgaccaggcagtgtggctaaggtagtcatttgtcgttgggcagaaactgggcacaaagggatgtcaccttagaaggctgccccctccctccagctgatgggtgaggcgagcagctgtatgtacaggtgcgacagggttgggaactactgggaggcgagggtgggtctgcaacctggatctggtggtgcagaaacgaaaagagatcagttgtttaaaccttcccggtttgcctgggactgccctggtttaagtgctgaaagttccagggcctgggaagcccctcagtcctgggcaaaccaggacaattggtcaccctacaagagggagcccttttcactctgttatcagtgcatttcagttaataaatattattagccttctattacagaccatgcaccttgcaaggtttgggggatagattggtaacaacaagacagtggtgatctctgcccctccttctggagtacttcctatagcaagaaaggtaggatttaaacaagtgattacaatacagtgcaatgcttgctttgattagagacaataaggcaatgagtgctttaattgggaaaattctggaagctctggaagcaggtgggaaagacaatccactacaagttcatgatttccttagcatatccacaaagttctagggctgctcagaaaagccatttgcagcaaactctgatgcactcataacagctatcaacaaagagggtggaggatgataaggaaatagacagatttaggtctattgatgtaatccctttgtgctgcttacattcccaacacgtagccacatttcttctcccacttcgacagtccttactggctggtgcaaaacattcagtgtgtagtgaacaggagtccttggcattgtccgtgcccataaattcagagtgacaagcatgccttggaaaaccttcttcaagttttcagatcatgtagataaaatggggagaggggtgaagatgatgttctggggttaataattcagtatgtttgtaaacagggctccagggtggaaaacttagtgccagattttctgcgtgttgttttacaacagaacagcatgtacttgtaagtatctaaaactaatggacatgtactcttgcctaagaggcccagttattgttttttgttttttgtttttttaaaaaaaagctttttaatgtactagaaatatatggcagctgttgtaagagctgaaaggcccgcccaatgcaggttgacagatgtccatatatccatattatatattaaaaataccccctgaatattttactttctaccagctatcacacagatccaataaaacaaaacaaatctcccagaactgaagcccttatctccatggaaaagtccaaacatttattccagtatcagagacacagccaaacaagatgtgtctcgaattttagagtccctttcttgccttcctcagcccagagggtgccagtgatgtttgtgtaaggtatgtccttttatggatgtttgtagaaaagatgaggatggatggtttttctagaggatagttctcattgttttcatcatgtgttagaaatagcacagatacattgggtcaatttctttttcttctttctctacctttatcatcattcaattaaaacaaagatactcacaaactattatttttctatcatatgggaatcaatgcccaacttacctgttctgagtactgaccctttggaggttcccaactattatgcagctttttctagcctagcttgtgacaggttgtggaggtataacacccccccacacacaccccagatgacctctgagctttcctttgcaaggaagcaataatggagacttatccatgagggatgaagtgcctcttcccttcacagtttgaccatgccttcctttgtagcttgttcagctcggcttgtcctgatttatgtttttttgccatctggtttatttctcttgttgttttgtattgttttaagtgtgctccaggccatctttaactgagtctttaaaaaaaaaaacaacaacaaaaaaaaaacaaatcataggagtgtcatttgaaggttagggatgaaagagaagtttaaaatgggactctgatcttccctgcaaagtccagtagctaaaaataaagttccttttactttgctgattatgtaatagaacacgttctcagatgtgaatgctatggaatgtcacagttgttcagagaatatttttttgggttttcctaaatggaggtgcaagagttctctcaaataattgaattcattcagttagctgttgaggacctactgtgtgcaagccactttgctagacactattgtggaccactttgtgatgctgatgagctgtaaccagaggcagtacttgcctttcctttggtctaacctcagttttcattctattacaccatataactctttctaaagaaaaaatgatgtgcgagggaagtggagagggagttattttgcaaaaggaaaggatagagttgggcaagggcagtgtttgtttgaaaaggggaaggttctctctgggtactgggtgctgtctgtgttctgggaagccatgaaatatcagtgacctggataactatgtttaaaccatgttcttattaaaaccagcagtcctggcttacccagacaaagaaattctgaaacaattttggaaatacattcacaagagtggaattcataaatggaactgtacagccatcagctgcactgtttagacataaagttggatgagcaaagggggaattttacaagtatggattcaaagcttttaaatgaacttgcctaattggtagtagtgatgtagagcatcttgctggaaggaaaacaaatctcatatctaaaaatgttctcttagatgtaaaagcaaatgcagcctcaaacaatgcttgcgaaacatcttggttaaggattttggaagagatttaaggatcatgggttgttgcctggcacttggtgaactgctccacacaatttagaaaccctgtcaagaggttcctaaatccagctgaccttagaatcacctggggagagtttagaacttgtacatttctggaccccattagatgcatgaggttgggctcttgggagtcagatggagaatctgtgagctcagagggatccccaggtgatttcaatcattagccctgttttgagaactgctagcctaatccatttctctggacagcatcctatccacaccattacagaccttttttttttttttttttttttccatacagatggccatgaaatcacatctcagcacatgcctttgactctggattgcacatgtattcattagctgaagcccaattttaaaatccaatcaactctatgattccttgaaatgactgcaaatcaagtcacatccagtgctcctcaggtttatttttgttcattattattctactgagtgctcaggacattctactgctcctgagttggtgagctagaggcataaatagcttttggatccctcgggtgtcgagatggttaaaaggataaatggtgataagtgaataaaagggtgaacattggcaagtgaacaaacaaaaatttgataaggctctactctaagccacatgcagtgtgaggcccttgacggcctcccccaccaaccctcccagtatctttatgggggtgtctcaaaccccgttttacacatgggaaaagcggagtgataatcccaggccacaaagctcagggacagagccagcaatcaagcctgggccttctgggtttaccataccacgtaattcccccactcgctcccatcctaaatctgatcctgagttttcttcattttatcatccataaagagcattctaaattctcttgtgctctgccctggggtccagcttgggctcatcaaggtccgcttacttctccagagatccccataatctatttggaggagtagcacagttctactctgatttggcatgttttagaggaatcaaaggtagggccattcatttttgaattatacataggtttcccttcatctctagaatgtaattaggcaaaagggcttgaggaataccaaatgccaagccaagagcattaagaagctgccaaaggaagcgggtattagcaacctctgttatgtgccatgtgggccagagctgttcttagcttctcggcaggagggagaggctgtggttccaggaatcaggagagagagggaggcaagcaggaaggtctttgcctcttccctgcagattttgtagtggagcagctggcatttctcggtgattcacagatgggcctgcctttgatggccttaccacctttcttattaattttctgataggtagtctctggaccaagaccagggtgacccacccgtagcactactaccatttgggaccagattattttgtgctgcgggggcctgtcccatggcttgtaggatgtttagcagcatccatgacctctacccactcagtaccagtagaacctccccacctcccacaagttagggacaaccaaaaatgtccctatacattgccaaatgtcctcttggcaacagggacagaattgtaccaggtttagaattgctggcctagaactatagtagaaacatgaagggaaaaagagatctcctgcaggggtagggatactgggttggaaatggacccccaagcttcaacctccccaccttccctcagcctgcagaggtggcaccaaaaagtggtatatgaagtatgtgagacttaacccagcgatctcttaaagggtaaatacccacttgccccattcacccttttcccatgctgccatcccacccacctgttcttggtacatggtgctggtgctgtggcagtagacactcttgatagcttgggctggtggttaagagcatagattctggagccaaggctacaataagttcacgttccagctctgcaactgagtagcaagttccctgttctttgcatgcctcagtttctgcatctttaaagtagtaataataacagcatctctcttttgggggtgtttgtgaggcttgaatatttgtaaacatttagaagagtacctggcactgtgtatacacagtaagcactgtgtataaaagtgtattgtaaataaaacataaatagtattgtgaagaagttctgttaaatacagccactcaacaaatgtttattggttgtcgaacaaggccccacccctaccctcctggaactcagagtttggttatgggccaacagtaacttgggcggggttctgagccatgattctgtgtggcctgcaaggggatcacagagtttactccctccctctctgcactaagggctgctgtagaagcagagcccactgccctggccatgctcttctatgtagtctcaaagtcaagttctccatatcccagtgggcaggccatctggccttagctccccaatgcagtgcctcttactcatcataagtcaaatgctgctttactctgcatcaactgaacattccatgtgacaatgactcaactctctatatcttcagctgtagccaaaataaatggaatctatgcattagtttgttttcacattgctataaagaactactcgagactgggtaatttataaaggaaagagatttcattgactcacagttccacatgactggggaggtctcaggaaacttacaattatggtggaaggcaagggggaagcaaggcacatcttacatggcaggaaagagagagcatgaggggggaagtgtcacaattttaaaccatcagatcttgtgagaactcactcactatcacggaaaccagccccgtgacccaagcacttcccaccaggtccctcccttgacatgtggggattacaattctaaatgagatttgggtggggacacagagccaaaccatatcaattcactattcaatatttggtagcacctctgtaatgaatttgaggtatatcagtctttggacacactagttgggaacattgtcctccctccttcactctcttgctccctccctcccttccttcctccctccaaataaatattcattgagcattgtctatgaaccaggtattattctgggtgctgggtgaggtctctgctcctagagacccaacattccaggttaagtagaagagacagactataaacagaaaacaaaggaaaaaaaaagatagcttgcaaatgtgataggtgctgaaggaaagacacaccgagactgatatgagagaggaaaactgggatggaggtggtgactgttccaaatggtcatagaaccttctctatctaagaaggctgttctgatttgagacttagctgagaaggaaccagttgtgagaagggcattccaagccaaggaaatggccagtacaaaggccctgaggcaggaaagagtttggtaccttcttggaatgggttaaagtggggccagatcagatagggctttgtagggcttggcttttattttaaagtacaatgagatgccttggagagttttatgcagacaaataaaactatttgatttatgttttaaaagaaggagggaatagtcactgtgtcaaacactgctgagatgagtaagatgagggccaagagaatctctcagtggatctggccacatggaggtcaacgtgacctctgtggagaagtagagggcagctgttctctttgccttttggttttagaacatatggtttcaccaaggaataggcacttgtatttgaagggatcaataattcaataacatttcttaatactgctttggtcagttttcagggaattacttggttttattctttcttcagtaagacttactgtaatggtcacaatgatgtttgtagtggtgatgtcatccttggtatctaagacatcactacctgcccaccatcaacccccttgatgatttcccagtgtgggacagtaccagcccagccacacatgcacagcccctggaactctgtgacattcatgacccatgttcattgcagaatggctggctgaggccaagggctgcctgtgactcaggagaactatctaggccctttataaatgggccaggcagggcacagagggttgacctcagccttctcagtgccatgttctcatggttgtcccctatgtggcttttcacttccaaagtccatccagccccttaaccttgcctgaacttttaagcccaagaatggcagaaaatccctcagaataaatccttaaagaggcatttgacagagcatatagaaacttacacttggtaaaaagtgaccatagaaaaaatctgtttagcacaagcttaaatattactgtgctttttatgcggtctcccgcagcattttggaaccgggccatttttcctgagtgatcgtttcctttgatttttttccccccactgctttgattttgtaacacaagaataatattttttctggaccaaatttcttataagtggtcttgcccagggaatgatgattctattttctcttaagtaccaagaagtacatacacatacaagcacatttaatagcttcagatgggatggtttgactgtcaaaggcatatttgcaaaattctgttcctgttgattccagcccctgattcaaagccccaccattataatgctgttgcagacacagtggagaaagcccttcatcacctgcacggtagatgcaggctgttcttcctctcttgaggagcaagccctgagtcttgatgaatggattccctctaatgtgtaatgccttcaagatggactcaaaggtaaatccatcccatttgcagaaagggaaggttcctaacttccccaagttaataaccatctgcagtgttggacaaggcttcaaattgctgacacctttgttcataccagctggcaagattgggtcacataattaaccacacaggggcacattttgcagttaactcatcctaggggggctgctctgctcaaaatcagacattggactctgccttactgtgattttttttaaaggcctaactgactggctggcaggactttcctgtcagctttctcctacctagaagagtctctttcatgcttaggccactgaattctggagtctgcactgagttcttaactgaaagtctgtgcaaatcccaaatcctaatgaaagaaaaaggtatggtccttgtctgagggtgcccctctctcgcctccccgtggaaatgggattgcaagagcaccattgccctagagtgtctactcttcacttctatagcccttggatctccctttaatcagcgctgcaggcacttgggagaaaatccagctagggcctgcatttccttgaggtgattccaaaaagtagattttctaggtcagtggatatgaatgattttaaattgccctctagaaagtttttaaccaatttacttccttatttgcagacatttgctatgcagctgtattcgtttgtttcttcgttcgttcattcattcgtttatctatttattcatctattcattcacttattgattcagcaccaagactgtataccaggcactgtggacctgtaaacaaatattaattgattcctgccctgggtggggcttggtgggttttctctttgtctctttgaagagaattgagattgtgtctgggcctcctgaagactggccaggataagctatccatttacgtagtggtgaacggggatccagacttgggaggagggttgctcacccctggctgcacatcagaaccacctggggagctctaaacaaatcctgatgcccaggcccaaccatggatgattttgatttcactggccttgggtgtggcctgggaatctgggtcgttcaaacgagatttggtgggttcagggtggtatggctgtagacttatctgggtctttcaaagctacctgatcaaagtctcttgtgcagctagagttgattgtccctctccaccctttatcctagagagtctagcctgatgaaaatcctgcatcaggtccccaccacctctgctcttgaccttacacttgtcactttagacttgatgatagttactgttccaccgcacatcttgcctactgtgggccatgggaggccagcaccatgccaggcttatgtttgaatagactgaccattgccatggaaaagctgctgagaagaaaaaccatccctcttttcatcttatgtattgtttatttatagtttcaaatataatcctcgccttatttatttaggattccacagtgaagctcatttggctccctatcttttgttataataacaatagctaacccctactgagtatttaccatgtgccaggaactgtttcaagcatcttgcacatgtgaactcacctacccttcttaacaaccctgcggcatatacactgtcatcactcccattttacagatgaggaaactgaggcatagagaggctaaaggagtttgtcagtgttcacacagccagtcagtggctgagttgggcatctacatctcatttcatttaagtgaggcctcttctttacaagtcggaaggacttctcttggatttattatgcctttgcattgtattttctttctcaaaacagaacttcaggggacgagtgagtgtacacctatgagatctatcagcatccctatgctctcacagtggcagagtggcttaggacagagagcttaggaagagaatcattcaacagcttgagtcactttcgttgcatccattggaccaagttgtcttgatcttgtggagacataagtaactaaaagtagacggttcttacctgtgccaagggcaggcaggaccctctgcagttagcactctcacatctgcatacttttagaattgtcctcataagaaaaaggagagactgagaaaagcctagccatgattcagaaacagcctgaattcatctgtctttgaaagtacctagaacttctcctctgctcattcttctgggagaaatcagaggctctcggaagtcagtaattgtgatctcttgagtcataatttctgcagttgtatcagagcctaatgtggggatgcaagatggaaacagcacatggggctgttgccatagacgaggcagagagtggaggggctgaaatctcctggaaggaagggattagctgcccaaagaagaaaacagatttgagaaatccatttaccctgaaggtttaatagggaatgcaggtcagacttactcaaatgtctttagtcacgggtctctctcctgtttttatcttgtacccagctcagagtttcaaaagagagggggtaagtgaacctttaaaccccgacgttaatatttacatccacaatattaggaataagaattcttgtcatctattgaactgaaggaatggtattaaaataaatgtaaaattattaatcgtatatttctcagctattaagacaaactcttgcttgtgcttgtatgatcataacacccaactcagatttctaagaatgtcactagcatgtgtttggtttttctctaaagaattaatattgcctatgataagaaaataatttggaaatattcacatggatttttgacatggccctaaggaattagccattaaagaatttcagaatcctaattagtcttcaaataatcttttgcatggtaaagatcttctgcttggaagaacactatttcaatatactgtttgtcacttcattacctgaaagctgcttggaggcattttgtggaatgaaaatcatttgagggcccagagggtcaacacaaaggtgcacagagccttgaattctaaccgtaaccctgcccctacctagatgcgtggcctaggccaagtcaccttttctgagcctttgtttccccagctacaaaatgagttgtactagtctttgtaaaaatggaaattagaaagccatatgtcatctatcccctgcctttctttcctaccactctgaaatttgttagctcctctcctccccttctccaacctctctctctcgcggtctctctctctctctcttacacacacacacaaacacacacacacacctccttagagtgctggaatgtcattttgccatgatgccatggtgtctcctttcctttttcagatctttgctcaacaagaggccttccctgatcaccctcttcaaagcaggcccttccccacaccctgctccctgtcactctcagtccacttactctgattgactttcttcttagtgcctagcaccatcagaaagtataagaagacaacatggtgctggcacaggggtggacagagggactgatgaaatagactggaaagtccagcgacagacctacatgttgttgagtcgggggacagttcacacgtttattttattattttaaattggataatattaaaaagaaacaatttttagaataaaaccaaaaaagtggaccatgtatagaacattgtcatgatccaaggataatgattatgcaaattcggtacacttcggatccaaaaattaaaaagaaaaaaagaatgctaatttaaggttgggcacagtggctcacgcctatagtcccagctacttgggaggctaaggtgggaggatttcttgagcctaggagttggaggctacagtgagctatgattgccccactgccctccagcctgggtgacagagtcagaccctgtctctaaatgtctctatttttttttttttttacaaaagaatgctgatttggctggagaggattccttcttcagctgagaggttggcatagacaatctgcaaagacccttggagcccaaatatgattctgtgttcagcattcactaggcttcaggcagtttctactttgccagtagtaggtgtcattttccccattttgcaggcaaggaaactgcagctcagagaggccgagtcactttcccaaggccacacagttcttaagaggtcagaaccaggatatgtgtgcaggcttgactcacaagctcattcctgtgccatagagcacaagcttctgctggctatttgaaggtgtatgggtgtgactttggccagcctcttactagggaaatagaatattcctctccagcatgcaaaataggaggcctttgcctttaaggaacttctgactttccacttcagtcggagcttttatgggtgccgcatcccagagacccacagaggaggtctcagtagcagcactttgaagtctctcccacagggccccctcagttgagcacaattgttgtccaaagaccaacacattttggctcttgcttgccttaatactccctctccgttcccaaatacaaaaacattggcatttcttggaaagtggttttggctcaaagcctgctatctatcccacactctcaagccagcttcctcagggcccctgttgctttatttcattgagtgtttgtgtttgggggctgatgttgctgcctcctttgtaaggggcctcctggcaggtgcccagagaagtgtcctcaccagctaaccaacagtcttcactgcagctcccctctccacactgggctcagtagtggtgaaaacccacaatgcacacatgcagaaccactgagggtttttctcctttctgtggttattcaatagtatttttaatatctcttttcttgaatcaagggataattaacctaaattcataagtggtcagatggatacattttgtacacacctttgtaaccacctgaaagaggctataaaacagtcttgtcaccccagaaaaggcccttcaggctcctttccaattcattccctctcctccctccctggagcaaccactttctgatttctagcattgtaagtatttttgcctgtttttcgactttgcgtcaatgaaatcttacagcatgtgcacttttgtatctggcttccttccttcaacatggtggttttgagatgcaattgtgccattacctgtagcagcagtgcattgctttttattgctgagtagtattccacagtttgggtgtggcatttacctgttgaccaacatttaggttgcttccattttgtggttctcatgaataggactgcaatgaacatctgagtacaagtcttttatgaatataggttttcatttcttttgggagaatacccaggagtggaatggctgacaacagggcaggtagttactgaacttttctagaaggtgtgagacagttctccaaagtggtggtgccattgaccagtggtggacaatcgtttcacttgcaccatagcctcaccaacttttggtgtttctagtcttttaaatgtttagctgttgtaatggatgagatatggttgcttagttgttttttaaggacattttaaagaattttccagcatgtcagtcaatgccagctcagacactgaaaaggtcccataggagggaaaccaggtgttaaatgtttagggacaggaggtttctactaatcatccctgtccctaaagcagagtctttccagccctgagggctgtctgtgggctgcctcagggcaagctcaaggccgaagccctagagcggggaactagggaaggggaaggaggccagcaagagagtcagagtggagaagaggagggcccctgcgcagggaacactctgaatcacactgtgatagccacaggacaagtctcagggcaaatggtgtggcacgccacacagacactgatcgtctaacgtgtaagcagccggcaggcacagaacagcccgtgagcctgctcagggagtcccagccggcttgtcctctcagctgctctgaccattcaaggcagatatgacaacatttccgaggcagaattttgttaccgtctatttggcataggcaactggaaatcctccaaaatccagttgccaggcatggaaccagttaggtggcaagcatcagaaccattgggagccatccctggaagtgccagctatgggctttcctggattctccaaccatgtcctcacaagcgtgaagcctgcctctaaaatatttcagccaatccgtatatcttgaaattgagtattatgaattttaccctttttaaaaatagccatcatgctaaagagcaagccatcaatttcaccacttaaaaaaaaaacacacatttctagcattcctggtgctcttgagtattgatggagatgaagagataactggaactccagtagcagcctcaggatgggagcttccagattagaacttgagcttcccctccatggggtgtgcacttgctagcagaatggtggctaactgggttaggggttcacctaagtcagacagaaaatgtcccactgtaggtgccagtgtattttaagttacagacaccatagccctgagtcatgtacctctggagccagagagcttaggcctagggagaattttatcaaccttggtttagggggtgggaggctgggttcaagtcagctctgacgtttattgcagggcttgaggtgggtctggggttcttgatctataaaataggggcaatctctgcttacctcctcaggtggttgtgaaggttacagaagatacttggatgggccctttgcacacaagagcccccatggtgtcagtttggtcactccaagatggcaaggacccagtgtgtttagaaccagcatttgggagaagaacccagtgcaggaggaggatgcttttgaatgggcagtctttgcctagaaaatcaattatatagggcaccaagggagaaagctggccctaggttcttgagccatagatgctaactctcctaaaggactatctacagggacctttcctatagaaaatccagtgtggggagaaggtagaaatccaggcctccctgctctgcaaaccagcaaaccatcaaagggtacaaggagataagggggttgcagtcctagcagattcctctggcgagaagccaggtgtgccaacttcccaggtatgtttgcctgtgttgtgccagggacctgctgcttctccctcccacaacccccaccttctcacatgggtgagggccacctgagcagctgtggggctccagggagtgaagctgctgaaaaccctgccttttcctgctccctggaggcagctcccttatccctgccagctctgtgaatgccaatgaaacagactctttcagtggatatttatgcagttacagagcaaagaatggtcctgaccccatgtaaatacactgattcaagtcaggaagagcagccaagggtgttcagtgaatttactgcagaaaagctagcacgtggaagcttggaattgggctgtgagtacttgggctgcttctaaggttctggtttgaaagccactggtatgaaagccagtgggttctggggtgctctgagcttggtggaagtaaaagagtgggagctcccaacaagcagagagaagcctgcctgcccccagcactgtgcacagggtgggtcccaggaagctctgcattacttaaggtaatgctagctttgcttactgacacattgcaagagtaccgtggctcaaacacaatagaagttgatttctcactcacttaaagccccaaatggtttttcctgatggcaggcggcccttccccctgcaagccgtgattcaggcatgcaggcccttccatcctgtggctccactatcttcaacagggagcttctaaaaggtccttttgcatcaagctgaggggaaggggaaaagggttggagcatcacatgtggaaggaagctttgtaggatccaggcctggaagtggtgcccctcactttcaactcacgttccctttgctagaactcaggcacatggccacacccaactgcaagggaggctggaaaatgtagtccaggaagaagatgagatgggtttggtgaacagctggccagtcagccacagatgaaatatttctgggaagcacgggaatgaacccctgcctgggatgcaagctggaccagaggcatgggaagtgagaattgagctccaaaaagaaaagggagcacctatttcaagctgtgtccttcatgggccaatattcgctagctgcagtggtaatggtggagagggaagtccaagcagggctgggccaagacagcaaagctaggcagacctgcctgaggtgcagatgcaggctgagaaatcctaggttctggtcagagaccgaagacatctctacttcttccttcctgcctttctctactcccacctgctctctgcacgcaaccaggaacctttgctcctttgctgtctctcttccatctcctccagaagtgccttccctgcagtgaacgttgtgcatgttctggaaagctctgaccctccctcccatcaaaacaaccattcccggggattcacagctcagttcctgggggtggggagttggcgggatgggaagcaacaatccaacaaacccagtcacaccaaggtggtaccagtctgctggggatgcttagaaactgagatgagaaaataaatgtgaaatacctagtggggagcatggtaaatgcttagtaaatggtttattatcaacttgtcagtgtgcgtgtgagagggagtaagtgggggtggggggaagagagagagagagagagaaagaaaaagaatgaaagaaagaaagaaagaacaagaaagaggaggaggaggaggaggaggagctagcaaagccctgcaaattaaacggttttatcttttcctcccaacctaatggctcactagtgaattgatggcttcctgctcgtcagggcctgagagaacatcaagattgtgtcggttgagttgtcagtcctttagggcacaaggttaattgatgggtgattctgaacaccctttaaaagagctactaggttggtgcaaaattaattgcagtttttaccattgaaaggaatggcaaaaaccgcaattacttttgcatgaacctaatagataacccctctaatgtttgaagcactcttgactctccgctaagcctcaccagccctgggcttcaggcacctaacctactagcctgccccagacacacctgtcctcttctgcctttccttctgtcctgcacttttggaaaaccctcctccattccaccatctcctgcgccaaaatcctactcatgtggcaaggtccagttcacaggtcagctgcaacaataaagatttgatgactggaattcagagggaaaaaaatacctgaggtggaacaggtgaggagggagaatcctgatttaaggatcccccttgactattagagggacaacaggtggcttcactcctacttggccactctgtgtgtgtgtgtgtgtgtgtgtgtgtgtgtgtgtgtgtgcacgtgtgcacatgtatgtgtgcaaacacatgcattctggaactcttcccccaataaaataggaaataatacctataatcgttattgctaactagccagatgttatacagccgatctttttccttcccccaccccaacttcgtattgtttatgctatattagctccaaccatgatacttgctttaggacacatacagtgagtttttagggacttcaaaagcctcaccaaccctaagattctgcggaggatgttgttctgcttttgacaaaacagaattccagaaagaagcttccctgtctaaaagatgagtactcttcaccctctctttcctgcattgtctgtacttctcgggtcgaggttattattattattattattattattattaggcagcatgcagctgatgaagtgaagtagtgtttatttattgatttttggtccccgagttggaacacaagatcaccagaaaagaaactccctctgtgactcatcccaggaacatcttgcattccagccagcacaaatatgattcaaagaactttctggagggccccagttatattttagcaaaggaacacattagctatgctgaccatctcttgaacgttttgcttttggaaagatagtcatctctggccccctcgtgtgtcttgttttttttataagatcttgagtcacaccccttttgagctgattcccctgtagtgtgagcattgttattataaaggagtgtcttcttcacaggggttacagaaggtaccaccaactggggaaacatttggtcatggtggcctaaattaatgacatttcgatattcacataagcattgagactttccaggccatggctggtgtagcagacatttgtcggtgtcctgccatttcctgcccagactggcctcttatacaccaaatgctacttactgcaaacatccatgatgctccctaaaggtgtgagtttttggtttttggtttttgtctcaggagcacactagatctgcatgctgggctagctggaagtgccaaggaatgactacatcctccaggagcagcccttggccagtgatggatgggggcgggtgaataaacagcccaacttcctagcctctcggttgagatgactctgaggtctccccagtggaattgagcttcagttgcccacagtggtaacttgtttgataaattggcttccttgctttccctgtctcaccacttcactcctctactggtgttgtctgggatcttctcccaaataaattactttcagttaatccttgcctcagggtctgtttgtgggggagcccaagctaagacaactagctagttgagttcaccaaaacccaacagcctcctctcttcactccccttgccctgttcatcaccatcgttagtaatgattcaaagcacataataggtgatggtcatgaagttgccattgtggctgtagcgctgcagtagggtgttgtgcatgggagtgcagtcctttgagagccctaacttctgcatggaaacctggtaagacagaaaccagcgtttcaggaggtagccagttcagtaacagggccctggacaactttggatgctgctaaaatctctgcaccagggaggcacgtactcaggaggttcatgttgggtgagcaataagtgtttgctgattgtgtctgtaaaggaatgaataattgactcacattcatgtccttccttagttctgagtgcttaagggtcaaggtcacgcccctgccccctttatttgatctcaggtgccttccaatgggccccgcaaacttaatcatagttgtcggttcttatctctatggagagatttcaagacagctaggaaggttcctccccatgaccagtatctgaaatgactcaattatagtttcatttctttgtccatagctttattactggctggattatctttattataccaataaaggaacataatacttcagccttatcagtcatgcacctcattgagaatgagtttatcagcttctttctggaaaacccaattttgatgggagaaatctaataattctgactatccaaggagagattggaggagctggcgggtaggcaaaaataaatattagacacagaaagaaggtacatttagatttttttcctgggactgataactcagccaagccacaaggggatgtgcttgatgattttagaggcataggagaagttctgcccaaatttggagcaccttccctaagtacttgcagtactcagacttgtaaacaatgctatattttattttttttaccatgtcctcactgtgctaagaagttccagtcctgtctctccctccaccctgctgtcctgcaaccaagctattgtaggttacagcatccccttgtggccagctaagtaactctcattcagtgttttcctcacagctttcctcagtttctctgtgttctttcactcttctgttatagctaaccaatctttcctttggacctacatgaacttttgaatcttctctccttcgactcttgcctagttacctcaaaaaggctctttgctttctctctccctcttatccttaccctcatcctctccgcttccacttcttccatgtttttgtgagtgagaaaatgagcttcatcgccactgaaaagtaggagaggagagctacttaagctctcgtgcaaaggagaaggaaaactgaaggatatgaagtgaaattatgtgcggtcaatcagcagtaacttccgaacccttgaaagtgctcatgagtccatattcaagatacaaaaggttctggccaccttttctttctcccccaggctttcagtctgaatgagaaacagatttgtgtatttatttgtcttcccactatatttaatttctaacattgggagagcattgttttctgttttcacttcaaatgctcatttcagctatgttgggtgttaggtgggtttttgtgggctggcctggaaaccttcccgtcaggtgtaacaccaagcttatggtaagtgccttcttagttcctagtagctgatttttacatgaatctttgaacaaacagggttgcgaatgaataaagccattcaggtgcaaagggagcatgggtgatactactcaagatgctcacaagaaatatggccggtggatctgatgatgccaatgatgccaatggcacaatgatgatgatggcactgacaatgagaatgatggtgaagatgaagactgtatcgacagtgctgacaacaataatgctaatgacattgatgatggtaccagtgatgatgatgacaatacaataattgccatgatttactgagcactttctgtgtgtcaggcactgtgccaagtacttcacttagcttatctcctttaatcattacaaccacccaatgtgacaggtttttttttttaatcattttacacagagagaaactgaggctgagaacttacttgccccaggtcacacagctagcaaaattaggcagagctgaagtttgaacctaggcctgtctaagttcaaagcttatactcctaaccactctcatagggggcccagggcccagggtgaggctgacactgtctccatgccaaagggtggcaagggattcacatgcattagaagaaggggaaaatctgaactccagttctttgtacttcagaaatctgcaccccttccttccagtgacccctcagagggtctatttctggcacactggtctctggaaaatgtcctgctaatgacacaggattataaacagtctttttcccagaacaaaaatttaacctttgtatctcaatctaattagaagtattttctcttccagaggcaggttttttcctcctctttgttccaaatttaagaggtttctttgttgccagaaaaatgtccaaaaaccgtagctctttaagatgatagaccttggcccaagaccttaaacgtgacctgagctcctgcatgagatggctgttccagcagcagcacctgagggtgcttggggttctgggtgtccaaccgaactgtagggcattggcccaatgcagggatgggcacttgctgactctcacagtcccctgtccaggtgagtgttccctaccaccaccagcagctctttatgattttcttctgtgatgctgaggtttgccaagacctgaggaaggcagttcattcctgttagtatcaggagcagccatctctagaaaatatacatttgttcctttccttagagagatccttgcatgaatatcaccccttccagctgtctagggactggcattcttaccttagagacttactcctttacctctgcaggaaatgtgagccttaaaggagccctgttaaaagcagataatcctgggataatatggatttggttaatatcttcagaatggagccaagagagatggcaacctgcctacaaagaaagtggtatcaggttggaggaataagagatgcatgcctggcacacagtaggtgcccacatcatttttgaaagaatgaataaaaatgaatggccacaaatctagttccatactgtagccctgcagtcaggcccgtgtgggcccccaaacccatcatagatcctttgcgggcaggctgaaggtagtaggggcttggaaaaccaggcctgggagctggtggcgtcctccctccaattcctccttggtgctcccacttgcccatcctttggggcccacagcaattcctcctccggcagctcctgggaggctaggtttgactcctccccagcaggcaccactggctccaaggaggcctgagtgagagtagggcagtcccccatgttacaaaagaggaaactgagtcccagatgtataaaacaacattccaacagtcatgaaaagttcatgtgtgtcctgaatctcttcatttcaatgacttatcttttggatatcactgagtcaaggcatgggggtgttctttttttgagcaagctcctcacctgtcaaactttttgacattttgttggttgaataaagccatcccacatactttggcgttagatgctggttccaatagagatgttctaatcttgggtgactgactgtgctgactctatagctcgtgtgttaaactcaagtgctcctcaacatcctttgaaatgtgaaacagaggcaacaggtggggtaatgtgcctttaaggaaggagaacgggtctgggagtcagtgtactctatgctgtgtgaacttgagcaagtcacttctcctctgagcctcaggttcctgttcttcaaaacaagaggggtggggccgggcacggtggctcatgcctgtaatcccagcactttgggaagtcgaggtgggaggattacttgaggccaggagttcaagaccagcctgggtaccatagtgagattccagtctcaacaaaaataaaagtaaaaatcaggtgggcattgtggcacacacctgtagtcccagctacttaggaggctgaggcaggagggttgcttgagtcttggaggttgagggtgcagtaagtaatgattgcacactgtactccagcctgggcaacagagtgagactctccccccaaaaacacaaaaaaacccagaaggggtaggttgggccagtaacactaagacttgttaaggcaggggcaccctggaagtctccctgggccctgagagcttcatttctcctgctgagttgtaacgttttcattctcacactcctattagaaaaaaaaaattttgagcactccccttaacacacacacacatgcacacacatatataattagatttatatgccttcctatatttattacatacactataaaataaaaaacaggaattaaaaagattagatgataaaacaaacataaataagttttatgatacctcagggcatgaccttacctcctctcactgggaagaccttgggccctcctgctgtttatggccagtttctgacgcttggctccacttctcctatttttcacaaatatcagatcagagataatatttgtactctgtcctccctaacagatcttccccgtagccactgtccgtcctcatgaagtttagtcccagttgcaatgtttgtggtcactactgttttcataaatgaattagcgtgtcagggaactcatctgtaaagctaatctgggcattcatattcccttcagagggctgtgtagacctctggatgtaaaaggcagtcgaccataaggcaggtgactattttgtgtattcctcatattttaaccaatttgagactacattcatgtggtaattatgttcacagctttggtaaaaaggacctgtactgatgtttaaagcttagaaaatttaaccactggggcaagtaattgacaattattataccctatggggagaggaaaaccagttgttacccagttggaattacttcttagatatttagtgcatctcaagtcccgaatggtaaaaccatgtacatgtagaattaaatgatgaaaattatgcttttcttacttggctcatagagagtggctggtgatttttatgcagaattaggttagtcattgaaggtttggtttaagtactgaatggaaagcacaaaatagactcagaatagggcattgatggaaggggcaagattcttagcagaggtctctgggaagtcagccttgcaagagggagagccatctcacgtcttcctgggggtgagggcacatggggagacactgcgggggccgggggggaagaggagggagtttggtgtgttgatagcctcagtcttttctgggaagtaagaaggaagatgggcgattgagaaggtcagcagaccagcagtcgtgtgctctggcctttagattaagggtccgcaacctcactgtacattagaatcacctgctgcatcctagaataattaaatcagagtcttaggggtaggacctaggcatggttttttttttaagttccagattactccaatgaatagcaaaatctgagaaccagtggtagaccagcacttctcagactttaatgtgcatacacatctcctggggccctgtttggaaggcagattctgattcagtgggtctgggctgtggcctgagatttgtatttctagcaagatcctgggtgctgctgctgctgctgctccaaggaccccactttgagcaacaagggcatccaggggtattcaatcttttggcttccctgggccacattggaagaagaattgtcttggaccacacataaaatacactaatgatagctgatgagataaaaaaaagaattgcaaaaaaaatctcataatgttttaagaaagtttacaaatttgtgtgggccgcattcaaagccgtctgggccgcatgcgacccttgggccgccagttggacaagcttgggtagacagtcctactttgactagaaataattgatagccgtctccatgctccatagaaaccaaagctgttgatattttacaattggaaaacccatatcttgagaaaattttcagcatatgttttaagatgtgattgttgtaggggaagaaacttaccttgatagatggcttaatttaaaaagcaaaatacttgacctctaatttaggctattctccaagtcctaaaatccacctatttgttggttgcgggcatctaacactgacccatcagagcctcccgtggctggtgaaggtgagtggctgccatgttctcccaccatggcacctgcgggtctgaccctctgctcttcccgaaacaagagcctggtgacctctgtaagaagtggccttgtgtaagttttagtcagcctttttgagttgcagcttactcatcaataaaaagagtcggcaagagacttgagatgtcagctttaatgtccctgcccaccttgacactccatgagtgtataaatggtgtgcctgcgacaagagggtgaggatgagaacaccaggctcaggaaggcttaggcgttcatttgtgcaccaattcatccagaagatatttcctcagcacctactagtgccagatatgaggtgggagactatcccctgctcctggagaaagaagtaaataagaaatcccagtatgggctgggcagagtcaggactagacaaagtcaagttggggtcctttgggagcccagtgagggtgggggatgatctcagaagaagcaactttagagctgaaccccttaagtcagacagatgagcaggagttggctgggtgaaggctgaggtgggagagagctccaggctaatggtcagaccctagggagaccggcctctggtataattagatctttgcaataattagatgaggggttcagataacagttctgtgaccccatgatatggtttggctttgtatccccacccaaatctcacggcaaattgtaatctccagtgttagaggtaggggcctagtgggaggtgattggaccataggacttcccccttgctgttcttacgatagagttctcaacaaaatctgcttgtttaaaagtgtgtggcacctccccccacctcttgccggccacgtgaagatgtgcttccttccccttcaccttctgccatgattgtaagtttcctgatccccagaagcagaagcctgtatggcccacagaaccgtgagccaattaaacctcttttcttaataataaattacccagtctcaggtatgtctttataggagtgtgagaacagattaatacaccccaaaagtctgcaagcagagctagtctcccagtccctccctacctcctcatctgtcctgggccctgagtcttttccccactgtctccatacagggggcacatgggctacatgggggtgaggccctagcaactggctgcaaaccaagatggtgaggtctccagggtctccagcaacttgcagatccaggttgcctgcttcctacccagccacactgccactgtttactgacctccactcccacacccctggggataatggggacaggtggaatggatgggtgccctcatttaaacccatttgaaaatgttttgcaaaacgcaaacgaaatgttccctgtcacctctgaagaaattcatgccccctgggcttgagcatcaaccggctcctttgatgctccttgatttgaagaggtcccccacccaccctaggcccaagctaatcagcagcttgtctgagtggggagatgggcctccaccttctctccagtcactatctggctacttggcttgtcctcagggacacagactcaccctttgaacccacaattcatgagatagttttgtattcttagggcatcgccgaggcttccagtattagcccctgcagcagcaacacccactatgctcccactggatgcacccagaccacctcagctgctgactcagagtcagagtggggtgcttgctggcaggttgaacagcaagaggaggagatgtagtgagaaagaccgaacgaggctttctgggaggtgggagggtgcatgatgaaggccaagttcatgttcctttgcctgggtgtcccaaggccagcgccatacttggtggggactaggtggaggcaggcaagcctgtctcagggccagcagctctctagagaaaagcccagggctactctcaggcctgctttggctgagtagtcaggcagatctggagctgtcctgttgaaggaggtggaagtgaggtttgggccaggggtttttcccctttgccctgagatcctgcatactgctcccctctacccacaccttggcctgtcctctgtccttcatcccactgggcctcagcgtttttcccagagacttgagtcacagcaggggatgcaagggcctctctgtagctcattggtgctgagatgccctccaacccatgtgacatctgtctctggaaggcaggctggggacaggtgagtaaccagaagtaggctgagaggatggaggcccctcaagccctccagtaacagaaccatagccacttcgggctgcagtccccaaggacaggaggaactccggtgaccagagggacagacgaggccccttgtgggggaaaaaagaacaacagttcaatgactttactgggaaggacctggcctccactttgaagaaatgtgatgctctcatactgtttcctgcatgcctctgcaggcacatgcactcggtgttgaaggagaggctgtggggactgcttttcccaggaaacaaaatgcatggaggggcgtggccttcacagctctcccagtcgaagggaagcctgggaagcccagcctttatgtacctttaggctagttatttaatctccctgtggaatcagtttttccaccaacaaaatgggcataattgtaagacccctctggctgggttgttctcaacagagggcctggcaaatggtagatgctcaatgagttgtagctcttgccatccatgggaggaacaggggcctgagggaggccgcctgccctggcaaagtcctcttttcactttctgagcaggactgttctgggaatgttagcaggcctagaccaaagccaggcagggaagggactgaggtttcacaggaaatgatgagaactggtacctaagctgaaggtgtgtgcaaggagcaggtggaggaggcatccagaagtttgtcttctttcctttgggaggggattgagagaagcagacagggagggagagaagctgccatttctgcgagggtggagagatgcagctgttatgagaaagctgtctcacagctggataatcctaaccccacaggaagaccaaatgtggcacagaacatgtcttgacttctgtagctgcccttgtcctcaccagtcctactgcagcttcccttcagccttttcttacccttccccaagggttctggccactgtgagggacaaggatctggccttaggttctcagggccttcatggggctttgtgcaagtggccaacaaatatttgtcctgctgatgtggatgcctctcctggcataacgttgatgcgtttgcatgctagcagatctctgatcaaagacgtgttgcctccactagagtataatgtccatgaaaacaagaacctcgtctgtttcactcaggatgagtgaatgaatgaattcatacatgcatgcatgaatgaatggtgtattagaggccaggtgcagtggctcacacttgtaatcccagcacttgggaagccgaagtgggaggatcacttgaggccaggagttcaagatgatcccggacaacatggtgaaaccccatctctactaaaaatacaaaaattagctgggcatggtggtgtgcacctgtagtcccagctactcgggaggctgaggcagaagaatcacttgaatccaggaggcagaggttgcagtgagccaagattgcgccactgcgctccagcctgggctgcagagcaggactccctctcacaaaaaaaaaaagaaagaagaaaaaagaaaaaaaaaaaaaggcatgttggaggcatggcatcttctgggctgaatcaggattcactcctaaagaaccagacccttcagctagggcaagccccctcagcctccctggggccaggctgcctcccaactctgtcccaagggggttactggccagcatgctgggtcacctcatggcttccagagggagacacgctctggatcctgccaaaggtgtggcccaccagtcattctccacaaagttgtttgcacagcatcctttccctccccccttctcctcctgcctcagagaaactccttgttctgtgcatgtgacacattctgattgcctggaaataccacagagttgttcatttgttaaagctgccttactgtagtgagacatcatttgcttatttcttttcttttcttttcttttttttttaaaggagtctcactctgtcacccaggctggagtgcagtgatgcgatctcggctcactgcaacctccgcctcctgagttcaagccattctcctgcctcagcctcccgagtagagtagctgggactacaggcgtgcgacatcatgcccagctaatttttgtatttttagtagagatgggatttcatcatgttggccaggctggtctcgaactcctgacctcaaatgatctgcccacctcagcctcccaaagtgctgagattacaggcatgagccactgcacccagcctcgtttgtttatttctagccccatggtgtgctgggccgcctctctttctttggaggttgtgttggtaatttcggggtgaggagaggaggacgagctgaccacaggactaaagtctaggcagttgggatagatgaggtaaaaaatctcagttgcccaaggcctgcccagtgaaactgaggattattgaattattattgagcccaaccagactccaaggctgctcagatccctgagttagacatggtgcctgccttctccatggtaacgaggccaaatatggacaggtttccatggagagccctatcgcatctgcagccctgcttccaccaggaagcacacgcgctaggtgcctttggcctctcaggaggtggccagaggtctgtgggaggtgccgaggacattgagaaagtgtgcctgacctatgaggattttcgtttccaacaagtgttccatctccccagccctaggctcaccaatgccctcttcctcttggcagctagatattaggagaggccacagatcagatagatgagctgattggggaagtgacagtggacccaatgaccattcatgcaagtcatcatcgatcttcaccttgccctggggaacggattttgctgttactgggagaaatgggaatgtcattggtcagagggagacagagagacaactgtaatgacccttgtgcttatcaaacctcttttggaagaatgattgctacagagtatttaaaatgccattttccatagtcatagcatattcacatgtgacaaggcattatttttttccttaaaggaaagtaagtcttcactgcttatttgaatttgaacaagtcaaatttctacatatcttaactgtctgacatagcaacttggactgaaacttcgtttttgttgaaggccaaacatataagctgagaattaggcttaaaaaatgcctggtttaacctcacttggctatttactgattacatcatctgcatttatagcttaatcatctgttaaattggggttctccacgcacacaggatcatgtggttgtgtttgtatatattaggagatatctataacctgaacatatacatagagagatgggttatgctccctggttaactaaaacgtggaaactttctaaagatgtgagagagctcttaaggcaattataaatagtcttttaaggaagattcatattgtatgttctgtgttgcaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcac

SEQ ID NO: 3140 - DNA, 61286 bp, human; identical to SEQ ID NO: 3139

SEQ ID NO: 3141 - DNA, 61286 bp, human; identical to SEQ ID NO: 3139

SEQ ID NO: 3142 - DNA, 57952 bp, human
gtgcctcggacaacgagtgtacgcagttaccacacagttaccaagcagttacctcagagccgcggcgcagacgtaggcctcaggtctcgggcctcaggtctcgggcctcagagccagaccccgccatctcacgatgtcagagaggacccaggaacagggtaaagtgacctcgcctcaactggcccgctagcttgggcctcaagttctgtcaagagtctggatggcacccacttaggtggccattcaggggcggcaggattggctagtcattgaccggggcgtgtcggggggcggcctctgggtattggccatctgccgccgattgctcagcgcgccggtgggaaatttggcgtggtggaccgagatggcccagggttcaggtcgtctcaggggctcaagatgtcccggagacgtgaggtgatcctgaggctcatggcgtctccgtggctcttggtggctcagggttggggtgacttgggcttgtgccgagagtgcgtcaagaggctgggcctggttgccctctggcccgcggttctttccggagcctcgagtggctgggaaacaatctcggcgctcgcgacgccgggctccggcgatacagatctatgcggccgcactttttcttgaatttattggttttccctggtgggcagccgcggaacacagccctgttcagcgttttggcatagcggctggggcacagcctcaaattccgggtgttctgagggggtgctttgggtggtacccgccgcctctcccggggtgcccgcgtgggttacattttgagatttcgaagcttattagatacttgatgctgactttctgggacgagcttatcctttttcagctgttctctttttggtgaggcggggtatgggggggcgaggaatgaggaatgactcagactttcacagaggttttttgttgttgttttttgtttttgtttttgcttggttttgttttgttttgttttgttttcagacagagtcttgctctggtgcccaggtgggagtgcaggggcgccatgtcggctcactgcagcctccgcttcctggattcaagcggtcctctcacctcagcctcctgaggagcggagactacaggcgtgcaccaccacgcccggctaatttttgtattttttgttgagacgggatttcgtcatgttgcccacactggtctcgaactcctgggctcaggcaatgctcccgcctcagtctcccaaagtgctaggattactggcgtgaaccaccccactgggtgagagctttgagtctaaagaattgacaaattcccgagttgatttcctgtcagacattttgcggttgagacatagagtctgaggctttgatggtaaccgagtttgatttagagacagactgtgcagcttcgctgttttattgtaaatacgtaaatgaggaggaagagaaacacgtagggtgttgggaacagaggcggaagttgggagatcctgcgaaatcggagtccctttggagtgggggaggccgtcgaggcgtgcgagggcccggcccccttgccgcgtggtcgttaagaggaaaggccctgatttggctggtggcggatcgcgtccctcccggctctccccgagtgcggcaaactggcttcaggttgactaaaagcgatttttccagcagctttgctgcgccttgctttctaaagcgaggcgtgggctgggtgcctttttgagcctcacttgtccggcctgtggcaagtgctgggcgatgggatacggttctggcggcaaaggaagggctgcctttgagagtcccgcaggaaggtttagaaagtggttgttcttaaaacaaacggagcggtctggctgttgtaattggccccgttttgctgtgtgttcctcaaagtggtcccggcgtgaaaagccgttttcagaactcattgtgagctgtgcctcatctgatgagttgatggcaattgaaagccttgcgccttggtagtataatgttcaaacaatttcttgtttttgtttgtttgttttgttttgtttttttgaggcagagtctctctctgtcgcccaggctggagtgcaatggcgcaatctcggctcactgcaacctccacctcccaggttcaagcgattctccggcctcagcctcccgagtagctgggactacaggcgcacgccacctcgccccgctgatttctgtattggtagagacagggtttcactgtgttggccaggctggtctcgaactcctgaccccaagtgatccgcccgcctcggcgtcccaaagtgcggggattacgagtgagagccaccacgcccggccatcttcaaacaatttctaagtgttaaaatgtcttttaaaatttaattgggaaagttatgtgtacacctaaaagaactgattggacttttacatatttactgagaaaccttagcggtgttgtcaatagctttactagctctagtttgaaagatctgttgatatacaaaagcttgtcttaaaaatacactttcagttgccttggttattttcttctgatgacagaatctaaagttccttgtacagaatcgacagaaaagtctaatgataataaatttgctattcagtaatagccacctagataaccattggtatgttacctttggctctcaaagttaggattatactgtatttttctgttttgaatccttttctcccctttaactttatttaactttatttcacaagcatatctagtattagtacattttctttgggaacatgcttcttcttcttcttgttctttctttcttttttgtttgagacagggtctcgttttgtcgcccaggctggagtgcagtggcgggatcctggctcactgcaacctcagcctcccgggtgcaagccatcctacctcagcctcccaagtagctgggactacaggcacatgccaccactcccggctaatttttctattattattattattattattattattttttggtagagacaggatttcgccatgttgcccaggttggtctcgaacttctgagctcaagcgatctgccccacttggcctcccaaagttctgggattacaggcgttcgctaccgcgccctgcctgagaacacacttcttattggcaatataccattccagctcagggaaataccaaaatttatttaagcttttgtttatttaatactttggtttagataattaggtggtttctaatgttctattttttttccatgaagactattaagtagacttcagagtgactcttaaaaaaaccccactttttacgggtgagaaaacagaggcaaaagagtcaatttatctggcccaacggtcatacctctggataattacagagcctgaattggaaccttcattctgtgattcctaatttagtaccattttcaaatcatcacatgcccctcacactagctaattattttattctcctgcattagtctatttgaaataaatagaataaatccaagttatgatgtagtttaaatgtggtctgtgagtgaatacttcaagcttaaatgtgttctttttcaggccagctttaagaaataaagcttattttgatcttggacattttgcataatgtgttttcatattcattaaaatggtttacctagttgatatttcacatctggtatatttgtcattacctatttcacattttgtgagattcagttttaattcatttcataacaacatttacttttgcactttatttctgcattatcagtcatcatagacattaatattagtttttagagaacaaatttagaacttcatggtcaccacaagtatgtctacttaacaccagttgcatcgtttaagttaaaagcatatcattgaacactgtggcatgggccagctggccacatttcttaaatgagaagaaatttattgctctacgaaattggaagtactagagatagtagtctatgtgtgtatatgcatacatacatatatacatacttcaaaacttcctactattggttcattaactaacttgtaatgattacagatataaaaatatgtaatacaaattttcagctaaaatatgttttttaaacaatctataactttataaggtagcttcctcaagaaactgtttatttaatgtgatattgaatctaatcttcctctttgcttattcttagattttgttattataactgtcgacgacagtgatgataacaatgattgcagtattgagatggtggaagtttctgaaacagcagataattccactaatgacatagcagatgattccacttatgtcacagcagataatcccactgatgacacagccacacaaccaaattttccaggcggcaatgatggccatcaccgtccactccaaatgtcatatggtaattttgttaaatttcatccttggcaaaattttactctctggtccccatttccagtaaattgcttaaatattcctgtaacctttacagtaattagttatgaccagagggcttagcttcatggtaataccacaatgtttacttctgcttgcattttcccttcacttaagctttgccatgtctcctttgttctgtgtgagacagtcccaggaagcattggggagaatatattctctgtctttgaacaattatttatatctggcaactataattgtaacaatttggtggcaatgcaaaagtaaaaagctaaaactgaacttctaggaataacagcttgagtcaagagtccatggagcaggtggcatgattatctatgtagaaagtctcaaagaagcaacaaaaatctcctggaagtcataagtgattatagcaaggttgcaggaaacaggttaatatacaaaagttaatcactttactacatgccaacagtaaacaattggaatttgaaatttacattagcatccaagaccccatggaaagtggagtcctgcaaccagaactgctatagccactggtcctttgaatggctctctaggaaatgtgagaccatccacatcctcacttgtacagagagccatgagacgttaactccttggaatatttcttccttagctgtatgacaatttgttctttgccctttgcttagagaattggattttcttctctttaaaacatggaaatgttattgcctatgttggagactggcaaattttttctgtaaggggccagataataaatattttaggctttgcaggccataagttctctgctttaagtatttaactctgcctttatagcatgaaagcagctgatatgtaaacagatggttgtggctgtgtttcaataaaactttatggtcattgaaatttgaatttcctataatttttccatttcatgaaatattctcccccccatcatttacaaatgtaaaaaaagtccataatatcttagcttatgagctatacaagaacaggtggcaaagtggatttggtccacaggtggtggtttgctgatccctgatctgataccaaaaaagtcatttgataccacttatctgttttggttttaaaactatatgcagggctagcaggatacttctttagtgtgttatagaacatctgatatcatagagacagaaagtagaatagaggttaccagggactgaggtgagggggagttattgtgtaatgggtacagagtgtatgttggggatgatagaaatattttgggtatagatagtgaggatagttatacaactacctgaatatatttaatgccactgaattgtatacttacaaatgattaaaatgataaatgtttgcctttcaatgtatacacatcattatatcaaaatagtgaaaaattagaagccatataaatgtcccacagtggaaaacagataacagaacctctggacatccataaaatggaatattatgcaggcatttaaaaatatttttaaaattataaatgacacacaaaattgcttaaaaatatatgagtaagataaataaatgtatttaaaggttacaatatttattgctgatggattgctttctctttttatttagattctgaattatttgtaatgagctgaattttttaggtgaatttttttttctttctttttttttttttttttttttttttgagacagagtctctctctgtcgcccaggttggagtgcagtggtgtgatctcggctcactgcaatctctgcctcccgggctcaagtgactctcctgcctcagcttcctgagtagctgccaccaccacgcctggctaatttttgtatttttaatagagagaggagttcacattgttggccaggctggtcttgaactcctggcctcaagtgatccgcccgcctcagccccccaaagtgctgggattacaggcatgagccaccacgcccggccataggtgaactttttatggaagtctatgacatacaaaatatgcacacatcataaatatacagcttaaataaatttcaaagtaatacatgcatataaccagcacccatcccaagaaatataaggttatgagctccctagaatcctatccaccccctttcagtcactactcttctttgtaaggtaaccactatcctgacttctcccaccatagattacttttttctgtttttgagttttataccaattgaatcatatgctatactctcttttatatctggcatttttttcagagacagggtcccactgtgttgcccatgctgtacttgaactccggggctcaattgatcctcctggctcagctcctgtgtagctggaactataggcacgtgccaccacacctggcttgtgtctggctttttttacttcttgctatgtgctgcaatagttggtttattctcactgctgtatagttcctttgtttgaatacatcagaatgtaattacttatagcttgcattatagtcagaaaaaaaaaacagcttaaaaaatagaatttggttgaatttacagctcagtttggaggtatcttattgtatcttttattttcttcttcttattatttttgagtcagggtctggctctgtcacccaggctggagtgcagtggcatgatcacagctcactgcagcctcaacctcttggactcaagcaattcttccacctcagccttcccagtagctgggatgacaggcgcacgccaccatgcccaggtatttatttttatttttatttttagtagagatgatatcttgctatgttgcccaggctggtctccaactcttgagctcaagtgatcctcctgcctcagcctcctaaaatgttgagattacaggtgtgagccaccgggtctagcctggagggattttataacttgatatttctatataacattagtctgcatttatctaacttgagagttagttctcccattttctttatccccttttgatttctctcttttgggtccttggtcattaggatctccactatagaatgaaaggaaacaggaaagagatgaaacttgaatcccttaattgtgcctctcattactgccctggctcaggaaggtttaagtgaagtagctctttcattaaagtgtcactcccagtaactgtgatgcaggcttttaaagcaaatctctagtacaagatacaatccaatactgttgcagccaatgtcttcttctagttccgtagttaggtgactcagagccataaccagatcttcctaattctagattgtttggcttacatttcacatccatttatttaggattaatataaaatttaataaggcaatcctaacttgaaagctgaaatggaccttagagatcatctcaactgatgttaacctggcagatgaggaggtggtgtctctagtggtctgcccagctcacatagcagtgggggtccgatctagaatagattcctggcttacattttggacacaatgccatctccttagtcaagggccttttgggggctcctttacaaaagcagttagcccttgcgttctcttgttcatttgtttccagcatttactatgtaggctttaagttattaagcagtcacttcacagtttgtaattgtgtttgatttgattcttattcctagtcataagtaatatagcccttcagttttaaaatagttactctaaattggtcatggaagaattcttgttttgtcactctaaaattcaacccaaagtccaattcaatttgagttagcattctgagagcatatccgtattaaggttattaagagagtagtgtatgaaataactttttaatgcattgcttcacagtagcccatggtgaccaaatagtttcacagataaaccacccagtacatttaagaagatacagttacaactcagaggaagtggattttccaaaaagaggaagattctatactccagaggtagatattatggtttgtttattaaagtgaaaatctctctttgttcttttcattctgctgtatttctttttaaaaaatggagttgaatttcatgcagtaaaatgcacaaatcagtgagttttgataaatgtgtatacttacaccccatgaagataatgaacattttggctgggcgcagtggctcatgcctgtaatcccagcactttgggaggccaaggcgggtagatcacctgaggtcaggagtttgagaccagcctggccaacgtggtgaaaccccatctcttctaaaaataaaaaaaaaaattagcttggcgtggtggtgcatgcctgcaatcctagctactcgggaggctgaggcaggagaatcgcttgaaccccggaggcggaggttgcagtgagccgagattgcgccactgcactccagcctgggtgacagaacaatactctgtctcaaaaaaaaaaaaaaaaaaaagacagtaataaacattttcatcaccctagaaagtggcctgggacctcttcccagtaagtccccatctcccttaactttgggggaaatatattttgatttttttttccatcctagatgagttttgcctgttctagaacttcacataaatagaactgtacagtatgtactgttttgggtcatagtcttttttcctgagaagaatgttttggagatttgtttcatagtattaatatttcattcctgttcattgctgagtggtattctgtcatatgaatactcataatttgcttacccatttttttttttttctgagatggagtcttgctctgtcatccaggctggagtgcaatggcacgatctcggctcaccgcaacctccacctcccgggttcaagcgattctcctacctcagcctcctgagtagttggaattacaggagcccgccaccacattcggctaatttttggatttttagtagagacagtgtttcaccatgttggccaggatgatgtcaaactcctgacctcaggtgatctgcctgcctcggcttcccaaagtcctgggattacaggcgtgagccaccgcatccggcctgtccattcttttgatggacatttgggttgtttgcagttttgggctattaggagtaaagtgactatgaacatgcttatggcagtctctttgtgaacctatgtttgcatttaatttgggtaaatacctgagagtggaagttttaggtaatggggtaggtgaaagtttatgagaaattgccagtttttctaagtggtcatactgttttacattaccactatattctcctgtgctttttgacctctgaagttgaataaaatagattattaaactatatataatttggcttaacagaaaatgtatttgtttacttacatgaggatgtggatatcagtgccacataagtagtgtaggcaattcttaacttctatcagcctcaatattttcatttttggggataatgctaattatctgcccagtgtcatggttttgtacataattatctgaaagcactttggaaagcatgaagcactatacaagggtaagatggtaatattttgtttacaattattaatatctattataatttgatataattttgccatctaataagtttgtaatgctgggctaattcgattaattttttatcatgtattttgaaacaaagaagtaggtaactccttggtatgtttatattaaaattatttttatggcccacaattcatctttagaataattatacagaaatataatggttatttactgtctgtttacttatttataccctgccttactccaaaaaatattttaagatgatttacagattaatttatcaagaaaaatagatggttaagtgtttcttgtcttgtccacagagtgtcactgttggtttatttgaaaatcaaaagccatttaagatttggttctttgttcatggttagaaatacttgcttttaaagcagttctggtgctagaagactcgtttatctaccacgaagtatataaatggttaagcttgatgaaaatggtgtcttaagtgtagctgggttaatgagaacacaattctgcaaatatatcttttcctgtagttgtaggatttgtgatgggcaaaggtcctttgatatcacaaataggccttaggtgcttcttgaaaatgaaatggaagttctgaacttttctttctttcatatgttcttttggtttattaataatttttccttagacaataacatgaatacttgattgtgaagaaggtggaagtatcattaatgaatgtataccagactttgaatctttatataatattaaatgctcattgccaaatatattccaagaaagcaatttgaattctttttcagtcttcatatatactacagaattactctgaactcaggctgaaggaaatatctctctctcctgaatctgtatgcttcttttcattagacaatgagctctgaagcattttgtttccttcttttccttatctagtaggaaattcacagcatttttgtacccagtttcattagcttttctaatttttaaaagaattatagatttacagaagagttgcaaaaatatttcagggaattctcatatatatgcttgacacagcttcccttaatgttaacttacatgtataacttaaaattatggtaattgtaataatcacagcacagttatcagaaccaggaaatgaacattggtgtagtactattagctaaactgtggtccttgtttgaattttgccattcctacccaatcccatgtcctttttctgttccaggataaaatctagtatcccacattgaatttagttgtgtctccttagcctcttctagtctgtgacagctccttattctttccttgtctttcatgactttgacactattgatgaccactgctcagttattttataaaatgtctcgatcttggtgtgtctgatactttctcttgaatagatcgagattatgcatttttggcaagagagtaacacatgagtgatgttatctcctcattgaatcatattgggggataggtggtgttgatattttttttattggtgatgttaacattgatcacttggttaacatgatgttttccagatttttccacagtaaagttactatttttccccattgcccacgataaagattttgggtggcaggggattttgagactctgctaatatcctgtttctcttcaactcaccaagacaagttagtatccatgcatggattttacctgcagcagccattattgtggtgtgtgccttatgttgattctctgtctccctcattccttctggatttattaattggaatgcatttgcaagggagagctgtcctttatctcctatttatttattcaattatgtatattcatattaatattgactcatggacatttattgcattgtatgagttataatccagtattgtaattatttcttcattgatcaaattttccagctttggctattgggagctccttcagttgattcccatggccttttgacttgtccctgccttttttgtatactcacttgttttctgacatcacaagatagtctaggctcatctgtactttccctgtcttagctctggaattaaactgttctctaaggagccccggttcctttagttggagactggtatttagaaaccgagatctggacactaggtgtgttcattgctcctcttgtgtcattgatcctaggccttctcagtggacagaactaggaaataaatgtaggtatcccaatccatgcacacacatacatctatatttcagtctcgctatatattaaaactatatgttcatactgatattcagtagcttttcttaaacctaggttcttatataataacttctttgcctacctcctttattaatcagctcttttattctcatattctctttttcttggctttataagacttctgaaatcctctggaacataggggagaaacaaaaagaatttaaaaatataaatatttaaactgttctttttatagtgcttactttggctcctagtgatattaagacattgactacttattttttatatatatatatttgagatggaatctcgctctatcacccaggctggagtgcagtggcgcaatcttggctcactgcaacctcctactcctggattcaagcctcagcctgcctcagcctcccgagtagctgggactacaggcacgtgccaccacgcccggctaattttttgtatttttagtagagacaaggtttcgccgtgttagccaggatgatctcaatcttctgaccttgtgatccacccgccccggcctcccaaagtgctgggattatatgtgtgagccactgcacctggcctattttttagaatgttaatagaacaatgaagtttcttgtgatgaaaatgatagaaaccatctttctggattccaacactgttgtaaagtatgaagttctgtctctcaaatgtagttttctgaaatactgagccaaaaaaatttttaatcacatttaataccattgtactattttttttttttttctgagacagaatttcgctcttattgcccaggctggagtgcagtggtgtgatctcagctcactgcaacctctgcctcccgggcttaagcgattctcctgcctcagcctcccgagtagctgggattacaggcgtgcgccaccacacccggctactttttgtatttttagtagagacagggtttcgccatgttggccaggctggcctcgaactcctgacctcaggtgatctgcccacctcggcctcccaaagtgctgggcttacaggcgtgagccactgtgcctgaccaccattgtactgttaatagaaattttgctgtgtcaagttctgtatgattatcatctcattgtgatacatttttcaaaaaatttctagttagaacagtatcccaaggtgaaaaatttgaagtaaaaataatttctatagcccctttttttttcacaaaaaagcccataactgatcaaatgtagttaagcctctttcatctagattgtttcacatttaatttctccaaaataatccttaaaggaaattggctgatttggatgaaatttagtatgtgcttgaatgtgtatcaagatgtctcaatggaaacaaaatggcagcccatcaaggttttgtaaagaaccataccttaggtggttttgagggggtgttgtaagaatcaccatgttggtaaagatgtgattaccggggattttctgagttctaagccagaggtaatgaaggtttattaaaaaaaatgtttcttaccgtatataatgtttcttgaatggaatgagctaaaatattttggaaagtaaaattgtttgggcgtttatcatgatcatgggggagaacagaagcggagtgcttccaagggacacatgcagtcttggggggaagtgggtgcagaggcgagctgggaagggagggagcaggttctccctagcctacctccccctgcactgctaggccagggtccccctcagcaagcctgcacactggggtgggaggcagcatctgtggggggaggtgcctagggccatggtcagcctgaaatggccccaatggctcctctccattgctcctaaggggctggctttttccttccctgcccgttctagatcacaggggtggcgctgcagcttgccttgttctttcataccagttccctcttgagtccacctccgtcctgcttagctgggagcagaggaggacgccctcagttggcagtccccggcctacctcagccctctagtcctgcctcttcactcctggagacagtggagcgcctagggcagtcctctcctccaactcctcatatctgtccccacagccaaccaactgcccccatccccgcccttcttctgaccccttcccgactattctagtggcctgggctgacatccttgctgctttctgcatctagtcccctccccgaactcagagctgcccccaatcgggcgtccctctgtctctcctctggctctagctcctgaccctccttcccctctacgtgttctcccacagcttggagaagccacttctcttgcctcccatccctcctttgctgtcatcctcactctctccttcccatgacagcctcgctcctggaatgtcattgatactcgctgtctccacatctggcttcctgtttttctctgggtatttttgaacctgctgtttcttctatcctgtaaacccttccatgcatcctcacctggtgagctccttctcatgttttaattctcacctcagacctcacctcctctgaaaagctctccatgactgccagcctgggttaggcccactcttctgtgcatgcttagcctcctgttcctgcctgtgtcatggcgctggtaataacaatagtaacatgaagagaccactgagcactgttggactgggcatagtgtagtgttgttaccgttagtagtaacctaatactatggcaaggttcttgtcctcaagagaaccctgagagagattttcatcccgattccctacatgaggacattgaagcacagagaggttaagtaacttgctcagggtcacacagccaataagtggctggactctagtatttgaccccaaccatgttcccctagagcctgcactgtttacctcagtgccatagcccagtggttctcactgggagcatcagaatcacctggagggcttgtgaaaacatagaccactgctcctactctcagagtttccgactccagaggtctggggtacggcctgaaatttggcatttctaatttcttgcaggtgttgttgatactgccagtttgtggaccactttgcaaaccactgttccaggctgctaatcactttgtctattggaatcctctctttacttgtctctctcccagctgagatggcagttcctctaggacaggagctttttttttttttttttttttttttttttgagacagggtctcattccattgcccaggctggagtgcagtggcacaatcatggctcactgtagcctcaacttctcaggctcaggtgattctcccacctcaggctcccaagtatctgggactacaggtgcatgccaccatgcctggctacatttttgtattttttttttctagagacggagtttttgttgttgttgttgttttttgttagagatggagtcctgctgtattgctcaggctggtctcgaacttctgagctcaagtgatccgcctgcctcggcctcccaaagtgctgggattacaggcatgagccaccgtgcctggctaggagctttctttcagtccatgtttccaacacatagcaaagtagttctgccaggtggaaggccgtcaataaaggtttagttgaatgaatgaatgaggaaatgtttctggccctttgtttaagcgtattttttttttgcccaaagtttctgtgtatttcaagaagaattctcagatttttatcagtcatatatgcttgattggcacgtaggggatgtgtactcaatggttttgtaagattagttgttgactgcatgattttaaaatgtttgaagccaaaagtcacatctgttatatttggctcaatgttctttctggagtggaacactcactgtctgtatataatatagacttcatatttgtacatatatgaacatatatgttacatatgaacattataaagtgagtatttggtcttttagcagatttgaggatttctttcctaaaatagcaccttccttgatgtgcagcgtcttcatcatcaatgtgctggtgtagaggcattgtggcgctttcatttgctggcattagagcatcctcagtgcctgcacggggtagagcagcagaggggatgttggggctcctgagctcagcctcttggctctgtgtcacctacagccaggcctcgaataggagcaagacatttctgatggcttgagaacttttgttgtgtctagcagttaacatttgacttaatggcattttcacatatgttatttttcttttgaaatatgagctactattttttaaatataatagaatttagaagatcttattgaaaataccactatgcaggttgaccgtctttgtggagctgtttcagaagtgcaatgttcttgggagcaaccacctttgatgaaatgtgtgttacaaaaacatttttacaactttgataaacctctagctcctaaagacacaaatcagttagaattgatagagaactagtaactctgagattagcaaggcttttctctacttactttaatagcagatgggggactacaattcccttggaagaatgctgaagtttaggtctgacagattacaacactgagtatttttatgttagtagatatcatgtataaaatgtagggttgaagaagaataaaaatcatataatcaaagtacagcatttatccttaacaatggaaaatgatgttgcaaggaaaatacataggaatgcttatttttttaaataaactttttaagcctcattttaagttacagttgacttatactgggttggtgtcattttagaggtcgtctggatttacacaaaaaagttttgattgtatgtctcatggagaaattgaagtctaggaaccgaagaaaataactttactcattctgttctcttaccctggataggtacagtctagcatatcaccaccagcggaaaggcaggaaacccatgcctgggccagccctgctgtaacatctcttgagtcagcagcatgtcatgaactgcaggaagcagacctcagtgagagtttatcatatcccagaattgtctcctcaagttcattacagcagtatgtcgcacaaggtggctcatttccttgtttcggtatgccatggaactttatcagtggaggtgctgaaagtaccaatgctgtcatctcatttgccaatgctactacagcagtacctatggcagttctgtcacgaagagaatccagtctggcaaataaccctggtgtggtgaattactctgctctaccagaaaatgaaaatgtgggcccaggtagagccttgtcatctttctgcttccatcccaatttgggtgagtttgaaatgacacatattacagatagcattcttcaatctagattttaaaacacccttcatgcaaattagtgttagttattttttaaattaaaagttttatcttgaagccattatagattcatatgtagttgtaagaaataatacagagagataccctttccccaattttccccagtggtaacatctcataagactgtagtttgtattcatttgtgtgtctgactttcggcttttttttttaaaacaattttatcagatgagaaagtttgtatgttcctaccatagtcaagatacagaaccgttctatcaccagaaagtttgcttgtcttgcctttctataaccaaacccatcctccttttccttcccccacttacctattcctaacctttggcaagtgtgatctcttctccatctctataattttgtcacttcaatattgttatataattggatgcatatagtatgtaaccttttggtactggcttttttttactcaacataatcccctggagactcaaccaagttgtgtgtttcagtagttcctttattgccaagtactattccatggtataggtgtgccatggtttaaccattcatctattgaaggaaattatttttccagtttttgactattagtagtaaggctgctatgaaaattcatatacaagtttttgtgtaaatggaagttttcatttctctgacatgattacccaagagtgcaactgctggttatatattaattgcatgtttaggtttttttaaaaaaacaaatctttattgagatattaatgtcttggtctgtttgtgttactataacaaaataccatagactgggtgattgaaaaagaacagaaatgtagtttctcacagctccagaggctgggaagttcaaaagcaaggtgccagccggtttgtgtggtgagggctgcatcctctgcaagagaggagcactgtgtcctcacatggcagaaggtagaaggacaagatttcaaaatgccgtgtgaagcctcttttataagggcctccatcccattcatgagggaggagccctcatagcttaatcatcttaaaggtcccatttcttaatacgatcacattggcaacacctgaattttggaaaggataccttcaaaccatagtaattgataagtaaaaaactgcacatatttattatacccaatgtaatgagtttggacatatgcatgtttagttttatgagaaactgcctaactattttccaggggcgctgtatcatctgacattcttgccagctatatatgggtgatctactttctctaaatgcatatttctgctctttcttttgttctttcttcctgatgctccaagattccttctttcatcatcttctttttttgattgaggagttttctttaacctttctttaagggtaagtctgctggggacaaattctttttgttttcctttgtgtgtgaatgtctgtttctctttctttcttgaaggataattttgctttgtatagaatttgtgggtgaagttcttgtattacagctcttgaaaactttttatttacagaaatgccagaaagaccagcaaacagcagtaaaaacagcactgagacagcgaattatccaactttaatgggaaattacaatggccaaaatactgcctctttatctgtcttcatccctccctattttggtgagtttgaaatgatacataatgctgggcgtggtggctcacacttgtaatcccagcactttgggagggtgaggcgggtgcatcacctgacatcagaagtttgagaccagcctgaccaacatggtgaaaacccgtctctactaaaaatacaaaaaattagccgggtgtggtggcgggcacctgtaatcccagctactccggaggccgaggcaggagaatcacttgaacccagaggcagaggttgcagtgagctgggatcatgccacttaactccagcctgggcaacaagagcgaaactccatctcaaaataaataaatacataaatacataaaaaagaaatgatacatattgcaaatagcattatttaaccttgatccaccagtttttttttttttgtttttttttttttttttttttgagatggagttttgctcttgttgcccaggctggagtacaatggtgcgatctcggctcactgcaacctccgcctcctgggttcaagtgattctcctacctcagcctcccaagtagctgggattataggcatgcaccaccacgcctggctaatttttttgtatttttagtagagacgaggtttctccatgttggtcaggctggtctccaactctcaacctcgggtgatctgtccgcctctgcctcccaaagtgctgggattataggcgtgagccactgcgcccagcctgattcaccagtatttttaatgtcagctagtgtgactcttttcaaactaaacttttcggtttgagataattttagattcacacacagttgtaagaaataatgcagagaactgtttatgctttagccatttcccccaaaggatgacatctttaaaactatagtaaaatatcacatccaaggtagtggcattgatacactccacagatcttactgagatgttcccaggtttacttgtaattaatttgtgtgtgtgtatttagttctttgcagttttatcacaagtagttttaatgtctacctccagtgaagacatagaacgtttctatcactgcaatgatgcctcatcttgccctttgataatcacattcactttcctcatgtcatcctttccttccaacctgccccatccctaacacctggtaactactgatctgttctctgtttataattttgtcacttcaagaatgttatattaagggaatgttacagtatgtaattttggggtattggtgtttttcactcagtatagttatctgaaaactcacccagcttgttgcatgtatcaagagttccctcctttcttttcttcttttttttttttttttttttgagacagagtcttactctgttgcccaggctggaatgcagtggcgcgatcttggcttactgcaacttctgcctcccgggttcaagcaattctcatgcctcagcctcctgaatagctaggattacaagtgtgtgccaccacgcccagctaatttttgtatttttggtagagacagggtttcaccatgttggccaggctggtctcaaactcctgacctcaggtggcctgcctgccacggcctcccaaagtgctgagactacaggcatgagccaccacacccagcctaccctcctttttatttttgatttatatttcatagtatggctatgccacagtttgtttagccattcacccattgaaaaggcatcaaattgtttttttttccagtttttggatattaggagtgaagccactatgaacagtcatgaacaggtttttctgtaaatataagttttcatttctctgtcatgaatgccaagagtgtaattgctgagccttatggtactagcatgtttagttttataagaaactgccaaatagttttccagagagtctgtattatcttccatttccaccagcaatgcatgagtgatccagtttctccacattcatatttctgttatttctattgttcttccttctggatgctctatattttcttttttcatccattcctttctgtttgaatacttttcttcagcctttctttcaggtttctttagtgttcctgcatgtgaaaatgtctttattttccttatgttcttcaaggaacatagttttgctgggcatagaatttgtggctgagagtttattttccatcaatatcctgaatgcaagtcagtggtagctctttaaaaacaaaaaaaaaaactaggctttttattttgagataattttgaattcacatgtaattgtaagaaattgtacagagatcccatttatactttacccattttcctcaatgataacatcttaaagaactatatcctgcatccaggatattggcattgattaaatccacatctctgtgtgtgtatttagttctatgaaatttaatcatgagtcagtttacatgtccactattagttacaatacagaacatttccatcatcactacaaagatccttcatattgttcttttaaaaccatagccacctcccccaatctcccttgcctctcatcttgccctgtcttaactactgatagtcagcaatctcactttgtttgccagaatttcattatttgagtatcattacttaaatgcaactaaatgctgtgtaacctttttatttatttattattattatactttaagttttagggtacatgtgcacaatgtgcaggttagttacatatgtatacatgtgccatgctggtgtgctgcacccattaactcgtcatttagcattaggtatatctcctgatgctatccctcccccctccccccaccccacaacagtccccagagtgtgatgttccccttcctgtgtccatgtgttctcattgttcaattcccatctatgagtgagaacatccggcgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacgataaacataagtgtgcatgtgtctttatagcagcatgatttatagtcctttgggtatatacccagtaatgggatggctgggtcaaatggtatttctagttctaaatccctgaggaatcgccaccctgacttccacaagggttgaactagtttccagtcccaccaccagtgtaaaagtgtttatttctccacatcctctccagcacctgttgtttcctgactttttaatgattgccattctaactggtgtgagatggtatctcattgtggttttgatttgcatttctctgatggccagtgatgatgagcattttttcatgttgtctgttggctgcataaatgtcttcttttgagaagtgtctgttcatatcctttgcctactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttgattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttacgccatcttgaattaatttttgtataaggtgtaaggaagggatccagtttcagctttctacatatggctagccagttttcccagcaccatttgttaaatagggaatcctttccccatttcttgtttttgtcaggggtttctgcttttgcttctatctcatgagagttattcactatcacaagaatagcatgggaaagactggcccccatgattcagttacctccccctaggtccctcccacaacatgcgggaattctgggagatacaattcaagttgagatttgggtggggacacagccaaaccatatcattactcaaggagaatttcactatgtataaattcacggttgagagttcttaagcacttgaaaaatgttctttctgtacgtatgccgagaattgcagaaaccaggctggaaaacaaccctcagacaatgaattacccaatttcttcgggaaatggcagcggcccatgttcttcctcttcatctgccggcctcacacctaattttggtgaatttcagatgctgtattacaagtgacactattgaatccggatcgatcaacatccttaatgcaagctagtagtagctcgtttttgaaattaaacttttatttttatttttttgaggcggagtctcactctgtcacccaggctggagtgcagtggtgtggtcttggctcactgcaacctctgcctcctgggttcaagagattctcctgcctcagcctcccaagtagctggaactatagggcatgccaccatgcctggctaatttttgtatttttagtagggacggggtttcaccatgttggccaggctggtctcaaacgcctgaccttaggtgatctaccctccttggcctcccaaagtgctgggattataggcgtgagccaccgtgcccagccatttttattttgaaataattttagattcacatgtatttgtaagaaataatagaaatgatcccctttatgctttacccttttctaccagcaatatcatcttacaaaactatagtaaattaacacaaccaggatattgacattgatacaatacacagatataactgagatagccccagttttacttataataatctgtgggtgtatctgtatttctttctgtgcaagttttcttccacgaataggtttgattctcaccaccacagtcaagacatagaacatttccatcaccaccaggctgcctcatctttgataaccacccccacctctctcaggtcacccttttcttccccattgactgttccctaacctctgacaaacgctggcctctataattttgtcactttaagagtgtaatataaagggaatcttatggcatgtaggtttttttttttttttttcagtcagtatgattccctaaaggcttatacaggttgttgtgtgtatcagttgttcctcttttttttctgataatcttccatggtttggatatacaatagttgtttttaaccatttaccaattgaaggccattatttcccccctcccactctttggtattaggactaaactgctctgaacattcctatactggtttttggataaatataagttttcatttgtctgtcatgaatgtcaagagcacaattgctgggtcttatggtactagcatgtttagttttataagaaactgccaaacatttttccagaaaggctttacatgtatgggtgatccagtttctccatatttatatttcttatctttcttttttctcttctttccttttttttttttcaattgagacagtctcgctctgtcatccaggctggagtgcagtggtgtgatctgggcttactgcaacctctacctcccaggttcaagcagttctcttgcctcagcctcccaagtagctgggattacaggcacccaccaccacacccggcaaatttttgtatttttagtagaaacggggtttcgccatgttggctaggctggtcttgaactcctgacctcaggggatccgcccacctcggcctcccaaagtgttgggattacaggtggagccactgctcccggcctatattgtggtctttctatcagtctttcttccttcctgatgctccaggatttctttcatcataccctttctgttttaacatttccttccctccctccctccctccctccctcccttcctctgtctctttcgttctttcgttcttcttttgtctcactctgtcatccaggctggagtgcagtggtgcaatcatggctcactgcagcctccatttcccgggctcaggtgaccctccctcagcctcctgactcagctaggactacaggtgcttgctatcactcctggctagtttttaaatttttttgtagaggtggggtctcatgttgtccaggctggtctcgaacttctgggctcaggcaatccacttgtctccgcctcccaaagtattgggattgtaggcatgagccactgcaccaggcctggagattttcctttaaccttttatatggataagtcggctagggacagatttttttagttttctttcgttcgagaaatgtctttaccttttttccagaaggatagttttacctcatgtagaatttatgattgagcattctttttttttcccaatagctgagaaaattatacttactgaaatgccaggaacaacagaaaccaacgtggaaaataactctcagacagtgtattacccagctttatcgggaaatacgagtgccccatatccagcctcttcatatcttcccatcacttctaattttggtgagtttgaaataatggatatcacaagcaggcctctcatctagattcatcaacattcttaatattaattcttagtggtagctttttacaaattaaacttttcatattgaggtagttcagaaatcatacacaggtataagaaagaagacagaaaaatcctgactaccctttacctaatttcccccaataattatatttagcaaaaaacaacaaatattacaaccagcatattcacatttatacaagccacagatcttatagagatgtcccattttacttgtatttatttgtgtgtgtgtgtgtgtgtgtgtgtgtgtgtgtgtttagtactatgcagctttattccacaagtaggtttgtgtgcccaccaccacagtcaaggtagagatcatttccatcagcatgaggcactgttgtgttacctttgataaccacaccaactctctcaggtcacccttccctaacactccatgacccatccctaacacctggcttccactgatctcttctttatctctgtaattttatctctttcaattgttgtataagtggaatcatatttggaattggattttttttcactcagcttagagactcgtccaggttgttttttctattaatagtttattcctattgctgaatagtattgcatgtctggatatactatgttttcttcaaccattcacctgctgaaggacgtctggtgggttttttgtgtttttattttatttttattttttgtctattgggtgtaaagccgctatgaattgtcatgtacacatttttgtataaatgtaagttttcatttctcagtagtttctttctttctattgatgaatagttccttcctttccatggtacagataggaacagtttttttttttttaaaccattcacctattgaaggacatctggttttttctttcaatttttggataatgcaagtaaagccactttgaacattcatgtactgtgtactggtttttgggaaaatataagttttcatttctctgtcatgaatgccaagagaacaattgctgagtcttatggtactagcatgtttagttttataagaaactgccaaacagtttcctagagaggctgtactattgtttatttccaacagcaatgtatgagtgatccaatttctccacatctgtatttctgatctttccatcattctttcttccttcctgatactccaagatttcttctcttatagtatcttttctgtttgaaggttttcgtatagccatttttttaagggtaaatctgcgagggacaaattcgtttaattttccattttgtgaggatgtttttattttcccttctttcctgagggacaatttcacccagtataaaattcatagttgagagttcttttctttcagtacttgaaagagttgcagaaatgccagaaacagcaggaactaacgtaaaaaacaatactcagacagtgaattacccaccttcatcaggaaggggccgtagccaaggtaacgcctctttatcgctctccattcctcccaagtttggtgagtttgaaatgatacatgttattagtagcactgtctaatctacatccatcaacgtccttaatgtaaaactagtggtaggtttttttaaactaaacttttaattttgtggtcatttaagatatataggtagttgtaagaaataatgcagagaaataccccttccactttacctattcttcccaacaatagcatcttgcaaaactgtaacagaacatcacaaccagaatattgacatcgatattatccacacatcttattgagatctcccacttaattgtattaatttgtttgtgtgcatttagttctacctagttttgtcacgagtaggtttgattcccaccaccatgaccaagatacacatttccatgattaccaagatgtctcattttactctttttcttttcttttcttttcttttcttttctttttgtgagacagagtctcaaaaatctctgtctgtcgcccaggctggagtgcagtggcgcagtcttggctcacagcaacctccacctcttgggttcaagcgattctcgtgcctcagcctcctaagtagctgggattacaggcatgtgacaccacgccgagctaatttttgtattttttggtagagatggggtttcactgtgttgggcaggctggtcttgaactcctggcctcaagtgatctgcccacttcggcctcccaaagtgctgggattacaggcatgagccactgcacccaactttggctgttttgttttttgttttttgtttttgtttttgtttttaattttggagtttttgtagagatggggtttcaccatgttggccaggctggcctccaactcctggcaccaagtgatccacctgccttggcctcctaaagtgctgggattacaggcatgagccaccacgcccggcccatcttgctctttaataaccacacctgcctcagcacataattccctgaacagtcatctgactgactggatgtatgagtggtccttaatttttattgtggacactattccatggtatggatgtttcacagttggcttattcattcacccattggaagatatcttggctgtttctagtttttgactattacaagtaaagttgcgatgaccactgatgtacagatttttgtataaacagaagttttgatttctcttggataaatgtccaagagtgcaaaggcttggttgtatagtaattgcatgtttagtgttataagaaactgccaaatagtattccagagagactgtatcattttacattctcgccaattatgtatgaatgatccggtttctccatatgcatatttcttcttctttcattgttttttcttcctttttgatgctccaagatttgctttttcatcattcttttctgtttgatgattttcctttagccgttctttaagtgtttgccagttagtgacaaatacttcagttttccctcatgtgagaatgtctttatcttccctatatttgaaggatacttttgcctgataatagaattcatgattgagatttattgtctttcaatatttgaaatattttatttatagaaacattgggaaaagcatgaaccagcccaggaaagaggtctgcaaaaacaaattacagacctttattagaaaacaacagtcaccagaatgtttcctcattatttcatagcgttccttgcaattttggtgagattgaaatgatacttgctatatgtagcactatttaatctagattcattagcatccgtagtgcaagatattggtagctttttccaattaaagtttttattttcagaaaaatttagctacacatgcagttataataaataatacagagaaatatgtgtttccattaccacttttcccaacagtaacatcttgcaaaactataagaaattatcacaaacagggtgttgacgtgataccttctacagatattattgagatgtccccagttttacttgtatttatttgtgtgcatgtgtatgtgtgtgttttagttcaatttttatcatatgtttaggttcatgtatcctctaccacaggcaagcccccaaatggttccttcttttttattgctgagtgctattccatggtgtagatgtaccgtggtttgtttatcttttcaggcattgaaagacatctaggttgtttcctggttttggctattagaagtaaagctgctatgaacactcatataccatataggctttgtgtgaacacaagctttcatttctctgagatactgcccaagagtgctgttgctgggtcctatggtaatggtatgtttagttttataaaatactgccaagttgttttccagagtgtctgtaccattttctaccccgaccagcaacatgtgagtgacctagtttctccacgcccatatttctgctctttctgttgttctttcttccttcgtgacggtgcaagattccttccttcatcatatcctttcagtttgaagatctcctttagttgttctttaagggtaagtcagccagtcaccgttttttaaagtttttctttgtctgagaatgtctttatttttcttttattcctgaaggatagtttcacctgatctaaaaaacatggttgagatttcttgtctttcagcactgcaaaatgttttacatattgaaatgttgttcaaaacagaatctggcccacaaatgagttatgggacaatgagttactcaactgaaatgaaaaataactgtgaccaagatgatgcttcagcatctgcctgcctcactcccgattttggtgagtttgaaatgatatatgttacaagtagcactctttaatctagattgaaagaatacagagagatcttgtgtacctttacccagtttcccccaatagtactattttacaaaaatatagtaaaatatcacaactaggattttgacattgatgcaatcaccagatctactcagatgtcctctgcttttcatgtattcatttgtgtgtgagtgtgtgtgtgtgtgtgtgtgtgtgagagagagagagagagagagagagagtatatttagttgtctggaattttatgacatctactttcagtcataaataaacctaactgtatctagtcatgatacagactgtcccatgacttccaggaactctcttactgactttttataaccatatctactccttcatgtcattccctgcctggcctcatctttattccatacaactactagtatgttctccctttttataattttgtcattgtaagaatggactgatataccattggactgataaatggactgatataccatttaaccttttgagattgctttttttccacatagcataattccctggagatttatacaagtttttgtgtatatcagaaattccttcctgtttattgctgagtactatttcatggtatggatttatcatggtttgtcacccactgaaggacatctagattgttgtttttggctattacaaataaagcagctatgacaaccagagtacaggtttttgtgtgaacataacgtttttcatttttctgtgataaatgccgaagagtgcaattaactgctgggtggtatattaattgcatgtgtagttttataagaaaccgtcaactatttccagagtggctgtgccattttacattcccatcagcagtgtatgagtgattcagtttctctgcgttcttaccagcattttgtatgttcgcttttttttttttttgagatagagtctcggtctgtcacccaggctggagtgcagtggtgcaatctcggctcactgcaacctctgtctcctgggttcaagcgattctcctgcctcagcctcccgagtagctgggactacaggcatgtgccaccatgctcggctaattttttgtatttttttagtagagactgggtttcaccatgttagccaggatggtctcgatctcctgacctcatgatctgcccagcacttagccattctgataggtatatggtaatatttcattgagggtttaatatgcattggcctttcgaaatgatgtatggctcttcatgtgctaattttctatctgcatatcctctttgaaatatctattcttgtcttatagtaatgtttgcttttttatgcttacattttgagagttacttaattgaaatgatcatacaatttttgtccttcattctgttcatatgacatatcacattgattaatttgtgtatgttgaaccatccttgaatccctgggataaatcccacttggtcatgatgaatgctcgttttgagacagtctctgtcacccagactgtagtgcagtggcatgatcatggctcactgctgcctcgaccccctcaggctcaaaagatcctcccaactcagcctcccaagtagctgggactacagggatggacaaccatgcctggctaatttttaaattttttttgtagagacaaaatcttgttgtattgctcaggctggtctcaatctcctgggctcaagcagtcttcccgccttggcctcccaaagtactaggattgcaggcatgagaccccatggccatccatgaatgattttttttttttttttttgagatggattctctttctgtcgcccaggctggagtgcagtggcacaatcttggcccactgcaacctctgcctgccaggttcaggtaattcttctacctcagcctcctgagtagctgggactacaggcatgcgccaccatgcctggccaattttctgtatttttagtagagatggggtttcaccgtgctggccaggctggtctcgaactcctgacctcgtaatccacccgcctcggcctcccaaagtgctgggattacaggcgtgagccactgcacccggctgatctttttaatgtattgttgaattctatttcctagtattttgttgagggtttttgcatcagtatttatcagagatattggcctgtggttttctttttttgatgtgtctttgtctagctttggtatcagggtaatactgacctcgtataatgaattttgaagtattccttcctcctctatttttgggaatagtttgagtaggattggtattaattctttaaatatttggtagaattcagcagtgaagcctttgggtcttgagcttttctttactgggagaattctattatggcttcagtctcattacttgttatttatctgttcaggttttggattccttcacggttcaaacttggtaggtgttatgtgtctaggaatttatacatttcctctagattttccagtttgttggcatgcagttactcatggtagccactaatgatccctttgaatttctgcggtatcagttgtaatgtctcctttttaatctctggttttatttatttggattttgtctctttttctttttctttttttttattatactttaagttctagggtacatgtgcacaaccaacagacacatgaaaaaatgctcgtcatcactgtctctttttcttagttagtctggcttaaaggtttgccaattttatctgtcttttcagaaaagcaaccttttctttcatttcattttttgtattgttttcttcattttaaattcttttgcttctgctctgatctttattattattttcttctactaattctgggtatggtttgctcttccttccctagttctttaagatacatcattaggttatttatttgaagtttttcttcttttttgatgtaggcacttatagctataaatttctctcttactactgcttttgctctatcccataggttttggtatgttgtgtttccattaccatttgtttcaagatttttttttcaatttccctcttaatttcttcattgaccattcatttaccattgcccactgatcatttaagaacatattatttaattttcatgtatagtttcccaaattcctcattactgatttctggctttattccattgtagtcagagaagatgcttgaaattgaataattttcaattcttttgaatattttcagacttattttgtgacttaacatatggtcaatccttgagaatgattcttgtgctgagaagaaatattaataggtatttgcagaacagctgcagaatatacatttaatatatccgtgaaatgttcatatctattagacccatttggtctatagtacagattaaatctgatctttctttgttaatattctgtctgaatgatctgtccaatgctgaaagtgaggtgttgaagtctctggctattagtattgtggcctatctctctctttagctctaataatatttgctttatatatgtgggtacaccagtgttgggtgcatagagatttacaattgttatatccttttgctgaattgaccccttaatcattatgtgatggtctcctttgtctcttcttgcagttttttgtcttgaaatctattttgtttgatataagtacagctactcctactcttttttggtttccattggcatggaatatctttttccatccctttattttcagcgtatctttacaggtgaagtgtgcttcttgtacacaacagatcattgtttcttgcttttttatccattcagccactctatcttttgattggagagtttagtccatttacattcaattttttttattggtaagttgggactttttcctgcgattttgttatttgttctctggttgtttttcggtcttctcttccttccttctttccttccttcctgtcttccttttagtgaaggtaattttttctggtggcatgatttaatttcttgtttttgtgtgtgtgtgtccatcgtatctttttttttttttttccagacagggtcttgctctgttgcccaggcgggagtgcagtggtacgatcttggctcactgtacccttgacttcccaggctcaagcgatcttcccacctcagcctccaaagtagcttggactacaggcacgtgtccccatacccggaaaactttttgtattttttgtagtgatagggtttcgccatgtttcctaggctgaacttttcttgaactcctaggctcaagtgatcctcccacctcggcctcccaaagtgctggaattacaggcataaaccaccatgcccagccccattgtatgttgtttgctttgaggttaccatgaggtttgcaaatactgtcttataacccattattgtaaactaatgacaacttaacactgattgcacaaaccaaccaacaagcaaaaagaaaactaatgaaaactctacactttaacttaatttccctttttaactttttgtttctctttatgtcttattgtactatgtctttttttttttttttttttccgacggagtttccttcttttcacccaggctggagtgcaatggcgcaatctcggctcactgcaacctctgcctcctgggttcaagcaattctcctgccccagcctcctgagtagcagggattactggcacccgccaccacgcctggctactttttgtatttttagtggagtcggggtttcaccatgttggccaggctggtgtcaaactcctgacctcagatgctctgcctgcctcggcctcccaaaatgctgggattacaggtgtcaaccactgcacctggcctgtactgtctatgtcttgaaaagttgttgtagttattatttttgattgggtcatcatttagactttctacttaagagtattttatacagcacaattacagtgttataatactctgtgtgttgttattaccagtaagttttataccttcagatgatctgttattggtaattaatgtctttttctttcagattgaagaagtctctttagcatttcttatagcataggtctggtgttgatgaaatctgtcagcttttgtttgtctgggaaagtctttatttctccttcatgtttgaaggatattttcaccagatatactattctaggataaaatttttttccttcagcactttaaatatgtcatggaactctctcctggcctgcaagatttccactgaaaagtctgctgcccgtcgtattggaggtctttgtatgttgtttgtttcttttctcttactgcttttaggatccttttgtaatccttgccctttgagagtttgattattaaatgtcttgaggtagtcttctttgggtgaaatctgcttggtgttctataaccttgtacttggatattcttgctctaagtttggaaagttgtctgttattattattattattattattattattattattattattatttttgcgactgagtctcgctctgtcacctaggctggagtgcagtggcgtgatctcagctcactgcaacttccacctcccgggttcaagtgattctcgtgcctcagccttctaagtagctgggattataggcacgcgccaccatgcctggctaattttttgtattttttagtagaaatgggggttcgtcacgttgctcaggctggtcttgaactcctgagctcaggcagtctgcctgccttggccccccaaagtgttaggattgcaggcatgagccactgcacccagccaatctttctgaataaactttctaccccatctttctctcgatgtcctctttaaggccaataactcttagatttgccattttgaggctgttttctagatcttgtagacatgcttcattcttttttcttttgtcttttttgtattttcaaatagcctgtcttcaagctcactaattctttcttctgcttgatcagttctgctattaagagaccctgatgcattcttcagtatgtcaaccgcatttttcaactccagaatttctgcttgatactttttatttcaatctctttgttaaatttatctgatagaattatgaattccttctttgtgttatcttgaatttctttgagtttcctcaaaacatctattttgaaatctgtgttggaaaggtcagatatctctgtttctctgggattggtccctggtgccttatttcattcgtttggtgaggtcatgttttcctggatggagttgatgcttgtggatgttcgtctgtctgggcattgaagagttagatatttattgttgtctttgctgtctgggcttacttgtgccatccttcttggaaaggctttccaggtattcaaagggacttgggtgttgtgatctaagtttctggtcactgaagccatgtctgcatcaggggacaccccaagtccagtaatgcagtggctcttgaagacttgtagaggtgccgccttggtgatctaggttaagatccagaagaattctctggattaccaggcagagactcttgttctttttttgagacggagtctcattctgttgcccaggctggagtgcagtggtgtgatctctgctcactgcaatctccacctcccgggctcaagagattctcctgcctcagcctcccaagtagctgagattacaggtgtgcatcaccatgcccggctaatttttgtatttttagtagagatggggtttcatcatgttggccaggctggtctcgaactcctgacctcaggtgatctgcccgcctcagcctcccaaagtgctgggattacaggaatgagccactgcgcctgggctcttcccttacgtccccccaaacaaaggagtctctgtctatggtgagctgcatggagctggggaaggggtgacacaaacacccctgtggacaccaccactgggactgtgctgggtcagacctgaagccagcagagccctgagtcttgcccaaggctcgctgtaaccgctacctggctacagcgtgtgtttgctcaaggccctcagcctctacaatcagtaggtggtgaagccagccaggcttgtgtccttcccttcagggtggtgagttccccccagccttgggcaggtccagagatgccaatcagaaaccagggcctggagctggagacctcaggaatctacctggtgctctattctgctgagctggcacccaagccacaagacaaagtccttcccactcttccctcccgtttctacaagcagagaagtctctccttgtggccaccactgccgcaggcccacaatgggtacctccaggccaccactgctgttcactcagcttacggtgaatgctgccaggcctgggactcactcttcagggcagtgggctcccctctggcccagggcaggcccagaaatgccatctaagagccaaggcctggaatcagggaccccaagagcccactttgtaccctaccccactgtggccaagctgggacctaagctgattttggatttcttattaaggtgcttttttgtgtagatagttgttaaatttggtgttcttgagaacaatcagtggaggcttctatttagccatctagctccgaagctgtgtcctgtgtgttttaaaatttccttggagacttctttttgacgtgtggattatttaggagtttgctgtttaatttccaagtgtttatagatttttctcttgtctgttattgatttctagtttggttccactgtggtcagaaaatatactctatatgatttcaattcttttatatttattgaggttttttcctttggctcaggctgtggtctgtcttggtgaatggtccataggcatttgaaaaaaaatgtatattctgcttttattagatggaatgttctataatgaaaatcctgttggttggttgtgtgttactcaggtcttctctgtccttgctgatgttctgtctggttgttcttttttttttttttttttttttttggagacagagtctcgctctgtcacccaggctggagtgcaatggcatgatcttgcctcactgcaacccctgccttctgggttcaagtgattctcgcacctcagcctcctgagtagctggaactataggcgtgtactaccacgcctggctaatttttgtatttttagtagagacggggtttcaccatgttggccaggctggtctctaactcctgatctccagatgatctgcccatctcagcctcccaaagtgctgggattacaggcataagccccccgtgcccggcctctgtaaggttgtcctgtcagttgctgagaggtgggtgctgaggtcctcaatataattgtgggtttgtctattttgcctttctactctttcagtttttgctttatgtattttgagacacttttgattggtgtgaacatattgaggatcattatattttcctgggggttaacccttttattgttatgtagtgttcttatttgtctctggtaactttctttgctctgaagtctgtttattttatctgatatcaatatagccactctgctttcttttttttggattaatatttgcatggtgcattagtccattttcatactgctataaagaagtacctgagactgagaaatttatgaagaaacgatgtttaattgactcagagttccacagccttaacaggaagcatgactgggagatctcaggaaacttaaagtcatggcagaaggtgaaggggaagcaagcaccttcttcacatggtggcaggagagaccaaagggggaagtgccacacttttaaaccatcagatctcatgagaagtcactcactctcatgagaccagcaagggggaaatctgtgcacattatccagtcacctcccaccaggcccctcctccaatttgacatgaagtttaggcagggatacaaatccaaaccatatcacatggtatatatttttcattcttttacttttaatctacttatgttattgaatttgtagagtttctaataaagagcatatagttgggtcttgtttttcttttcatttacactacctggcaatcgagggtcttgttttttatctacttggtcaattgctgccacttaattggtatgtttagatcatttacatttaacgtaattattgatacagggtttaagtcttccattttattatttttctgtttatcttctgtttctcattctccttttctttttcttgccttcctgtgagttacttgaacattttaagtattccatcttgatttgtttgtttttgagtatattgatttgtgcagttttcctagtggttgctctgagtgttactgtatacgtatgtgacttatcactgcctgttggaatcagcattttaccatttggaatgaagtgttgaaactttaattccacttaggtttcgtttttctccccacctttaaatatcattgttataggtatcagatggtgttttcatttttgtttcagtcattccatatgatttagagaactcatgatggttttgtatcgcctttctttctgctctttctcttcttcatttttattgctgaatagtattctgtggtatggatttaccacagttcctttaaccattcacctcttgaaggacacttggattgttttcaggttttggctatcacaaataaagctgctaaggatactcatgtgaaggttttcatgtcaacatgagctctcatttctctgggataaatacctaagagtgaaatttccagcaatttcactcttaggtgcttaaccctaaaaaaacccctgcaattaattacctcattttaaattataataataattacaatgatagtaattgtaattacaaatgtagtaattgttttccagtgtggctgttccatttctccacatgcatctttctattctttcttcctttctgatgtgccactgttccttctatcatcataatctttctgtttgaagatcttcttttagccattctttaagagtaggtctccagcattttgggaggctgaggcaggcagatcacttgaggtcaggaattcaagaccagcctggccaacatggcgaaaccccatgtctattaaaaatagaaaaattagccaggtatggtggtgggtgcgtgtaattccagctactcggaaggctaaggcatgagaattgcttgaacccagtgggcagaggttgtagtaagccaagatcatgccattgcactccagcttgggcaacatagtctaaaaaaaaaagaaagaaagaaaaaaaaaaagagtaggtctgctggcaacaaatctttttagttttcttttgtctgagagtgtatttcccctctgtacctgaaaaacagttttgctggatatagaattgtcagttgagagttcttttctttcagcactgttacctctgaatattttggtaaaagtagacaccaacacggaaaacagcgtcaacacaatgaatcgctcaactttattggacagtgacagtggccaggattcttcctcatcatctgtctgtatccctcccaagtatggtgagtttgaaataacacacattataagtggcactatttgagctacattcttccacttccttgatgcaagacagtgaaagctctgtgtttcctattttgaggataggttttaggtgatattcagaaccatgactaacatttattgagtgcatattacgtgcaaggcactgtgctaaacaattaacatgcctcttcttcacttatacccataatgactccatggtgttggcacttttattatccccatccccaaggtcacagagctggtgagtaggacttgagctctgccccagctttctctgactttaaaactcatgtgtcttttttctttttgaagtggagtcttgctctattgcccaggctggagtgcagtggcatgatcttggctcactgcaacctccacctcccaggttcaagtgattcttctgccttagcctcccaagtagctggaattacaagcacacaccaccacacccagctagtttttgtatttttagtagagatggggtttggccattttggccaggctgttatcaaactcctagcctcaagtgatccatctgcctcggcctcccaaagtgctaggattacaggcatgagccaccgtaactggcctaaagctcatgtttcttaccagtccactgtactgcctgccaagccacagtggcagagatgaggggaccccaagctctgtggcttctaagggtaagccttccaaatattttatagtcagttcatttttgtctcaacttctaagcagcttatctcttattaatatcctagaacaaggatcaggaaaccttttctgtgaagggctagatagtattgtctgtcacaaatacccacctttgctgttgtaagataagagcagcctcagcccatagacgaatgaataggcgtggccatggccagcacacctttcacacacattggtggggggatgggccagtggactgcagtttgttgactcccttcctagaggagagcttattcctttaaactattttgttactcaaactagaagaaatttcaagaattgtggtctcggctgggcacggtggctcaggcttgttaatcccagcaatctgggaggctgaggtgggaaaatcgcttgagcccaagagtttgagaccagcatgggcaacatagcaaaaccccatctctacaaaaaatacaaaaaattagccaggcgtggtggcatgtgcctgtaatcccagctacttgggaggctgaggtgggaggatcacttgagcagcccggaagtttgaggctatagtgagccatgatcatgccactatactccagccaaaaaaaaaaaaaaaaaaaaaaacagaaacaaaagttgattctctgtactgaaatgggcactctgatacattgttagaaatatacattggtacaaactttctgaaagatagtttgtagagaaatccataaaaacatttatggcagttgactgtaatctcactttatctgaaagtataataaaaattacataaaaattttggtctagaatgtcctttacagaatgattgggaaaaattggaagcaaacaaacaaaaataaatgatgatagggaattaatcacttgacttctggtgtatccacagcatgtgaggcagtaaagcctaatggttgagggcatgagctctcatgtctgcctgcttgatttcaaatcccagctcttactaaccttatgaccttcagccactttcctaacctaaatactagtttattcagttgtgaagtgacaaaaataatagtgtctacttcatagaattgtgaggatcaaattggacaatgcatttaaagctcttaacacaatgcctgggatgtaagtacaacataaatgtcacttgtcaggaaaattatgatgacaggaatgcagattaaaaaaaaaagatgaaaacagagaaatgctcaaaatataatgttaactgaaaaagcaggatttaaactatacttaaagtatgatttcaattttgtcttttaaaaaaataaataggaaaaagaatggaagatattagtagaagattcatggtttagagcagttaactcataaacagacagattttaaaactggttctgtaactagcagtgtgaccttttcaaataacttatctcctttgggcctcagtctccttatttggaaataatggggtgggaataatggggtgggagtaatgatagagttgttagaatgatgaaactgagctagtgcacagatgtaaaatatttagcacatgcctgatatacaggaactactgataaatgctagctatttgaaaattttcttaatgatccccacccacgctttcaacattgtcttcagggaacatccacttgcccagtggaatggctctgagtgtactcttagagcgtgaaatggagcagtgggaactcagggcaacatgtttacatatgcacctgcagcctaacaatgacatgtgttcaagctaatgaacagagtagttcaatacagcaagctcaagaccagtagaagtgaagaatgttgacagtttggcagatggtggcaaagagacccatttaaggaagaggaagagataagcatagaaaaaaaattcacccaagtagaaattcatgaattagaaatcatttatctgcatttgccttatttgaagaaaaagaagaaataaatcagtgtaattctcttgtgtactttgagggtacccttgcatgacaaaaccaaggatgttcctttttctctttatttttaaaggctatcttggtgatccaaaaagaaatgtcagagtacttaaaatccatttgctggccgtacaaaatatggccaaacctaagcaagcagcctgctacttggttcgtattttgttctccaaggaaatcctgattagcagctcagtggatatccatttgaaagacagccaatccctcgacccgaacaaaatggctgcattgagaggtatgtgtacataaagtgataatggaatcttatttttaatcatcatttggtcatataatgaatgttattggcagttgaaggaataacaataagtctgtgtaaatcttaaaactattcatttttttcacctgtctgaccctgattttacaacttaataatatataattggtaacaatttccaaagaataaaacttgtccattgacttgaatggttgaataagacaagcctcatctactatagttgtttatggttagtactaagtcaattctttagccctgaaacttgctacaaaaaaaaaaaaaaaaaaaggaaaaagctccctctgccagaaggtggtggggtggggggcgggggggaataaaagacttgtcagtgctagtgactagcaacacagaaatagaattttatgattagttctttttagcctcctgccttcctgccttccagacatgtctattgagatcctagaactcatggatactaaggataccacaatgaataagtgtttctgcctatgaggagctcatagtctagaaagggacatgttgatggaaacagatacatcccagtccagtgtggtagtgttggggaagctcagagcagctgctttgagggagttggggaaggcttagctaaggacaggacatttgagctggattctgaaggactccttcagtaggtagaaggaacaggaggatgttctaggcagagggaagagctggggaagatagacaggatgagtgagcccctggtgtaatcatgtttgcagtaacactattttctcttgatatgtttccttttagttctgatttatccattgggttattaaatggtctgagcaccctgaaatagtcaacattgggttacacacttaaaattttttttttcagacgcatggtcttgctctgtcacccaggctggagtgcagtggtttgatcatagctcggtgcagcctcgaactcctgggctcaagcaacccttcctccccagcctcctgagtagctaggcccacaggtgcatgccaccatacccagctaagttttgtattttttatagagatggggtctcactttgctgcccaagctgttctcaaactcctgatctcaagcgatcctcctgcctcgacctcccaaaacactggggttacagacatgagccactgtgcctggcctacacactttttttttttttttttttttgagcaccaagagctcaatattagcttcctacgtcagtgttttaggggatctcatggtaggggaaataattcagcaaagcatcctcattgggtggaatttctaaactctcagaaagaataagagaaaaggatgagaagtagaaagagaagaagtcaccagagtgctcaccattacacaatgtaaccatctaaaagtcagtgtttaaagaaaaaaatttttcattagtttgttaatttttttttctaattttcgtgaatactttctgctgtttgcagaatatctggcaacaacttttcccacctgtgatttgcatgaacatggaaaagactggcaggactgtatttctggtatcaattctatgatctactgtttatgttctgaaggcaagagtactccagtaagttatttttcatctaaatatggtaactgttacctgagtttgtactgtgtacagtttcagaactgatagcatgaggcacagtctctttaggccatgtgctaaaattctcattaacttagggggcatgggatgttctttcaaaagcacactgcatgtttattttacttttttgatatttatgctctataaaaatatcctaaagataaataaaataaagtgctataattagtatatttgaagccaaggataatactaggaaaatagtttcagctacaaagatatttggcaaatcttttgcagtatctcaccgagcaacacaaaaaggagccagctgtgtgctccttggctgtttcaatggtagctgaggaggtgcaggggaaaatgcaggcacttcgttacttgttcacttttagtgatgatggaacttggtgaaataaactcatgtcatgacgttaaacgattacagatattttacactccatatagttatgtggtaacagaaatctagtttctctttcctccagtctatcttcaaagtacattagagatttttgtttgttttaccacaaccgggccattagggaagagtgtcatatctgttgtcttctgatgaaacatgtatcttaatgacaattcctaatttccaccaacccccttttcttctggccacgtctagtcgctcctgtgtctctagagtaagtttatggaaacaatttgccaagaatatttgtagctgagcgtatgtttccctggtgaacgggttgatttcagtgatagctcaagcaccatctgcctgaaaccaaatctgcttatttttaacattccgttttatagccttcaaaaattgcaccctaaacaatttgaatgtaaaattaagacactgcctggaaaatggtaatttgcatatttgcttaggtgtcagaagagaagcagtgtctgccaagtgcctgctatgtgcttgactaggaatgggacaggtccttgccactcagagtaggtccacagcccagcagcagcagaccactggcaagcttgtgaaaaatgcagggtcttgattcagaggcaaaatttgcattttagcaagaccctccccaacccccgtccccaatgtgatttgtgtgcacactaaagttcaagaagcactaacccagagcagtggttgtcaaccctgggtgcatattagaatcacacgagacacttttaaaaatagttactaacgcctgagctccccactcccatcaccagagattctggctgaatttgcctagggtggggcccagcacaaccatttgtttttacagatcctgaaggtcattcaaatgggcagccagacttgagctccactagggaaaaagaatacaaacaaaacatgagaaacaaaaagtggtcatccccaagaaactcactgctttgtttatttgtgaaatgtttattatgtgcctaatttgtaccagcagttctcattgagttccttagacagagctacaaaatcctccaaggagcagcaggtcatgacagcttgcggaagaagccacccctttccttctttccagatagtattgcgacacacagtattcctatggcttcagcccaccttttaaagagtcagttgcttccctagcaacctggtgggcctggtaggtggtagagcacagacatattttcttgctgtgggactttgtttacggatatgattttgtgtttcaacagaaaactgttcgcaaaaataaaaaacgtaccaaccgtgttgcatcggcatctgcagatagaaatgaccaaaggggcagagatggtggtgaaggctgttcttggatgtttcagccaatgaataactccaaaatgagagaaaagaggaacttgcagccaaacagtaatgctatccctgaaggaatgcgagaaccttccactgataatccagaggaacctggtgaagcatggagtgagtttttttaaaaacttatatttaaataagttctcttgctgataaatgttgaatctgagtgatgcatttatggggttcattgtactattctctctacttttatgtgtgtttgagaaatttcatcagaaagtgaaataatttaatgtcttttattaatgagttaatgaaatatatagacacatggttctaagactgattgttatttttcctacggaaagtggctctttgctgactcactggactgtgtgagttctgataaggcactgtcctctgtggtgaaggggaggggctgcagctgagatgcacttcttgttctctgtgtgcctggcacattgcaggtgcgcagtaggatttttggcacgaattcgtgaatctcatctctcagaacattgtgctcccgctgctaaactgctgaaggcacctcctgctttgatgggtgtcaagtggcagtggttcagtagtgactgtgccacctgccacttgtgcttcccaatgcatcctcccagggcgctggactttagcatcacccataccgatgagtgatatctgaagtagcaagactttattctgtctgtaccctgctcccatgttaaccctaagtagaatactacctgggatccttttcaaacgaaattattgacatgatatagctttatttcttccattgtaaaagtaatctaactactgtatttgttaagattgtacactacagacacagactggataaattaaacaacacaagtcaccagttgaatacctcctgtattcaaagaagcaaagaactgagcgagcgtcaggcaggcaggagctagagcagccccaagactgtgagaacttgggccacatatctctaaccctgactcagctataacgaggggacagggcgactaagcccactgtgagccaagcagtcactgcagtgtgtgtggagtctgttatgccattttatttgaaaaattggaaaatatttttaagagggggaaaaaagctcccacaatcaaaatactttaaaaaactattgtgggcattttcattttccttcagtttttttttcctgtgaacattttgaaacattatgattcccatataattactctccttctctaatattataatatgtatctatttttcctcaagaatctacaatcttcataatcattgctcttaataggattatagcattccattaattaagtgcaccccaatttatttaattgcctcccactttgtttctttttgctgttgttgtcgttttggtttgagggttttttggaagggaattataaatcagtctgcaaaaaaaccatcttcattcagaagattttttttttttgagatggagtctcgctctgttacccaggctggagtgcaatggcacaatctcggctcactgcaacctccacctcccaagttcaagcgattctcctgcctcagcctcctgagtagctgggactacagatgtgtgccaccatgcccggctaatttttttgtatttttagtagagacagggtttcaccatgttggcctggctgatcttgaactcctgacctcaggtgatccacctgcctcagcctcccaaagtgctggattacaggtgtgagccactgcaccagcccattcagatagatttttccatactttggattattaggttaggttcttagaaattgaattaccaggttaaagagtattaacctttttttcctgacccttgataaatattactaggtaaatctcccagagttaagtctttggacccattaaatgtgtttctaaataatctctcctgctaaatgttgaatctggatgattcaacagtttttattgccacccattaaatgatggatgttctaagttgaagaatatacttactgacttataataattatatttttctagtatatttaacaaataattattatatgtaaaatataatatttttcaaatgtagttaattcgaatagactatggactgaagagagatgatgatgattaagctgtagagttgagaaatgaaaagtcttaaaacttatttttcatttcaaataagatatctaagatacaatatgtaaagtgaaccagcagtgtgttgatttaaaatgaatttaatactaaatagaaaacctacattttaaaaattataagtatttcaggaagaatcatggagcttatttttgaaaaagtccttcttgtaagtagggaaacaatgcattaaattacttagaatttgttactaaatgtaattttaaaacttcttgtatcctaaaaggtaacaaacagtatattaaatcttcctgttgaaccatggtagcatgtgtaatcacagtgatttctacctcatttctcatgctgtctcataatccactaaaaacgtaaggctttaggctgggcacgatggcttatacctgtaatcccaacactttgggaggccgaggcaggagggtcgtttaaacctggaagtttgagaccagcctggggaacaaagtgagaccctgtctctacaaaagatacaaaaaattagctgggtgtggtggggtgggcctatagtcccagctacttgagtggctaagctaagagcattactcaagccctgggaggctggggctgcagtgagccatgattgtgctactgcattccagcctaggagacaaagcaagactctgtctttaaaataaataaaaatgtaaggccttaaattttttaacctctcaaattcttgagcctaacaattgagaaaaatcaacgtttctgtttcagcttttaaaaaataatgcaatctaacatttgctatgaaaattgacatctttcttttttgcttctaggctattttggaagaccatggagaaatatacggatgccatgttcagtactgactttggcaaaaactaagtcttgcgcaagcctgtcggctagataccttattcagaaactcttcacaaaagatgtcctggtccaaagtaacgtctatggcaatctgaagcatggcctgtgtgcccttgaccccaataagattagtgctctccgaggtttgttacacatagagtatgtctgaataaataaaagccaattgtgtttaagagaagggtagaaagaagaatccattcaggttgtgtttgttctggggagaatggaacttagtaattactgagtgcctcattagagtacagcaaggagcaagatcatgaattgtatttctctctgcatttgggttcttagggctaattgctctgtcttgaatggctttactagaacaggaaaggggttattgactgtggctccctgctatggactgccaggggtatggaaactcaaaacaccttcattgactgaggagcaaggtcaaagctaaagggcttcatccatttgcagaagtgtcaacaatagcacagaaggttaatttgctaagtttcttttgtgcacgttagcctaatatagtctctgacatatgcaaatgaagtaataaagcttctaaaaatttcctgtgaaatcttaaatttggacaaagcggaagcaaaatatttcttacttgtgtcactggcacccagcaaagatgtagctctgatctcaggtggttcctaccttcatatcatacattttcatagccaacaaatttgaacagcactggtgtttcagaataaagaaacctggttttcagctagcagctcttataagcatttgttatcatctaacccaattgtttcaaactttttttttactgcaacccataataagaactacattttacattgtgacacagtacatgcctctgtgtgagtgtgacttttaaaaaccaaagcaaaaatttcacaaacagtacttactctatgagtgttacattccagtgttttctcttccattacatttctttcaagtactgctatcactgatttcacaacctagtaattggttacaacttgcaacttgaacatcactgagctaacctactaggcaaaaaaactaaactcaatttcccttactttatggttaaaaaaaaagtttgtaggcaattctgaaatgaatgtatttatagaagaaatagtgtctttccaattacctttttttaatgtgggggaaaataggtgacttttatagttctttaatatctggaaaagattacttctttaaaagttgatgaaaaatattttcctaagccttttatcattttatctctcactgaattttattaaaatctggaagatgtcttttgcagtaaacaaatattcagcatgagtttgacgtattattcacatagggcagattttaacaaatttctcctaagactcaaagttctattgctttgtagaagggcaatcatttgagttatttcagcagagagaagacagtagagtcattgttgtcccaaggggcagagccagccccaaggagtagaagctgacaagaaagtctgtttcactttaatataaagataaaatgagcttggagaaggaagagtcagagcaaaggctgggtgaccagatatgagagaagagacctgcacttgtgggaggactgggcttatgacccctaatatgatttttgtaaaagtactccttcattcgaaatgagttcaaacatacagaaatgtatggaaaataatataataaatacctgtctacccccatcaccgataatagacatttcgtgttttgtgttccaggtttttgttttaaaaaaataatgaaagcttcactgatataattaacactccaactcatcatccctttcccctctcctgctccccagaagtaatcacagtcctggagttggatatatcattcccatgcatgttttatacttttgctacctatgttaatagatccataaataatatataatattgttctgtattttattttattttattttattttttcttttttttgagatggggtcttgctctgttgcccaggctggagtgcagtagtgtgatcgtggctcactgcaaccctgcactccagtccctcaaactcatgggctcaagcaatcctccgatcttggcctcccaaagtgctgggattataggtgtgtgccactgcactcggcatctggttgttttaatgtacataaatggggatgtacagtaatctttttgcacatcttaaaatcactcaacattatgtttttgagatctgttcatacatttgaactactgattcatatcccattgaatgaataaaccaatttattcttctattctagtatagtttcttaccctaatattttgttatttgagggaaaagcttctgaaaattagtagtcaaaggtaactctgtccaggagccaaaggtgttgatttcatataaataactattatctgatgctgtctgatgagagttcagtatcacttaagggctcttaattgatagggaggaagttagtaggcagatttgcaattagcgaacaaccctcactccttaaacccccatccatgtctttatattgcagaactgtcaaatcttagctataggaaatactttacaggccctctaatacaacatcccacccacagcaggaactcctatctcagctttgacagagtcacctcccctgggcttgaacacttccattgatgaggcacccgctgtctcagctccaattcatgggaaagttcttccttctagtgactcaaaatgtaccttcccttgtaaatcatacacttttgtcctggttatcccttctctacctaaacagggtcaatccaatcacttttcagaggttgggccttcaagcagttaatgacagctgtcacttcctgctggagcattaggagatcataaagacactcccttttaagttcagaaccgagtgagagagggctgctccattcaggcaggtgaagataaaaatagcagctttattcttcaatcgtacatgtcccattcatcccaactttccaacatagaggtctctccacatggtaacatgagggttggggaggaaatgttctacccaaccttttccctcttaagccttatgctttttcagtgaaatattaacatttccctccagaattcctcacatacgtgttgccctgatccttcatgatttgattcaatgactaccttcagatgtgcttaaatacacccaggatacaatagtacaacctattaggctgttaatgcagccgaaaatgtcacatgccatttaaacatttacggtcaggtcgggcacagtggctcatgcctgtaatcccagcccttttgggagtcagaggcaggaggatgccttgagctcaggagttccagaccagcctgggcaacatggcgaaaccctgtctctacaaaaaatacaaaaattagctgggcatacactagctactagctactccctagctacttgggaggctgaggcaggaggatcacttgagcctagaaggttgaggctgcagtgagctgtgattgtgccactgcactcaagcctgggtgacagagtgagaccctgtctcaatgaaataaaatagaaaaaaataaaatttatggtcaactaagacctctagatctttcttgctataactgacatttatccagtacttattgttagtattcaggctgttaccatttatactgctagtaccttttaatgttaatgtaggaaaaatataaatataaatatattttttgctgcatcatatcttgtcagtgtaggtcagcatttcctgaactgtgtttctccaattcagctaaatgttaataggtgtttcatgaaataccttttttcttttcttttctttctttctttttttttctttgagacagggtctcactcttgcccaggctggaatgcagtggcatgatcacagctcaatgcagccttgatctcccgagctcaaatgatcctcccacctcacactctcgagtagctgggactacaggcatgtgccaccacacctggctaatttttgtatttttttgtaaagatggatttcactatgctgaccaggctggtctcaaactcttgggttcaagcgattcacccgcttcagcctcccaaagtgctggaattacaagcataagccactgtgcccagcctcatgaaatacttttaaagtcaaacggctaggaaagaccttaagcaagcactccaagggcctcagtcaatagatgggtttcacttgactgtcagtttcttttattttggagacagggtctcattcccgttgcccaggctggagtacagtggctagatcatggttcactgcagactcgacttcccgggctcaggtgattctcccacctcagcctcccgagtagctaggactgcaggcatgcaccaccatgcctggctaatttttttgtatttttagtagagacggggtttcaccattgttgcccaggctggtcacaaactcctgagctcaagcaatccgttcgtcctggccactgcgcctggccgactgtcagtttcaaaactgaatgcctttacccatgaagcctgcctaaatctcccagtcctgacccctgaccctctgttgtcctatgcgctgccacctccctcatttatgcgttccaccaacacggctgcatctgtaacatttcaatcagcaaaaggaggctccacttatcttttctgtgggatttttcagaaccctgaatatgcttgtgtgcaatcttaaatccccaagtggtgactagctgcggagggtagcatttcccatttgcgcaactagaaccttttcccccaagaaacttcttttatgactagtgttccagagaacacattttgggaaacaccagccaatttaggctccttgttgccacctgttgaaagctatgcaagcgctgtatttgtcttccagtgtggtaattatccctcccagctttgctgttgtgagtagttgggacaaacattttttccagaactcatttttggttaataaaatgttagcaggatagagtgggatactgaatccagtgacataccacaaaaacctttttccaggctaccgctgatccattaattaattagtcctttgggtacggaagccttttaaccttgacacatgctttgctaaaaaatttggatatatgtgatgtttatggcattgtcctcatttattagcctattaaccctattgaaaaacaaatgagattaatgtagctaactaatgctaacctgtagggatcaccagatctttttccaagggctgaaaggcacttaggcctttgattacctaatgatgtgtccgagggcagccctgctcttctaataaacacctctcttccctacctttctccttgtctgtcttcttactttctctaagagtgctccttgaattatgttactctgtcaccttccctttcagaagtcttcctctaattgcaagatctaaagacccttattccttttatcagagataaatccagcagtaccaaaaaagttagcagttacagcttcttccctctcaaagtaggatgacactgcagcctcttgttcattgcagaggcttagcatgtctctatttgagctgatgagtgacgtgctagacgcttctttgatacttttgagagtaacaaaagttgaccttgggtactcaaggcagcagaggatttctattctggtatgtggcaaggtcatgggagattgttgctttattgtgatttaagcatggtgctgtttcatatagttctctttttagattaaaagatttgtccagctaatttaataatgattatagcctatgtgtgtttaattaaagtgttaatgatcctttcacagtcgcagtagtagaatgaaagttgaatgaattgatttctctgagaagtgatttgcaagtaactgttatgtcttgggtctttaccatcagagttcctccaagaaaactacccaatttgtgatctctcggaaaatggaagagactggaagtcgtgtgtgacctccatcaacagcggtatccgtagccttagacatgacgtcagaagggctgaagccaggtctcagtcgcttccagcagtgacccctccagagctggagcaggagtcaaagccaggagatcccgacgccactgacccaagcacctgaacggcagctgccaaactttttttttttttttaactgttaagactattttgtaagtttctcaagttctaattccaaaatcagcctgctgtactggcagagtagtttgcattgacacctgtagtaatcgccaaacctctttttctgctcataaaggaggtagaatcacattaggaagatacgtaatgtttcatctgtggatttgatgacaacctctgattgagggaatggtagtaaactcctcatgggcttgtgacccatggctttgacttagataattgacattaatatactttgtttttttgataaggtagagaaagaaattcaatagaaagtaaggagccactcagtcaaataatataattcgtataaaacttgacaagtctttttatttttgtgacttgtgagatagtttaagatatttttatgtgaccaatttgtagaatgaatacatattttcaaagttatcttttcaaaattcaacttttagagtattttagcaaaatatatgtatagtttataatatagaagtatagctttataaagatattaaggatttattttttaaaataattctctgaatagtttgctgtagtagttgccttcagcttaataaaaccatagtacttctacatacatctttataagttaggctatgcctacaaaggtcttaaaaagtagataatttaccgggtgtagtggctcacacctgtaatcccagcactttgggaggccgagacgggtggatcacctgaggtcaggggttcgagaccagcctggccaacatgacgaaaccccatctctactaaaaatacaaaaaaagtagccaggcatggtggcaagcacctgtagtcccagttactcgggtggctgaggcaggagaatcacttgaacctgggaggtggagactgcagtgagccgagattgtgccactgcactcgagcctgggtgacagagtgagactccgtctcgggaaaagaaaaaaaagaagtagataattaaaaaaatcttgcataaaaaaaaatcttccataaagggcaaaaaggctttaacttccattattcagatttaatccaactaagatagtctttggcttcattcactgttcagtttcacaagttttttacaactactagtaacagagctaatacagaatagtaatccacattataaacatagatcaaaataccacatcataccccataaatacatgcagttattatttgtcaattaaaaataaaatttttttaaaagaaaagtacagttcgaccctaggcaagaagaaatttcaaattgtatatgcatattttgaatttggtttatattttgtggtatctgaaatattccctggactagaagcaaaaccacagaaacaaaactttacatttagaaaaaaatttcaagacttctattgctaactttattacattagtggtttttagaagttatttagagcagtcttgtctgatagaactttccaccatgatggaaatgtaaataaatataccacattaaaaatataaatttgcaatgtccaataggctcgtatggctattgagcatttaagatgtaattaattagacagaggaagtaaatttaacattttctctcattttagctaattagaatttaaagtgaaatagccacaagtggatagtggctactgtgttggatggcacagttcaaaatgcctcttatttataaaaaaaagtgtttaaaagtggttcccatggcttgaagaggaataatatacacataacttctttaaaatcacattttgtttgagatggagatcttgctatattgcccaggcttatctggaactcctgggctcaagagggaggatcacatttgactggacaaaatacattttataaaggtgttttgtattttatgttaaagtggaattgtgtcttcaaaattgtgtcttcaaaatttcacaagttaatactattactgtattagtccaatgttaaacattttaaatgcctgctcataagactcatttttgataaataaatgtatctttaatgttttgtttcccaaatagatacaataaataaacatttaaaatgcctta

SEQ ID NO: 3143 - DNA, 49929 bp, human
ggctcctgcccgggcctcattgtgcctcggacaacgagtgtacgcagttaccacacagttaccaagcagttacctcagagccgcggcgcagacgtaggcctcaggtctcgggcctcaggtctcgggcctcagagccagaccccgccatctcacgatgtcagagaggacccaggaacagggtaaagtgacctcgcctcaactggcccgctagcttgggcctcaagttctgtcaagagtctggatggcacccacttaggtggccattcaggggcggcaggattggctagtcattgaccggggcgtgtcggggggcggcctctgggtattggccatctgccgccgattgctcagcgcgccggtgggaaatttggcgtggtggaccgagatggcccagggttcaggtcgtctcaggggctcaagatgtcccggagacgtgaggtgatcctgaggctcatggcgtctccgtggctcttggtggctcagggttggggtgacttgggcttgtgccgagagtgcgtcaagaggctgggcctggttgccctctggcccgcggttctttccggagcctcgagtggctgggaaacaatctcggcgctcgcgacgccgggctccggcgatacagatctatgcggccgcactttttcttgaatttattggttttccctggtgggcagccgcggaacacagccctgttcagcgttttggcatagcggctggggcacagcctcaaattccgggtgttctgagggggtgctttgggtggtacccgccgcctctcccggggtgcccgcgtgggttacattttgagatttcgaagcttattagatacttgatgctgactttctgggacgagcttatcctttttcagctgttctctttttggtgaggcggggtatgggggggcgaggaatgaggaatgactcagactttcacagaggttttttgttgttgttttttgtttttgtttttgcttggttttgttttgttttgttttgttttcagacagagtcttgctctggtgcccaggtgggagtgcaggggcgccatgtcggctcactgcagcctccgcttcctggattcaagcggtcctctcacctcagcctcctgaggagcggagactacaggcgtgcaccaccacgcccggctaatttttgtattttttgttgagacgggatttcgtcatgttgcccacactggtctcgaactcctgggctcaggcaatgctcccgcctcagtctcccaaagtgctaggattactggcgtgaaccaccccactgggtgagagctttgagtctaaagaattgacaaattcccgagttgatttcctgtcagacattttgcggttgagacatagagtctgaggctttgatggtaaccgagtttgatttagagacagactgtgcagcttcgctgttttattgtaaatacgtaaatgaggaggaagagaaacacgtagggtgttgggaacagaggcggaagttgggagatcctgcgaaatcggagtccctttggagtgggggaggccgtcgaggcgtgcgagggcccggcccccttgccgcgtggtcgttaagaggaaaggccctgatttggctggtggcggatcgcgtccctcccggctctccccgagtgcggcaaactggcttcaggttgactaaaagcgatttttccagcagctttgctgcgccttgctttctaaagcgaggcgtgggctgggtgcctttttgagcctcacttgtccggcctgtggcaagtgctgggcgatgggatacggttctggcggcaaaggaagggctgcctttgagagtcccgcaggaaggtttagaaagtggttgttcttaaaacaaacggagcggtctggctgttgtaattggccccgttttgctgtgtgttcctcaaagtggtcccggcgtgaaaagccgttttcagaactcattgtgagctgtgcctcatctgatgagttgatggcaattgaaagccttgcgccttggtagtataatgttcaaacaatttcttgtttttgtttgtttgttttgttttgtttttttgaggcagagtctctctctgtcgcccaggctggagtgcaatggcgcaatctcggctcactgcaacctccacctcccaggttcaagcgattctccggcctcagcctcccgagtagctgggactacaggcgcacgccacctcgccccgctgatttctgtattggtagagacagggtttcactgtgttggccaggctggtctcgaactcctgaccccaagtgatccgcccgcctcggcgtcccaaagtgcggggattacgagtgagagccaccacgcccggccatcttcaaacaatttctaagtgttaaaatgtcttttaaaatttaattgggaaagttatgtgtacacctaaaagaactgattggacttttacatatttactgagaaaccttagcggtgttgtcaatagctttactagctctagtttgaaagatctgttgatatacaaaagcttgtcttaaaaatacactttcagttgccttggttattttcttctgatgacagaatctaaagttccttgtacagaatcgacagaaaagtctaatgataataaatttgctattcagtaatagccacctagataaccattggtatgttacctttggctctcaaagttaggattatactgtatttttctgttttgaatccttttctcccctttaactttatttaactttatttcacaagcatatctagtattagtacattttctttgggaacatgcttcttcttcttcttgttctttctttcttttttgtttgagacagggtctcgttttgtcgcccaggctggagtgcagtggcgggatcctggctcactgcaacctcagcctcccgggtgcaagccatcctacctcagcctcccaagtagctgggactacaggcacatgccaccactcccggctaatttttctattattattattattattattattattttttggtagagacaggatttcgccatgttgcccaggttggtctcgaacttctgagctcaagcgatctgccccacttggcctcccaaagttctgggattacaggcgttcgctaccgcgccctgcctgagaacacacttcttattggcaatataccattccagctcagggaaataccaaaatttatttaagcttttgtttatttaatactttggtttagataattaggtggtttctaatgttctattttttttccatgaagactattaagtagacttcagagtgactcttaaaaaaaccccactttttacgggtgagaaaacagaggcaaaagagtcaatttatctggcccaacggtcatacctctggataattacagagcctgaattggaaccttcattctgtgattcctaatttagtaccattttcaaatcatcacatgcccctcacactagctaattattttattctcctgcattagtctatttgaaataaatagaataaatccaagttatgatgtagtttaaatgtggtctgtgagtgaatacttcaagcttaaatgtgttctttttcaggccagctttaagaaataaagcttattttgatcttggacattttgcataatgtgttttcatattcattaaaatggtttacctagttgatatttcacatctggtatatttgtcattacctatttcacattttgtgagattcagttttaattcatttcataacaacatttacttttgcactttatttctgcattatcagtcatcatagacattaatattagtttttagagaacaaatttagaacttcatggtcaccacaagtatgtctacttaacaccagttgcatcgtttaagttaaaagcatatcattgaacactgtggcatgggccagctggccacatttcttaaatgagaagaaatttattgctctacgaaattggaagtactagagatagtagtctatgtgtgtatatgcatacatacatatatacatacttcaaaacttcctactattggttcattaactaacttgtaatgattacagatataaaaatatgtaatacaaattttcagctaaaatatgttttttaaacaatctataactttataaggtagcttcctcaagaaactgtttatttaatgtgatattgaatctaatcttcctctttgcttattcttagattttgttattataactgtcgacgacagtgatgataacaatgattgcagtattgagatggtggaagtttctgaaacagcagataattccactaatgacatagcagatgattccacttatgtcacagcagataatcccactgatgacacagccacacaaccaaattttccaggcggcaatgatggccatcaccgtccactccaaatgtcatatggtaattttgttaaatttcatccttggcaaaattttactctctggtccccatttccagtaaattgcttaaatattcctgtaacctttacagtaattagttatgaccagagggcttagcttcatggtaataccacaatgtttacttctgcttgcattttcccttcacttaagctttgccatgtctcctttgttctgtgtgagacagtcccaggaagcattggggagaatatattctctgtctttgaacaattatttatatctggcaactataattgtaacaatttggtggcaatgcaaaagtaaaaagctaaaactgaacttctaggaataacagcttgagtcaagagtccatggagcaggtggcatgattatctatgtagaaagtctcaaagaagcaacaaaaatctcctggaagtcataagtgattatagcaaggttgcaggaaacaggttaatatacaaaagttaatcactttactacatgccaacagtaaacaattggaatttgaaatttacattagcatccaagaccccatggaaagtggagtcctgcaaccagaactgctatagccactggtcctttgaatggctctctaggaaatgtgagaccatccacatcctcacttgtacagagagccatgagacgttaactccttggaatatttcttccttagctgtatgacaatttgttctttgccctttgcttagagaattggattttcttctctttaaaacatggaaatgttattgcctatgttggagactggcaaattttttctgtaaggggccagataataaatattttaggctttgcaggccataagttctctgctttaagtatttaactctgcctttatagcatgaaagcagctgatatgtaaacagatggttgtggctgtgtttcaataaaactttatggtcattgaaatttgaatttcctataatttttccatttcatgaaatattctcccccccatcatttacaaatgtaaaaaaagtccataatatcttagcttatgagctatacaagaacaggtggcaaagtggatttggtccacaggtggtggtttgctgatccctgatctgataccaaaaaagtcatttgataccacttatctgttttggttttaaaactatatgcagggctagcaggatacttctttagtgtgttatagaacatctgatatcatagagacagaaagtagaatagaggttaccagggactgaggtgagggggagttattgtgtaatgggtacagagtgtatgttggggatgatagaaatattttgggtatagatagtgaggatagttatacaactacctgaatatatttaatgccactgaattgtatacttacaaatgattaaaatgataaatgtttgcctttcaatgtatacacatcattatatcaaaatagtgaaaaattagaagccatataaatgtcccacagtggaaaacagataacagaacctctggacatccataaaatggaatattatgcaggcatttaaaaatatttttaaaattataaatgacacacaaaattgcttaaaaatatatgagtaagataaataaatgtatttaaaggttacaatatttattgctgatggattgctttctctttttatttagattctgaattatttgtaatgagctgaattttttaggtgaatttttttttctttctttttttttttttttttttttttttgagacagagtctctctctgtcgcccaggttggagtgcagtggtgtgatctcggctcactgcaatctctgcctcccgggctcaagtgactctcctgcctcagcttcctgagtagctgccaccaccacgcctggctaatttttgtatttttaatagagagaggagttcacattgttggccaggctggtcttgaactcctggcctcaagtgatccgcccgcctcagccccccaaagtgctgggattacaggcatgagccaccacgcccggccataggtgaactttttatggaagtctatgacatacaaaatatgcacacatcataaatatacagcttaaataaatttcaaagtaatacatgcatataaccagcacccatcccaagaaatataaggttatgagctccctagaatcctatccaccccctttcagtcactactcttctttgtaaggtaaccactatcctgacttctcccaccatagattacttttttctgtttttgagttttataccaattgaatcatatgctatactctcttttatatctggcatttttttcagagacagggtcccactgtgttgcccatgctgtacttgaactccggggctcaattgatcctcctggctcagctcctgtgtagctggaactataggcacgtgccaccacacctggcttgtgtctggctttttttacttcttgctatgtgctgcaatagttggtttattctcactgctgtatagttcctttgtttgaatacatcagaatgtaattacttatagcttgcattatagtcagaaaaaaaaaacagcttaaaaaatagaatttggttgaatttacagctcagtttggaggtatcttattgtatcttttattttcttcttcttattatttttgagtcagggtctggctctgtcacccaggctggagtgcagtggcatgatcacagctcactgcagcctcaacctcttggactcaagcaattcttccacctcagccttcccagtagctgggatgacaggcgcacgccaccatgcccaggtatttatttttatttttatttttagtagagatgatatcttgctatgttgcccaggctggtctccaactcttgagctcaagtgatcctcctgcctcagcctcctaaaatgttgagattacaggtgtgagccaccgggtctagcctggagggattttataacttgatatttctatataacattagtctgcatttatctaacttgagagttagttctcccattttctttatccccttttgatttctctcttttgggtccttggtcattaggatctccactatagaatgaaaggaaacaggaaagagatgaaacttgaatcccttaattgtgcctctcattactgccctggctcaggaaggtttaagtgaagtagctctttcattaaagtgtcactcccagtaactgtgatgcaggcttttaaagcaaatctctagtacaagatacaatccaatactgttgcagccaatgtcttcttctagttccgtagttaggtgactcagagccataaccagatcttcctaattctagattgtttggcttacatttcacatccatttatttaggattaatataaaatttaataaggcaatcctaacttgaaagctgaaatggaccttagagatcatctcaactgatgttaacctggcagatgaggaggtggtgtctctagtggtctgcccagctcacatagcagtgggggtccgatctagaatagattcctggcttacattttggacacaatgccatctccttagtcaagggccttttgggggctcctttacaaaagcagttagcccttgcgttctcttgttcatttgtttccagcatttactatgtaggctttaagttattaagcagtcacttcacagtttgtaattgtgtttgatttgattcttattcctagtcataagtaatatagcccttcagttttaaaatagttactctaaattggtcatggaagaattcttgttttgtcactctaaaattcaacccaaagtccaattcaatttgagttagcattctgagagcatatccgtattaaggttattaagagagtagtgtatgaaataactttttaatgcattgcttcacagtagcccatggtgaccaaatagtttcacagataaaccacccagtacatttaagaagatacagttacaactcagaggaagtggattttccaaaaagaggaagattctatactccagaggtagatattatggtttgtttattaaagtgaaaatctctctttgttcttttcattctgctgtatttctttttaaaaaatggagttgaatttcatgcagtaaaatgcacaaatcagtgagttttgataaatgtgtatacttacaccccatgaagataatgaacattttggctgggcgcagtggctcatgcctgtaatcccagcactttgggaggccaaggcgggtagatcacctgaggtcaggagtttgagaccagcctggccaacgtggtgaaaccccatctcttctaaaaataaaaaaaaaaattagcttggcgtggtggtgcatgcctgcaatcctagctactcgggaggctgaggcaggagaatcgcttgaaccccggaggcggaggttgcagtgagccgagattgcgccactgcactccagcctgggtgacagaacaatactctgtctcaaaaaaaaaaaaaaaaaaaagacagtaataaacattttcatcaccctagaaagtggcctgggacctcttcccagtaagtccccatctcccttaactttgggggaaatatattttgatttttttttccatcctagatgagttttgcctgttctagaacttcacataaatagaactgtacagtatgtactgttttgggtcatagtcttttttcctgagaagaatgttttggagatttgtttcatagtattaatatttcattcctgttcattgctgagtggtattctgtcatatgaatactcataatttgcttacccatttttttttttttctgagatggagtcttgctctgtcatccaggctggagtgcaatggcacgatctcggctcaccgcaacctccacctcccgggttcaagcgattctcctacctcagcctcctgagtagttggaattacaggagcccgccaccacattcggctaatttttggatttttagtagagacagtgtttcaccatgttggccaggatgatgtcaaactcctgacctcaggtgatctgcctgcctcggcttcccaaagtcctgggattacaggcgtgagccaccgcatccggcctgtccattcttttgatggacatttgggttgtttgcagttttgggctattaggagtaaagtgactatgaacatgcttatggcagtctctttgtgaacctatgtttgcatttaatttgggtaaatacctgagagtggaagttttaggtaatggggtaggtgaaagtttatgagaaattgccagtttttctaagtggtcatactgttttacattaccactatattctcctgtgctttttgacctctgaagttgaataaaatagattattaaactatatataatttggcttaacagaaaatgtatttgtttacttacatgaggatgtggatatcagtgccacataagtagtgtaggcaattcttaacttctatcagcctcaatattttcatttttggggataatgctaattatctgcccagtgtcatggttttgtacataattatctgaaagcactttggaaagcatgaagcactatacaagggtaagatggtaatattttgtttacaattattaatatctattataatttgatataattttgccatctaataagtttgtaatgctgggctaattcgattaattttttatcatgtattttgaaacaaagaagtaggtaactccttggtatgtttatattaaaattatttttatggcccacaattcatctttagaataattatacagaaatataatggttatttactgtctgtttacttatttataccctgccttactccaaaaaatattttaagatgatttacagattaatttatcaagaaaaatagatggttaagtgtttcttgtcttgtccacagagtgtcactgttggtttatttgaaaatcaaaagccatttaagatttggttctttgttcatggttagaaatacttgcttttaaagcagttctggtgctagaagactcgtttatctaccacgaagtatataaatggttaagcttgatgaaaatggtgtcttaagtgtagctgggttaatgagaacacaattctgcaaatatatcttttcctgtagttgtaggatttgtgatgggcaaaggtcctttgatatcacaaataggccttaggtgcttcttgaaaatgaaatggaagttctgaacttttctttctttcatatgttcttttggtttattaataatttttccttagacaataacatgaatacttgattgtgaagaaggtggaagtatcattaatgaatgtataccagactttgaatctttatataatattaaatgctcattgccaaatatattccaagaaagcaatttgaattctttttcagtcttcatatatactacagaattactctgaactcaggctgaaggaaatatctctctctcctgaatctgtatgcttcttttcattagacaatgagctctgaagcattttgtttccttcttttccttatctagtaggaaattcacagcatttttgtacccagtttcattagcttttctaatttttaaaagaattatagatttacagaagagttgcaaaaatatttcagggaattctcatatatatgcttgacacagcttcccttaatgttaacttacatgtataacttaaaattatggtaattgtaataatcacagcacagttatcagaaccaggaaatgaacattggtgtagtactattagctaaactgtggtccttgtttgaattttgccattcctacccaatcccatgtcctttttctgttccaggataaaatctagtatcccacattgaatttagttgtgtctccttagcctcttctagtctgtgacagctccttattctttccttgtctttcatgactttgacactattgatgaccactgctcagttattttataaaatgtctcgatcttggtgtgtctgatactttctcttgaatagatcgagattatgcatttttggcaagagagtaacacatgagtgatgttatctcctcattgaatcatattgggggataggtggtgttgatattttttttattggtgatgttaacattgatcacttggttaacatgatgttttccagatttttccacagtaaagttactatttttccccattgcccacgataaagattttgggtggcaggggattttgagactctgctaatatcctgtttctcttcaactcaccaagacaagttagtatccatgcatggattttacctgcagcagccattattgtggtgtgtgccttatgttgattctctgtctccctcattccttctggatttattaattggaatgcatttgcaagggagagctgtcctttatctcctatttatttattcaattatgtatattcatattaatattgactcatggacatttattgcattgtatgagttataatccagtattgtaattatttcttcattgatcaaattttccagctttggctattgggagctccttcagttgattcccatggccttttgacttgtccctgccttttttgtatactcacttgttttctgacatcacaagatagtctaggctcatctgtactttccctgtcttagctctggaattaaactgttctctaaggagccccggttcctttagttggagactggtatttagaaaccgagatctggacactaggtgtgttcattgctcctcttgtgtcattgatcctaggccttctcagtggacagaactaggaaataaatgtaggtatcccaatccatgcacacacatacatctatatttcagtctcgctatatattaaaactatatgttcatactgatattcagtagcttttcttaaacctaggttcttatataataacttctttgcctacctcctttattaatcagctcttttattctcatattctctttttcttggctttataagacttctgaaatcctctggaacataggggagaaacaaaaagaatttaaaaatataaatatttaaactgttctttttatagtgcttactttggctcctagtgatattaagacattgactacttattttttatatatatatatttgagatggaatctcgctctatcacccaggctggagtgcagtggcgcaatcttggctcactgcaacctcctactcctggattcaagcctcagcctgcctcagcctcccgagtagctgggactacaggcacgtgccaccacgcccggctaattttttgtatttttagtagagacaaggtttcgccgtgttagccaggatgatctcaatcttctgaccttgtgatccacccgccccggcctcccaaagtgctgggattatatgtgtgagccactgcacctggcctattttttagaatgttaatagaacaatgaagtttcttgtgatgaaaatgatagaaaccatctttctggattccaacactgttgtaaagtatgaagttctgtctctcaaatgtagttttctgaaatactgagccaaaaaaatttttaatcacatttaataccattgtactattttttttttttttctgagacagaatttcgctcttattgcccaggctggagtgcagtggtgtgatctcagctcactgcaacctctgcctcccgggcttaagcgattctcctgcctcagcctcccgagtagctgggattacaggcgtgcgccaccacacccggctactttttgtatttttagtagagacagggtttcgccatgttggccaggctggcctcgaactcctgacctcaggtgatctgcccacctcggcctcccaaagtgctgggcttacaggcgtgagccactgtgcctgaccaccattgtactgttaatagaaattttgctgtgtcaagttctgtatgattatcatctcattgtgatacatttttcaaaaaatttctagttagaacagtatcccaaggtgaaaaatttgaagtaaaaataatttctatagcccctttttttttcacaaaaaagcccataactgatcaaatgtagttaagcctctttcatctagattgtttcacatttaatttctccaaaataatccttaaaggaaattggctgatttggatgaaatttagtatgtgcttgaatgtgtatcaagatgtctcaatggaaacaaaatggcagcccatcaaggttttgtaaagaaccataccttaggtggttttgagggggtgttgtaagaatcaccatgttggtaaagatgtgattaccggggattttctgagttctaagccagaggtaatgaaggtttattaaaaaaaatgtttcttaccgtatataatgtttcttgaatggaatgagctaaaatattttggaaagtaaaattgtttgggcgtttatcatgatcatgggggagaacagaagcggagtgcttccaagggacacatgcagtcttggggggaagtgggtgcagaggcgagctgggaagggagggagcaggttctccctagcctacctccccctgcactgctaggccagggtccccctcagcaagcctgcacactggggtgggaggcagcatctgtggggggaggtgcctagggccatggtcagcctgaaatggccccaatggctcctctccattgctcctaaggggctggctttttccttccctgcccgttctagatcacaggggtggcgctgcagcttgccttgttctttcataccagttccctcttgagtccacctccgtcctgcttagctgggagcagaggaggacgccctcagttggcagtccccggcctacctcagccctctagtcctgcctcttcactcctggagacagtggagcgcctagggcagtcctctcctccaactcctcatatctgtccccacagccaaccaactgcccccatccccgcccttcttctgaccccttcccgactattctagtggcctgggctgacatccttgctgctttctgcatctagtcccctccccgaactcagagctgcccccaatcgggcgtccctctgtctctcctctggctctagctcctgaccctccttcccctctacgtgttctcccacagcttggagaagccacttctcttgcctcccatccctcctttgctgtcatcctcactctctccttcccatgacagcctcgctcctggaatgtcattgatactcgctgtctccacatctggcttcctgtttttctctgggtatttttgaacctgctgtttcttctatcctgtaaacccttccatgcatcctcacctggtgagctccttctcatgttttaattctcacctcagacctcacctcctctgaaaagctctccatgactgccagcctgggttaggcccactcttctgtgcatgcttagcctcctgttcctgcctgtgtcatggcgctggtaataacaatagtaacatgaagagaccactgagcactgttggactgggcatagtgtagtgttgttaccgttagtagtaacctaatactatggcaaggttcttgtcctcaagagaaccctgagagagattttcatcccgattccctacatgaggacattgaagcacagagaggttaagtaacttgctcagggtcacacagccaataagtggctggactctagtatttgaccccaaccatgttcccctagagcctgcactgtttacctcagtgccatagcccagtggttctcactgggagcatcagaatcacctggagggcttgtgaaaacatagaccactgctcctactctcagagtttccgactccagaggtctggggtacggcctgaaatttggcatttctaatttcttgcaggtgttgttgatactgccagtttgtggaccactttgcaaaccactgttccaggctgctaatcactttgtctattggaatcctctctttacttgtctctctcccagctgagatggcagttcctctaggacaggagctttttttttttttttttttttttttttttgagacagggtctcattccattgcccaggctggagtgcagtggcacaatcatggctcactgtagcctcaacttctcaggctcaggtgattctcccacctcaggctcccaagtatctgggactacaggtgcatgccaccatgcctggctacatttttgtattttttttttctagagacggagtttttgttgttgttgttgttttttgttagagatggagtcctgctgtattgctcaggctggtctcgaacttctgagctcaagtgatccgcctgcctcggcctcccaaagtgctgggattacaggcatgagccaccgtgcctggctaggagctttctttcagtccatgtttccaacacatagcaaagtagttctgccaggtggaaggccgtcaataaaggtttagttgaatgaatgaatgaggaaatgtttctggccctttgtttaagcgtattttttttttgcccaaagtttctgtgtatttcaagaagaattctcagatttttatcagtcatatatgcttgattggcacgtaggggatgtgtactcaatggttttgtaagattagttgttgactgcatgattttaaaatgtttgaagccaaaagtcacatctgttatatttggctcaatgttctttctggagtggaacactcactgtctgtatataatatagacttcatatttgtacatatatgaacatatatgttacatatgaacattataaagtgagtatttggtcttttagcagatttgaggatttctttcctaaaatagcaccttccttgatgtgcagcgtcttcatcatcaatgtgctggtgtagaggcattgtggcgctttcatttgctggcattagagcatcctcagtgcctgcacggggtagagcagcagaggggatgttggggctcctgagctcagcctcttggctctgtgtcacctacagccaggcctcgaataggagcaagacatttctgatggcttgagaacttttgttgtgtctagcagttaacatttgacttaatggcattttcacatatgttatttttcttttgaaatatgagctactattttttaaatataatagaatttagaagatcttattgaaaataccactatgcaggttgaccgtctttgtggagctgtttcagaagtgcaatgttcttgggagcaaccacctttgatgaaatgtgtgttacaaaaacatttttacaactttgataaacctctagctcctaaagacacaaatcagttagaattgatagagaactagtaactctgagattagcaaggcttttctctacttactttaatagcagatgggggactacaattcccttggaagaatgctgaagtttaggtctgacagattacaacactgagtatttttatgttagtagatatcatgtataaaatgtagggttgaagaagaataaaaatcatataatcaaagtacagcatttatccttaacaatggaaaatgatgttgcaaggaaaatacataggaatgcttatttttttaaataaactttttaagcctcattttaagttacagttgacttatactgggttggtgtcattttagaggtcgtctggatttacacaaaaaagttttgattgtatgtctcatggagaaattgaagtctaggaaccgaagaaaataactttactcattctgttctcttaccctggataggtacagtctagcatatcaccaccagcggaaaggcaggaaacccatgcctgggccagccctgctgtaacatctcttgagtcagcagcatgtcatgaactgcaggaagcagacctcagtgagagtttatcatatcccagaattgtctcctcaagttcattacagcagtatgtcgcacaaggtggctcatttccttgtttcggtatgccatggaactttatcagtggaggtgctgaaagtaccaatgctgtcatctcatttgccaatgctactacagcagtacctatggcagttctgtcacgaagagaatccagtctggcaaataaccctggtgtggtgaattactctgctctaccagaaaatgaaaatgtgggcccaggtagagccttgtcatctttctgcttccatcccaatttgggtgagtttgaaatgacacatattacagatagcattcttcaatctagattttaaaacacccttcatgcaaattagtgttagttattttttaaattaaaagttttatcttgaagccattatagattcatatgtagttgtaagaaataatacagagagataccctttccccaattttccccagtggtaacatctcataagactgtagtttgtattcatttgtgtgtctgactttcggcttttttttttaaaacaattttatcagatgagaaagtttgtatgttcctaccatagtcaagatacagaaccgttctatcaccagaaagtttgcttgtcttgcctttctataaccaaacccatcctccttttccttcccccacttacctattcctaacctttggcaagtgtgatctcttctccatctctataattttgtcacttcaatattgttatataattggatgcatatagtatgtaaccttttggtactggcttttttttactcaacataatcccctggagactcaaccaagttgtgtgtttcagtagttcctttattgccaagtactattccatggtataggtgtgccatggtttaaccattcatctattgaaggaaattatttttccagtttttgactattagtagtaaggctgctatgaaaattcatatacaagtttttgtgtaaatggaagttttcatttctctgacatgattacccaagagtgcaactgctggttatatattaattgcatgtttaggtttttttaaaaaaacaaatctttattgagatattaatgtcttggtctgtttgtgttactataacaaaataccatagactgggtgattgaaaaagaacagaaatgtagtttctcacagctccagaggctgggaagttcaaaagcaaggtgccagccggtttgtgtggtgagggctgcatcctctgcaagagaggagcactgtgtcctcacatggcagaaggtagaaggacaagatttcaaaatgccgtgtgaagcctcttttataagggcctccatcccattcatgagggaggagccctcatagcttaatcatcttaaaggtcccatttcttaatacgatcacattggcaacacctgaattttggaaaggataccttcaaaccatagtaattgataagtaaaaaactgcacatatttattatacccaatgtaatgagtttggacatatgcatgtttagttttatgagaaactgcctaactattttccaggggcgctgtatcatctgacattcttgccagctatatatgggtgatctactttctctaaatgcatatttctgctctttcttttgttctttcttcctgatgctccaagattccttctttcatcatcttctttttttgattgaggagttttctttaacctttctttaagggtaagtctgctggggacaaattctttttgttttcctttgtgtgtgaatgtctgtttctctttctttcttgaaggataattttgctttgtatagaatttgtgggtgaagttcttgtattacagctcttgaaaactttttatttacagaaatgccagaaagaccagcaaacagcagtaaaaacagcactgagacagcgaattatccaactttaatgggaaattacaatggccaaaatactgcctctttatctgtcttcatccctccctattttggtgagtttgaaatgatacataatgctgggcgtggtggctcacacttgtaatcccagcactttgggagggtgaggcgggtgcatcacctgacatcagaagtttgagaccagcctgaccaacatggtgaaaacccgtctctactaaaaatacaaaaaattagccgggtgtggtggcgggcacctgtaatcccagctactccggaggccgaggcaggagaatcacttgaacccagaggcagaggttgcagtgagctgggatcatgccacttaactccagcctgggcaacaagagcgaaactccatctcaaaataaataaatacataaatacataaaaaagaaatgatacatattgcaaatagcattatttaaccttgatccaccagtttttttttttttgtttttttttttttttttttttgagatggagttttgctcttgttgcccaggctggagtacaatggtgcgatctcggctcactgcaacctccgcctcctgggttcaagtgattctcctacctcagcctcccaagtagctgggattataggcatgcaccaccacgcctggctaatttttttgtatttttagtagagacgaggtttctccatgttggtcaggctggtctccaactctcaacctcgggtgatctgtccgcctctgcctcccaaagtgctgggattataggcgtgagccactgcgcccagcctgattcaccagtatttttaatgtcagctagtgtgactcttttcaaactaaacttttcggtttgagataattttagattcacacacagttgtaagaaataatgcagagaactgtttatgctttagccatttcccccaaaggatgacatctttaaaactatagtaaaatatcacatccaaggtagtggcattgatacactccacagatcttactgagatgttcccaggtttacttgtaattaatttgtgtgtgtgtatttagttctttgcagttttatcacaagtagttttaatgtctacctccagtgaagacatagaacgtttctatcactgcaatgatgcctcatcttgccctttgataatcacattcactttcctcatgtcatcctttccttccaacctgccccatccctaacacctggtaactactgatctgttctctgtttataattttgtcacttcaagaatgttatattaagggaatgttacagtatgtaattttggggtattggtgtttttcactcagtatagttatctgaaaactcacccagcttgttgcatgtatcaagagttccctcctttcttttcttcttttttttttttttttttttgagacagagtcttactctgttgcccaggctggaatgcagtggcgcgatcttggcttactgcaacttctgcctcccgggttcaagcaattctcatgcctcagcctcctgaatagctaggattacaagtgtgtgccaccacgcccagctaatttttgtatttttggtagagacagggtttcaccatgttggccaggctggtctcaaactcctgacctcaggtggcctgcctgccacggcctcccaaagtgctgagactacaggcatgagccaccacacccagcctaccctcctttttatttttgatttatatttcatagtatggctatgccacagtttgtttagccattcacccattgaaaaggcatcaaattgtttttttttccagtttttggatattaggagtgaagccactatgaacagtcatgaacaggtttttctgtaaatataagttttcatttctctgtcatgaatgccaagagtgtaattgctgagccttatggtactagcatgtttagttttataagaaactgccaaatagttttccagagagtctgtattatcttccatttccaccagcaatgcatgagtgatccagtttctccacattcatatttctgttatttctattgttcttccttctggatgctctatattttcttttttcatccattcctttctgtttgaatacttttcttcagcctttctttcaggtttctttagtgttcctgcatgtgaaaatgtctttattttccttatgttcttcaaggaacatagttttgctgggcatagaatttgtggctgagagtttattttccatcaatatcctgaatgcaagtcagtggtagctctttaaaaacaaaaaaaaaaactaggctttttattttgagataattttgaattcacatgtaattgtaagaaattgtacagagatcccatttatactttacccattttcctcaatgataacatcttaaagaactatatcctgcatccaggatattggcattgattaaatccacatctctgtgtgtgtatttagttctatgaaatttaatcatgagtcagtttacatgtccactattagttacaatacagaacatttccatcatcactacaaagatccttcatattgttcttttaaaaccatagccacctcccccaatctcccttgcctctcatcttgccctgtcttaactactgatagtcagcaatctcactttgtttgccagaatttcattatttgagtatcattacttaaatgcaactaaatgctgtgtaacctttttatttatttattattattatactttaagttttagggtacatgtgcacaatgtgcaggttagttacatatgtatacatgtgccatgctggtgtgctgcacccattaactcgtcatttagcattaggtatatctcctgatgctatccctcccccctccccccaccccacaacagtccccagagtgtgatgttccccttcctgtgtccatgtgttctcattgttcaattcccatctatgagtgagaacatccggcgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacgataaacataagtgtgcatgtgtctttatagcagcatgatttatagtcctttgggtatatacccagtaatgggatggctgggtcaaatggtatttctagttctaaatccctgaggaatcgccaccctgacttccacaagggttgaactagtttccagtcccaccaccagtgtaaaagtgtttatttctccacatcctctccagcacctgttgtttcctgactttttaatgattgccattctaactggtgtgagatggtatctcattgtggttttgatttgcatttctctgatggccagtgatgatgagcattttttcatgttgtctgttggctgcataaatgtcttcttttgagaagtgtctgttcatatcctttgcctactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttgattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttacgccatcttgaattaatttttgtataaggtgtaaggaagggatccagtttcagctttctacatatggctagccagttttcccagcaccatttgttaaatagggaatcctttccccatttcttgtttttgtcaggggtttctgcttttgcttctatctcatgagagttattcactatcacaagaatagcatgggaaagactggcccccatgattcagttacctccccctaggtccctcccacaacatgcgggaattctgggagatacaattcaagttgagatttgggtggggacacagccaaaccatatcattactcaaggagaatttcactatgtataaattcacggttgagagttcttaagcacttgaaaaatgttctttctgtacgtatgccgagaattgcagaaaccaggctggaaaacaaccctcagacaatgaattacccaatttcttcgggaaatggcagcggcccatgttcttcctcttcatctgccggcctcacacctaattttggtgaatttcagatgctgtattacaagtgacactattgaatccggatcgatcaacatccttaatgcaagctagtagtagctcgtttttgaaattaaacttttatttttatttttttgaggcggagtctcactctgtcacccaggctggagtgcagtggtgtggtcttggctcactgcaacctctgcctcctgggttcaagagattctcctgcctcagcctcccaagtagctggaactatagggcatgccaccatgcctggctaatttttgtatttttagtagggacggggtttcaccatgttggccaggctggtctcaaacgcctgaccttaggtgatctaccctccttggcctcccaaagtgctgggattataggcgtgagccaccgtgcccagccatttttattttgaaataattttagattcacatgtatttgtaagaaataatagaaatgatcccctttatgctttacccttttctaccagcaatatcatcttacaaaactatagtaaattaacacaaccaggatattgacattgatacaatacacagatataactgagatagccccagttttacttataataatctgtgggtgtatctgtatttctttctgtgcaagttttcttccacgaataggtttgattctcaccaccacagtcaagacatagaacatttccatcaccaccaggctgcctcatctttgataaccacccccacctctctcaggtcacccttttcttccccattgactgttccctaacctctgacaaacgctggcctctataattttgtcactttaagagtgtaatataaagggaatcttatggcatgtaggtttttttttttttttttcagtcagtatgattccctaaaggcttatacaggttgttgtgtgtatcagttgttcctcttttttttctgataatcttccatggtttggatatacaatagttgtttttaaccatttaccaattgaaggccattatttcccccctcccactctttggtattaggactaaactgctctgaacattcctatactggtttttggataaatataagttttcatttgtctgtcatgaatgtcaagagcacaattgctgggtcttatggtactagcatgtttagttttataagaaactgccaaacatttttccagaaaggctttacatgtatgggtgatccagtttctccatatttatatttcttatctttcttttttctcttctttccttttttttttttcaattgagacagtctcgctctgtcatccaggctggagtgcagtggtgtgatctgggcttactgcaacctctacctcccaggttcaagcagttctcttgcctcagcctcccaagtagctgggattacaggcacccaccaccacacccggcaaatttttgtatttttagtagaaacggggtttcgccatgttggctaggctggtcttgaactcctgacctcaggggatccgcccacctcggcctcccaaagtgttgggattacaggtggagccactgctcccggcctatattgtggtctttctatcagtctttcttccttcctgatgctccaggatttctttcatcataccctttctgttttaacatttccttccctccctccctccctccctccctcccttcctctgtctctttcgttctttcgttcttcttttgtctcactctgtcatccaggctggagtgcagtggtgcaatcatggctcactgcagcctccatttcccgggctcaggtgaccctccctcagcctcctgactcagctaggactacaggtgcttgctatcactcctggctagtttttaaatttttttgtagaggtggggtctcatgttgtccaggctggtctcgaacttctgggctcaggcaatccacttgtctccgcctcccaaagtattgggattgtaggcatgagccactgcaccaggcctggagattttcctttaaccttttatatggataagtcggctagggacagatttttttagttttctttcgttcgagaaatgtctttaccttttttccagaaggatagttttacctcatgtagaatttatgattgagcattctttttttttcccaatagctgagaaaattatacttactgaaatgccaggaacaacagaaaccaacgtggaaaataactctcagacagtgtattacccagctttatcgggaaatacgagtgccccatatccagcctcttcatatcttcccatcacttctaattttggtgagtttgaaataatggatatcacaagcaggcctctcatctagattcatcaacattcttaatattaattcttagtggtagctttttacaaattaaacttttcatattgaggtagttcagaaatcatacacaggtataagaaagaagacagaaaaatcctgactaccctttacctaatttcccccaataattatatttagcaaaaaacaacaaatattacaaccagcatattcacatttatacaagccacagatcttatagagatgtcccattttacttgtatttatttgtgtgtgtgtgtgtgtgtgtgtgtgtgtgtgtgtttagtactatgcagctttattccacaagtaggtttgtgtgcccaccaccacagtcaaggtagagatcatttccatcagcatgaggcactgttgtgttacctttgataaccacaccaactctctcaggtcacccttccctaacactccatgacccatccctaacacctggcttccactgatctcttctttatctctgtaattttatctctttcaattgttgtataagtggaatcatatttggaattggattttttttcactcagcttagagactcgtccaggttgttttttctattaatagtttattcctattgctgaatagtattgcatgtctggatatactatgttttcttcaaccattcacctgctgaaggacgtctggtgggttttttgtgtttttattttatttttattttttgtctattgggtgtaaagccgctatgaattgtcatgtacacatttttgtataaatgtaagttttcatttctcagtagtttctttctttctattgatgaatagttccttcctttccatggtacagataggaacagtttttttttttttaaaccattcacctattgaaggacatctggttttttctttcaatttttggataatgcaagtaaagccactttgaacattcatgtactgtgtactggtttttgggaaaatataagttttcatttctctgtcatgaatgccaagagaacaattgctgagtcttatggtactagcatgtttagttttataagaaactgccaaacagtttcctagagaggctgtactattgtttatttccaacagcaatgtatgagtgatccaatttctccacatctgtatttctgatctttccatcattctttcttccttcctgatactccaagatttcttctcttatagtatcttttctgtttgaaggttttcgtatagccatttttttaagggtaaatctgcgagggacaaattcgtttaattttccattttgtgaggatgtttttattttcccttctttcctgagggacaatttcacccagtataaaattcatagttgagagttcttttctttcagtacttgaaagagttgcagaaatgccagaaacagcaggaactaacgtaaaaaacaatactcagacagtgaattacccaccttcatcaggaaggggccgtagccaaggtaacgcctctttatcgctctccattcctcccaagtttggtgagtttgaaatgatacatgttattagtagcactgtctaatctacatccatcaacgtccttaatgtaaaactagtggtaggtttttttaaactaaacttttaattttgtggtcatttaagatatataggtagttgtaagaaataatgcagagaaataccccttccactttacctattcttcccaacaatagcatcttgcaaaactgtaacagaacatcacaaccagaatattgacatcgatattatccacacatcttattgagatctcccacttaattgtattaatttgtttgtgtgcatttagttctacctagttttgtcacgagtaggtttgattcccaccaccatgaccaagatacacatttccatgattaccaagatgtctcattttactctttttcttttcttttcttttcttttcttttctttttgtgagacagagtctcaaaaatctctgtctgtcgcccaggctggagtgcagtggcgcagtcttggctcacagcaacctccacctcttgggttcaagcgattctcgtgcctcagcctcctaagtagctgggattacaggcatgtgacaccacgccgagctaatttttgtattttttggtagagatggggtttcactgtgttgggcaggctggtcttgaactcctggcctcaagtgatctgcccacttcggcctcccaaagtgctgggattacaggcatgagccactgcacccaactttggctgttttgttttttgttttttgtttttgtttttgtttttaattttggagtttttgtagagatggggtttcaccatgttggccaggctggcctccaactcctggcaccaagtgatccacctgccttggcctcctaaagtgctgggattacaggcatgagccaccacgcccggcccatcttgctctttaataaccacacctgcctcagcacataattccctgaacagtcatctgactgactggatgtatgagtggtccttaatttttattgtggacactattccatggtatggatgtttcacagttggcttattcattcacccattggaagatatcttggctgtttctagtttttgactattacaagtaaagttgcgatgaccactgatgtacagatttttgtataaacagaagttttgatttctcttggataaatgtccaagagtgcaaaggcttggttgtatagtaattgcatgtttagtgttataagaaactgccaaatagtattccagagagactgtatcattttacattctcgccaattatgtatgaatgatccggtttctccatatgcatatttcttcttctttcattgttttttcttcctttttgatgctccaagatttgctttttcatcattcttttctgtttgatgattttcctttagccgttctttaagtgtttgccagttagtgacaaatacttcagttttccctcatgtgagaatgtctttatcttccctatatttgaaggatacttttgcctgataatagaattcatgattgagatttattgtctttcaatatttgaaatattttatttatagaaacattgggaaaagcatgaaccagcccaggaaagaggtctgcaaaaacaaattacagacctttattagaaaacaacagtcaccagaatgtttcctcattatttcatagcgttccttgcaattttggtgagattgaaatgatacttgctatatgtagcactatttaatctagattcattagcatccgtagtgcaagatattggtagctttttccaattaaagtttttattttcagaaaaatttagctacacatgcagttataataaataatacagagaaatatgtgtttccattaccacttttcccaacagtaacatcttgcaaaactataagaaattatcacaaacagggtgttgacgtgataccttctacagatattattgagatgtccccagttttacttgtatttatttgtgtgcatgtgtatgtgtgtgttttagttcaatttttatcatatgtttaggttcatgtatcctctaccacaggcaagcccccaaatggttccttcttttttattgctgagtgctattccatggtgtagatgtaccgtggtttgtttatcttttcaggcattgaaagacatctaggttgtttcctggttttggctattagaagtaaagctgctatgaacactcatataccatataggctttgtgtgaacacaagctttcatttctctgagatactgcccaagagtgctgttgctgggtcctatggtaatggtatgtttagttttataaaatactgccaagttgttttccagagtgtctgtaccattttctaccccgaccagcaacatgtgagtgacctagtttctccacgcccatatttctgctctttctgttgttctttcttccttcgtgacggtgcaagattccttccttcatcatatcctttcagtttgaagatctcctttagttgttctttaagggtaagtcagccagtcaccgttttttaaagtttttctttgtctgagaatgtctttatttttcttttattcctgaaggatagtttcacctgatctaaaaaacatggttgagatttcttgtctttcagcactgcaaaatgttttacatattgaaatgttgttcaaaacagaatctggcccacaaatgagttatgggacaatgagttactcaactgaaatgaaaaataactgtgaccaagatgatgcttcagcatctgcctgcctcactcccgattttggtgagtttgaaatgatatatgttacaagtagcactctttaatctagattgaaagaatacagagagatcttgtgtacctttacccagtttcccccaatagtactattttacaaaaatatagtaaaatatcacaactaggattttgacattgatgcaatcaccagatctactcagatgtcctctgcttttcatgtattcatttgtgtgtgagtgtgtgtgtgtgtgtgtgtgtgtgagagagagagagagagagagagagagtatatttagttgtctggaattttatgacatctactttcagtcataaataaacctaactgtatctagtcatgatacagactgtcccatgacttccaggaactctcttactgactttttataaccatatctactccttcatgtcattccctgcctggcctcatctttattccatacaactactagtatgttctccctttttataattttgtcattgtaagaatggactgatataccattggactgataaatggactgatataccatttaaccttttgagattgctttttttccacatagcataattccctggagatttatacaagtttttgtgtatatcagaaattccttcctgtttattgctgagtactatttcatggtatggatttatcatggtttgtcacccactgaaggacatctagattgttgtttttggctattacaaataaagcagctatgacaaccagagtacaggtttttgtgtgaacataacgtttttcatttttctgtgataaatgccgaagagtgcaattaactgctgggtggtatattaattgcatgtgtagttttataagaaaccgtcaactatttccagagtggctgtgccattttacattcccatcagcagtgtatgagtgattcagtttctctgcgttcttaccagcattttgtatgttcgcttttttttttttttgagatagagtctcggtctgtcacccaggctggagtgcagtggtgcaatctcggctcactgcaacctctgtctcctgggttcaagcgattctcctgcctcagcctcccgagtagctgggactacaggcatgtgccaccatgctcggctaattttttgtatttttttagtagagactgggtttcaccatgttagccaggatggtctcgatctcctgacctcatgatctgcccagcacttagccattctgataggtatatggtaatatttcattgagggtttaatatgcattggcctttcgaaatgatgtatggctcttcatgtgctaattttctatctgcatatcctctttgaaatatctattcttgtcttatagtaatgtttgcttttttatgcttacattttgagagttacttaattgaaatgatcatacaatttttgtccttcattctgttcatatgacatatcacattgattaatttgtgtatgttgaaccatccttgaatccctgggataaatcccacttggtcatgatgaatgctcgttttgagacagtctctgtcacccagactgtagtgcagtggcatgatcatggctcactgctgcctcgaccccctcaggctcaaaagatcctcccaactcagcctcccaagtagctgggactacagggatggacaaccatgcctggctaatttttaaattttttttgtagagacaaaatcttgttgtattgctcaggctggtctcaatctcctgggctcaagcagtcttcccgccttggcctcccaaagtactaggattgcaggcatgagaccccatggccatccatgaatgattttttttttttttttttgagatggattctctttctgtcgcccaggctggagtgcagtggcacaatcttggcccactgcaacctctgcctgccaggttcaggtaattcttctacctcagcctcctgagtagctgggactacaggcatgcgccaccatgcctggccaattttctgtatttttagtagagatggggtttcaccgtgctggccaggctggtctcgaactcctgacctcgtaatccacccgcctcggcctcccaaagtgctgggattacaggcgtgagccactgcacccggctgatctttttaatgtattgttgaattctatttcctagtattttgttgagggtttttgcatcagtatttatcagagatattggcctgtggttttctttttttgatgtgtctttgtctagctttggtatcagggtaatactgacctcgtataatgaattttgaagtattccttcctcctctatttttgggaatagtttgagtaggattggtattaattctttaaatatttggtagaattcagcagtgaagcctttgggtcttgagcttttctttactgggagaattctattatggcttcagtctcattacttgttatttatctgttcaggttttggattccttcacggttcaaacttggtaggtgttatgtgtctaggaatttatacatttcctctagattttccagtttgttggcatgcagttactcatggtagccactaatgatccctttgaatttctgcggtatcagttgtaatgtctcctttttaatctctggttttatttatttggattttgtctctttttctttttctttttttttattatactttaagttctagggtacatgtgcacaaccaacagacacatgaaaaaatgctcgtcatcactgtctctttttcttagttagtctggcttaaaggtttgccaattttatctgtcttttcagaaaagcaaccttttctttcatttcattttttgtattgttttcttcattttaaattcttttgcttctgctctgatctttattattattttcttctactaattctgggtatggtttgctcttccttccctagttctttaagatacatcattaggttatttatttgaagtttttcttcttttttgatgtaggcacttatagctataaatttctctcttactactgcttttgctctatcccataggttttggtatgttgtgtttccattaccatttgtttcaagatttttttttcaatttccctcttaatttcttcattgaccattcatttaccattgcccactgatcatttaagaacatattatttaattttcatgtatagtttcccaaattcctcattactgatttctggctttattccattgtagtcagagaagatgcttgaaattgaataattttcaattcttttgaatattttcagacttattttgtgacttaacatatggtcaatccttgagaatgattcttgtgctgagaagaaatattaataggtatttgcagaacagctgcagaatatacatttaatatatccgtgaaatgttcatatctattagacccatttggtctatagtacagattaaatctgatctttctttgttaatattctgtctgaatgatctgtccaatgctgaaagtgaggtgttgaagtctctggctattagtattgtggcctatctctctctttagctctaataatatttgctttatatatgtgggtacaccagtgttgggtgcatagagatttacaattgttatatccttttgctgaattgaccccttaatcattatgtgatggtctcctttgtctcttcttgcagttttttgtcttgaaatctattttgtttgatataagtacagctactcctactcttttttggtttccattggcatggaatatctttttccatccctttattttcagcgtatctttacaggtgaagtgtgcttcttgtacacaacagatcattgtttcttgcttttttatccattcagccactctatcttttgattggagagtttagtccatttacattcaattttttttattggtaagttgggactttttcctgcgattttgttatttgttctctggttgtttttcggtcttctcttccttccttctttccttccttcctgtcttccttttagtgaaggtaattttttctggtggcatgatttaatttcttgtttttgtgtgtgtgtgtccatcgtatctttttttttttttttccagacagggtcttgctctgttgcccaggcgggagtgcagtggtacgatcttggctcactgtacccttgacttcccaggctcaagcgatcttcccacctcagcctccaaagtagcttggactacaggcacgtgtccccatacccggaaaactttttgtattttttgtagtgatagggtttcgccatgtttcctaggctgaacttttcttgaactcctaggctcaagtgatcctcccacctcggcctcccaaagtgctggaattacaggcataaaccaccatgcccagccccattgtatgttgtttgctttgaggttaccatgaggtttgcaaatactgtcttataacccattattgtaaactaatgacaacttaacactgattgcacaaaccaaccaacaagcaaaaagaaaactaatgaaaactctacactttaacttaatttccctttttaactttttgtttctctttatgtcttattgtactatgtctttttttttttttttttttccgacggagtttccttcttttcacccaggctggagtgcaatggcgcaatctcggctcactgcaacctctgcctcctgggttcaagcaattctcctgccccagcctcctgagtagcagggattactggcacccgccaccacgcctggctactttttgtatttttagtggagtcggggtttcaccatgttggccaggctggtgtcaaactcctgacctcagatgctctgcctgcctcggcctcccaaaatgctgggattacaggtgtcaaccactgcacctggcctgtactgtctatgtcttgaaaagttgttgtagttattatttttgattgggtcatcatttagactttctacttaagagtattttatacagcacaattacagtgttataatactctgtgtgttgttattaccagtaagttttataccttcagatgatctgttattggtaattaatgtctttttctttcagattgaagaagtctctttagcatttcttatagcataggtctggtgttgatgaaatctgtcagcttttgtttgtctgggaaagtctttatttctccttcatgtttgaaggatattttcaccagatatactattctaggataaaatttttttccttcagcactttaaatatgtcatggaactctctcctggcctgcaagatttccactgaaaagtctgctgcccgtcgtattggaggtctttgtatgttgtttgtttcttttctcttactgcttttaggatccttttgtaatccttgccctttgagagtttgattattaaatgtcttgaggtagtcttctttgggtgaaatctgcttggtgttctataaccttgtacttggatattcttgctctaagtttggaaagttgtctgttattattattattattattattattattattattattattatttttgcgactgagtctcgctctgtcacctaggctggagtgcagtggcgtgatctcagctcactgcaacttccacctcccgggttcaagtgattctcgtgcctcagccttctaagtagctgggattataggcacgcgccaccatgcctggctaattttttgtattttttagtagaaatgggggttcgtcacgttgctcaggctggtcttgaactcctgagctcaggcagtctgcctgccttggccccccaaagtgttaggattgcaggcatgagccactgcacccagccaatctttctgaataaactttctaccccatctttctctcgatgtcctctttaaggccaataactcttagatttgccattttgaggctgttttctagatcttgtagacatgcttcattcttttttcttttgtcttttttgtattttcaaatagcctgtcttcaagctcactaattctttcttctgcttgatcagttctgctattaagagaccctgatgcattcttcagtatgtcaaccgcatttttcaactccagaatttctgcttgatactttttatttcaatctctttgttaaatttatctgatagaattatgaattccttctttgtgttatcttgaatttctttgagtttcctcaaaacatctattttgaaatctgtgttggaaaggtcagatatctctgtttctctgggattggtccctggtgccttatttcattcgtttggtgaggtcatgttttcctggatggagttgatgcttgtggatgttcgtctgtctgggcattgaagagttagatatttattgttgtctttgctgtctgggcttacttgtgccatccttcttggaaaggctttccaggtattcaaagggacttgggtgttgtgatctaagtttctggtcactgaagccatgtctgcatcaggggacaccccaagtccagtaatgcagtggctcttgaagacttgtagaggtgccgccttggtgatctaggttaagatccagaagaattctctggattaccaggcagagactcttgttctttttttgagacggagtctcattctgttgcccaggctggagtgcagtggtgtgatctctgctcactgcaatctccacctcccgggctcaagagattctcctgcctcagcctcccaagtagctgagattacaggtgtgcatcaccatgcccggctaatttttgtatttttagtagagatggggtttcatcatgttggccaggctggtctcgaactcctgacctcaggtgatctgcccgcctcagcctcccaaagtgctgggattacaggaatgagccactgcgcctgggctcttcccttacgtccccccaaacaaaggagtctctgtctatggtgagctgcatggagctggggaaggggtgacacaaacacccctgtggacaccaccactgggactgtgctgggtcagacctgaagccagcagagccctgagtcttgcccaaggctcgctgtaaccgctacctggctacagcgtgtgtttgctcaaggccctcagcctctacaatcagtaggtggtgaagccagccaggcttgtgtccttcccttcagggtggtgagttccccccagccttgggcaggtccagagatgccaatcagaaaccagggcctggagctggagacctcaggaatctacctggtgctctattctgctgagctggcacccaagccacaagacaaagtccttcccactcttccctcccgtttctacaagcagagaagtctctccttgtggccaccactgccgcaggcccacaatgggtacctccaggccaccactgctgttcactcagcttacggtgaatgctgccaggcctgggactcactcttcagggcagtgggctcccctctggcccagggcaggcccagaaatgccatctaagagccaaggcctggaatcagggaccccaagagcccactttgtaccctaccccactgtggccaagctgggacctaagctgattttggatttcttattaaggtgcttttttgtgtagatagttgttaaatttggtgttcttgagaacaatcagtggaggcttctatttagccatctagctccgaagctgtgtcctgtgtgttttaaaatttccttggagacttctttttgacgtgtggattatttaggagtttgctgtttaatttccaagtgtttatagatttttctcttgtctgttattgatttctagtttggttccactgtggtcagaaaatatactctatatgatttcaattcttttatatttattgaggttttttcctttggctcaggctgtggtctgtcttggtgaatggtccataggcatttgaaaaaaaatgtatattctgcttttattagatggaatgttctataatgaaaatcctgttggttggttgtgtgttactcaggtcttctctgtccttgctgatgttctgtctggttgttcttttttttttttttttttttttttggagacagagtctcgctctgtcacccaggctggagtgcaatggcatgatcttgcctcactgcaacccctgccttctgggttcaagtgattctcgcacctcagcctcctgagtagctggaactataggcgtgtactaccacgcctggctaatttttgtatttttagtagagacggggtttcaccatgttggccaggctggtctctaactcctgatctccagatgatctgcccatctcagcctcccaaagtgctgggattacaggcataagccccccgtgcccggcctctgtaaggttgtcctgtcagttgctgagaggtgggtgctgaggtcctcaatataattgtgggtttgtctattttgcctttctactctttcagtttttgctttatgtattttgagacacttttgattggtgtgaacatattgaggatcattatattttcctgggggttaacccttttattgttatgtagtgttcttatttgtctctggtaactttctttgctctgaagtctgtttattttatctgatatcaatatagccactctgctttcttttttttggattaatatttgcatggtgcattagtccattttcatactgctataaagaagtacctgagactgagaaatttatgaagaaacgatgtttaattgactcagagttccacagccttaacaggaagcatgactgggagatctcaggaaacttaaagtcatggcagaaggtgaaggggaagcaagcaccttcttcacatggtggcaggagagaccaaagggggaagtgccacacttttaaaccatcagatctcatgagaagtcactcactctcatgagaccagcaagggggaaatctgtgcacattatccagtcacctcccaccaggcccctcctccaatttgacatgaagtttaggcagggatacaaatccaaaccatatcacatggtatatatttttcattcttttacttttaatctacttatgttattgaatttgtagagtttctaataaagagcatatagttgggtcttgtttttcttttcatttacactacctggcaatcgagggtcttgttttttatctacttggtcaattgctgccacttaattggtatgtttagatcatttacatttaacgtaattattgatacagggtttaagtcttccattttattatttttctgtttatcttctgtttctcattctccttttctttttcttgccttcctgtgagttacttgaacattttaagtattccatcttgatttgtttgtttttgagtatattgatttgtgcagttttcctagtggttgctctgagtgttactgtatacgtatgtgacttatcactgcctgttggaatcagcattttaccatttggaatgaagtgttgaaactttaattccacttaggtttcgtttttctccccacctttaaatatcattgttataggtatcagatggtgttttcatttttgtttcagtcattccatatgatttagagaactcatgatggttttgtatcgcctttctttctgctctttctcttcttcatttttattgctgaatagtattctgtggtatggatttaccacagttcctttaaccattcacctcttgaaggacacttggattgttttcaggttttggctatcacaaataaagctgctaaggatactcatgtgaaggttttcatgtcaacatgagctctcatttctctgggataaatacctaagagtgaaatttccagcaatttcactcttaggtgcttaaccctaaaaaaacccctgcaattaattacctcattttaaattataataataattacaatgatagtaattgtaattacaaatgtagtaattgttttccagtgtggctgttccatttctccacatgcatctttctattctttcttcctttctgatgtgccactgttccttctatcatcataatctttctgtttgaagatcttcttttagccattctttaagagtaggtctccagcattttgggaggctgaggcaggcagatcacttgaggtcaggaattcaagaccagcctggccaacatggcgaaaccccatgtctattaaaaatagaaaaattagccaggtatggtggtgggtgcgtgtaattccagctactcggaaggctaaggcatgagaattgcttgaacccagtgggcagaggttgtagtaagccaagatcatgccattgcactccagcttgggcaacatagtctaaaaaaaaaagaaagaaagaaaaaaaaaaagagtaggtctgctggcaacaaatctttttagttttcttttgtctgagagtgtatttcccctctgtacctgaaaaacagttttgctggatatagaattgtcagttgagagttcttttctttcagcactgttacctctgaatattttggtaaaagtagacaccaacacggaaaacagcgtcaacacaatgaatcgctcaactttattggacagtgacagtggccaggattcttcctcatcatctgtctgtatccctcccaagtatggtgagtttgaaataacacacattataagtggcactatttgagctacattcttccacttccttgatgcaagacagtgaaagctctgtgtttcctattttgaggataggttttaggtgatattcagaaccatgactaacatttattgagtgcatattacgtgcaaggcactgtgctaaacaattaacatgcctcttcttcacttatacccataatgactccatggtgttggcacttttattatccccatccccaaggtcacagagctggtgagtaggacttgagctctgccccagctttctctgactttaaaactcatgtgtcttttttctttttgaagtggagtcttgctctattgcccaggctggagtgcagtggcatgatcttggctcactgcaacctccacctcccaggttcaagtgattcttctgccttagcctcccaagtagctggaattacaagcacacaccaccacacccagctagtttttgtatttttagtagagatggggtttggccattttggccaggctgttatcaaactcctagcctcaagtgatccatctgcctcggcctcccaaagtgctaggattacaggcatgagccaccgtaactggcctaaagctcatgtttcttaccagtccactgtactgcctgccaagccacagtggcagagatgaggggaccccaagctctgtggcttctaagggtaagccttccaaatattttatagtcagttcatttttgtctcaacttctaagcagcttatctcttattaatatcctagaacaaggatcaggaaaccttttctgtgaagggctagatagtattgtctgtcacaaatacccacctttgctgttgtaagataagagcagcctcagcccatagacgaatgaataggcgtggccatggccagcacacctttcacacacattggtggggggatgggccagtggactgcagtttgttgactcccttcctagaggagagcttattcctttaaactattttgttactcaaactagaagaaatttcaagaattgtggtctcggctgggcacggtggctcaggcttgttaatcccagcaatctgggaggctgaggtgggaaaatcgcttgagcccaagagtttgagaccagcatgggcaacatagcaaaaccccatctctacaaaaaatacaaaaaattagccaggcgtggtggcatgtgcctgtaatcccagctacttgggaggctgaggtgggaggatcacttgagcagcccggaagtttgaggctatagtgagccatgatcatgccactatactccagccaaaaaaaaaaaaaaaaaaaaaaacagaaacaaaagttgattctctgtactgaaatgggcactctgatacattgttagaaatatacattggtacaaactttctgaaagatagtttgtagagaaatccataaaaacatttatggcagttgactgtaatctcactttatctgaaagtataataaaaattacataaaaattttggtctagaatgtcctttacagaatgattgggaaaaattggaagcaaacaaacaaaaataaatgatgatagggaattaatcacttgacttctggtgtatccacagcatgtgaggcagtaaagcctaatggttgagggcatgagctctcatgtctgcctgcttgatttcaaatcccagctcttactaaccttatgaccttcagccactttcctaacctaaatactagtttattcagttgtgaagtgacaaaaataatagtgtctacttcatagaattgtgaggatcaaattggacaatgcatttaaagctcttaacacaatgcctgggatgtaagtacaacataaatgtcacttgtcaggaaaattatgatgacaggaatgcagattaaaaaaaaaagatgaaaacagagaaatgctcaaaatataatgttaactgaaaaagcaggatttaaactatacttaaagtatgatttcaattttgtcttttaaaaaaataaataggaaaaagaatggaagatattagtagaagattcatggtttagagcagttaactcataaacagacagattttaaaactggttctgtaactagcagtgtgaccttttcaaataacttatctcctttgggcctcagtctccttatttggaaataatggggtgggaataatggggtgggagtaatgatagagttgttagaatgatgaaactgagctagtgcacagatgtaaaatatttagcacatgcctgatatacaggaactactgataaatgctagctatttgaaaattttcttaatgatccccacccacgctttcaacattgtcttcagggaacatccacttgcccagtggaatggctctgagtgtactcttagagcgtgaaatggagcagtgggaactcagggcaacatgtttacatatgcacctgcagcctaacaatgacatgtgttcaagctaatgaacagagtagttcaatacagcaagctcaagaccagtagaagtgaagaatgttgacagtttggcagatggtggcaaagagacccatttaaggaagaggaagagataagcatagaaaaaaaattcacccaagtagaaattcatgaattagaaatcatttatctgcatttgccttatttgaagaaaaagaagaaataaatcagtgtaattctcttgtgtactttgagggtacccttgcatgacaaaaccaaggatgttcctttttctctttatttttaaaggctatcttggtgatccaaaaagaaatgtcagagtacttaaaatccatttgctggccgtacaaaatatggccaaacctaagcaagcagcctgctacttggttcgtattttgttctccaaggaaatcctgattagcagctcagtggatatccatttgaaagacagccaatccctcgacccgaacaaaatggctgcattgagaggtatgtgtacataaagtgataatggaatcttatttttaatcatcatttggtcatataatgaatgttattggcagttgaaggaataacaataagtctgtgtaaatcttaaaactattcatttttttcacctgtctgaccctgattttacaacttaataatatataattggtaacaatttccaaagaataaaacttgtccattgacttgaatggttgaataagacaagcctcatctactatagttgtttatggttagtactaagtcaattctttagccctgaaacttgctacaaaaaaaaaaaaaaaaaaaggaaaaagctccctctgccagaaggtggtggggtggggggcgggggggaataaaagacttgtcagtgctagtgactagcaacacagaaatagaattttatgattagttctttttagcctcctgccttcctgccttccagacatgtctattgagatcctagaactcatggatactaaggataccacaatgaataagtgtttctgcctatgaggagctcatagtctagaaagggacatgttgatggaaacagatacatcccagtccagtgtggtagtgttggggaagctcagagcagctgctttgagggagttggggaaggcttagctaaggacaggacatttgagctggattctgaaggactccttcagtaggtagaaggaacaggaggatgttctaggcagagggaagagctggggaagatagacaggatgagtgagcccctggtgtaatcatgtttgcagtaacactattttctcttgatatgtttccttttagttctgatttatccattgggttattaaatggtctgagcaccctgaaatagtcaacattgggttacacacttaaaattttttttttcagacgcatggtcttgctctgtcacccaggctggagtgcagtggtttgatcatagctcggtgcagcctcgaactcctgggctcaagcaacccttcctccccagcctcctgagtagctaggcccacaggtgcatgccaccatacccagctaagttttgtattttttatagagatggggtctcactttgctgcccaagctgttctcaaactcctgatctcaagcgatcctcctgcctcgacctcccaaaacactggggttacagacatgagccactgtgcctggcctacacactttttttttttttttttttttgagcaccaagagctcaatattagcttcctacgtcagtgttttaggggatctcatggtaggggaaataattcagcaaagcatcctcattgggtggaatttctaaactctcagaaagaataagagaaaaggatgagaagtagaaagagaagaagtcaccagagtgctcaccattacacaatgtaaccatctaaaagtcagtgtttaaagaaaaaaatttttcattagtttgttaatttttttttctaattttcgtgaatactttctgctgtttgcagaatatctggcaacaacttttcccacctgtgatttgcatgaacatggaaaagactggcaggactgtatttctggtatcaattctatgatctactgtttatgttctgaaggcaagagtactccagtaagttatttttcatctaaatatggtaactgttacctgagtttgtactgtgtacagtttcagaactgatagcatgaggcacagtctctttaggccatgtgctaaaattctcattaacttagggggcatgggatgttctttcaaaagcacactgcatgtttattttacttttttgatatttatgctctataaaaatatcctaaagataaataaaataaagtgctataattagtatatttgaagccaaggataatactaggaaaatagtttcagctacaaagatatttggcaaatcttttgcagtatctcaccgagcaacacaaaaaggagccagctgtgtgctccttggctgtttcaatggtagctgaggaggtgcaggggaaaatgcaggcacttcgttacttgttcacttttagtgatgatggaacttggtgaaataaactcatgtcatgacgttaaacgattacagatattttacactccatatagttatgtggtaacagaaatctagtttctctttcctccagtctatcttcaaagtacattagagatttttgtttgttttaccacaaccgggccattagggaagagtgtcatatctgttgtcttctgatgaaacatgtatcttaatgacaattcctaatttccaccaacccccttttcttctggccacgtctagtcgctcctgtgtctctagagtaagtttatggaaacaatttgccaagaatatttgtagctgagcgtatgtttccctggtgaacgggttgatttcagtgatagctcaagcaccatctgcctgaaaccaaatctgcttatttttaacattccgttttatagccttcaaaaattgcaccctaaacaatttgaatgtaaaattaagacactgcctggaaaatggtaatttgcatatttgcttaggtgtcagaagagaagcagtgtctgccaagtgcctgctatgtgcttgactaggaatgggacaggtccttgccactcagagtaggtccacagcccagcagcagcagaccactggcaagcttgtgaaaaatgcagggtcttgattcagaggcaaaatttgcattttagcaagaccctccccaacccccgtccccaatgtgatttgtgtgcacactaaagttcaagaagcactaacccagagcagtggttgtcaaccctgggtgcatattagaatcacacgagacacttttaaaaatagttactaacgcctgagctccccactcccatcaccagagattctggctgaatttgcctagggtggggcccagcacaaccatttgtttttacagatcctgaaggtcattcaaatgggcagccagacttgagctccactagggaaaaagaatacaaacaaaacatgagaaacaaaaagtggtcatccccaagaaactcactgctttgtttatttgtgaaatgtttattatgtgcctaatttgtaccagcagttctcattgagttccttagacagagctacaaaatcctccaaggagcagcaggtcatgacagcttgcggaagaagccacccctttccttctttccagatagtattgcgacacacagtattcctatggcttcagcccaccttttaaagagtcagttgcttccctagcaacctggtgggcctggtaggtggtagagcacagacatattttcttgctgtgggactttgtttacggatatgattttgtgtttcaacagaaaactgttcgcaaaaataaaaaacgtaccaaccgtgttgcatcggcatctgcagatagaaatgaccaaaggggcagagatggtggtgaaggctgttcttggatgtttcagccaatgaataactccaaaatgagagaaaagaggaacttgcagccaaacagtaatgctatccctgaaggaatgcgagaaccttccactgataatccagaggaacctggtgaagcatggagtgagtttttttaaaaacttatatttaaataagttctcttgctgataaatgttgaatctgagtgatgcatttatggggttcattgtactattctctctacttttatgtgtgtttgagaaatttcatcagaaagtgaaataatttaatgtcttttattaatgagttaatgaaatatatagacacatggttctaagactgattgttatttttcctacggaaagtggctctttgctgactcactggactgtgtgagttctgataaggcactgtcctctgtggtgaaggggaggggctgcagctgagatgcacttcttgttctctgtgtgcctggcacattgcaggtgcgcagtaggatttttggcacgaattcgtgaatctcatctctcagaacattgtgctcccgctgctaaactgctgaaggcacctcctgctttgatgggtgtcaagtggcagtggttcagtagtgactgtgccacctgccacttgtgcttcccaatgcatcctcccagggcgctggactttagcatcacccataccgatgagtgatatctgaagtagcaagactttattctgtctgtaccctgctcccatgttaaccctaagtagaatactacctgggatccttttcaaacgaaattattgacatgatatagctttatttcttccattgtaaaagtaatctaactactgtatttgttaagattgtacactacagacacagactggataaattaaacaacacaagtcaccagttgaatacctcctgtattcaaagaagcaaagaactgagcgagcgtcaggcaggcaggagctagagcagccccaagactgtgagaacttgggccacatatctctaaccctgactcagctataacgaggggacagggcgactaagcccactgtgagccaagcagtcactgcagtgtgtgtggagtctgttatgccattttatttgaaaaattggaaaatatttttaagagggggaaaaaagctcccacaatcaaaatactttaaaaaactattgtgggcattttcattttccttcagtttttttttcctgtgaacattttgaaacattatgattcccatataattactctccttctctaatattataatatgtatctatttttcctcaagaatctacaatcttcataatcattgctcttaataggattatagcattccattaattaagtgcaccccaatttatttaattgcctcccactttgtttctttttgctgttgttgtcgttttggtttgagggttttttggaagggaattataaatcagtctgcaaaaaaaccatcttcattcagaagattttttttttttgagatggagtctcgctctgttacccaggctggagtgcaatggcacaatctcggctcactgcaacctccacctcccaagttcaagcgattctcctgcctcagcctcctgagtagctgggactacagatgtgtgccaccatgcccggctaatttttttgtatttttagtagagacagggtttcaccatgttggcctggctgatcttgaactcctgacctcaggtgatccacctgcctcagcctcccaaagtgctggattacaggtgtgagccactgcaccagcccattcagatagatttttccatactttggattattaggttaggttcttagaaattgaattaccaggttaaagagtattaacctttttttcctgacccttgataaatattactaggtaaatctcccagagttaagtctttggacccattaaatgtgtttctaaataatctctcctgctaaatgttgaatctggatgattcaacagtttttattgccacccattaaatgatggatgttctaagttgaagaatatacttactgacttataataattatatttttctagtatatttaacaaataattattatatgtaaaatataatatttttcaaatgtagttaattcgaatagactatggactgaagagagatgatgatgattaagctgtagagttgagaaatgaaaagtcttaaaacttatttttcatttcaaataagatatctaagatacaatatgtaaagtgaaccagcagtgtgttgatttaaaatgaatttaatactaaatagaaaacctacattttaaaaattataagtatttcaggaagaatcatggagcttatttttgaaaaagtccttcttgtaagtagggaaacaatgcattaaattacttagaatttgttactaaatgtaattttaaaacttcttgtatcctaaaaggtaacaaacagtatattaaatcttcctgttgaaccatggtagcatgtgtaatcacagtgatttctacctcatttctcatgctgtctcataatccactaaaaacgtaaggctttaggctgggcacgatggcttatacctgtaatcccaacactttgggaggccgaggcaggagggtcgtttaaacctggaagtttgagaccagcctggggaacaaagtgagaccctgtctctacaaaagatacaaaaaattagctgggtgtggtggggtgggcctatagtcccagctacttgagtggctaagctaagagcattactcaagccctgggaggctggggctgcagtgagccatgattgtgctactgcattccagcctaggagacaaagcaagactctgtctttaaaataaataaaaatgtaaggccttaaattttttaacctctcaaattcttgagcctaacaattgagaaaaatcaacgtttctgtttcagcttttaaaaaataatgcaatctaacatttgctatgaaaattgacatctttcttttttgcttctaggctattttggaagaccatggagaaatatacggatgccatgttcagtactgactttggcaaaaactaagtcttgcgcaagcctgtcggctagataccttattcagaaactcttcacaaaagatgtcctggtccaaagtaacgtctatggcaatctgaagcatggcctgtgtgcccttgaccccaataagattagtgctctccgaggtttgttacacatagagtatgtctg

SEQ ID NO: 3144 - DNA, 57952 bp, human; identical to SEQ ID NO: 3142

SEQ ID NO: 3145 - DNA, 49929 bp, human; identical to SEQ ID NO: 3143

SEQ ID NO: 3146 - DNA, 228046 bp, human
agggcggggccggaggtttcgattagttgtctctgccgctggggaaggtaaagcggcgacggcgtcctcaggagctgtggggtcccctgctagaagtgggggactcggcggggtgagtagtcgcgccgccacccgcccgccaagccttcttacccttacatcggccccgcgtccacccagcttctcctgagagtggagacccacccagtccccccgggcggacaagagaaggggcgggggcgccggttcccccggaacggggcgacgcggtgaggacgtcccagcccggagtagcccctcctcagcgctcccctgcgcctctggaagggcttcccccgaggggctggggctgtcttttggggtgtggggaggcgaaagggtgtgaaagaggggcggcgggtcgagcccgccccgcggggttcccctcagcggcgggtctgcggcgtccccgccccgccgctcccgcggcacgagctccccggggcttgcggcgaggtaagccccttcccgccggcgccgaggaggggcctgcgcgccccagccccctgcccgagttcggagggagcccgagactcgccaggggccgtcagtcgcggcccgggcccttctgaccttggctgcccgcgagggtgggctagcgaccgggcgccggccccgcggctccgcaacctcccccggacaagtttcaggcgatgctgtgaagttcacgactggcatagtgcggggaagaagaatggccccttctcagaccttcataccttttggaccctcatagaaatcggattctgggatttggaaccgtctcccagaacgaacaggtcctccttgcattgacacgttttgtgcccacgttggggaaaaaaataacctgaacatatttcagtgtaaaggcagatcttccttgagggttttgtttttcgcttcatttgagtgttaaagaacagatgcctgaataagaaaagcctgaccttagtatctctacagtgagattagacgggtgctgtgatatttaagtagttgcagatcagtattctgttagcacaatctattttaattggctggaatttaagctgattttagaaagtattgttgacaccgaatgatttctttctgtgcatctgaattaggtttgtttgaacgtaatggttatatagttaatgtaaaagattacacaaattaatttgtctgagagcgtttgtcagaaacaggagacagagatgtgtatagaacaggattatcgttttaggtaacatctgctggaacatttccagcttgtttctttcttgctgtagggttacaaaaaagacatcttcaccgaggctattcggaattacatgtgagtgacacttagatgtaaatttgtttttatttccttcaagtgttttaaaatgttttgttcacaaaatgtgaagaggctatatttacttgttcctgtatgttagtgttgaaggtgatagtatgatcttatgattaacaatccaattagggtccattaataatagatttttaaaaaaggcgtgctgcttttcgagaatatgataggttgagtacctagcaagacttctaatttctttttattaaaagtactattttaggattgagaatttttggcgttgacactgaaaccaggaataaggaagcctgcagcagtcttagcagtttgacaccaccagtaggtgtttctgttgacaaatgcagagaagagaacatttgggaaggaaatctttttttcggggcgggggttgggggggaggtgagggtggttgaggggggaaggagccagaagagagaagctaatgctgccagcactgtatgctgagcatttcacaagtacaaggaaacctaattagggaaaaattccgtttggctctattaaataatagaactacaaaagaggcatactaaataaagttaaccattccaagagtgttagatattatctgccatttcagagtagttgggggttcctcaattggagagggtatcaaatctctttgaattgtcttgcctttttaacatagtcaatgcagcgattaatttgctagatgtatatatatcaaacagttgagtattccagttttgttgtttagcatatttcctaagcctaaattttttaaaatcaaaatccgatatattttttttaaatttgaaatagaattctttgtccagagagtaattccttttttcctggctcagtcttaaaatttattcatgatttaggggtttgtgattggtatttttttacccctttttctcaggtttttgatttttacttatgcaagttccctaagtctgcctttgtttatattgtaattttcttggaattatttaaatcagagtgtggcatctattgtgtcccctggggttttaaaaggaaaggctcccattgaaagaaattgcagggccgtctcgcatagatgggtaatagaaggttgactgattgcgaatcagatgtattcggttgcaaatatgctgcttggggttaaggcagtttcagttaacgggaaccagattttacgtggtgtttctactttgaaggtacagtattgttacattacaaactgaaagacagaggtggagaaattcctttaagtatcacccctagccttgtttcaccactgtgtccaggaatctatgagagactgttaacaatagctgcattgttggaaatgacagtggcttctcttgcagaaagttaacctttcattatgattttcatttcagtttactttgtaaaagaaaatttagctttatctgagaaattggctgtaagaaatttgcaaagagagcaaggaaaataggttttcttcaacgtgtctgttaaaattcacattctctccccttccgttttgataactggtggtgatctttatttcctctagatattaggtatgctaacacagtacctgatttttggcagttactgtgggaatatgacttttttatgtaataaattgatgtcaaataataatatgaggcttttaggaataattaattcacatgcatagatctaaaacatgagggaaatcttttagatgacccttcactttggtacaagaatagcacaatttgaagtattaagttgctttctaagtagaaaaagctatttactcagaattgggtaattttagattttaaagttttttttttttttttgcaacatcaaataatttggcaacatcaaatttcttgttaaaggaggcgacagaatctcacagattctttatcatctgatcatggcatcagttggactacatttcaacttaggacaataatgcaattaaaagactacatttaaactttctgtttggaggtttttctaatttgctttcaatctcaagcccaatgttagaaatcttttgttggtgacgcacaattttagtgttcagattttaggttttgatcgtttttagaatttttttttatgtgtgtagagcagcgcatggatgactgaattaatcaaagatctggcctcatttctcattcaagtttgtacatttcttcacactgagatacgagcttgggtgcaattctgttggtgggcgtgaaagctgagggtaaggaccttctacctagagactgataacatttaaatatttcagatttgggaattaatagaaagttatttattaggttaaaaggaactagcccattcaggtatttgaaaatgattgtcaatactttgaattaagctcttagaaacattggggtttgagacaatcctaatcagggtcaggttttgggtgtggtctctcttttgggcagtcttctctgtaataattataatactccatctattgagccttactgcatgccagacactgtgacacgtaatttatttgcatgaatacatgtgtgttctcacaacagctctatgaagtaggtcttcttacctcctgtatacatgtcaaatgggctcagagaaataaagtactttgctcagattacccagctagtcatcagaaacagcaaaattgccatccaaactggtctgacttgaagccgtgctcttcaaaaccatgctttctgcttctctttaggaaactgatttcccaagcatatttatttttgacaccgggtctcactctgttgcccaggctgaagtgcagtggtgtgatcacagcttgctgcacccttaacttggcagactcagtggatcctcccatctcagcctcctagtagctggagactacaggcacgtgctcccataccaggccaatttttctttatttttaatagaggcggggtctcatgatgttgctcaggctggtcttgaactcctggcgtcaagcgatcctcctgctttggcctcccaaagtgcttggactacaggcatgagccaccgccaggcccaccccaagggtattttgagttcctactgtatattatgcctcgggtgtactgaaggtatatgtatgcttcttggagttcatgggctacattggcaaggctgctggacctttagtcacatgggggactgaactcagatccatcaggactgctagataggacaattggaagtgcagacttttctaaccagagggtcagacttttctaacagaggttctgtttcttcataaatgaaggctgtacataatcatgccaaaaatgaggtagttgtttctaattagctacttggtatttcatgtttctggatattgcattataacttttgatggactttgattacatttgctacactaataaaggcttcgaagatactccttgaattcaattttgtggcttagatatacccttgaagtaaaatggcagccattataatttgcagatgggcacctcttgtgtaattatgaccagtgaaataaaatctggaggtaaagtctatagagatatattattgtgtgtgcgtgtttttttgagatggagtctcgctctgttgcctaggctggagtgcaatggcgtgatctcggctcactgcaacctccgtctcctgggttcaaacgattctcctgcctcaacctcccaagtagctgggattacaggtgcatgccaccatgcccagctaatttttttgtattttagtagagacggagtttcaccgtgttgcccaggctggtctcgaactcctgagctcagacagtccccccgcttcagcctcccaaagtgctaggattacaggcatgagccactgcgcccaccgcttgttgtgtgctaatacagaggttggactctgaaaatttttctacatgaaagtagaactttctgctatttaaagcttcttgtgattaaaacaaattttctttacatttttaattttttttttcttttttttttgagatgagtcccccactctgttgcccaggctggagtgcagtgatgggatctcggctcgccgcaacctccgccccccaggttcaagtgattctcttgccttagcctcctgagtagctggaattacaggcgcctgccaccacgcctggctaatttttttgcatttttagtagagacggggtttcaccatgttggccaagtggtctcgaactcctgacctcaggtgatcttcctgcctcggcctcccaaagtgttgggactacaggcatgagccaccgcacctggcggtgatttttttttaaaacaagacccatcattaagagaactaaacagttatgtgccctaaggaacacttagaagtccatgttaggaaaaaagaaaacttaacatctttttctgtaatcgattaaaatcacttttgttacctatttaagttagaaagtgctgatgaatactgtagagcctcagggccagaaatatcttggccaaagcaggaccatatttctacacaggtgggacctgtgtgttaattttgttgatttcttttcttttttttttttttttgagacggagtctcgctctgttgctcaggctggagtgcagtggcgcggtctcggctcactgcaagctctgcctcccgggttcacgccattctcctacctcagcctctggagtagctgggactacaggcgcccgccaccatgcctagctaatttttttttttgtatttttagtagagacgggtttcaccatgttagccaggatggtctcgatctcctgacctcgtgatctgcccacctcggcctcccaaagagctgggattacaaaattttgttgatttctttataacgtaatggaggtgtactttacataccataaaactcacctttttagtgtatgattcaattatttttaagttaatttatggagttggtgtgactatcattacaatccagttttagaacatttccatcaccccccaaaattctctcctgtcaatgagttttttttaaccttatttacttgcttcacctagacctctcctttttttgagacagggtctcactctgttgcctaggctggagtgcagtggtgtgatctcacctcactgcaacctccacctcccaggctcgagcgatcctcccacctcagcctcttgagtagctggaactacaggcacatgccactgcacctggctaatttctttctttctttctttctttctttttttttttttttttgagatggaggctcgctctgtcacccaggctggagtgcagtggtgtgatcttggctcactgcaacctctgcctcctgggttcaagcgattctcctgcctcagcctcctgagtagctgggattacaggcatgtccaccatgcccggctaatttttgtgtttttaatagagacagggtttcaccatgttggccaggctggtcttgaacccctgacatcaggtgatctgcctgcctcagcctcccaaagtactaggattataggcatgagccatcatgcctggcccacctggctaatttttgtattattagtagagacaggatttcaccatgttggctaggctggtctcgatctcctgggctcaagcaatctgcccgcttcggcctcctaaagtgctaggattacaggtgtaagctaccgtgcctggccaacctagatctttttgtcatcagatactgacaaatgaaatcatgtagatcttaaaagatgtctttttttttttttttttttgagaccggatctcaactctgtcactcaggctagagtgcagtggtgtgatcacggctcactgcagtctccacctccccaggctcaagtgatcctcccacctcagcctcctgagtagctgggactacaggtgcaggctgccatgcctggctaatttttttgtattttgtagagatgggttctcacagttttgctcaggctggtcttgaactcctgagttccctactttggccattcccctactttggcctcccaaagtactgggattacaggcatgaaccactgtgcctggtctaaaagatgtccttaaaaaatatcttctggagaccaggcgtgggtggctcacgcctgtaatcccagcactttggcaggccgaggcgggcggatcatttgaggtcaggagtttgagaccagcctggccaacatggtgaaaccccatctctacaaaaaatacaaaaatcagctgagtgcagtggtgtgcacctgtaggcccaacctcctgggaggctgaggtgggaagatggcttgagcttgggaggcagaggttgcagtgagccaagatcgtatcactgcactccagcctgggcaacaggagtgaaaccctgtctcaaaaaaaaaaaagaaaagaaaagaaaaaaaatacacttctcggccgggcctggtggctcacgcctgtaatccctagcactttgggaggccgaggcaggcggatcacctgaggtcgggagttcgagaccagcctgaccaacatggagaagccatctctactaaaaatacaaaattagccgggcctggtggcgcatgcctataatcccagctactcgggagcctgaggcagaagaattgcttaaaccggggaggtggaggttgcggtgagccgagattgcatcattggactccagcctgagcaacaagagcgagactccgtttaaataaaaaaaaaaattttcacacacagtatcatttcataatgctttttgtattttcaaaagttcttgcctatgcataatacatagcggaatttaaaggatcataactgcaaatgatataaattaccttgtgtttgtggcttaaattttattttcatttgatcttttttaaaccagcaaataaaatacaacattcttggtgatatgttgggaatgcagggaaaataaatgaaggtaaaagtaatgtaattattgtgcaagaaaaagttactttcaaatgtaagagcacagggaaacaattggttttcttgattttaagctaatgacattgtgcattttgttgtttggacctctaatcccccttgacagatccatgcctaatgcgcgtgtcgtagagcaggcttcatcaaatttaggtatttagacactgtgtctacttcagactggattgtgatgggatttgcaaacagcttaacatgcaaggtactgtaactgccttttcctgcctgcatcattttcttcttagttaccttctagggtgggctgaggagtaaggccagcttaggaacgggaagtctcatcagcacaggctgatccccacttgtgcaggtttcctcctttgctcagtgtattgcttgggtagacggacactgcttagggatgttatttttttgggtacatataggagaggaatgtaatggtttggttagaagtaaagtgttttggaaaatgtatctaattttctttgcttttagatgaacatttctctatggaaagtgacccttatatgtaccaggcaggtaaatcaataactccttgtgtggttggttgtgtctggatttttaatggcaaacaggttagacacacggcactggtctgatattaatattttactgtcagttcaatcgtaactggtttgaaataggcataggtaacatgaagtgccagtgtaacttgattttgatagtaagaacaactttggtttctggaaattaacaaaacatatataaataatatatattgtttaaaaggattatgttattttaggtaagttgcaattttagatatcagttttaaactgtgtattttgtattatgggccaggcatggtggctcatgcctgtaatcccagcactttgggaggccaaggtgggcggatcccttgaggtcaggagttcgagaccagcctggacaacaaggtgaaaccctctctctacaaaaaatacaaaaattagctgagtgtggtggcacgcacctgtaatcccagctactcaggaggctgagtcgggagagtcccatgaacctgggaggcaggggttgcagtgagccaaggtcgcaccactgtactccagcctgggccacagagtgagactctatctcaaaaaggaagaaaaagattttgtattatgtttaaagattaggttcttggaagtatgagattgtattttgataattaaagtaaacatatacagtctcatgaggaagatatgacagataaaaaaaggtggtgagtaatagttgaagaacaacttactgacccggatttacctgattaccctgacattgctgattttagaaactaatttcctgatgagtagaatctttcaaagattaccagaggctgggtcagatgtgacatatcctagaatttatccacaccctcagacacacaccccaccaaggtttgtcagccgcttatgggatatattaactttaattgctagtaattattattcctaatattaccactaaattcaagtttagcaatgcaaatgaaaagaaaaaatttgattttaattgtacttactgaaaatagttggggtagacaaaagctaattttgtgcaaataattattttatactttatcaattatttatttctcaaataacctgtcctacatcctgaggatctgtccttcattcatttaacaaatattacttaatgattctgtattgtgtgccagactttgctggagactacatggagtgataaaatgtaagtaggccctgccctcaaaaaattaattaattaatttttgagacagaatctcactctgtctcccaggctggagtgcagtggtgcgatcttggctcactgccacctccgcctcttgggttcaagcgatttttgtgcttcagcctcccaagtagctgggactacaggtgcgtgcctccacacctggctaatttttgtattttcagtagagacggggtttcactatgttggccaggctgatttcgaactcctgacctcaagagatccacccaccttggcctcccaaagtgccatgattacaggtgtgagccggccaaagaatttagtcttgagatggaggcagaggagaactgcagaacactatgggagtgtacttgacccttgaacaaggtaggggttagggtgctgaccctcacgcagtcaaaaatccaagtataacttttgacccccccaaaaacttaactactaaaatggcctactgttgactggaagccttattggtaatataaatagtcaattaacacattgttttgtatgttatatgtattatgtagtatattcctacagtaaagtaagccagagaagaaaatgttattaaaatcataggaagagaaaagatacttactattcattaagaggaagtggatcattataaatgtgctcatcgtcttcacattgagtaggctgaggaggaagagggaggggttgtcttgctgtctcagcaggggcagaggtggaagaggtagagaaggtggaaggggaggcaggagagggaggcacactcagtgtaatttatattgaaaaaaaatctgggtataagtagatccatgcagttcaaacctgtgttgttcaagggtcaactgtatgtaacagggtagggttggagagtctgtccttgggggaagaggtgggaaggtcgctctgaggaagtaacatttaagtgagacccgaagaatgagaaggacctggtctagttggggaaataagttttccagacagaaggtgcaaatgtgatgaggcaaggtgagagagctggggtttttgcacaacagaaccttttaaagaactgaaagagggctgggcatggtggctcacacctgtaatcccagcactttgggaggctgaggcaggcagatcacttgagcccaggagtttgagaccagcctgggcaacatggcaaaaccccatttctacaaaaatgcaaaattagccaagtgtggtggtatgtgcctgtagtcccagctactcccagagagtaagctgggaggattgcttgagcccaggagctggaggctgcagtgagccgtgattatgccactgcactccagcctgggtgacagcgagactcttgactcaaaaaaaaaaaaaaaaaaaaaaaaagaactgaaagaaatctaaaacgaccagaaaatagagaaacaggcattgaagcacaagttggcagcaggggccaggtcttgaaaaggtttagtaggccattttgctgggtttttgaacttgtcctaaatctcctgggaaacggttgaagattttaaggaggggtgtgacatgaaatgaaatgctacaaaacccaagaattttagttcaatggaaccttggtaatttaccagaaaggtcataatctctgcaaagtaaaatattcttcccttgtttcattaaaatttttgtaactcctttcttgattgattgtcgtctgcggtactcctttcattgtttttgtagaaattccctttaattttctaaaggtaccttttcttttatccctcactgttctgttaaccttatataggaatgtcatttctatttataactgaattagaatattttttctaacagctttagctctcttccatatttaaacttaaaattctttgctgtttttttccctccagacacctttaatctgctcgaagtatttaatgttttaacgaaatgtttcattaagtttgctttattcttttgttcttccaaatacagtgtcttagatctagtttaatatttctcagcatttatgctatttcatgttttatgaaatcacatgtgagcacccagaatgtttttagaaaattttgttactattgtataggagcactactcttcatcaggagcaccattttcaaatctggttcacattctgtggccttatcttttacattaaattggtctctgttaaacattttatgttcaggtgggcttatgtatatataagtgctataaaggtgttattttttatatcctgatttgtttctttctccgacaataaatgcccctacatgctgaattctttttaggaaatctttgccatactaagtttgtgattgccttggtgattgtgtgagcattcattcaagtctttcttggtgtaaagttgttagctcatgcctgtaaagaatacttttgcccactgttcctctccacatatacgaagaataactgcagcatcacctctttcaaatagttccttggaaatctacatagtgattcaggcttgaattgagttcgcttttgccatgagttattttctttcttttctttttttttgagacggagtcttgttctcttgcccatgctggagtgcagtggcgcaatctcggctcactgcaacctccgcctcccgagttcaagcgattctcctgcctcagcctcccgagtagctgggattacaggcatgtgcccccacgcccggctaagttttgtatttttagtaaagacggggtttcaccatgttggccaggctggtctcaaactcctgacctcatgatctgcctgccttggcctcccacagtgctgggattgcaggcttgagccaccatgcctggcctgaagaggtacactcaacaggcacttaaggggactgggaaaggaaatgactcttgagtgcttgtgaagagtcttaaaggaagtccagaatgtcaggtgcaggtaaagggtttacaggcagagggtgcattaaaagacaaggatctggctggccgcggtggctcatgcctgtaattccagcactttgggaggccgaggcaggtggatcacgaggtcaggagttcaagaccagcctggccaacatggtgaaacccccgtctctactaaaaatacaaaaattagccgggcgtggtggtgtgtgtctgtagtcccagctactcaggaggctgaggcagtagaatctcttgaaccctggaggcggaggttgcagtgagccaagattgcaccactgccctccagcctgggcgacagagcgaacctccgtctcaaaaaaaaaaaaaaaaaaaagacaaggatctaaggatgggcatataaagctgggagaattgcaagaagtaatgtttatttatgtattacatgctttgctttgatgcttgtaccctagctatatcccaggatcttttctactgtaagctccgtggaggcaaggagtgttgactgttgtaccctcagtatgtggcacattgccttgcacataggaagtgctcaataaacacttcccttatcaaaggtgcccctttttgcccccccccccgccccccaccatttcctcatgtctgtatcttcttccttgtgcagtggtatatcaggtgcctatccagtggatcctcctctctgcttaccctatagttatgcctgtcctgtgtctagttacctgtgtaagatatgtaattgttataattggatccacactggtaaatgagtaggtgctaatagctctctgtggggctccagaatcttttctaccaacatttatggtatggcagatgaaggggaagccaaaggtgacaactaccagagtgacatatctgagctttttttcatgatttattgcatgaattcattgaaatgctgagttctattccataataggtgtgtgtgtgtgtgtgtgtgtgtgtgtatgtgtatctacattgtacaatacaggcatactttggagatagttttggttttagaccaccaccataaagcaaatattgccataaagcaagtcacacaaattttgtggttactgagtgcatataaaagctttgttggctgggcgtggtggctcacgctatatcccagcactttgggaggccaaggcaggcagatcaccagaggttgggagttcgagatcagcctggctaacatggtgaaaccccatctctactaaatatacaaaattagctgggtgtggtggctcccacctgtaatcccagctactcgggtggctgaggcaggagaatcgcttgaagccaggaggtggaggttgcagtgagctgggattgcatcactgcactccagtctgggcgacagagtgagatttggtctccaaaaaaaaaaaaaaaagctttgtttatactatactgtagtctattaagtgtgcaataacattatgtctaaaaaaaaaaagcacatactttaattaaaaataatttattgccaaaaaatgctagcaataatttgacccttcagtgacccataacctttttgctggtggtgggttttgccttagtattgatggtgactgactgatcaggatggtggttgctgaaggttgggggatctgtggcagtttcttaaaataggacagcaatgaagtttgccatatctgttgactgttcctttcattgtaggttcttctgtagcatacgatgctgtttgatagcgttttacccacattagaactatttctccaagcctgctgctgctttatcaactaagtttatagagtagtgtatttttgaaatagtcatttcaaaaatgtttaaggcatctttaccagtagatttcatctcagaaaaacagttcctttgttcttccataagcagcaactcctttgtccattcatgttttatcatgagatcacagcaattcagtcatatcttcaggctcctcttgccttggcctcccaaagtggtaggattgtaggtgtgaaccactgcacctggccatatcatttttttgtgtgtgttttgggtttttttagacggagttttgctcttgttgcccagactgtagcacaatggcactatcttggctcactgcaacctctgcctcccgggttcaagcaattctcctgcctcagcctcccaagtagctgagattacaggcatgtgccaccacacctaggtaattttgtatttttagtagagacggcgtttcactgtgttggtcaggctggtctcgaactcctgacctcaggtgatccacccacttcagcctccatataatctttgtgtctttaaatgggtatgtctttccttctgctaggccgttagtgctggtatttgagttaatctagttaggaattggtgtagccaagtccaaggttgtactactcaccaaatgacagccaataagttaagagacaaggtgttggcgcaaagaaagcaaccttatttggagagccagcaacctgagaagatggtggactagtaatgtccgaaagaaccatcttaatatgaattttcgcctccttttatgttagaggaagagggaagagggaggaggttgaggtcaagagatgactatgatgaccacagacatctaggtggcagtgagggtctgtggaggttgtgaaacttctttgtccttggtcaggtcacaatactataaatctttaacatggctgggcatggtggctcactcctgtaatcctagcactttgggaagccgagtcaggcagataacttgagtctaggagttcaagaccagcctgggcaacatggtgaaacaccgtctctatcaaaaatacaaaaattagctgggtgtggtggcacacacctgtagtcccgctactcaggaggctgaggtgggaggatcacctgagcccaggaggtcgaggctgcagtgagccatgattgcaccactgcactctagcctgggtgacagagtgagaccctgtctcaaaaaaaaaaatcattaacaacgttgttacttgtgtgtacactgcccctatctcttcaggggttttcagaagggactatttgctttaaactataaactgaatttctcccatagttagatggtttcactgggtggtggtgggggggcttagaagcaaaatgatgttagtcatgctaggcttccttttcactgttacattgggctggatttgagtttttttgtgttgttatggttaacctagtgtaccccagttttcaaattctcttagagatactttgtgatcagggtgggaattggtttaccagaacagtgtctgttccagtctaaatttcaggtctccccttcgaagtgtgctttagtgagggtctctttacatactcttgattttctcccgtccctttctcagtgatattctgctcttactgttcctggaagtttgtttgcttggaggtggggaggggtgataggatgtggtctctgttcttgattaagcctcagtttcaggcctgactctcaggatcttgccccttccctggctgttgtattgggctcaatgtggaatcctacccctctcccaggacttgggcccccacccctcctccctgctgctctgatttttcactattgtcttaagggtagaagtaaccattgtcctttctgtcacagtgaaggcttgtcttcctgagtggagataggggagagtgatctgagggtagtgtccagcctctcaggcttagctgctgcccacccccaggtttgcatcacaatgagcctacctcaggactctttagagctctgagtgagtggggtgggggagttggaggaggaagaccctacaggaagttgaggtatcatatcctcaatttctgtgacccccagtggtttcacactatcttttcagcaagccacattggatttcacgcatttactgactcttctacccgttctttttggtgtccagctgtactctccaacaggcgagcacatggtcgtctcctctctcccttcaggtactctccttagtttttgagccaactggttgctctgttggtttttttgttttgttttgttttgttttgttttgttttgttttgttttgaggcggagtttcgctctttcgcccaggctgaagtgctgtggcgcgatctcggctcactgcaagctccgcctcccgggttcacgccattctcctgcctcagcctcccgagtagctgggactacaggtgcccgcctccacgcccggctactttttttgtatttttggtagagacggggtttcaccatgttagccaggatgatctcaatctcttgacctcgtgatccgcccgcctcggcctcccaaagtgctgggattacaggtgtgagccaccgcgcctagcgctctgttgggtttaaagaaagtcttgaatttgaaattagttcagctctttttcattgtagttctcttattccagggtttaagccagaaatttggttactcttaaaattttaacatgagcgtttccttaagtctaagcttaattattattcctgtcctcctgaataagaccaagagtttggaatgatttactccttaaccgtcagcccctcttccatgttaatgttatttatgtgttagttttgccttatttaagccaccttacaccaataaaaatagtgaatatttactcatgtgcttttcaggtttctttgctcaccattcttccttcactccatttcttccttcttggttcagtttcttccttctttattaaaaaatgttcttaattatttcagtaagggccccttaatagtaaatttggttttggtgtttgtgaaagtgtctgtacttcactttttcccttgaatggttgttgagctgggtccagaattttgggttaattcctttccccgagtactttgatgttattctcttgtgttttgacaaatttgtaaattttttttaacttttaagtttggggctacatgtgaagttttgttacataggtaaacacatgtcacaggggtttgttgtacatattatttcatcatccaggtaataagcccagtacctagtagttatcttttctgctcctctccttcctctcacccttcccctcaggtagagggggatagttaatgttattcttttgtgttttgacagatttttaaattttgtttaacttttattttaggtttgggggtacacctgaaggtttgttacataggtaaacacatgtcttaggggtttgttgtacagattatttcatcacccaggtattaagcccagtacccaatagtcattttttctgctcctctccctcctcccatcctccaccctcaggtagtccccaatttctgttgtttccttgtgttcataagttcttatcatttagctcccgttaatttttagttttttggtctaggctggtctggaactcctggcttcaagtgatcctcctcagcctcccaaagatctgggattacaggtgtgaaccactgcacctggcctagttttatttgctaatgacaagtcaacagtcagtttagttgtaatttcgttgtaggtaagtaattctctctcctcttgagctacttttaagagcttttccttgtttatttatttattttttatttacagtacttttgagttgctgtttatttccttgtttttttgatcttcagggttttttttttttgcgatatctctaggtgtggatttgttttatgtatcctgcttttatttgatgtattccattagtctgaggacccctgatgtcttcagctgtgggagaaaatcttagccattatcttttaaaatagtttcgtctccattttccatttatggaaccattatttagatatgttttgggatttttcatcacatccttcgtgttgtttaatttacatttctatctcttctggctaatctcttgacatctatcatacgattcactaatttcctctttggctgtgcagttaatttgttaacttattgagggtttcactaaaaacatttggctatatatagtcaaatatataaatattgatatttatacaaatatacaaatatatatgtgtgtacaaacatatatatacatgttttaaagataggatcttgctgtgttgcccaggttggtgttgaactcttggtctcaagtgatcctcccaccttggtcccccaaagtgctgggatgtacaggcatgagccactgtgccccacctcgaatatattttcaaatttaagaatttctgttacattttctttcaaacctgtatttaaattttctttcaaatcagcttttaaattttcataagagcattttctttggacatttaaaaatatagttatgtttaagtcctctttggattattttcttagctgtaatttttgaggaatgaaatctcccatttggcttcccttcttccctccaagatttttgctgtttctccgtgtggtgtgcagtatttgacaatttaacgattgtttgcctatgcccgggttgtggaatgctcttttggtctagttttgcatttgtctctgatgggaccctttgggttcactgcgtctagagaggttttggtctattctcagatgggtctccagcacctggaaagtagtgtaaattttgactccatatttgtgtagaacagacttggggttttcccttctgtttgggtcactttttttttttttttttttgagacggagccttgctctgttgcctaggctggagtgcaatggcacgatctcagctcactgcatcctctggttcccgggttcaagtgattctcctgcctcagcctcttgagtagctgggattacaggcacacgccaccacgccctgctaatttttgtatttttagtagagacagggtttcaccatgttggtcaggctggtctcggactcctgacctcaagggatctgcccgcctcagcctcccaaagtgctgggattacaggcatgagccaccgcatccagcctgtttgggtcactttctctgcacagcgctgggctggtgcttgtagcttttctttttattttttcactcaaggacagtcctttatgtctttgtctttgtgctagtggttcacctccagcttctttcccatgcacaggcttcaggcaactgataatactttggctcagtatctccacccaaatctgatctcgaattgtaatccccacatgtcaaggggagggacttagtgggaagtgactggatcatgggggcggtttcccccgtgctgttcctgtgagttctcatgagatctgatgattttataaggggctcttcaccctttacactctgtgccctgctgccttgtggagaaggtgcctgcttccccttctgccatgattgttaagtttcctgaggcctccccagccatacggaactgggggtcaattcaacctttttcctttataaaataaattacccaatcttgggtagtatctttaaagcagtgtgagaatggactaatacaggaaacttctccagtttcctggtcctgtaatcatttgcatttgcagcccttgatttagagggcaggggtgagcaggtgtttatcatatgaagaatctcatttaatacgtttttctgtctttgcagccactcctttctattctattttcttcctgactgttgatcaggaagtagttctaccagttaagaacaagaaagtaggcttgtaatcccagcactttgggaggccgaggtgggcagatcacctgaggtcaggagtttgagaccagcctggccaacgtggtgaaaccccgtctctactaaaaatacaaaaaaaaaaaaaaaaaattagccagggatggtgggcgggcacctgtaatgggaggctgaggcaggagaatcgcttgaacctgggaggcagaggttgcagtccgtgagctgagaccacgccattgcactccagcctgggcaacaagaacaaaactctgtctcagaaaaaaaaaacaaaaaaacaaaaaaacaaaactgggaagtagttgtaaccacagacaacccccaccttgaacaggttatttaccaaaagttcttttggacattgattgtatagaacacagttcacattatctgataggaactatgttatttaaaaaatggatttgtttcccaggtgagcctgaggagtctgttctctcctttatgcagttgaaattcatatagacttgtgagttctttgggactgtaatcaatatacagtatgtgatttctgtgggaaggtataatacattttaacgttctcagtgaagaagggagtatgctgttttccaaccccagtcggtattccctggtgtgacctgccagctaccagaccccaacagttgttacaaactctagccactgttttcaaatctgccactaaatatcaccactcatactcagcacatgaccttgcctccacttcactgagaactttgagccatctggttgattttcttcacacttctaccagtttgtcatccctgcttctccagagttgccctctcctcctgtctcaggggatgagatgcttcttctgctgtttgaggcagtcctttgccaggagccttaggcttcactgctgcttctttggcagtcttttctcatcagttattccccttcattctccccattctgttcccagtggctgtccacttggggaggaggggtgaagattttgcctccaggagacatttggcagtgtctgcagacatttttggttgtcacaattggggggtggtggtgatgcatgtgctgctagcatctaacgggtagaggcgtgtagatatcctacaatgtacaggacagccccatgacaaaggattacctggtccacaatgtcagtagtgcctgggttgagtaatgttgctgcatcctcagggtctcacttttgactccttcgtttttctctgcccattatcttatgcctaagattctcatcctaggaaaccttccctgaaccacatgtccaatcctctcctagctacctaacttctccccttctcactgaaacttctgaaagagcgatttacacgtagtctctcattcactcttcaaattttagctgttgctttctggcttcccacccccaccgctgcttaaactgtttttgctgagaatgcctgtgacctcttgtgtgctgcatctagtggattcatttagtcctaattttacttgacatttttgttgcacctgacactgttaatcactatccccttgaaccaatgtattccattgtcatccttgttctccatgtccttctcttgtatttctttccctccctcctgtgtgggcttcttgatgatctacttactccttacacactgctgttacctggttttgacttcttagccaagaattatcataggtcattgtctccatgaagtaccttagttaccccaaggatttcagttgcacttatatacagatgtttttctaaatttctaaattctttttttttttctttttgagacagggtctcactctgtttccctggctggagtgcaatggcatgatcacagctcactgtatcctcaccctgtaaaaacggggtttctctgtgttgcccaggctggtctcagaactcctggtttaagcgatccaactgccttgacctcccaaagtactgggattacatgcatcagccaccatgcccggcttaaattcttccatgacttttcccctccaggctttagtgtctcttgtaatctgctggaaatctacacctgaatattctataggtaccttacgctcagcatgtctaatgtgaagtacatcttttcctcaaacttcgttttctgagatccacctgggctcccaagacagatagtggggtcttgtccagttcatatattatctacagttgccaatgtgatataaaatatgatttaggtcatatcacctacttgaaagtctgcactggtgctgtcttggtaacagaaagagaaagactgaattcccttattttgcccatcaggctctccttgatatagtctctgcccacccacctctccaacctcacatcatctctcttctgcctcatacgctatgctccggcacgtataggttcctatacaattttgtttcatacttgatgtctttactttttgtcttttgcctggaatgcagtatttttctattgaatatgtgggttgcttgccttctgagtggtgagattccccattcctcatggaagctacagttaattggcaccttgccccacttctgtggcctcaacattatgaggagtaaggatgtctgaattatttcagagagccagggcttggtaaatgctgcattagtcttgttgaaagaaggtagggaggggacattggcaagggtgtttcacagctcttcagttgtttctttcctcagtccctacttcctctattttattacctttcaggggttcttctggaaaaatgtatctttggagggagagcctcttttctttatttttttaaatttatttatttatttttgagacgaagtctcactctgttgcccaggctggagtgcagtggcacgatctcagctcactgcaacctctgcctcctgggttcaagcaattctctgcctcagcctcctgagtagctgggattacaggcgcccgccaccatgactggctaatttttttgtatttttagtagaggcaggatttcaccatcttggccaagctggtcttgaactcctgacctcatgacccacccgccttggcctcccaaagtgctgggattacaggcgtgagccactgcgcccggcctgagagcctgttttctttgggttttgccatctattttaacttgcttcagtgctccttggaattcctcactgatctatgtgctgagagcatctcctagattctcagggctgctctggattaattttttatttctttcgcttatttcactgagttttggtgtgggaggaaaggtaaatgtgtgtttggtcagccattttaaagtagagcttcagtgccctgtcttcgtgggtttcccccttttctctattgcagacatcatggccgagaatgtcttttaaagtgaatcattgtgtacacctttgatcattttattaagatactggccttatatcctgcccttcccccctgccgccccccagaatcactgggtggtgatggtagatgattcacatgggaatgtgctacacttgtgaaagatgtagaggaaatactgctgattctcctgaaggaaaagtctgttaatttttctctgttggccattctggccgcatggtttctccttattgtttttttgttggattttaaaaattactagtaagattgaacatttataagattcatttgttgcccatttatattttttcctgcattttcttttcatgttaataaaagttttttccccttaatacgattcccttaattctttttttttttttttggagacggaggctcactctgtctccaggctggagtgcagtggcgcaatcttggctcactgcaacctccacctcccatgttcaagcgattcccctgcctcggccttccgagtagctgggactaccggcgcatgccaccacgcgcagctaatttttgtatttttagtagagtcggggtttcaccatgttggccaggatggtctcgatctcttgacctcgtgatctgcccgcctcggcctcccaaagtgctgggattacaggcatgagccactgtgcccggtccccttaattcttttgaagtgaaataagcagatgctgccaaatgtaagatatggcccggtccccttaattcttttgaagtgaaataagcagatgctgccaaatgtaagatatgttgctcagtttttagtgtagatttattatgttctgattcttggaaaatgaaaatctactcctggttttttggttaatacatacctcatgcggtggctgtgaaaattaaactaaataacataggtgaagtgcccaacacagtacttggtacataataggcagcattaaatactagttcctgttattcattctttcttctttgccagattattaaaatgactacagtactccacaccttagacaaaaagttgtttttactgaacccttgttcgatgaaggacagtatgccaaataccttgagggatacagagatgttttaggctgcttcctgtccagggataaatattagcatactatatatatagttacattttgaggctttttttttgagacagagttttgctcttgttgcccaggctggagtgcaatggcgcagtcttggctcactgcaacctccgcctcctgggttcaagcaattctcctgcctcagcctcccaagtagctgcaattacaggcatccgccaccacgcccggtgttttcttgcatttttagtagagatggcgtttcaccatgttggccaggctagtctcaaactcctgacctcaggtgatccacttgcctcggcctcccaaagtgctgggattacaggtgtgagccactgtgcccggcctttttttttttttttaacatgctgttgtgaaaaccttttggtcttttaactgttactttatttgagcacagaacactttaaagtttggttgccacatttaatccatgacacctctgtgagagtagttattagttccattttatagatagggtccctgaagggtggcaggagtaaaaatagggtatattgggatgtagaagaatgctaaccattattgtttccaaccttggtaggtatagagtaaatacttgttgaatgaatgaatgttcttttataagttgtgtattaagcccatacctaaatcttatctctacttcttttcttttttatttttgagccggagttttgctcttgttgcccaggctagagtgcaatggcatgatctcggctcactgcaacctccatcttccgggttcaaacgattctcctgcctcaggctcccgagtagctgggattacaggcgcccgccaccacacaccgctaatttttgtatttttagtagaggcggggtttctccatgtttgtcaggctggtcttgaactcccgacctcaggtgattcacccgccttgcctcccaaagtgctgggtttataggcgtgagccaccacacccagccaatatctctacttcttatagttttattcaaccccttctatgtttaatttaattgattaatttttgtgagacagggtctcactctgttgcctgggctagagtgcagtggcatgatcttggctccctgcagccttgcctccctggttcaagcaattctccagcctcagcctcctgagtagctgggactacaggtgtgcgccaccatgtcctgctaatttttgtaatttttggtagagatggggttttgccatgttgcccaggctggtctcaaactcctgatctcaaaatgatccacttgcctcggcctcccacagtgctgggattacaggcctgagccaccatgcccggcccccttttatattttatctggcaaaaataagcattaatgtttagtggttgatagggaggacattggaagtcggaagagagataacccacactgttttatacataataaaaaggcattaagggaaggtatatgtgctgatactgatttaactttttgcccttgttctgattctttgcaagactacttttctggtttctgtaacaactgcaaagggcttcccaagtttggggctagggtaaatggctcaatttgttgcactctaaggatgattgtattaatagatttttcattctaatctctggtagagtacggaaaatcaattataattaggctcagactcaaggggaaaactttaggtagatgaatttcataatatacaaactttaatagaataagtgattactgtctcagagtttactctgtatttagctgtctgtagttggttgtcttagatagtgaaatatggtcttttagtaaaaatggtaagacccctgtataggatttgaagtaggacatctatgagcttatttcaggtagtaagtagtattaacacatcgctttcactctccacatggaacactgcattatttttttttattttttttgagacagagccttactctgtcacccaggctggagtgcagtggtgcaatcttggctcactgcaacctccgactcccgcattcaagcgattctcccacctcagcctcccaagtagctgggattacaggcacacgctaccacgcccggctaatttttgtatttttagtggagatggggttttgccatgttgcccaggcttaggtattctttttctgtgtttctcctcaagtgtatggttctctagtttgtgaattcactgggtggttgtgatgtccagtcagtaaaatgataaacatgaaagcactttgaaaatgatttaatgtcattgcatggaaatgttatagtatcattgcatcactatttataatagttctcaagtttttttttttttttttttttttttttttgagactgtgtctcgctctgtcacccaggctggagggcagtggcacaatcttggctcactgcaatctccacctcctgggttcaagtgattctcgtgcttcaacctccctagtagctgggattacaggcgtgcaccacgacgcctggctaatttttgtatttttttgtaaagatggggttttaccatgttggccaggctggtctcgaactcctgacctcgtgatccatccgcttcagcctcccaaagtgctgggattacaggcgtgggccactgggcctcaagtgtttttaaccacgtttgagtgccctcttctttttggtcacacaactttactgtaaccccactaattttttcagatgtagttcatatactatctcctgtataaaacataacctcttcagtctgaaaggggtactgtttcctttgaacatttatagctattttgatttgtacagttcatttggtcatcatgagtctgaattgtcacatcttgccttttgtcttgataagttaataatgtaggatcttaagatgtttatctcttagtgagaccagcaaacatttattaggacaataacacctattgtcctaatctctggacataaagtttttgtgtattaattccagtgttcacaactggattgtaaggtactttaaagaaaagaccatgatgtgtatgtacttcctggtttcatgaatgttttctttatatataataaaatgtagcagtgggtaagattagtggatgtatcattaatgttaaaattgagttttaacattttcctttttagaaccagtctagcacttctctggggtaactgaatttttgttaaaattggtccatatatatttcctgtcttttttagtttgtttcacatactttgacttatttcctacttatttctcctccattaaggtataaattctctccttaaattgcttagccttggattttcacagattcttttgaaaaacctacgttttcataggcgtgttgtctttgtaagatctaactctgcagtgatttattgagctcgttttgttttacttattgagcatcaagattgaaagaggaaagtaatgtaattttcattatttataatgcatttggctttttaaagtgttttgaggttaaaaccaatagcagtctagcactagttgaaggtattttgaagaggtggttagtatccttggggctgttaatcaggaggtagcctttatgtagagacttgaaggaatagtgttagcagggtgttcttgtaggagctccccttattcgatggtttggagtccataattggaaaattaattttaaaaattggtaaagctctaagcaatcaaatacgaatgcacatataactattttgccataaagcatacttttctttcttctttctttttttttttgagatggagtcttgctctgtcgcccaggctggagtgcagtggtgtgatctcggctcactgcaacctccgcttcccaggttcaagggattcttgtgtgtcaacctcccgagtagctgggattacaggtgcctgccaccatgcctggctaatttttgtatctttagtagagacatggtttcactgcgttggccaggctggtttcaaactcctgacctcatgatctgcctgcctcggcctcccaaagtgctgggattacaggtgtgagccaccgtgcccagcctaaagcatacttttgattaccagtatttgtttgtttgtttgaggcggagtcttgctctgtctcccaggctggagcgcagtggcgtgatcttggctcactgcaatctctgcctcccaggttcaaacgattctcctgcctcagcctcccgagtagctgggattataggcgcacactaccatgctggctaatttttacatttttagtagagatgaggtttcaccattttggccaggctggtcttctactcctgacctcaaatgatccacctgcctcattatatcatttgaaaatgatataatgtcattgcatggaaatgatataatatcattgcatcactataatagttctcaagtgtattttttttttttttttttttgagaccatgtctcactctgtcacgcaggctggagggcagtggcatgatcttgggtcactgcaacctctgcctcagcctcccaaagtgctgggattagaggcatgagccaccatgcctagctcattgccactattttgacgtatgtctaggatctttctcagttgactgaagttcggtgtcatcttgtataatccatcctatgtgtgcagtaggttcagtttcgacgacttgaaagtagagcaataatttagataacctatgaaactagtgcagaataatagatttttatagttgtctcctgtcttttaacataatctaacccacatccgatttgacaggcacattttttaagtgactcatcacctttgttgaatcttgccaaagcatccaatgtaatttttacaaaattggcactttcttgtaattggtttgcacactatttaaatgaaaaacatgtaatgattgttaccagaggaattgacagttttgggtaagaaatgcaactgacttttggatacaaagcatccagcttaatataagggagcagaagtgtgaagttgaactagatagttaaccattagccaaaaacatttgtactgatggcaacagccagatctctgttttccagaggtaatgaggagtttgatgaggagtttggtaactgttaggttgaggactgttaagaggcctgctggaggccagtatggcacttcagtgcacagtgcaaacccgcttctgtaatgcattttatactttttaaaaattccatttcccatgaataacatgcttttttatgtaacagaagataatcgtaacaattatcatgtaacagaagataactgttatttggaatgcttggagaaaatcactgtttaagatttctgtaaagccttttcctgtccaagatttctgtaaagcctgtttctgtcattgcctgaaacatcattatgcagcacgtgactacctttattttagcacttctcatttggagttaaccctttcacctttactatgaggtcttcctctgaaaaacttttgtatacaacatctgatccacagttgatacccaacaaactgaatgaaacagaagttctggccacttaagtagatgtcacaacccaatctttttctttctttctttctttttttttttttgagacggagttttgctcttgtcacccaggctggagtgtggtggtgctcactgcaatctccgcctcccaggttcaagtgattctcctgccacagcctcctgagtagctgggattacaggtgcccaccaccacgcccagctaatttttgtatttttagtagagacggggtttcaccatgttagccaggctggtcgaactcctgacttcaggtggtccacccaccttggccacccaaagagctgggatttcaggcgtgagccaccgcgcccgcccgtcacaacccaaccttccgtcacaacccaatcttgatgtggtgtagttttcattgatgtgctactgaaaaataagctgttattatttataaactcagttcagagaatattttaggataattatactcagttgagtatattatattccatatgtcaaagatgctgtgctatgtctacagagttctgagcttaataatacatagttcttgtctgtggacatgtatattgttggtacagtgggaatatatgaggaggagagattaattcaagcctgaaggaatttgagaggatttgagagtagataggacctgaactggacttggaatggtaacaataattaggattttttggcagatattttactgctttatggcattggatagtctggatctccttcaaattcttttcccttcttttctgtcaaatacacctagtcttcctacttccatctctagccttcttcctctgcaataatctttattttccttaacaatctattgcttttggccattttcctcttctttcttgcccttggtgtaatgcgttattgttttaaccctaaccctgtgcttctggaaatatgcttttctatcttctacatagccacaacacttcatcagtatccttcttagagcatttatcgtttctttgcactatagttacatacagactccatcctctgctggaccttaacttcttgagggcaagttgcacctttatagttcttaaagtatctagtatatagttttctaagtagtaggcaccacatactattctcttacatttagcttctttcctcaaactcaactcctcttctagacttgcctttttctgtgcatagtactagagttctttcaattccccattctggtcagtgagttctgcttctgtctttgaaatgttatttgtagccccaccattttttccactgtcgtcattgcatgccaattaaaagataaatatttagtgcatattgttctaagcactgtgtaggtgctaggaatacaaatataacagatccaattccttgttcttagaatcctagtcggggattattttggtactttgttgagcaaatgtttattgaacactttctctgtgcggagctctattgtaggcatagatgtattatatcattttccacaggctgctcatcttcaaggggaaaacatggctactggatttcctctgttctaaggtacacttttcttcccattttcttctagcatctctgaaatccagatgcgtctaaaccctggtatgtttaatgtttttttgtttgtttgtttgtttttttttgactgagtctcgctctgttgcccaggctggagtgcagtggtgtgatctcggctcactgcaacctctgcctcctgggttcaagcaattctcctgcctcagcctccttagtagctgggattacaggtgcatgctgccatgcccagctaatttttatatttttaatagagatggggtttcaccatgttggttgggctggtctcgaactcctgacctcgtgattgacctgcctgggcctcccaaagtgctgggattgtagacgtgagccaccatgcccggctttttttttttttttttttttttttgagatggagtttcactcttgttgcccagagtggagtgcaatggtgcgatctcgactcactggaacctccgcctcctgggttcaagagattctcctgcctcagcctcccgagtagctgggattacaggcatgcgccaccatgcctggctaatatttttgtatttttagtagagacagggtttcaccatgttggccaggctggtctcaaactcctgacctcaggtgatccacctgcctcagcctcccaaagtgctgggattacaggcgtgagccaccgcacccagcctgcttaatgttttttattcccccttcaagagctgttaaagtgatgctgcttacaactagtagttgtaactatagtataatttctaattactatactgtatactatagttgaactatagtatatattaatggtaaatatgatggacatgtgtagaattgtgctgtcaaatgtggtagcttctagctacatgtggctatgtaaatatgttaattagacattaaatttattaaattttaattaaaactaaaagattaacttgaacccaggagtttgagaccagcttgggcaacatggtgaaactctgtgtctacaaaaaatccccccccaccccaaaatcagctgggtgtggtggcacatgcctgtagttccagctactgtgggagttatggtggaggtggggctgaggatcatttgggaacgggacatcgaggctgcaatgagctgtgcattattgcaccgctgcattccagcctaggcgacagagcgagaccctgtctcaaaaaaaaaaagaaaaagaaaataaaggttcagttcctcagttgcactggccacagttcagatacccaatagccacatttgactagtggctactgtattagacagtgcagatatagaacattcccatcattgcagagtgttctgttaggtagcactggtctagaatgtggttccacagttgtacctggagggttggaaaagctttggttagtttacttcctggcattattattacctgtatttccttccttcagggaggtcagggaacttttctgtcttttccttctgcctttagttttaccagggcctgggacagtaagtggtaggtacgcagaaataaaaaacaactggagcattaaatagtttagataaaaaggggaaaggctatacatgtgcataacaggaaatagcttagctggctttattcaacgtgtatcctggtgtacttttttaagagggtttttagaacaaatttcatcacattgaaaatttaagaacttttatctaggtttgtatcagttttgttgtcgtgctgctataaagaaatacctgaggccgagcaccatggctcatgcctataatcccagcactttgggaggctgaggcaggcggaccacctgaagtcaggagttcgagaccagcctggctaaaacatggcaaaaccccgtctctactaaaaatacaaaaaaaaattagccaggcatggtagtgggcgactgtaatcccagctactcgggaggctgaggcaggagaatctcttgaacctgggaggtggaggttgcagtgagccaagatcgcgccactgcactccggcctgggcgacagaacgagactgccttaaaaaacaaacaaacaaaaaagaagtacctgagactgggtaatttataaagaaaagaggtttaatatgttcatggatggttctgcaggctttacaggaggcatgactgcttctggggaggcctcaggaagctttctttctttttttttttttttttttttttttgagatggagtctcgttctgtcaccaggctggagtgcagtggtgtgatctcagctcactgcaacctgtgcctcccgggttcaagtgattctcctaccttagcctcctgagtagctgggactacaggtgcatgccaccacacccagctaattttttttttctttttccgagactgagttttgctcttgttgcccaggctggagtgcaatggcacgatctcggctcactgcaacctctgcctcctgggttcaagcgattctcccaccccagcctcccgagtagctgggattacaggtgtgcgccaccatgcctggctaattttgtatttttagtagagacagagtaattttcgtatttttagtagagatggggcttcaccatgttggccaggatggtctcgatctcttgacctcgtgatccgcccgcctcggccttccaaaatgttgagacaggcgtgagccaccgcactcggcctcaggaagctttcaatcatggcagaaagcaaaggggaagctggcaagtcttacatggctggaggaagcggggtgccgtaggggggaccgtactacacacttttaaacaaccaggtcttttgagaactcagtatcacgagaacagtacccaggtagatggtgttaaactattagaaactgcacccattgtctaatcatctcccaccaggccccgcctccaacattgaggattacaattgaacctgagatttgggtgaggacacagatccaaaccatatcaaggttctttttatttatttatttattatttatttattttttggagacagggtctcactctcttgcccaggctggggtgcaggggtgtgatctcagctcactgcagcctctatctatccaggttcaggtgatcctcccacctcagcctccagagtagctgggaccacacaggtgcattccaccatgcccagctaattttgtattttttgtagaagcggggttttgtcatgttgcccaggctagccttgaactcctgggctcaagtgatcctctcaccttggccttccaaagtgctgggattataggtgtgagccaccattcctggcttatctaggtttttatcccttattaagtgggattcaaggaggcccatcatgtcagaatgctgtgggttggcaggaggcatcacaatgaaattttccatgttcccaaatttgatattcacagtactacatataatttctcagggaagatagggttggacacgatggaaatattttggtgaaccattcgttcccttgggtttctttctcatttggggagtgtggtttacaatgattggagcaaaagtttcctgaatctttttcttgtttccattttattgcatggtaaaacacaatttatccactttcttgtcaatgagtatctagttagattcctgttttttggctaattcaaataaaactatgaatgtttttgtaccggtcttttggtgggcagttgctttcctttctcttgggtacatacctaggaaggagggaagttgctgggccacagcatggccagttttctaaaacagttgtagcaatttatgttgctttctttttgaaaggacaaaagattaaagtttgccattaggcatttttactgtccgagtatttccatcaagcctgtgtgagttaagtcattaattaccaaacatcacagacctttggggtcacttgcagataaatctgaaaatagtatagacctaccatatcattcaaaagaccttaaaagaatataaaaactaagcatcttatctctccctctattgtcaatcttgatttactttcaagacacacggtctttgaagaaacttgttcatgcctttgtaaatggattgtgttgagtactgcttcctgttgcttactgttatgggaatgagtgtactttgcctgtcagtgatattactagctactatttgagggcttgcagtgtgtaacagaataaaggacaatgcccttttgaaattctagttcagcataagtcagcaagtttcaaactgagttcttgatatttgcaaggttctgtgctaggcatctccatgtccaaagaccaatgagaatgaatctcctaacctcttgaccttgtctaatggggataggaggcacataccatgatacaagaccaactataattgtcactagaattggaaataaagtgctgccgggcttccatatcacagcatatcacattttatttgggttgcagagaggggaaggtatccttgtaaagtaagcttatccaacccgcggtctgtgggctgcatgtggcccaggatggctttgaatgtggcccagcacaaattcgtaaactttcttaagacatgagattttttttgcggtttttttttttttttcttttttagcttattggttatcgttagtgttagaatatttcctgtgtggcccaagacaattcttccaatgtggcccagggaagccaaaagattcgacacccctgctgtaaagcttcatggaagggttgtggtctaagaggtccaccttgaaaggatttcagtcgcagctgcaatatatgccaggtgaagggaattgcttgatggaatcatgtagcaggaacatatagtctataccaagtggttctcagagtgtggtccccagaccagcagcatcagcatcatctggaaacttgttagaaatgcaaactcttgggctccactccagacctactgattcagaaactcagaaatcccagaaacctgggttttaactagttctctaggtgattgtgatgtgttaaagtttgaaaaccattggtctagacttaattggtcagagaatagttgaagtaaggtttgagaagggaagttatgagaacaagaaggcaggggccttactgcagagaccttgattgagtactagggtgtgagtatatggggctggggaaccgttagggtgaaggaaaggacatccttggagtttactttaggaagagtgagccaacaaactttttttgtaagatgaattaaaactaaaagatactggaggccgggcgtggtggctcacgcctataatctcagcattttgggaggcctaggtgggcggatcacttgaggtcaggagttcgtgaccagcctggccaacatgatgaaaccccgtctctactaaaaatacaaaaattaaccaggcatggtggtgtgcgcctgtaatcccagctactcaggaggctgaggcaggagaatcgcttgaacccaggaggcggaggttgcagtgagccaagattgcgccactgcactccagcctgggtgacggagcaagactctgtctcaaaaataaaaaataaatgaaaaaaataaaagataccggaagctgggagtagcagccttggaaagtgaaaggagcaacacagctgggatgagtgagccttgacagctggctggtcaagtgtcaggaaagaggccacagcctcagaagcagctatggttctgaacctgggtgttgagaggatggtggtgcctttagaagcagtgcaggcagaagacgcaaaggccacatggtgcaggaaaatgggacaagggggaagaggatgttttctacaaataattgcttcttcccctgaatgtacaagtttagtgtaagaaattcaggtacttgaggggacagtgaagaagaatgcagaatcgcctcaaatcccactttacagagattagcaaaacattattctctttaaatattttgagtatacatttgtttctttaaactcagttttgtatgcatggaattatacaattccgtaacaaattttctcagacaaattgaatttgaatacgttagtgttccacacatgaatgatcagtgtgcgtttggaaattggtggattttatatttgggaaacagaatgtttatacaagcagctaattggtaaagattgcaatttcattatccatggtcataaaaacatcctgtccacattagttgttacagaggaaatctggggcaaaacagtttaagatgcttggtgtgctgttagtctggggagaagaactgcaactaagaagaaaaaagatgaaacatttgtggcttttattagaatagcaagtttattacggtgtcttacaagaactaattaatattgggcataaaatagtctcattacataggtcaataccaagttccaaagttctcctttaaaataggcagctagctcctagtgaattttatgagccacaagcaaagatgtggaatagtttgcccatttcttagttttgtgacatgtatgacagaatataccatcttcttaagtatggtgtgtgtgttttttttgtttttgtttttgttttttttttaaagaaattatgggcagaaacctttatatttcttcctacctgatttgaatgtgagttcacattttcccatacctatgagagagcactagatattttccagttactttacttattaccaatctgataggttaaaactgatttctcatttttgttttttttttaatttaattgattactattgcgatggaacagggtttttctttttcttctttttatttaaaatagagatgaggtctcactaagttgcccaggatggtctgtaactcctgaggtcaagtgatcctcccacctcagcttcctaaagtactagaattacagatgtgagccatcatgcctggccaggaacaaacagcttttattagataattgcatttcttttgtgaaaggactgttaatatctctttgtctgttttctctttgggtgtttatattatactgatttgtaagatgctaacatattaaggatattcagcttctgtctttctcttttttttattttaccacttttttaaatcaagaggtgtagatactcattggctttttaaactatgccacagtgaagcatggcaaacacttcataaggtataggagatattcagtgaattatcacaaagccaaaccttatgtaacttgacctaggtgatgacataaacattgcaaaaccccaaaagtcagtagtgtacctaaggctgggggtgaaaggtgaggtctaccccaggttcaggcaataacaaagtgcattttctttagggaatttaaaatcagtaaaattattgactaagagttggtctgctttttgttatcatgtgttggccatttaaaaaatgtcagtgtgtgtacatgtatatataatatctgctttgtggctgaactgttaactttctttttgacaaatagaagttcttaattttaatatagtccagtttatctgtcttttcctttatggtgggtgcttgctgtatccacaaagagatattcttctatattatatttaaggagcattattgttttgacttttatatttaggtctgtaatccacctgaagttagtatttatgtatggtgtaagttggaggttaagttgaattttgttttcccttatgaatagccaaatgacagtgtcatttgaaaagatctgatttgcagtgccaactgtcttgtacagcaagcatccctgtatgatctatttctgggccttctgttcattcttttcatctgtttgtctagtgactgagctttataatatgtcctaatccagagagaaagtctttttgttgtacttcttcaaggacgtcttgtttgccttggctatttgtatttatgtatacatttttaaatcttctgccgggcatggtggcttatgcctgtaatcccagcacttttgggaggccgaggtgggcggatcacttgaggtcagaagttcgagaccagcctggccaacatggtgaaaccccgtctctactaaaaatacaaaaaaaattagctggatatggtggcgggtgcctgtaatcccagctactcgggaggctgaggcaggagaatcccttgaatccgggaaggggaggttgcagtcagccgagattgtgccactgctctccagcctgggcgatagagtgagactctgtctcaaataaataaataaataaataaaatcagcctgtaaatttcgattaaaaatttgttaggattggttgggattgttttgggtctctagatcaatttggatagaattgacatctttacagtgttaaatttcaagaacatgggatatcccttcactttattaggtccctttaatttgtaaaagtattttttgtttgtttaatagctttctacatagaagattttccactttttatttctaggaatttgataatttttgatggtttcaggaatggtattaaaaattcatttcctagctttattgctggtgtatagaaatactgttggtttttgaacattaacttttgtatccctcagctttgataagctaattttttctgctagcttacttgtagattgttttggattttctattgtgtacaatctgtggaaaatgataggttttttggtcattcctagcactcatttttgtctagatttctacctgttctcagtgaagagatttgtctgaattatatataatcattattactggaagcagaaagtcttcctaaatgaaagataaaaactacaccccattctcatttctgaattatctttgaatttaaacccaaatctcaaaggtgcctcaatcccagtgaaagctaatagtattttttgagacagtgttataaatgttcctaatggatttataagcaaatcttatgaaatctttaaaatttaattttttttgagacagcttttaatgtgtatctcaaggacttaaaatatgaaaacttatcagtagtttaaaaaattcttccaagtagtgaagtcactagtgaagccataaggtgtctctgatgtgctcatttttcttttcctttttttgagacagggtcttgctttgtcatccaggttggagtgtggttgctcattgcaacctcagccttgagctcctgggctcaagagatcctcctgcctcagcctcccgagtagctgggactacaggcacccgccaccacgcccagataattttttgtatttttttgtagagacagggtttcgccatgttgcccaggctggtcttaagctcctgggcttaagcagtcctcccaccttggcctcccaaagtgctgggattacaggtgtgagccaccatgcctggctcatttcctagtccttgttcttatgagcctcctactggaagtaccccagggagctctccgcatttgcagagggcattggcttgcttgggtaatgctctgtggtgccaatagagatgcactgcaggaagaactctggaaacttcgttgggagagaagtggcatatgagcatcattgtgagcaagtgtcaggtaatgttttccagaggaaaataccaaattgactagttgtatgccagacacatctgacagtaataacagaggcatactctgaatatgaacctgtatagcatatgtacctgacagcagtaacttacttaagcataccccgagaatgaccctgaggtctaagaacaacttgtgttcatagggtaccgaactaaggaatccagcagtgaccaaccagcagattcattcattatctataaggaacatctgagcccccaggccagtcctgtggatcctgggctttgccggaagattgaggatctttgttttgggttaaatgaaggttgccaggtggaggttggtgggggagggtgctaagtcaaaatgttatataaactgcatgcttttttacaagtgggatcagttcttctttctagcctgctgccactggactggatggccctgcatgtaagttccctcaaaaaccctacatctttttcactagctctgggtctcttctttggcttttcaaacatggtgctgtccctattgaagttaataggggttcaggacaacattagtaatttgatgagttgcagctgagggatcagagtattgtcataggttgtcctgtagcattttcatgcatgctccttgtgaacttgaggagtctgtaagctgctgtagtcaaggaggtcaacaaatgctaagcagcctcagtaaagggattgcaacttaaaacagcccaccattgcaggttcatctccatgaaggaccagcaagagacagttacaatgagcaagggctctgttgactattttgggaattaagggagtgggcaagcaaaagctgtaattgtaattagtgttgtggaaggagaattatcccccacctttttttttgtctttcactgcggtttacatgtgataggtgtttgattaatgtcagttgtatatgtgaattgttatgaagactttagaaaactttagaaactaatgttaagtgatgattgaaatgtgctcagattaaaaaaataattttagtatcttcaaccagtctagctggttaaataattttattattcctgtagattaaaaaattttaaatatcaagtttagagaaaaatcttattctaattttggagtatgattatatttcaattcagtatgtagttttccaatttgaaaaaaatagctatagctataattataatcagcaaatgaatgggatctgagactgatttaagttaaaatttgtgaccttaaaggaattgattcacagtgttctggattcttttcagaatgtgcggatactgtaagtacaatttttcttcatagtaagtgtaaattaaatataaactctatagtaaactcaagcattctataagaagccacataacgtgctatttctttcttttcccagtggtgttttagtgaatcattagttgtatgtttctttcttgagttggagctgaagaaatccttcccactggaaatatgagttctataccattttgtgggtagggatccagcggtgggcctttagtaagcgtaagcactggcttttgcatttatacttgtttttatagaataacaccatcttgtaaaatgatttgttcccagagtttttctagatacggtaattttaaacacaccttatgaatgttcttttaaaataagttataaagtgaattattttgtaaaacaagagttcttttattagcatgaatatctcctaatcttccctcacccccagtactactagctacttctagggttgggttttcagatacaatcaattttcttagtcttacgtagtgctttggagattagtgctcagatctcgtattgaagtatggttcttactcatggcagataatttctgtcttttcacttttgagttgtttttatacccttgaatatagtaggctaactatagaatacctaatgtcacaatcatgaaagaaatagttggtaatttataaaagctgtacgaaaatgtatattagacttttatggtttttaaggtcaaaaagaaactgaagactctttagaaaaggtcacaaaaaatcattgaatagggctgggcgtggtggctaacgcctataattgcagcactttgggaggctgaggcgggcagatcattggaggtcaggagttacagaccagcctggccaacatggtgaaaccccgtgtctactaaaaatacaaaaattagccaggcgtggtggcacacacctgtagtcccagctacttgccaggctgaggtaggagaattgcttgaacctgggaggcagaggttgcagtgagctgagatgctgccactgcactccagcctgggcgacagagtgagactctgtctcaaaaaaaaaaaaaaaaaaaaaaaaaaatagcggggtgcagtggctcatgcctgtaatcccagcactttgggaggccgaggcgggtggatcacctgagttcgggagttcgagaccagcctgaccaacatggagaaaccccatctctactaaaaatgcaaaattagctgggcgtggtggtgcatgcctgtaatttcagctactcgggaggctgaggcaggagaatcgcttgaacccaggaggcggaggttgcaatgagccgagatcgtgccattgcactccagcctgggcaatgagagcaaaactctgtctcaaaaaaaaaaaaaaaaaatttcattgaatcagacctaccagtgtctagttcaggatttgaatgcttagtatatattcattccttttgggggaaaagatatttctaatgactacttcatatgttttgtgtttttataattttctagttagaattcacgggcttatttcaaagaagacttctttaaaattaccaatttttagtccatttgtcttttctcttagcaaatccccaaatgacaaattgattaaaagaacacttagaataaatactgtaagttgtattatttaatatgtatttttatgtgccacatgtagagaaatgattaaagacaaaagtaatgaagcagactttttaaagaatcacttgacagaaagcagagaacatttcttacatatagaagtaaatgggctgggtgtggtggctcacgcttgtaatcccagcactttgggaggccgatgcaggcggatcacctgaggtcaggagttaaagaccagcctggccaacatggtgaaatcctgtctctactaaaatacaaaaattagctgggcatgatggtgggtgcctgtaatcccagctacttgggaggctgagacgggagaagcgcttgaacccaggagatggtggttgcagtgagctgagatcgcacagctgcactccagcctgggtggctgagtgagactccgtctcaaaaaaaaaaagaagaaaagaaaaaaaaaaaaaagaagaaaagaaaaaaaaaaaaaagaagtaaatggatgaggtgaacctcattatcttaggaacattttagcttaatagtaacaggaaaatagctttcagaatgggtttaatcagaataattaaacccattctgtcagtactgctggattacagattaattgctgaattttgagtacattactgagaatttggtcagagaaatagaaccactgtgagtattatgggtaaggaacttatatggtaatcagactgtacacaattataagaggtgctggggatgggaatatctatctgaaaaaggaaagacctgaaaaaatcactaatagatcctcctgaggtactggtacaggttgataaatgagagcttactgggaaaattttaagaagccaaatgtgtacagtcaccaaagtaggcatgcagaaaggcttttttctggagagttctgtggaaggctgtttcctccgtgtagctgctgcctctgtgggtccacagccaagcatttgttgttgggtcttgctctactgttggtcagatcagaagaagagctggacacagaggggacaagaggagagcagggacaagctggaagctgccacacacctctgcatttgtcgtcaccctgtgtgaccttcatgaagatcttgtaagaatttggccatcttgaacttggtgtactgtgcaggaaagggaattctgggaaacacagttcccggcttgatcaagttcacaagagactgatccactacattgagcttctcattttgagcatctcaagtctttttttttatgtgtggttaaaaatttttattttttatttttattttttgtgggtacatagtaggtatatatatttatggggtacatgagatcttttgatacaggtatacaatgcataataatcatatcagggtaaatggagtattcattacctcaagcatttatcctttctttgtgttacaaacaatccagttatactcttttagttatttttaattttaatttagttttattaattttttttgagacagggtcttgttctgttgcccaggcgggagtgcagtggtgcaatcacagctcactgcagccttgacttccagggctcaagccatactcccacttcagcctcctgagtggctgggactacaggcttgcattgccacacccagctaatgtttgtaatttttgtagagacgaggtctccttatgttgtccaggctggtgccttaactcctcagctcaagcaatcccctaccttggtctcccaagcaatcccctaccttagctgggattacaggtatgatccactgtgcccagcctagttattttatttttatcttattttgtttcagtttatgtattttatttattttattttttattgtttttttgaggcggagtctcactctgccacccaggctggagtgcagtggcatgacctcagctcactgcaaccagctcttcccgggttgaagcaatcctccaggctcagcctcccaagtagctgggattacaggtgggcaccaccacgccttgctaatttttgcatttttagtagagacaggagtctcaccatgttggccaggctggtctcgatctcctgacctcaagtgatccacccactttggcctccgaaagttctgggattacaggcatgaggctctgtgcctggctgctgcctagttattttaaaatgtacaataaattattgttgactatagtcaccccgttgtgctatcaattattcattctgtctaactatatttttgaacccattcagtgtctcttttggtctcatctcatcagtagatgatagcaatgttaaaatactttgagcctcaagattttcatttcctgatggtatttactgaggaatttaaaatgctgtactttggatagcttttgttcttttacttattaacaccatggcctttccctagtgtattttaccatacagtgcatctgtatcttattttctgacttttctcattgttgttaaagttttacaatcccagtaaatgaattccaggccagataatatcatttcagttttggagaggaaaacgagtacaaactttaagtagaagtaacttttacatagtctttggtggatttaggttaaaaatacccaagcatgccataagacattgtgctgtccttctgaaacgataatattccactctagcaataatgaataaaaggggatgacctttttcaggagatctaaatttgtgtacttctaggctctttgaaatacagagcatcaaaattttgttggctaggttgatatattcagccagcaaaattaagtggtttgctgttctctgattctgcgacacatcgtttgtgttctgggtctataccttctgtcttctgcagtgcaagtataacatacatgctagatagtttctgatttttttttttttaaatgtggatatctgacggagtaggggattttagggcatgataagatatagaaaatgctgaaaatagttttcatttatttccttcctgcagtccataatggggtgttcatttgcctctttcccatttaatttttcctctctagggttggagaatctcttctaattttttttttttttttttgagacaggatcttgctctgtcacccaggctggagtgcagtggcgtgatctcggctcactgcaacctctgtctcctggatgcaagccactttcctgcctcagcctcctgagtagctgggactacaggcacatgccaccacgcctggctaatttttgtatttttagtagagagaggggggtttcacaatgttggacaggctgatctcgagctcctgacttgaagtgatccatccgcctcggcctcccaaagtgctggaattacaggtgtgagccactgtgcccggccctcttctaatttcttttaagagcattcactgataataactgaagtatcctggagagttacatgaacctcttagatgtagtcatagaatatttaatatattttgttggcttctagtatctgttcacttttagaatagtacagtattttttttttccagtaggtgctcgtcacccaggtaaacactacattttccagtctccgttaaagccaggtgtggtagaggattaaatcttgtccagtaggatatgaatgaagatgttaggtacatcttgggtgttttgcctaaaaggagtggagttttggcctccctgtcctccacttttcccccttctctgtggctgagatatggggaaattggtgagagttgagttagatatctcagactgtgatatggacagtgctggaaccacttacctggacttttacatgaaagataaaaatgaacttctctctcttttttttttttttttggagactcagtcttgctccatcacccaggctagagtgcagtggcgccgatttcggctcactgcaacctatgcctcccggattcaagcaattcttgtggcattttttaaagacctgggggtggggagaggggatggtgtatgaaaagtaggccatcaggggaacttcggttcttttttttttttttgagacggagttttgctcttgtcacagctcactgcaacctctgcctcctgggttcaagtgattctcctgcctcagcctcctgagtagctgggattacaggcacgtgccaccacaccagggtaatttttgtatttttggtagagatggggtttcactgtgttggccaggctggtctctaactcctgaccacagttgatccacccgcaccatcccaaagtgctaggatgacaggcctgagccaccgtgcctggccctgggaactttggtctaatgaaataaaatttctgcaaattaaagtgttcgtttttgttaccttgatagcattagtctagactttcttcatttttacaagaccgtgaggagattattcatggtatagtatggtatcagaaaaattgtaagggtatggtatgtgttgattatttccccgaaaaccatcctattttcatctctgttgcctctacctttattaaggtacataagtccccaagttttataagtccccaagtttctacctcctcggaaccattttccctcatcctcaacaatcctttctgatatagaagtttatcacttgtggtatgactgttctccttaaaaccttcaataatttctaatgcctgaggaccaaagtaaacacagtttataacaaacaataatcaaacacaccttgtagcaatcagtataacaatgcccttttacagcagattaaattattgaagtgacttgttcaaagtagcagaggaagataaaagcataagcgtgttttgctgtacagaattgtgaaaatggaatccccgttcctagggaccttaacttttagtagtggaaaagcaacttaggcaggcaaataattcagagatttggtattgtttagtccaaagttagtgtttgaatgaatataaggtagtgaatgaaatttggagaatctgttgttcaaacttttaaaaagttaaatagtattaccttaaatataggaacacattttctcattttgtattctttgaatttttatttattttaaactttgtaattattttttgttttttggtttttttttttttgagacagaggctcactctgttgcccaggctggagtgcagtggcaatctcagctcactgcaaccgctacctcctgggttcaagcaattctctcctgcctcagcctcctgagtagctaggattacaggcacgcaccaccacacctggctaatttttgtatttttagtagagacggggtttcaccatgttggccaggctggcctcaaactcctgacctcacgtgatccgcccaccttggcctcccaaagtgctgggattataggcgtgagccaccacacctggcttaaactttgtaatttttatttcttttcttttctttttttcttctttgtttttttgagacagtgtcttgctcagttgcccaggctggagtgtagtggcacaatcacggctcactgcatccttgaccttttgggcacaagcgatcctcccacctcagcctcctgagtagctgggaccacaggcatgcccaccatgcttggctaatttttaaaaatttttctgtagactcagggtctccctgtgtggtccaggctggcctcaaactcctgggctcaagccatcctcctgcctctgcttcccaaagttctgggattacaggcatgagccactgtacctggcctgaactttgtaattttgtaagaacattttaagaaaatgctaattggaaaattatcatctctactctttttcctgtcaaatattatatacatcatttataatttattttagccttctaatacttagtattaatacagtgagaactggtggtggtacttcagtgttccaaactcagtctactgcttttcttggaaaagatgatgaaaataactactttaatgtttgtggttattgctcttttctagtatctgaattttaaaaatacattgtatagagttatgtttactcatataacaaattttagattttgttcttacaatgtatttccaaaacaagtaacattactattcctatttcttagtaacttgtgtaactcaagatcagaaaatttatattgatcagaccttgaaatcagggttaagcattcacatttgaacaaaggataggtttcttgagtattttctctgtagttcattccttatgtatttcttactgtgctcatccaaattttctcatttctttggttcaactttcagtactttgtgagctctctcattaggtgcaatatgtttataatttttatcccttcctgttggattgactcttaatgtccttctttatctttttttaatttttgagatggggggtttcactgtgttgcccaggctggagtgcagtggtgtgatctcattgcactgcaaccttcgcctcctgggctcaggcagtcctcctgcctcagcctcccaagtagctaagatcataggcatgcaccacgatgcctggctacttttttgtatttttgatagagacaggttttcaccatgttgctcaggctggtctcgacctcctgggctcaagtgattcacctgccttggcctcccaaagtgctgggattacaggtgtcagccactatacccagcatccctctttacctttagtaattgatttttgattaccaattactgactattggttattgatagtgattattaataaagtccacattcagatttttttagttttttaccttatacttttaaaagtcttaacatctagtttgtttgattttaatatagccattccagctctcttatgcatttatatctttatcctttcaatttccacttatttatagctgaatgtaaaatacgcctcgcatagacaacatatagttgaatctttttttttttgagacggagtctcgctctgtcgccatgctggagtgcagtggtacaatctcagctcactgcaacctctgcctcccgggttcaagcgattctcctgctgccccagcctcctgagtagctgggactacaggcatgtgccaccacgcccagctaatttttgtatttttagtagagatggagtttcaccatgttggccaggatggtttcgatctcttgacctcgtgatccgtccaccctggcctcccaaagtgctgggattacaggcgtgagccactgcacctggccctgaatcttgttttttaattttaatttttattattattttttgagacggagtctcgctctgtcaccgaggctggagcacagtgttgtgagccggattcaagagattctcctgtgtcagcctcccgagtagctgagactgcaggcacgtgccaccacgcctggctaatttttgtatttttagtagagatggtgttttgccatgttggccaacctggtcttgaactcctgacttcaagtgatctgtccaccttggcctcccaaagtgctgggattacagacatgagccactgcacctggctgaatctttttaaaatccagtctgacaatctttgcattttgattggattgtttaatcctttcacatttaatatagttattgatatgtttggatttacatctattattttgctgtttgtttactgtatttttcattttgttgttttgtttttctgtttctcctttactgttttattttgtattaagggaagaatttcaagtgtaacattttaatttctttaatgatttttttttagtttttttggagttattttcttagtgttgctctaggacttaccacatacatgcttatcagaatctacttcagatgtatgctaacttaactccagtaagatatagaaaccgttccttccatgtagctctattctctcttcctttttgtgatgttattatacatgtcttatttatgttaaaacctgagatatgttgttaaaatgataactttatataatttcatattttaaagaagctgggagaataaaggagaggaagtatatatttgtagtttgttatattaactttcttatttaccatttctggtttccttaatttttgaagaaatttgagttaccatctggtatcatttccttactccagtatagctttgttcccacccacctcctttgtgctttagtggccctttaacaaaaattcgtgtggagtcatgttactgtctagtgtcacttgttttcagtatgtaaaacttcctttagtattttttgtaagttggatcttctagcaatgaattctctcaagttttcatttatctgggaatgtctttattttgccatcatttttgaaacatagttttgttggatatgaaattcttggttgacaagtttttttttttccttttctttcatcgctttgaatgtgtcatcttactgccttccagtctccatcgtttgtttcttttctttccttttttttttttttttttgagatggagtctcactcactttgtcgcccaggttggagtgcagtggtgctatgtcagctcactgcagcctctgcctcccgggttcaagtgattttcctgcctcagcctcccaagtagctgggataacaggcatgcaccaccacacctggctaatttttgtaatcttagtagagatggggtttcaccatgttggctaggctggtctcaaactcctgacctcaagtgatctgcccacctcggcctcccaaagtgttgggagtacaggtgtgagccaccgtgcctggccaatctccgttgtttctaatcagaaagtcagctattaattttattgaggattcttcttatgtgataagttgtttttctcttgttgctttctttttttttttttttcttaaatatatattttgttgttgttgttgtttttgagatggagtctggctctgttgcccaggctggagtgcagtggtgtcatcttggctcactgcaacctctccctctcgggttcaagtgattctcctgcctcagcctcccgagtagagtagctggggctacaggtgtgcaccaccatgccccgccaatttttgtatttttagtagagacggggtttcactatgttggccaggctggtcttgaactcctgacctcaagtgatctgcctgccttggcctcccaaagtgctggtattacaggcatgagccaccacacctggccttaaatgtattttttgatatagagatggggtcttgctgtgttgaccaggctggtcttgaactcctggcctgaagcaatcctcctatcttggcctcccaaagtgttaggattataggtgtaagacaccgtgcctggcctctcctgctgctttcaagactttctatgcctttcagcattttgactatgatgtttctgggtgtggatctctttgtgtttattgtatttggagtttgttgagtttcttggatatgtagttaaatgtttttcatcacatttgagaagttctcagccactatttctttttttttttttttttttttttgagatggagtctcacactctcgcccaggctggagtgcagtggcacgatctccgctcactgcaagctccgcctcccaagttcacgccattctcctgcgtcagcctccctagtagttgggactacaggcacccgccaccatgcctggctaattttttgtatttttagtagagacggggtttcactgtgttagccaggatggtctcgatctcttgaccttgtgttccgcccacctcggcctcccaaagtgctgggattacagacgtgagccaccacgcccggccagccactatttcttaagtatttttttctgttctttcttctcctctggtattcccattacatgtatgttgttgtgtattagtccaggctctccagagaaacaaccaaaaggggatgatgagatagatagatatgtttagtggtatcccatttttctctgaggttctgttcatttttcatttttttctgtgttcttcagattgcataatctctatcaatcagtcttcaagttcactgattcttctgccagctgaaatctattcatctcctctagtgagtttttaaaaataagcttcataatttagaataggttttggtttacagaaacattgcaaagatagtggagagtttccatgtaccccacatgtagttttccctattattaacatcttatattggtatgatacattcattctaattaataaaccatattgttagtgattattgattactgatattcaaagttcatactttattcaaatttcctgttttaatctaatgtctttttttttctgctctaggatctcatgtaggatatcacattacatttagttgtcatatcttcttagactcctcttggctgttacagattctcagactttctgtgtttttgatgaacagttttgagtaatactgcttaggtgttttgtggagtatccctcagttgggatttgtctgatgttttccttgtgattagactggtgttgcaggtttttgggaggaagaccacgtaagtaaagtgtcattttcatcacatcgtatcaaagggacatactatcaacatgcttatcactattgatgttaattaaccttgatcacctggctgaggcggtgtttgtcaggtttctgcattgtaaaactactctttttctccctttccataatgtcctctttggaagaaagttactatgtgcagcccacatttaaggactatggagttatgttccaccttattgaagatggggtatttacataaattatttagaattcttctgcacaggggatttgtcaactctgactctctcatttacttatttaaaaaatcattatggactcatggatttctttttaatactttggttaataatccaaatgtagtactactttattttgttgctaaaattgtccctgctttggctactgggggccccttcagttaactagtgtgatttgacatagcacacttcttcttccttcttcctttcttctttcttcttcttcctcttcctcttctttcttcctttttttttttttttttggagaggaagtctcgttctatcccctaggctggagtgcggtggcgtgatctccgctcactgcaacctccacctcctgggttcaagcgattctcctgtctcagcctcttgagtagcttggattacaggtgtgtgccaccacgcctggctaaatttttgtatttttaatagagatggggtttcaccatgttggccaggctggtctccaactcctgacctcagatgatccacccgcctcggcctcccaaagtgttgggatgacaggcgtgagccactgcgcctggccttcttttttctttctctctttctcctcctcctcctccttctctctctctctttttttttaaacctacttctttattttctggcactagaatatgctccaggctcatcttgtacatttttatgccccagtcctagtttcagccatttcaccaaagagtcctggtttctttctttctttctttctttctttctttctttctttctttctttcttttgaggcagggcgtcactctcacccaggctggagtgcagttgcatgatcgcggctcaccacagccttgacctcctaggctcaggtgatcctcccacctcagcctccagagtaactggggctacaggtgcgggccaccacacctggctaatttttgtattttttttttttttttgtagagaaggggttttaccatgttgcccaggctggtctcgaactcttgggctcaagtgatctgcccggcctgtctcccaaagtgctaggattacagacatgagccactgtgcccgactcctggtttatttttatcacagaatggtattagaaagcaggatctaggtgctaggtgggtgctaatgaatctttcattttggttatttactttcctattccagaatttccatttggttccattttcagtattctcagccttccttgcctggggtagaggtgctgccctataaatgaggctaggtggaggtagctctgcttgaccggaatagttcctgcaacatgaaacagaggctgcgaggggtggcaggggatgtgaaattctggtaacctactgctcctggggagaaactttcgtcttggctacactcactgggcatagagctgggggtgagggagagggaatgggcatgtaaggaagtgagtcctggttcaaatttttccaacttggtctttttaccaagattcagtagattttcttgactaaatattgctgcgtttgccccatgtccttagggcaatttctgcagactgtaaatagtttcttctctttccttctttttttgtatcctttgtaccagttaaggttgttttgctgaggagagggtccagggtccacatggaccacctcacactgccattctggaagtgcttttctttggtttaattttgttggaataaagtattacttatggaaacagcattaggtaaatatatttcacgtattctaaatagtaatcttcattgccccatcttgttttctatatcctttgatactaatttataacaacagttctttagaatttagacactaactcacctcttctctttgtattttatcttttgagaatgaagcttcattttatttttcatagccctggcagactacttccatttatagtcctgtaaccatcccttttgtgtgtgtattgtttctgtgatgtctttcatgaaacttcttagggctaaaggtaattgaagcacatttgcttttcctcccactcaaatgtttttatttccttcaaacaaataccttagcaattctgcatctagatgttcttcaatttgtcagttcttgtttttttttttttttcttggcacaacagaagatgttctatttcatacagttaatgaaaggtatctttacttacgtaactataaatgatcaataatgatgatagtgcaatgcaatttcagaagttgttctagatttagcatagttctaaattgttgaggccgagtagaaaaattttcagtgatattgttcaacttgataaagtaacattactttgcagataatataattgtcatcagaactggcaagactaaaattgtttgctttaaaatattttattttccttaataaaaatattgctttaaaaatgttaatgacatttcatgaatctattcttttgggcattgacataaattactggtctcatttggggaatccatttaaatgtaggctctttgagatgatataataaatccctctttctaaagttattggccttcttattacatcatctattgtgtttcattagtgttatcttttaattagtaataatctctattatgtggcttctatgcatcagaggctttatataatcttgaatcctcttcattagcctataagtaggtggtatcagttcttcttaatgaatgagaaaataggcttgaagggactacataacttgctcatggtcacataattagtgagggatgacacccagatgtgtcagtattctcaaaagactagaaagaagggtccaggtagaggaagggtttgtggcaaaagcagtgcatggactgcttgttcatcatctttttttttttgagatggagtctcgctctgttgcccaggctggagtgcagtggcacaattttggctcactgcaacctctgcctcccgggttcaagcaattctctgcctcagcctcccaagtagctgggattacaggcacccaacaccacacctggctaattttttttttgcaattttagtagagacggggtttcaccatgttggcctggctggtcttgaactcctgacctcgtgatccacccgcctcggcctctcaaagtgttgggattacaggtgtgagccacctcacctggcctcatcatcttaattggtcttggattgttgaaataagttttcatcttctaaggaggacatatcaaaatctagaaactaaaaagttaaaaaaaatttttatgttagcctaaacaattgaaaatagcagataacaaacaatatttaaatttgaaatgtctgtgggtttctatattgaatcctgtgtctatgattatataaactaggagttacttcaaggaaaatgatgacaccacattgagaagtaggctccttagtcaccaggaggctatctgattttcccacttactctattgtgaatggagaagaatcctttggtcaagccagagcatagctcctcctcagctgattaggagacctggagatgagatctgtttcctctttgctataatgaatgtgtagggtttattctctctatcagattctggattccctgaaaacaaagatggtggtttgtatttcaatgcactttacatgtcatttgcatgaaatgagaagcgcaagtaactaactagttggtattgtggaactataaaatagaatgcagtattgtttacaagttcattctctgttagatactgttataaatatgcataatcaattctttttttttgggggggggacagtctcgccctgtcgcccaggctgaagtgcagtggtggcgcgatctcggctcgctgtaacctctgcctcctgggttcaagtgattctcctgcctcagcctcctgagtagctgggattataggagtgtaccaccatgcccagcgaatttttgtatttttagtagagatggggtttcacaatattggccaggctggtctcgaattcctgacctcaagtgatccacctatcttggtctcccaaggtgctgggattacaggcatgagccaccaccactcctggctgcataatcaattcttaattatttatgaattgttagaatggtttatcccaagcccatttctttctctgtatcttttttttgtttgtttttgacacaggatctcaaaaatcatcactagatggtaaatctgtagggaattattattttgagtcaggatcttcctctgtcatcccggctagaatgcgggggtggtggggggcaggatctctcctcacagcagcctctgtctttcagactcaagcgatccttctacctcagcctcctgagtagctgggaccacagggacataccaccatgcccggctgactttgtaatttttagtagagccagggtctcgccatgttgcccataataaataacaactaagacctcatagttgtcagtcatgtaatattattttccatttgctccatctctattcccagtttcagttagtagagtcctgatatacccagtagtcaaggcagaatttttttttcttttttttttttaatataatttttgattttacaaaccctggcctacaggtcacagcagaaattttagcatcattttagacttttccatttctcattcatcaactatttttaaattgtcgctgtgtcttttgattacatctcttaaatatctcaactttatctgcctttctttgttcccactgttgctgctttagtttaaatttcatcattttgtgcctggcctctataaatcagtagctttctgactagtgtctgccctaactctcttcctgcctccatggtgatttttctgaagtataacactggtaaaatgctcaacttaaaccttctcttgatttcttgttgtctatggcagtagccttcaaacttcttgtaaggcagttagaccccttcttcaaatatagggtgtcaacaaaatttcaacaaattgagtctcagagatctgattgggttttattaacgattcatggaccaggtagcatccagtctacgaaacagaaagagctctaatgacctagacttagtgggtacattttgtatgcacaaaaaagtggaggaaagcaggaccaaggatcaaatagtgggttggtcatttcaaggttactttccttatagggaatcttggcttaagggaatttagctatcatctttctcctgatttcttaggtggtcagattttacaagtaaataagttaggttttggtttggtaacttggaaccttagcctgagtgactccatttgggcctgctgttctttctttaactaaggcaaatacaatgtttaaaatagattttttttaaaaagagagagcgcaacactattgtctgattgaagcaggacaggaatgtaggaactctgcttttgcttctacctttctcaaaaagccccttgagccatatagggcaaagtttgaaaaccaccatcctgaagcagaacctagacttcttagcatggtatagaagccttttatgattttgtccatgccttttttcgtgttattcctggacttttgccctggatttcagatatgctgcattacttgcattcaccgaacactcattttttttgcctatatttttgcacaaacttttcatagaatgcctttacccattttgtctatcagctaaacttctgttcttgtctcaagtattaattcagatatcacctcttcaatgaagctttctctgattttccaagtcaaagttaatcttttttttctgcttttctagtatctcttcacattggaaagcaggaagactttgttatatgtgattcagcactagtagcttgaacttacaacctgttatatgacttacaatatttgcatttaaaatgcctgaaccaaacttttgccaacatttaattgtctattttttgctttctcatgaaagaaaatgtcagatgttttgcttaaaaagcggtcaagcacaatggcatatagccttaacttggttatgaaattgggcaattaaatcttttcattttaggtaaagtcctttatattctgtggtattgtagatggcattattaaagtactgaagtttccttttgttatctattttaaaggattgaatatgtactatgattatcatgtattgtgactcgcataaagagtagcaaatttatgacatgattggttcccttcaatcaaggcaccttgttgaaactcttttgaggaaatttttcattcagatttatctttaatgcagcttccaaataagtgcttgatgaatattttatttaatgagtaaattgtgaattaccttgtggtcgaagatattgtctccttattcactactttattctctcctccttctccatattccacttagctacatctttctcctcattcctaaaaaaaaaaaaatctctaaatatcttggtgcataagaaaagaagaaagaccagtgaattttcttgtttcttgcctgctttaagaggtggaattgactgtagataagaattgtggttaggctaaatattgcatatatgaacagcaagcatgccataatagatgcttaataaatgtttgttgaatttgagtagggtagatcttaggctctcagtgctttaaatgattactgagatttgaggatttcttcactttgccattgaataaacttaaggcttagagaggtagaagtggctttgcagatttctggtgaataggaatttttcaataattagaacgatctgaaattggagtgagctgttttgttttgtttagacaggatcttcctctgtcaccggagtgcactagtgatcatagcttactgcaggcttgaactcctaagctcaagctatccttctgtgtcaacctcccaagtagctgggactacaggcatggaccagcacacacggctaatttttgaaattttttgtagagacaaagcctcgctgtgttgcccaggcttgtcttgaactccaggccttaaacagccctcctgccatggcctcccaaagtgctgggtttagaggcatgagccgctgtgcctggctgtgagctgtttttgtaggcactaagtttcatatcacacctggcacggtggctcattcctgtaatcccagcactttgggaggctgaggcgggaggatcacttgaggtcaggagttcaagaccagcctggccaacatggtgaaacactgtctgtagtaaaaatacaaaaattagctgggcgtgatggcgtgtgcctgtaatcccagctacttgggaggctgaggcaggagaatctcttgaacccgggaggcggaggttgcaatgagcctagatccccctactgcactccagcctgggcgacagagtgagactccgtctcgggggaagaaaaaaaatcacttcctagctagaccaatgtgaaaaaattatttgtttgagctcttgttttgatattaacatgatgtagctaagtggtatttttctgctaattgaccttttgaaattcaaatactacttaattctattatggaacagtagaggaaatggggattctggccagagaaaacaaggaaaaagtacctcttgaaggtacttgacagtgaaatgatgaaacctaaaatgttgagatgaattgcaacaaaactttgatatttaataatgcatttgaagggaggccctgttctgttgatgaggcagaccatcaagagcagtgtagacgttgccaactcataatggcaagctaagagttcaggattttcaactgaatttattaaatctggatattcaaaatttttgtcattttgccatatattgggggtgtcttaattaaagggattttatgtagttcaaaataaatgttacaattgttgtattatactagtactatgaagatgactatgataagagtgtcttttgtatgctaattgggtgactcctggcagaacctcctagatagcttctgatgggggctggtcaaccagaaagaagaaggcactattagagatttaggactttcatcttcaccccagactttctgggaggggaaaagggaaggagaatgagctcaatcaccaatggctagtgctttaatcagtcatgcctacataatgaaaccttcctaaatgatggtgccctggagccttgtgggttggtgaacacactgtaaagcaaaacaaaattctaagccgcccagccaactgaatgaaaccctcctctcagccaagggcactctaacctgaatgctagttcaggccatgataggaaagacatgcctcattatacctttgtccctttggaattcaggcatggctaaccagcattaatgttaaaacagactctttgtagcagtaagataccaacatgatacataaaatgtatcacactttgtagcagtaagataccaacatgattgcaggccctgaaagaaatagaagtattttaccctgaaatatatttctctattttgaaatggccctggcaaagctgtctctcatggggaaaaaaatctacattctatagataatccccttccctttccaggtctttttcctggtccaggagagaatactgtctggcacctttttaagtctgttttttttgggaacaaagtctccgctctgtcacccaggctggaatgcagtggcatgatcttggctcactgcaacctccgcctcccaggttcaagcaattctcgtggtattttttaaagacctggggtggggacaggggattctcctgcctcagcctcccgagtagctgggattacaggcatgcgccaccacgcccggcaagtttttgtatttttagtagagacggggtttctccatgttggccacgctggtcttgtactcctgacctcaagtgatcctcccgcctcagcctcccaaagtgctgggattacaagcaggagccactgcacagactgccttcttaagtctgataagaaacatttacaatctgttccataggaagcctctgcataataagaaccttggtctccacaaccccttatcttaacccaaatcatagaagggagattctattgattccaggtctttaggtaaactcaaccaattgccaatcaggaaatctctgaatccacttatgacctggaagcacccccctccccacctttgagttattctacctttctggaccaaaccaatgtacatcttacatgtattgattgatgtcttatgtctccctgaaatgtacaaaaccaagctgtagggggccaggcgtggtggccttatacctgcaatcccagcactttgggaggctgaggcgggaggatcactggagtccaggaattggagaccagctgggcaacatggtgagacctcttctctacccccaactctccctcaaaataatagtaattaaaaccaagctgtagcctgaccaccttgggcacatatatattctcagcatctcctggggctgtatcacagttcgtggtcttcatatttcgctcagaataaatctcttaaaatattttagagtttgactctgtcaaaatcatcgaggtgctgggaggctggtgtgctctgagaaggcacggaaggcctgtgctggctccccaacccctcataccttgccctgtgcatctcttccatttggctgttcctgagttgtatcctttataagaagctggtagtaaatgtaagtaatgcatttccttgagttctgtgagtcacgctagcaaattatcaaacttgaggagagtgagttgtgggaacccccaaatttgtagccaagttggatagaagtatgaatagcctggggacctgggacttgtgacaggaatccgaagtgagggcagttttgtgagactgagtccttaaacctgtggattgaattgaaggatactcagttggtgtcagagaatcagaattggtgttggaaaagataccacgcatttgctgtctggggaaaaaaaaaaagccctcaggtaggcacatgaatcttcagcttacaaatggaaacgtaccaaagcttcaagagactgctgagctcatcattaaggtagtatgcgggaaagctataactcaaaagtgctcttaaccatatctttttaaaaaattgtatcctctttgagggaaagaatctatcttttcttttttaaattgttattatttattagtcagcttctcagatctctttggaatttaattgaatgcttttatcaattaatggtcttgatgaaattgcttgtatttttgactattatttgtatggccaaagtaattttacgtacccttctgaagttagcagcacaaacaattgaggaagtgcaaagattttcgcttgatttttcttcagtttcttctatattttaaataggacacaaatatctctgtaaataaaaataacttccaatacatttggaaaacatcccagacttcctgtccatgcctcgcaaagttgctgctgtctagtcattattactatgttttttccctttgacataagtgaccctcacaggaatagcttcatcaccagctgtttggccagtggtattccacttactttgtttttcctgtttctctgaaatatgctgaaagataatcactccgtgccttcccttgtttagaatgaatttactcaattgctctggaagcttaccttggtaaatgatttggaaccgtaatgaaaaaagagggtaggctttatatattttatattggtgccttaggaattgacatttatttattgaggatttttgtgctcattttcaatttgaaagggtcctagtgtttagaattaaattgtgggacttgaaagctaaaaaggaacttggagatcgtccaactgaggagccttattttttaaatgaggaaacaaaagttgtcaagatcaaccataaatctgatagtttggcttggtgaaagaaacctaggtttcagaaaatctctcatgtagtttgcagtttatagccacaaggaccaggagtctgaagacttgataagagggtctgtttttcaaaatattaacaaagtttagcctggaagctccctttgtgaattttccatgtcattgacagtgtttgaaatctcgtcatgtcttcaggatcaataacctctaccatgtacttttatactttttaattagcggattttcaaacttttaaaaacagtaactcctttttttcaatataatcttatattgaaccacaggatacaaaaaagatacgtgatatttaattaaaatagttttaagcacaattttaatttgttggataataaattaatgatgacatagctaaaatttatgaaatgctgattagagtactgtacatacatatttcacttctctctctagcttaaaatatttgaatgggtgtactgtaattcatttaactaggcccttgttgatgtgtatttagactgtttccattcttgtttttgcaaacaatgttgcagtgaataatgtatgtatacattatgtggtgtgtgtgtatgtgtttctggggataaattctggaaatgtaattgctgtgtcattagaatatgtttttagttttgaaggattttatcaaattggtttccaatttgatatatattcccaccagcagtgtatgagcaagcttaattctctcatgctctcatcagcatggtatgttatttttggtttttgctaatgtaaaaaattgtatctcagtgtggttttaatcttctatttgtattatatgtaaatttgagtaacttttttatgtttaagagccatttgtgtttctttttctctgaactatttgttcatatcactttgcccattttaaaaattgggtttccgcccctcttaatgagcaggagtagccttctgtgtattgagtttaactttgtgatataagttgcagattcttttcctcaggttttcatttctatttttcctgtagtttgtaccttttccatttttatggatatctaaactcaaccttaacttgacaaatggaaccttggatttctatccttcctttaacctccttctcttctagtcttcctcagtgaagaaacagcacctctcatgtgtctctactcatacatagcccaagcccaaaaccaagaagttatccttgcctcctctttccctccctccctgtctctaatccatcctcagtggtattgacttcctctccaacatgtcccaaatctattcatttctcttaatatccaccaatttagtccatcctccccttatctttcacctgggtggctgccatggcttcctagctgttctaccccaaaactgatgtctcccgttccaggtactgagccattctctactctgtagcttatgtgatcttttcaaactgcaaataatcagattgtcataccactccctgaatccacccctcctattcttgttcaaaaccctcctgtaagtccttatgtcccatggcaaagattatgcttcttgaaatagcccaacctgctgtttctccagcctcaccttgtactatgttattgacccccacccctccccacctcacctgtgggtctcttgtgtcaccctgttccctcctgacttggggctttagcataaattattttctcctggagcatcccccttcttccatgagtttatgttgaattattctacaggcctcagctcactaattgctttctctaagagagccaacaactcttcctaataggtgggaaacccctgtcataagcccttccagcaacttatatctctttcatagcactaatatttactgttttatacttactgtgtgagtctttgattaagctctatgagatagggatcttgtctgttttctttactgttatgtcccagaatctatcatagtacccggtacatggttagctctcaaaacattgaatgattgcttaactataaacccttaggtgtagagtttacagaatgtactgttttgccctttctggaaaatgggacatttgctcttggccagtctttgttctcctcttcttttccctgtgattttcccaagactactaaatttcagcaattccattttgaaagtcttaaagcatttcaaacatgaaatttatccaggtcaatggtcttgaattcatttaaagcctgtaggtgttcttcaagtcttggacttcagttccttccattcctttttcatgtgaagtttatttttcttggagttgaggacaataactcagaccacattttctgacccacatcaatccagcaaaatctaggtggtccccaacttctgtaagtttattttaaattcagttacttagaatttgcagttcagaaaatattaccccaaagaaaccgtgttaaaattgatctttatattttcatgaagatgtcttcaaaatccttttaaccaatagggtatctgaaatagtacagttttagtatgaactctgagtttctctgatcctattttattgaggcagggtcttgctcatcacccaggctagagtgcagtggcgtgatcatggctctctgcagcttcgacttcctgtgttcaaatgattctcccacctcagcctcctgagtagctgggagtagctgggactcaggcatgcaccaccacgcttggttaattttttgtagatgcagggttttgccatgttgcccaggctggtctcaaactcctggagtcaagcgattggcctgcctcagcgtcccaaagtggtgggattacaggcgtgagccagcgcccctggctctgatcccattttagctctgtttttctttttctttctttctttttttttggggacaaagtcttgctccgtcgcccaggctggagtgcaatggcaagatcttggctcactgcaacctccgcctcctgggttcaagtgattctcctgcctcagccttccaagtagctgggattacaggcatgtgccaccataccccgttaattttttgtatttcttttttttttagtagagatggggtttttgccacgttggccaggctggtctctaatgcctgacctcaggtgatccacccgccttggcctcccatagtgctgggattacaggcgttagccacccagcccagccttagctctgtttttcaatctgaatccaaagaccctcatattaggaagggctgggagtttaggaggattggcagtgctgggagaagtatcaagtagctggtagaagatacattgggttgatactggatttcctcccttgtggaaggattctgaaggtcaagggtagggaggcacataacatatttggtagtttgaaatttttatgctagtaaattgtgtataactcatgataatcaaatatctgtttgatttaataaggggggactgaattataaaggatggattgataaatcaagttactctccacttttgggagaataaagcaaaatgaagatcctattaattatgggtcagatggtcccatctagaaagaaaactaagtaggagtgcttcatctccttgcttgtattcagcatggagaagtctttacaaaagggtaattaattagggtgtttttcacaaggccgtgccttccatagaaatggttttcttctgtatgtggatcttgagttttaagatgctttccaaccatttgaactctcttattataacagaagtttagtcatgtaccaaatgtattcctatgcaattttcagtgacaaaatggttctctcatttggatgtgtaaaaacaatgccaggaacaaaaacaaaactcatgattcaactgattttgtactctctttgggaagaagaaaagacccgttgagatgaagattataatttcagtaacaaagaaaacattcaaggcccaggcagctcttaaattcaatactaataatctatgaaataaattataagcctacgtttctgtcagttctttagatacctgcttgtttgctaatacagaaacattgcttaattttacatgtattttcttagtgtgagtcaaatccaacctaaaatgcatttggttatttgtttacacagttagtgactggtaatcaaaaacgcaaacaatttttgagggagttagaatcttcactttagtaggtaccttagagggcatctagtttagtacaggattcctttctaccagggacaaactgtttacagaggccccttcctgcctcttgcgaggttcctccttgtctgttctgcttcagatatacaggccttctgtgttccttgaatttatcaaactctctaagactctttgtactgccttgaacactcttctcatagccctggtggcttggaatttttacatgggacagatttctctgaaatactgccttctcagacaaccttccccagatctcctacctaaaggacctctccccttcccaactgccataactctatcataagactctgttttatttccttataatacttgtcactgtctgaaattatcatatttattgtctatctcctttagctccatgagagcaggagcatggtccatgttgttcaccgctatatcctgaagtatctacaatagtggctgtcccattgtaggcatctgacaagtatgacaaaaatgagaatgaatgaataaccattgatgattgatcattttgttaatgttaaaaccaaactctgtaaaatattttaaagaggtttattctgagctaatgtgagtgaccatggtctggggaacagtctcaagagccctgacaaaatatgtcctaggctatcagattgcagtctgcttttatatgttttagggagagaattgtaggtaaaatcatcagtcagtacttggaggatgatgtacattggttcagccaaggtagtgggggatcataggtggattaaaggattttctgattcgcagttggttgaaagagttaagctttttctaaagacttgaagtcagtagaaagaaatggtaaagttaagataagggggttgtggaggccaaggttcttgttatgtagtaaagcctcataggtagcagctttcagggagaatagatggtaaatgtctcttttcagaccttaaaggtgtcaggctctcagttaatgtctcctaggttgggggaaaggcccagaaagggaaggcttggctgcactatggagattctgttggccccgtgacagttattttaaaatatgtcaaagaaatatattttggggtaaaatattttgattgccttcagggtctgctatttgtcatgtgatgctataacacagtcagattggaaagtaagccacattatactttatactaggttaatcatctctgatgaggctttatggtttgtagggcgtgacttaacccctgctttgcctgaccttaggtgttgtttataatttgttatcttattgccacagtgtctggtttgccagtcttaggatcgccatccaaaaagagggagtataacgaggtatgtctgacctctcttcctggctgggaattcagtttttcaggtttctctggggtgcccttggccaagaaggagtttgttcagtcagctggggggtttaggatttttttttttttctttttgagatggagtcttgctctgttttccaggctggagtgcagtggcgctatctcggcttactgtaacctctgcctcctgggttcaagcaattctcctgcctcagcctcccgagtagctgggattgcagacatacgccaccacccccggctaatttaggattttatttttggtttacatgttccaatcactactgagctgaaatttgtctcctttttgcttctactactgaacttagttctgtcccctggaataaatcactggctcgattccattttttccaaagtcttcagacatttggatgtcagtcatctctcactgaggccaaactcacctggtttccttaccagttcctcatctggcatggttttaggtgagtggtcactatccaggttatcagttgttggcaatttttggttttgttgttgtgatacccagcactaaacatagtgcattatgtggtgtcttgaacttccgagagagagaacagttaaactttcttgtttaatgtgatactgcaatgctttgtctttgataaaaattattttttaataccatataaatgacgaaggaactatttatatatgaaatcattatcagaaatattctgaggtcttaaaagcttgttttataatggaatataacaacgtagaaatacattaaacataagtatatactctaatgaacaattataagtgaatgtctatttaaccatcactcaagacatagaaatagtgccccaggaacccctcctgtgttgtgttgtgttgtgttgtcttgtctagcctttccctttccctttctctttccctttcttccttcctttctttcctttctttctctgtcaccccggcagtgcacagtgcacagtgcacaatcacggctcaccgcagctgtgatcacctaggctcaaggaatcctcccacttcagcctcccaagtagctgggactagaggtgttcgccaccaacgcccagctaattaaaaaaaaaaaaaaaaagttgttgtagagacaaggtctcattatgttgcccaggctggtctcaaactcctgggtttaagtgatccttccgcctcagccttccaaagtgccgcctcagccttccaaaatgccgggctgccatatgtcttttctcaatctcagtccctccttagaggtaattaatatcctgatttttttacaataaacacttccttgatcacttttttatacagttaccacttacatgtacatacttaatatagtttatagttcagctttgcctgtttttaaactgtatataaaagaaacaatgctgttgtatcagttttctgttgcataataacttaccacatgcttagccatgttaagacaccatatattattagctcacagttctgtaggttcccagcctgatctttttattacttgtgttttctgtttcatgaatttttgctcttactcatttctttcttcacattttcattgggctcattttgtgtttcttttgtttagcctcttgagtttgatgcttagttcatgtttccagtttttagtattttctgatatatgcatataagattctcaatttcctccttaagcattgttttctttctatagatttgtatttttgttattgttaagtgtattatgttttcttccttgattgacatatggattattttgggagtgtatttatttccaaacataagaattattttctaactacttcttttgtgattgatcaactttagttgtggaaagagaccatccttttacttcagtccttgtaatttattttatttatttatttatttttgagatggagttttgctctgttgctcaggctggagtgcagtggcgccatttggctcactgcatcctctgtgattctcgtgcctcagcctcctgagtagctgggactacaggcacgtggtcatcacacctggctaagttttgtgtttttagtagagacaggatttcaccatgttaaccaggctggtctcgaactcctggcctcaagtaatctgcctacctcagcctcccaaaatactgggattacaggcccgagccactgtgcccggcccttgtaatttattttgaattgctttatggcctagcatatgatcagtttttgtgaatgttgtatgtgtgcttggagaggagaaaaagatattttgcagttctttgctatagttgatatgttcatttggtcaaattttaaaaacatgttcaatgtcttctttatcctaatatttttctctttcatttagttctctttttttgttatgctctctatctagcattctaatttatttttatagtttgatctttcaccttttggaccttttagttctgtcacaatgttcagtctttgtttttttttttttttttgagatggagtctcgctctgtcgccgaggctagagtgcagtggctcgatctcggctcactgtaagctccgcctcccgggttcatgccattctcctgcctcagcctcccgagtagctgggactacaggcgcccaccacaatgcccggctaatttttttgtattttttcagtagagacagggtttcaccatgttaaccaggatggtctggatctcctgacctcgtgatccacccgcctcggcctcggcctcctaaagtgctgggattacaggcgtgagccactgcacccggccagtctggtttttattgcatcaaccctaccgttgttttgtaggctattgctgatcatttataggctatccctgacccaaagtcttttgggatcattttctttttcagttgtttctattggttcttgttcgtggtatcttaccttgcgtgtttggccatctttgattatgtactgcacattgtaaatgagaaactatctgtagcagtattgtgaggcctggttgatgccatcttccctcagagcgttgctttttttctttgtttcacccagacaactggtggctttaacaatctgaatgtggaaccaccttaatccaaagtacatttaaagattttatctagatcgcccagatgacataaacctacagttcaagtttgtccaagggctgatttatttctgttttttcttatcctgggagtatattctggggttttggcttcaagtgagtggtgatttatcaaactttctccttatttataaaaattttatttttaatgattatagctacttaatagttgtatatatttatgggatacatgttatattttgatacaagcatacaatatgtaatgatcagggtaattggggtatccatcatttcaagcatttatcatttctttgtgttaggaacctcccaattccactcttttagttattttgaaatatacaataaattattgctaacaaactttctcattttgagacacccttgactttgaattttgtgttccttgatctctaacgatttcaagagcaaacctgtttttctctcattttctggatcttcaaataccagaaaagctaaaatagttttgggtggtttggattatctctctggattctattcttttgctttgattgctttgattttagccaggtaattcttcacaatcttgttaagtgtttggagcttttaagatgtttctgaaaagtattccctctagcatttgtatttgtctgtaaagggacatttcatccaagatatgtagtttgccatcaccagaactaaaacgttttagtttttatgccttaaaaaaaaagattaatcagttatattcatataaaattgcagctaaatccaatatggcataatttttttcttcagtatgaatactggtatttaaaagaccattcttgacatccaagataagtatccactcacatcattattattttttttatttgttttgagaccgactctccttctgttgcccaggctggagtgcagtgacgtgatcttggctcactgcaaccatcacctcccaagctcaaaaaattctcgtgccttagcctcctgtgtagctgggactacaggcacccaccatcacacccggctaattttttggtattttatctggagatggggtttcaccatgttggccaggttggtctccaactcctgaccttaagcagtctgcctgcctcagcctcccaaagtgctaggattacagacgtgagccactgtagccggccccactcacattctgattcccagtttttttgtttgtttgtttttgtttttgagacggagttttcactcttgtcatccaggcttaagtacaatggcaatatctcagctcactgcaacttctgcctcccgggttcaagtgattttcgtgtctcagtctcccgagtagctgggattacaggtgcctgccaccgcacctggctaatttttgtatttttagtagagacggggttgtaccatgttggccaggctggtctcgagctcctgacctcaggttattcaccctcctcagcctcccaaagtgctgggattacaggcatgagccatctcacctggcctaattcccagtttttattactcagttttgactgccacaaagaatagtgagaccaaatgttttttttaaaaaatttttatttttttttatttttttgagacagtctcgctctgtcgcccaggctggagtgcagtagtaagatctcggtttactgcaacctctgccttccgggttcaagcaattctcctgtctcagcctctcgagtagctggcactacaggcgcgcaccaccatacccagctaatttttgtatttttagtagagatcgggtttcatcatattggtcatgctggtctcgaactcctgacctcaggtcatctacctgccttggcctcccaaagtgctgggattacaggcgtgagccaccacgcccggccacaaatgttctttacaaatacttttatacagaactttttgggtcttcttagtgagaatgattaatttttatctcaagtttcctttgaaatgaaccataccattattggcagagagtagaatatttaaatatttcctgagtgttctttcaaaccagccgtagaaaatgaaagagtgattcgttttcagaaatgctctgagcatcttttaccaggaatgtgactgacatagatcctcatatagctggctccttgtcattgccatctcagctcaaatgttacctttttagagaagccctccctgtctatcattctttttccctctttcataacaaaatacaagataatagtctcgtattttttctccaccagcaaaatgtaaagttccatgagggtaaggaccttgcctgtcttgtttaccactatgttgtgtgtcttatcctgaaaacatgggaggcagtcagtaattatttgcttaatgaattaataaatatttcatctcaaattgtgacatctttttctctaaatatcagaataatccttaaaaaatttttgattccagtgaactaaagttttctaagctaagtatagcgaaaggaggtcagtgtagctggagtgaagctagtcaagggagagtctagtaggagatgatatcaggaggggaggtcaaggcctgtggctcatgtggattttgcttttcactcttaatgatatgggaggccattagagggttttgaatgagaagtttatgagaagtgacatggtctgagttatcttcaagagttactctgacttctttaaggtctgtaggaatctgtagggatactgaagtatggtctattctgggctctcacatctgttctattggttatttatccgtgccagaaccaccctgtcttaatttccctcactctattataatcctcaacctattcagtagggcatcctgccagatcctaccctcaaagcctagtgctcttgtaacttttcttatctttcttactcttttctttttcttattctttgctgctcatacttgtagtaggagggtgttgcttctacttggaactctgcccttccatatatattttaaaatcagcttgtcttaattctttagaaaaccttgttgggattgtgattggaattgcattgactatatagatcaatatggaaagaattgatacctttatagttttgaatcttcctagctgtaaaatttggataacttatttacgtgttttttaatgtcttgagtaaagttacatatatatttgaaaagtcgttttgaatatcttttgttaaatcttaggtgctttttaaaattattgtaaatgtggtttgtttttgtttttctttgagacaaggtctggctctattgtccaggctagagtgcaatggcacaatcttggcttactgcagcctccgcttcccgggctcaaaccatcctcccatctcagcctctggagtagctgggactacaggcatgctctgccacatgcagctaatttttatatattttgttgaggctggattttgccatgttgcccagtctggtctcgaactcgtgagctcaagcagtctgcttgcctcagcctcccaaagtgctgtgattataggcgtgagccattgtgccccgcccataaatgtgatttttaaaaattgcattttctatttcttacaaatgctctttacagatgctgctgatatttgtgtattaagcttatgttcagctaccttgccaaacactaataattccaataatttatgaattcttttgaattttctatgaggtaatatatgcaaattctgttttcgtttccctcttttcaatcatacattttattcatttattgtttcttattttactaagccagctataacccacaaggatgtttttgttttgtttttgtttttgagacagggtcttgcggtgttgcccaggctggagtgcagtggtgcgatcacggctcaccgcagcttcgccctcctgggctcaagcaatcctccctcctcaccatctgagagtagctgggactacaggcgtgcacaaccacacccggctagtttttgtagtttttctagagaaagggtttcaccacatttcctaggctggtcttgaattcctgagcatgagtgatccgtccacctcagcctcccagcagcctcccaaagtgctgggattatggacacgagccactgtgcctggctaggatgtttaatactaatgttaataagtattaatagtagaactccttgtcatgtttttgtttgtttggtggagacagggtctcacactgttgcccaggctagtgtccggtggcgcaatcacagctcactgcagctttgacctcctgggctcaagtgatcctcccgtctcagcctcccacaaccatgcccaccaggctaggttttttttgtttttgtttgttttttttgtttttgtagagactgggtctccctgtgttgctcaggctggtctctaattcctgggctcaagcgatccttctgccttggcttcctaaagtgctgggattatatgcgtgaaccatggtgcctgggcacatgttcttaagttttaaagggactatgtctactgcttcacatttaagaatgatgtttgttgtaggtttttgtcagatgcccttatcaggatatgcacattttaaaatcacctaattatgtatatattgctttttagaaaatttgcaccaatttacatttctaccatcagtgtatggaagggcactccttgacaatacttacccacatcacatggggtattcttgttaaaagtttcagattttggccgggcgcggtggctcacgcctgtaatcccagcactttgggaggccgagacgggcggatcacgaggtcaggagagcgagaccatcctggctaacacggtgaaaccccgtctctactaaaaaaaatacaaaaattagccgggcatggtggcgcgtgcctgtagtcccagctacacgggaggctgaggcaggagaatggtgtgaacccgggaggcggagcttgcagtgagtcgagatcgcgccactgcactccagcctgggcgacagagcgaaactccgtctcaaaaaaaaaaaaaaaaagaaagtttcagattttataggcagtaaggaacttcttgtttagatttgtttcttccttttaaaacaatattttgtgttgttaccactgttattcttagagatgggataagctttttgaaacaaagcttattttgaaaatatttcagatttagagaaaaactgcaaaaatagtgcaaagaatttcctacttcctatacccttgacctagattttccaagtgtgttaatattttatcatatttgctttatcattctttctgtcttttttctcttccctcatacacacatataatttttctcagtggtttaagttgtaaacatgatgcccctttaaaaactttagtgctgtttcttaaaaatgagagcattgttttatataaccgaagtactaatatgaaaattagaaaactactgacaacagtactataatctgtgaacatttgaattgtatcaattgttcttcatagcgaaaaaagaacaaaagctttttcttgtccaggatgtaatccaggatcatgcaatgtatttcattgtcatatctcttaatcttctttaatctggaatagtcgcttcttgttactcagttgtttcttgtctttcatgaccttgacattttaaaagaatatgggccaattatttagtaaaatgtccctcagcttgggcttgtctcttgcttcttgtgattagattcaggttttgcatttctggcaggaatgccacagaagtggtgatgtgatacatcctatcagggggcatataatgttggtttgtccccttattgatgacgttaacttgatcatttaattaaggtggtgtctggcaggattcttcagtgtaaaattactatttttcttcttgtaattaataggtatcttgtggatactttgagattagataatatcctgttttccatcaaattttcaaccactagttttagcatgtattgatcatacttgcttgaaataattattaccagagtgattgccaaatggcgatcttctaattttatcactacatttattatttggaattatacttcgcaaaagagctttctcttctcccccatttatttatttatgtcagtaaggacttttaaaaaaattatatgggttataatctgttactgtgcttatttactttgttgctcaaatattcccgattaggccagtgggagtcacatcagtctgactcctgtgtccttttgaggtacccctatcattctttgagcatttccttactttctggcaccacaaaaatatgccctaggctcctatggtccttctcctgccccacccttggaatcagccatttcttcaaggaaccctagttccttttatcagagcaccagctgtgttcatagctataggggtatcattgcttctaggccttctcagcagacagagctaggaaatatatgtatgtgagtgcacatttacacaaacacctttatatctgtctatactcctatatattaaaaactgagcttatattgttaactccaactccaagccttctccctttttatatttgttactcccttttatgagaataagaaaccaaggtcagtatattcacagaatatttacctatttgcccaatcttagaacacacacaaacaagtttcatgtcattgtataaaagcaggtagctaagtagaatatagtatttgtttataattctttttatttttagctttaggagagtagatagtgaaaatgctgtttttaaaagttagctgtggttaattcatttgtccttgtccccaaaagtgtggttatattattcatttcaaatacagagaggttcatttgtttgtattcattccattttgggttcttcgctcctattactgttggtttcttcttcattttaagtgtataaaacattaaaatggattgaaaaataactctacaaaaaggtaagattggttactagagtactgcaaatataaaacttacagcttttaattgtgtttgtttttttcagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggtaagttggaatttttgcgttccttgagttttgagcaatgaacagttagttattcctaccaccaaaaagttactaattagatcctgttaatttaacctatatcaattcacatgtgtgtctaagagtaaaatattaaaaataaaattactcttaaacaatttgggtctcactctccaataaaaaattaataactttttaaaaccctttaaagtttaataaatcaaagatttttttcccttttcttttaaaaagagccccagtgttacaacagtctttgccttcattctttttttttttttttttttagcaatcatgagttccttagtctgcattttttttcttggttccattttatttttatatcagctaggcttattttgaataacttaaatttcattcattcattcattcattcattcattcattcattcaagacagagtctcactgttacccagactggagtgcagtggcatgatctcggctcactgcagcctctgcctcctgggttcaagcgattctcctgcctcagcctcctgagattacaggcgtgagccactgtgcccagctaatttttgtattttcagtagagactgggtttcaccatgttggtgaaattttacttaatacctggtaaataaacaaataagtaaattctgtttctttgaaaatgggagactatgttttgtaaattctgaggcatacaattttatctctgaaatcagggtgtatcttataatcagtatcatgtcacagtttaattggcagcattctccctttcctaatagtacataaaataatgctcatgaccaatgatataccattgatttgatgaaatatgatgtcattttgtataaactgactcctaaaaaaaaatcatttcttctgatttttcctgcttagtgatttttgctctagacttaaagataactttggaaattttgataaatgattctgttaacagaagataagtgattataattatggtttcttagcatttatatctttaaagcatatgttacaaaaatttcatatttcagaattttcaaataaactctgaattcctaaaggactaaaaaagttcacctatgtgaacagcaaagctgttattaagttttaaagttggcaaatcctttcaaatacatagaaacaattaaaataaagagtttaatcattggatgcttgtttcaaggtctgaaattcaaaccatacaaaacaaataggtctttgttccttcactagtcaactcctcttccatttcttcatcgatgttatgtaaaaatttcattttcagtgtcttgcttaccatctgttctggaatagcctattttatttttcaaaagtattagaattagagaccaatgcaataaagctgctgactggagaaggctagcacatacggtgtaacaaggttagaatgctccagattctgggcctaagtttttctggatcataactagtttttctcattatagccataggtgatcatcttctttgggattggctcaaaattaccagactgttatatatatatatatatatcagaatatgttactttgttatcagaactaccattgctgtatgtttctttctttggaaagcacctcacatgtatttttggctaggatatacatataaagtatataacaatctgtcaccaggaacggtgactcatgcctataatcccagcactttgggaggctgaggtggtggatcacaaggtcaagagatccagaccatcttggccaacatggtgaaaccctgtctctactaaaaatacaaaaattagctgggtgtggtggcgggcgcctgtagtcccagctactcaggaggctgaggcaggagaatcgcttgaacctaggaggtggaggttgcagtgagtgagcttgtgccactgcactccagcctgatgagagagcgagactgtctcaaaacacacacacacacacacacacacacacacacacacaggttgcagtgagtgagcttgtgccactgcactccagcctgatgagagagcgagactgtctcaaaacacgcacacacacacacacacacacacacacacacacacacacacacacacacccctgtcaagcaaactctgcattcttgtagtttagacagtgtattttttaccccatagaataactggcataggcagttagaattggacaattgcctggcaattgtggagttaagttagatggttataatggctggttctatgctaactgtgataataggattcatccatctctaccaaagtgagggagacttgttcaggtcccatagactgtgttggagacacatttcccaattttgtatccgtgaagcccccttctcatagatgaatgcaggcttgccagtctgctaatgttaatgttcttgatgtttctgcaaagctcagctatcattcattacattttgattctcttaattagatttttcacattataattttaacctcagtttcctgagtactttgctgtcaactctgtcctacttctaaggaagaagtctattgcctagataataggataagtaaccccaaaggtagttacttgttgaaatacaccaaagacagtgggagtgcttgtcgcctttgtgcatgaactgagtctttatttatggcaaaaggtagcaaatcctactagctattaattggaatactgaggcctggactactttgccagtcaggagagacattcagctgggtgtggtggtgcatgcctataatcccagcactttgggaggctgaggtgggaggattgcttgaggccaggagtttgagaccagcctgggcaacatagtgagaccatgtctctacaaaaaaaacttaaaaaacaaaacaaaacagaaaaaaaaaaaaaaagaggggcatttcagtatcctagaggaagattttaatgtcttctagaacagataatgtatttggtgggctctgtgcttgagcttactactgggatgtcattagctcttaaggtttttttgtttgtttgtttgtttgttttcgagatggagtcttgctctgttgcccaggctggagtgcagtggcgcgatctggactactgcaacctctgcctcctgggttcaaacgattctcctgcctcagcctcctgagtagctgggattacaggcacctgcaactatacccaactaatttttgtatttttagtagagatgggtttttgccatgttggccaggctggtcctgaactcctgacctcaggtgatctgccagcctcggcctcccaaagtgctgggattataggcgtgagccactgtgcctggcctagctcttaagttttaagttccacagaatcttctgagttaattttcctttattctcaaagttcttgagaccaaatcttgtctccataaatgtgtaaccctacatttaaacgtatcgccagtgaaattttctttaaaaagaaacatttaaaaatacttgttggaagaaatgacttgtctatactcttgatttataataaatgtataataaagtatgttccatttgtatgtggctcattattgcattatcactatagaatcttgtcactttagtagtcattattataacactgagaagcaatgtcagtatagcagagctttgtagtttgtatgcgtgcccttgattgtttacttctttttattataggagcctatggagttgtacttaaatgcagacacaaggcaagtacattatttttaaaaagaaatatctgtatatgtttaactgttttgaaactaatgtagtggtctttgcgtgtgggcatgtacaggttgagcattccttatctgaaatgcttgagaccagaaatgttttggatttttttggattttggaatatttccatatatgtaatgagataccttggggatgggacccaaggctagacacaaaattcatttatgtttcatatatacttaatacatatagcttgaaggtaattttatgcaatattttaagtttttgcctaaaacaaagtttaaatacttatatgtggaattttccacttgtggcatcatatcagtactcaaagttttggattttggagcattttggatttttgaattagggatgctcaacctgtaattaaaactctggttatgaggatgttgtttaatgaagtggaattaatatgtgaatgctgccagaaagagactacttttagataagcttgatcatggttgggtagtccttagttcttagcaatcacgtgctatttttttttttcaactgacctatgccgtgcacctcataatgacatttagatcaacagtggacagcatgtatgatggtggtcccgtaagattatgatatggtattttttgtttagataaaaaacattttcagatacacaaatacttatcattgactatggtactcagtaaggtaacatgctatacaggtttgtagccttgaaacaataggctataccatgtagcctagatgtgtagtaggctataccatctaggtttgtgtaagtacactctatgatgtttgcacagtgataaaaatcacctaatgacatatttttcagaatgtattcttgtcattaagtgatgcatgactgtataagtgaaaagctgcctaatgggaaaagagaaaaggtggtgggacaggaataagaaggcagggcagtgacagatttaatttatgttcaagtacttatgagcaaagagtttttttaaaaattatttttcatgtagacccattaacttagattgcttgatgcatttgaatccagattttgaagggtaataaggtaggtgtttggatatgagctagaacttgggataatagtgtagattatgattactggctatagttgattacccttgaacagctgtgaaatgaaccttactagaaattattttactatggtaataatcacaaattattcagagaagttatttgaagtttccatagctgttattcagttgtaagcatgttttactgggagagtaactttcagatggcaagtgttgaaactgtaacaaacattagtttaaatatttttctattatggcatacctagtctgagtatttggcttcatttgcatataatttgttaagaccaaggttttaagttttttcgtgatgtttcagaatgatataatttatgtctgtggtgattttagcaatttaacccaaaacatttaaactcttgaatctgtcgtctattgaaaataatgtatgtgtgtgtatgtatgtaaatatgcacacacataaataaagatgatactcttatatttgctttttctttcctattgtacaaaatactacctgccttttgaatttaagccttcgtgacacttaatatatttttgtgtttagatcacagatctcttacttccatgcaatggcttttgtattcttcttgaaattgggtgattgaactattttatgttaataatagttatctgaagatctctttgccattaaattttcaaaaatggttcgaatactattggttcttgattaaggatgattaagaatttaaaataataaatataataaaaataaatttagcaccttgaacaccttgttaagaaatattactgtagtttgaaattaaacaaatgaaaagctccctaataaaatgctaaatgctatacttttaatgacttgcctttagttataagtttctgaagcttaaaaaaaattcctgggtggatattacttgggagaaataggttattagtttctaagttaaatttgactttttcccgaacataaaacctccttttatacaatggctctgtttatgcaacattgcaaatggaaacttcagttcttacttctaatcttgggttttaaaactcaaagatttatgagatatgtacatatcttacatatgtacatacacatatgcatacatgtattatacgtatacatatatctgatatatattacacatcatgtacagagtccaaatgttttctcctagtcattgtcatacttcaacctgtgaccttttcctctatactttcatgtaactttaagctctccttctgccttttatataaaaatagtttattatttaaatatgttgtttttatctttctatttactcatttgttaaaatggttgtttcatatacctggttctcaaaacacacactgttagtgccagcaggatgggcccagtgtgaaagtggatgagaatggacatctctactcttaggaaaccaactctaaatgtgaactctgatttttagttactgtgtgtagggaactttgaattacaaggataaataaaccatacttttcttgcctttatatggcttatggtctgtctgaagagatagaagaatagataacttaaaaaaaaaacaagtctgtgaggttgctgcaaatgagatacatctaaaacatttctctctttgctgtccttcactacatgaggtcacacaccagctctttaagtattgtagctttctccttgcatgtgtctaaaaagatatcactggatggaaaatttaaagcataaattagtgcctatctcagagtattataaaactcttttttagaatctgcagctgtttagtcattaggcttgttatagatagtatatccttttctcagctaaaatcagaccttcaaatctataccccattatccaaaaatagagaatttgatgcttctggcaagattgatgctttagggtcaaacaaatggattattatgaaactcatattataattaaaaatgtatgtaatcttcccgattgtacttatgtaaagtaatcaggccaatatcttttgcatacctttaaaaatttagtgaaatgtttataaaaatgtataagtcaggtctgtgtgattgtttatgcataaattgggtatctttttgaaaaggttgactgggggtgtatatataattaattcttagcatgttgtatatttgaacaagtatagaagaaagtcacttttttaatctgtgtactgttgcagtaattgagagatcatgctgataaataggtgtattttgcttttgtgcatagaatatgatgttgggctgatccagaccaaagatcatacttcctaatttactgaaattaatgctgctcaatttcaaaggaaaaatatagcttttactttttttttgacagctgaacaaaattaagctgtatatatttattgtatatataataataagttgttatatatacacattgacatgcatatgaaaactcttagcagtgactaagcttctttttaggactcattatgactactcacatttgaaagatgttctaggctgggcacagtggctcacgcctgtaatcccagcaccttaggaggccaaggtgggcagatcacctgaggtgaggagttcaagatcagcctggccaacgtggtgaaacctggtctctactaaaaatacaaaaattagccgggcgtgggggcgcatgcttttagtcccagctactcgggaggctgaggcaagagagtcacttgaacctgggaggcggaggttgcagtgaaccgatatcgcaccactgcactccagcctgggtgacaagagtgaaactccatctcaaaaaaaaaaaaaaaaagatattctggtttggacctttaccctgcagatatgcatagttaattatctttttatttgtatgtgtttgttttttttgttttttggttttttttgtgacgaagtctcactctcacccaggctggaacgcagtgatgtgatcttggctcactgcagcctccacctcatgggttcaagcgattcttgtgcctcagcctcccgagtatctgggactataggcgcgcaccaacatgcccggctaatttttgtattttcagtagagacggggcttcattacgttggccaggctggtcttggactcctgacctcaagtgatctgcctgcctcggcctcccgaagtgctgggatttacaggcgtgagccaccgcgcccagcctcgtgtgtctgttttaaagtgcctgtgaaataggcatgttttgtagcatgctcttcttagcaaaaacacgaaaaggtcatgcttacaacaaggcaaggataattgaatggggttgaaataaagacattcaattagaacttgaggaaagtgggcttgtacagcttgatagagagaggctggagggtgatgctcattgagcccaggacaggaaagtggtgattcatgtaatttgtttcctgtgactatggttgacttatgagaagtttttgtttgttttgaagcagtaggtgacatatgcttttgagatagctagttatacaaagctgtgaacatccaacattggggtacagcctataagtgttcaataaataataatcttacgttagagaactgaaaatgaaggatgcagtagagagctgttgcagagtagcagggacctggtatgtgtggagggatgaaagatgatcccagggacttgaatgtggtaaactagaaaagctttggtattatttatcaggctgggaaacttaataaaagatatatgagtttggggggagaaataatgagtttggctttaataaagaataaaaatggcagcagaacataaaacctagtattaacaaatactacctattgagcatctaccacatgctagacactctactagatgtctcaaccactacaacaagataactctattcttagcctcattttacacatgaggagactgagtcttagagggtctgtgtaatagggccaaaatcatgtggctgataaattgtggaactaggctttgatctgactccagaaatagctaacttgagcatgagataggagccttctcttctcttctcttttccttccttccttcctcccttccttcctttcttctttccttctttctctctctctctctctcactgtgttgcccaggttggagtgcagtggcacaatctctgctcactgcaacctccgcttcccgggttcaaacaattcttatacctcagccttccgagtatctgggattacaggcatgagccaccaccatgcgtggctaatttttgtatttttaatagagatggggtttcaccatgttggccatgctggtcttgaactcctgacctcaagtgatcagcctcccaaagtgctgggatgacaggcgtgagccattgcgcctggcctacgtttttttttttttttttattgctaaacaattttaagaagatacttgaggaaaaagatctgtctcctcttagagaagcactcatagagaaccattgtgtgtggtttctgctcttgtcctgggttttgttgctgatccaattaattgtagaacagtgcctggaacgctgaaatagtctcacccaaattctaattctttgtattttaatattttgtatttgagattttgctagactgttgataccggaaaaactacaaatgctgctgttgtctttttttttttctaataagataggatctcgctatgttgaccaggctggtctcgaactcctggcctcaagcaatcctcccatcttggcctcccaaagtactgggattacaggcgcctggccacttgtgttgtctttttatctattaaagaaataatgggtcatgtgtcattttccatgctgatctgactttttgtttttttgagatgaagttttgctcttgtcacccaggctggagtccaatggcgctatctcggctcactgcaacctccgcctcctgggttcaagtgatctcctgcctcagcctcccaagtagctgggattacaggcatgtgccaccacactgactaattttttgtatttttagtagagacagggtctcaccatgttggtcaggctggtcttgaacccctgacctcatgtgatccacaacgcctgggcctcccaaagtgctgcaattacaggcgtgagcacctggcctgacctaacttttttagggagctagaagagttttgggcctttgcaagcctcctgtttgcctttatcctcatcatccgaatctacatttagtttattgtttgtgagttttttagtaaacagagtaagggaatggtcatgttacaattagtattacctctttctactctgaaaacttttcctcattcctcctttttacagtgattcagttcctaaatcatcgtttccccgctcacttctagaggatgaattggctggaatgcttttccagtgtaccactttcaaatccttgggattatctttcatccctcttcagggactgagttcctgctactctgcaacagctctctactacatctttcatcttcagttctctaatttaagttaacattcttatttattgaatacttatagttaactttaaagtccttttatggtaatcataaaaatataattagttcaaagaagagaacatctcttctgtactataaggtgaataatttcattaggctctgataaatgtgcttaagtgatttatactagctccttaatgccacttttcttcaaaacttcagaaacaaaaatgagtgtgaatcatttttccccccacaggcctgcaatatataggcactgatgaacaaatacctatatagtggaaactcttgagtaatttaagcatagctctttatcagttgttgaaacttcttcaaagtagtgcatggatcccagcactttgggaggccaaggcaggcagatcacctgaggtccaagagttcaagaccagcctggccaacatggtgaaaccccatctctactaaaaatacaaaaaaatttgctgggcatggtggcggacacctgtaatcccagctactcaggaggccgaggcagaattgcttgaacccgggaggcggaggttgcagtgagcggagattgggccactgcactccagcctgcgcgacagagcaagactccgtctcagaaaacaacagagtagtacgtcgtgatctatttctacataaaaagtaatccaacactgatttactgtgtaattagaagctgtagttcatattttacaatttaaaggtgtatttcatatattaaagcattttaatttaaaaaaaatcaacttttttttttgtttttaaagttacttcctatacttaaaacactgtgttctaggcatgacatcataaagtaaaattcaaccagacatctaaggaaaatctgttgaatgcctatcaaatatcaggcacttagctaggcactgactacaaaaaaaaataagatgtaatttttacttttaaggaatttaacatggataaattaacaaatataaagtcatgttttcttttcttttcttatttttttttttttttttttttttttttttttttttgtgacagagtctcgctctgtcgccaggctggagtgcagtgggacaatctcagctcactgcaacctctgcctcccgggttcaagtgattctcctgcctcagcctcccgagtagctgggactacaggtgcccgctaccatgcctggctaattttttttatttttagtagagatggcgttttaccatgttggccaggatgatctcgatctcttgacctcatgatccaccctcggcctcccagagtgctgggattataggcgtgagccatcgccccagccctaaagtcatgttttctgttgtcaggaagtttaacatatagtttgggaggtgaatttgagataagatggtagttgacatgatagtgtgaaacctttcccttttttttttttccaataaatttctccattgaagcctgccttaggaaaaattcatgtcaataataaagcgggaggggaaaagcatttcccagaaccccacatgagaactaccataaagctgggaatagaattaaggagtaacattattagctgataatggactgaatgagaatggtatagtgagaacctctgttttacctctgtgtgtcagagggcccagaatccttggtgtagtaatgatggattgtagaaccttccccaaatggcacagttgaaacttgatccaggaagcccaagtcattgccgttaagactctaccatattaggatgggcaggagaacctctcctagctgtatagatccggagttggcaaactactgcctgtgggctctattttataaataaagttttgttggaatgcagccacagtcatttaagtattttttgtgcatgcttttgcaatacaatgacggttgagtagttgtgatagagactgacccacaaagcctgaaatatttattatctgactttgtatagaaagagtttgctgacttctgatattgagcaagccctaactaggagaatattgtgggaacagcgtagtggccttagtgaaccacagtcttaatttctatttgactctttgcccttggtgctctaagagcctgaggaataaggttaataaggtgggggacttcagtgaaaattacttttccgttgatctggacttgagtaaatcctttgaatggctgggcaggaagttttgtattggttacctctttcacgtgtcaactgtcacagcagagatgtggaatttgctgggtactgggcatacagagacgcatatagtctatttaccttctgtcacatcactggcctgcatagtaccctttccacccaaagacgaatacgaagaagaaaacagtcctcattgagattgtgaaaaaattcttcagctcaagagaaggacattctcataaatatgaagagatttatgagtgtaaaatactttggagaaaaatatgtgagattcaaaggaacgtaaataagaaattaagacgaaacagttaacttttgtttcaagtgcctcttccaggcgttgtgctagctgctttattttcgtgtctctttcaatcctcacattaaccataaaagttagaaggaattatcctcctcttatgtgggggaaactggtgctcgaataggttaatttcctgaaagccatacaagtcagtagatggttgagccgggaattagtcacattttaggctccccttctttcttaaaaaaattgaggtaaaagtcacataacatgaaattaaccattttaaagtatacaagtatgtgacattgagtacattcataatgttgtgcaaccaccacctctttgaagttccaaaacattttcatcacctcaaaagaaaaccctgtactcactatttaccccccattttcccttgcccctggcaaccaccaatctgctttctgtatttacctattttggatatttcatataaatggaatcatacaaatcatacaacatgtgaccgtttgtgtttggcttctttgacctatgttttcaaagtttatccacgttgtagcatgtaacagtacttcattccattttatgcctgcatgatactgtttcgtgttgtatgaatatacctcatcgtgtttatcttttcatcagtcatggacatttgagttgtttctaccttttgtctattgtgactattactgctatgaacattcatgtacaagtgttgtttgaatttctattttcaattctctggggtatataccccaaagtagagtggaaatgccatgtttaattttttgaaaaattgcttaaactgttttccacagcagctgccctcctttacattcccaccagcaatgtatgagagttccaatttctcaacatcctcaccaactcttgtttcctcctccttctcctcctcctcattgagacaaagtctcactctgtcgcccaggctggagtgcagtgtctccctgcaacctccgcctcccaggttcgagtgattcttgtgcctcagcctcccgagtaactgggattacagttgtgcaagccaccatgcctgactaatttttgtatttttattagagatggggttttgccatgttggccaggctggtctcaaactcctggcctccagcgatccacctaccttggcctcccaaagtgttgggactataggtgtgagccaccacgcctggccaccttattattactttttaattgttgccaccctagtggatgtagtgtggtatcttattgtggttttgatttccatttccccaatgatgagtgattttgagcatcttttcatgcgcttttggtcatttgtatatcttctttggagaaatgtctattccaatccattgagcattttaaaattgggttgtctttttggttgaattgtaagagttattcatataatctgaatatagattccttatcagatatatggcttgcaaatattttctctaattttgtaggttgccttttcactttcttaatagtgtgctagatgatgtacaaggtttttaattttgatgaagtccagtttattttttcctttattgctcatatttttaaaaccattgccgaatccaatgtcatgaagatttatggctgtcttttttttaatggtacagtagtatagttttagctcttatgttaggttgttgatccattttgaattgttgtttgtacagttaaaaattgttttaatgaaattttatttttatatatttaaggcgtacaagtacagttttgttacatgggtttatttgcgtagtggatgaagtctgaggtttttgtgtaaccatacccaaataatgtacattgtacccattaagtaatttctcataacgtttgtactgtttttgtatatgttgtgagatagaggtctaacttcattcttttgcttgtggatattcagttgtcccagcacctggatttgttgaagagatcattctttccccatttactggtgctagcacccttgttgaaaatcagttggccatagacatgtgggtttgtttgtggactctcacttttattcctctgggctatgtgcctgtctttatgtcagcacttcactggttcgattactataaatttgtggtaaatattgaaattcggaagtgtgagtcttccaactttgttattctttttcaatactattttgtctatcaagggctccttgcaattctgtatgaatttgaaattttttttttcatttctgggaaaaaaagctgttgaaattttgatagagattgcagtgactctgtagattgctttgggtagtactgtcatcctaactataaattcttccaatccatgggacctttccatatatttaagtgtttaacttcttttagcaatgttttgtagttttcagtgtgctagtcttttacctcattggttagatttattcttagatgttttattcattcggatgccttttttgtttttgaggcagagtcttgctctgttgcccaggctggagctttttttttttttttttttttttttttgagacagactttcggtgtgttgcccgggctggagtgaagtgttgtgatcttggctcactgcaacctctgcctcctgggttcaagcaattctcatgcctcagcctcctgagtagctggtattacagatgtgcaccaccacgcccagctaatttttatatttttagtagagacagggttttgccatgttggccaggctggtctcaaactcttggcctcacgtaatccacccaccttggcctcccaaagtgctaggattgcaagcgtaagccaccgcacctcgctgctattttaaatgaaatagctctgttaatttcttttttaagaaattttttaaagatttttttaagctattttaaatgaaattgctgttaatttctttttaagaaatttttttaagattgtttgttgccagtgtatagaaatattatcgatttttttttttttttttttggagacagaggctctgtcacccaggctggctgtagtgcagtagtgtgatctcggctcactgcaacctctgcctcccaggttcaagccattctcctggctcagtcccccatgcagctgggattacaggtgcatgccaccacacccagctaatttttgtatttttagtagagacagagtttcaccatgttggccaggctggttttgaactccagacctcaagtgatctgcctgccttggcctcccaaagtgctgggattacaggcgtgagccaccacacccggccccagtttatttttttttattgtggtaaaatatatgtaatataaaatttgccgttttaactatttctaaggccgcagtttgacattaattgtattcacggtgttacgtaaccatcactactatgtatttgcacatttttttcattaccccaaacaggaactctctgccaattaagcaataactctctaattcccctatccccagtagttgtaacttccaacctactttctgtctctgtgatttttgcctattctagatattttatataagtggaatattacagtatttgtccttttgtgtccgatttctttcacttagcatgatgtttttaaggttcattcatgtagagtatatcagaacttcattcctttatatgactgaacaatattggaacaacatataacaatattatatggttgaaccttgaaaacatcatgttcattgtatatgtatacaacgaacaaaatgtgttgtatacatgtaattagacatcatctattaccattgagtattcgtgctgttacctgtgggttttataaatgttctttatcaggttgaggaacttgccctctatttatagtcttctcatctgccatggatatgatatgtggggggagaatgtacaccacattttgtttatccatttgtttcttcgtggacacttgagttatttatacctttggttattatgaataatgctgctatgaacattcacatacaagtatctgagtccttgttttcaattcttttgaatatatacctaggagtagcattgttgggtcatatggtaattacatgtttaatattttggggcccactggtttttgtgttttgatcttgtattatgcaactttgctgaattcgtttattagttctaatatttttgtgtgtggattctttagaattttctctgtataaggtaccatctgtgaataggggtagttctacttatccatttacaatttggacaccttttatttcttctacttgtcaaattgctctggctagaacttccagtgctttgttgaatagaagtggtgaaagtgggcatctttgtcttgttcctgatcttgagaggaggggttttagtctattaccattgagtattcatgatgttagctatgggttttaaaaatgtcctttaacaggttgaggaagttgtcctctatttctagtcttctcatctgccatggatatgatatgtgggtaaaggtaggtgggcagtttaaaatgcacagtgttatcacaaagcagctacctctttcaccaagccttcctctggtagttgtgagtttttgaatacctgcagagttgtggaaaagttgattctgatactttttgcaagctcattagttgtttttgtggagggacagagtcctagatttcccagttctgccattttcagtgctaacactctccagatatgtgttttgcacatatttccttccagtctgtggcatgtcttttcattcttacaatggtatgtttaccagagcagaagtttttaattttaatgaaatcctacttagcaattttgtctttcatggacagtccttttggtgttacatctgaaacctcattgccaaactgaaggtcacctagattttctaggttatcttctggaagttttatacatttgcattttacgtttaggtgtatgatccattttgatttagtttttgtgagacttgtaaggtctgtgtctagatcctttcttttgcatttggacatctagcaccgtttgttgaaaagattgctttccccattggattgcctgtgctcctttgtcaaagatctgctgattgtaattgtgtcgagtctattttttgtttgtttgtttgttttagagatggggtcttgctttgtcatccaggctgcaatacagtgatgcagtcatggctcactacagcttcaaactcctgggctcaagtaatcctcccatctcagtctcctaagtggttgggactataggctcatgccaccatgccctgctaatttttaaattaactaattaattatttttgagatggagtctcgctctgtcacccaggctggagtgcagtggcgcaatcttggctcactgcaacctccacatcctgggttcaagcacgtcctagtctcagcctcctgagttgcaaggactacaggtacatgccaccacgcctggctaatttttatatttttagtagagatggggtttcagcatattgatcatgctggtcttgaattcctgaccccaggtgatctacccacttcagcctcccaaagtgctgggactacaggcgtgagccaccgcgcccagcctaatttttaaattttttatagggacagggtcttgctatgttgaccaggctggctcttgagtctgtttttgtgctttattctgttccattgatgtctgtgtctatttttcaccaataccatattgtcttgattactgtagttttgtgttatcttaaaggggagtagtagtatcagtcctttcactttgtcattcttcagtattgggttggctgttttgggcctttcaatacaccctttgactttagtttgtcaatattcacagaatagcttctggggatttggattgggattgcattgaatctgcagatcaagttgagaagaactgacatcttaacaatattgagtctttttttttttttttttttttaattggagtctcactctgttgcccaggctggagtgcaatggtgcgatctcggcccactgcaacctccgcctcctgggctcaagcgcttctcctgcctcagcctcccgagtagttgggattgcaggctcccaccaccacgcctggctaatttttgtatttttagtagagctggggtttcgccatgttggtcaggctggtctcaaactcctgacctcagatgatccacccgcctgggcctcccaaagtactgggattataggcgtgagccaccgcacccggccaacaatattgagtcttataatctgtgaacacaaaatctctctccatttatttagatcatctttgattttcaacagcaatgaataatttttcacatacagatcctgcaaatattttgttaggtttataccttagcactatttttggggtgctaatataaattgtattgtgttttcaatttcaaattctagttgttctttgctggtatacaggaaagtaattgacttctgtctgttaactttgcatcctgtgaccttgctgtaattgtttagtagttccaggtttttctttttcttttttttgtttttgtagattctttgggattttctacatagacagtcatgtcatctgtgaacaaaacagttttatttctttcttcccaatttgtatatcttttctttccttttcttatcttattgtatttcttatgacttccagtacagtgttgaatatgacttatgaggtggggcatccttctgatcttaaggggaaggcgtgcagtttcttactgttaagtaccaataatgttaggttttctgtagatgttcttcatctgaggaagttcctctctatgcctagattgctgggaggtttgttttttttcttaaatcggtgacggagattgagtttcaaaaaacgcttttctgtatccagtgataagaccatgtgatttttctacttagcatggtggtggtggtatattacatggcttgattttggaatgctgaagcagcctttctttctttttttttttttgagagggagtttcactcttgttgcccaggctggagtgcaatggtgcgatctcagctcaccgcaacctccgcctcctgggttcaggcgattctcctgcctcagcctcccgagtagctgggattacaggcacctgccaccatgcctggctaattttgtatttttagtaaagatggggtttctccaagttggtcaggctggtctcgaactcccgacctcaggtgatccgcccgcctcagcctcccaaagtgctgggattacaggcgtgagccaccgcgcctggccttgaagcagcctttcatacctggtgtatagttgttttcatatattggcggatttgattcccttaatatttgttgtggatttttgcatctgtattcatgagaggtattggtctgtagtttgccttttgaaaaatatatttagcttattttggtattaggatgatactgacctcatagaatgagttaggaagtattccctctgctcctgttgtctggaagagattgtagataattggtataatttcttaaatgtttgctagaattcaccagtgaaaccatgtgagaatggagctttcttttttggaatattaataattattgatcaattttcatatacacaggcctattcagattattattttatgtgtaaattttggtaatttgtatgtttcaaggaattggtccattttatctaagttgtcaaatttttaggcatagatttatttataataatctgttattttccttttaatgtccatgtgatttggtagtgatgactcttcattcaaatctgatgtgaataatttgtgtttttttttctcttggttaatttggctagaggtttatcagctttattgatttcagagaagcagcttttgtttttactgttgattgttttcagttcattgatttctactgtaattaaaaattttttttcttctccgtgttttaggcttaagttgcccttctttcttttctttcctaaggtaaagcgtagattattgattttacgtctgttttctaataacgcacttgatgctataaacttttctctaagtgctgctttcatagtattgcacaagttttgacttgtatttttatttagtccaaaatattttaaaatttctcttcagacttctttgactcatgtgttatttagtagtttgttgtttattctctaaacattttgagattttccagctatgtttttgttactgatttctatttttattccgttgtggtatgatagcatacttagtatgatagctacaaatttattaaggtatatgttatggcccagttgtggtctatcttggtaattgttccatgtaagcttgagaagaatgtgtattctgctgttactaaagtattatataaatgtcaagtagatccagttgcttgatggtattgttcaattcatagatacccatactcattttttttttttttttttttttgcctgctgtatctatcggttactgaaaggggctgttaaagtatccaactatagtagtggatttgtctatttctgtttgcagttatatcagtattttcctcatgtattttgatgctctctagtttggtacattcatattaaggattgttatgtcttcttggagaattttgcattttgtaatgctattctttatcccaatgattttccttgttctgaaatctgctttgtctaaaatttatataactacttcaacttcctcttgattagtgttatcgtggtataactttctccatccctttacttttatcctatcccttccctccctgcctctctctctctctctctctctttctcttgctttgctttgctttctatttatttattaattatttttagatacagtcttgctctgttgcccagcctggaatacagtggcacaatcatggttcactgcagcctccgcctcctaggctcaagtgatccttctacctcagccttctgtgtagctgggactacaggtgtgcactgccatgcctggctaactttttgtattttttgtagagacagggttttgccatgttgcccaggctggtctcaaactcctgggcctcaagtgatcctcccacctcagcctcgcaaagtgctgggattacaggcatgagccaccacacctggcccattcctttatattcatttttttaaatctactctgataatttcttttaactggtgtattgaggccattcacagttaaaatgatattaatatggttgtattaatatgaaccatgtttataactgattttctatttgttgtacttactttttttttttaatcccctctttttctgccttctggttttaactgaccgttttacaggattccattttctctcctgttttagtgtctattatacttgtttttactttttttttttttcggtcattgccctagagtttgcagtgtacatttacaacttatctaagtacactttcagataactctatactgcttcttgaggagtgtaggtaacttttactagaatttttgaactcctccctccagtcccttataacgttactattattcatattgcttatccatatgctatactcagtcaataatagttactattattattttgaacagttatcaattaagaataggaaaaatagattttatcttatttattccttctccaatgctcttttctttctgtagatcccagtttcttacctatataattttgctttctctctgaataactttttaaagcatttttaaagggcaggtctactggtgacaaattcactcagcatttatctgagaaactctccttcagttttgaaggatcatttcactgagtaactttgaggtagagttttttttttctttcaacattttataaatatttcactctactttcttacttgcatggtttctgacaggacatcagaggtaattcttatccttgttctctataggtaaggtgttttttttcctctgatttctttcacaattttctccttgtgtttagttttgtgtagtttgaatatgatgtacttaggtgtagatcttttggtatttattctgcttggtgttctctgagtttcctggatatgcagtttggcacccttaattttgaaagattctttgccattattctttcaaatatttcttctcccttgtctcacttttctcttcgtattccaattacatatgttacaccttttgtaattttcccataattcttggatgttctgttttgctttttaaaaatctttattttgccgggcacggtggctcacgcctgtaatcccagcactttgggaggctgaggcaggcggatcacaaggtcaaaagatcgagaccatcctggcgaacgtggtgaaaccccgtctctactaaaaatacaaaaaaaaaattagccgggcatggtggtgcacgcctgtaatcccagctactcaggaggctgaggcaggaagaattgcttgaacctgggaggcgacagaggttgcagtgagccaagatcacaccactgcactccagccttggcgacagagtgaggctccgtctcaaaaaaaaaaaaaaaaagaaaaaaaatttcttttttcctctttccattttagttttggaagtttctactgacatatcttacagcctagtgattttttgctcagccgtgtccagtttactgtcgagtccattaaaagcattcttcatttttgttacagtgattttgatttctagcattttcttttaattcttccttagagttatgtatgcttacattacccatctgttcttgcgtgctgtctacttttcctattagagcccttaacatattaatcacagttattttaaattccctatctgataatccccaagtctgtgccatatctgagtctggttctgatgcttactttgtctctttagactatgctttttcttgctttttggcctgccttgtaatttttttaaagctggatatgatatattaggcaataggaactgaataaataggcctttagtgtaaggttatatgttaatctgtctagaagctaggtcatgtttaatgatgtaggtatagatgccagaggcttcagtttcctctagtgtctttgttattttatttttcctagtctgttgtctgtgggttctcctaagaactcctttataaatagtgagtctgtgtcttgcaactctttcagttgtaattctctgttaatgtactggagctctgttgacatgatgggaagagtatggcgaagggaagaaagtgttctataatctcattcttctgtaagacctgagtctttggctacaaccttcagaagtgtttccagccaccccttcccctccttttcttctgttagatgaaacaagaaggctagagggactgtctttggctgatttcctttctccctggacaccaaggctctggtaaattttctcttggactgttgacctttgttatgaaaaacattctggccttatttcaaaatggttactttcttcctctccctacctaaaagaagaggagatttttattagatcttacccctgggtgtatttcaaattaattttccttgtgtcttacacaaaaggggaggagttttttcttgggtcttcatagtcagaacctggtgagatttcctggaggtaaaactgcaagaacttagagggcctcctaagatttagtccccaggagttctcattcacaagctagtctcagttagcctttgtcaaaattatcatttaagttttcttactagtgtatgattccagtgccttctgctccaggtactgctgatcttggatgtgattctttgtatttgcctgtttctctagatttcaggcgattggttcaccctctgacctcaattccgtaaatccaagaaatttgctgattttcaatttgttagggttttttctttttttcttttttcttttttttttgagatggagtctcgctctgtcgcccaggccggactgcggactgcagtggcgcaatctcggctcactgcaagctctgcttcccgggttcacgccattctcctgcctcagcctcccgagtagctgggactacaggcgcctgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccagggttttttcttaatgtaaggacaggagtgatggtatccaagcactgtatgggttgatgctgaaactggaagtcctgtttacattttaaaattggaaatatcttgtccagtttataaataatattcagcaagaggttttttaactttcctgtgaaccattttcttagctgaaatgactcattcccagttattttcatccctttgaatttcaaatctctgtattttcatatgcttagtaagaactttttcagaacaaaatatttggaaaacttaagaactttatgtagttcttgcaaatggctactaactttaccctaaagaaactagaattattacacattttgatttccttttctcccctacagcattgttttttttttttaaccttctgtaaaccatgctcaagtagttctagggattattttcttcacttatttcaccccacttatttttgaagaagaactcagttttctaaggcactttgaaatctctagagactaagcacggcttaaatttgaaaaactaatgagaataaatgtggaactcttatgctgccaatggtttattttcaattaaccttgaagaatgtagtaattataaactacagatcgtggtgactttagcttaataggattagtttgagaatctgtgtgatagaggacaatttggctaaaatgtgttatttaagcaaccgagaaagtagtgtgtgtgtactttaaagccttataatttgattactggctacaaatttgcattttggtaggctttagttcttatccttggataacagttgtaactaacctcagtcatttgagacattataaatttcgttaaccttgcttcttttttagggttcattttaagttttatttttctcactgaacgtactgtgagaaacagccattaaaccaagaaacaaattagcagtatatttaaagatcgcttattagttagcagattaatgtgtttaataaatattttcctcttttctcatttgattaaaatgaatatttgtctttgagaattaaatatatttttaaaagaattaaaatgttaaatagaatgtaattttttttgtttttctctataaatgtaattttaatatactaaataaaatgtgttttaaaatgatttgccgtactgaaaggatttggttgaaaataattaatttttgctgtgtaataatcaattagctgtggcccattttacaataagatctatttgtgtagcatgctgtgaattagagacagaaaccttttactatgcttttgcttagagacctttattataaagaagtaagggccgtagagtggaaatggataaagactagcaggtcttcaggagtggcatgcttatgagttaagcaccatgccaggttccaccacccttagcagattagtgggtggtatcagtgttgctcctcccaaaatgtttttttaagaactcttcatgtattatgacagtaccctagaagaaacccacaagaatgaacacaatgtatagtaatatagtcttaacaaaatagcttccatgtgctaacaattcaactgaagatagatggtctatgttcagtaaatacatatttaagttgggacccctattgtcagggacttgacctccaattcccagataatgagggagcagcagctcattttttgtcctgatcttactacttcatgctatctgggctggcagatacccttggaaaatgccatttcattcactaaagcttcagtaccacagtgccaggattgattgcctgttcctctctccagagattctcaggaccagccccatcattcttgacatcccttactttttgtcaccaccaaaactcactggccatctgttagcacagaatacccatccttgtgctgctctgtaggttcctcagtctgatccagtttcctccaaccctcccactggcccctagaactcttgaataatttctcccatggcctccgtcttgccccagcatcacagtgtaatctcactttctgtccctggttctctgctgctgccaaatggatgcctgagggtagcccctgctctggcatcagtctcaggctgtgctgtttcttcctttgcctactacctggtaacctcactgcctgccttttagttccttgaatacagtgaggtcttcactcttaaaaatctttgcacaggctgcttccttcatctgcagcaattttctcagtgttttgacctggccgaccctatccagtctgatctgggtgtcttcgcgttgtcctctgctggggcctcctatttgttttcttcttggcacttaattaaatttgaagttgtatattcacttgctcactgagccttttttctggattctatgatatatatttttcctcatatttctgaaattgtgatgtatcttaaactggatttcttgattcctttctgaatggtaggtaaaataatggtttatcttacaattgtcttacatttaataaaatattgcacttttaattattgtttcccccggttgattgtgagttccacacgtataggaatttcattttactcaccaatgaaccagtgcctagcacagtacctggcacctaggaggctctaaataaatagtagttgaatgaatatcattatctatttgggagattttggccctaattttctcaagatgaattagtcagtgtgtaagtatgaattgttaattcagtttctgttgttgaatcattgttttcgagattcctttattctggaattgaaagagacctttagatttgtctattttgttcctccatctatgtaacttgccctattataggtatatgtacatccttgtttagaagtacttactcaccttgcatgaaaatgaattcacataaacttctacctggtgtgagcaattttctttcattagggagaaggagcgaggaaggtaccaaacagcagcagacttttgaacttgagacagttttggctgcttgaacttaacttttttcattttacttagtcccccaatgagtgcaatcatttggcatgcctacttcactttttttaagtgaactaacagcgaacaggcaacgttggtgactggagtgcctcaggcacctcctagagaaggttcaagcttagtccccagctggaggtaaggtgtggttctcagtccttttcatttccccaatcctgctcctgagtactgcagttgagtcagcctgggataatgagcagtttgcctttcattgaacactcaacagcctggttgtgaaaatgtctgctatgaccagtctttgccaatctcccatgtatgcttctgggttctgcagataatacttgtgtctcttcccccactcttgtacctgacacacatgttctacgtgatgtgaaaagaagagaagttgaacaggcaattgggagaactcgaagttgcccaaattgatgatgtcagtgtggagatgcacttgcagggaattgaaataaagaagttcaagtgtggccttgagaaacatggaagggtgagaatcccagggagcttgctgcgaacgtgtaccattggtgtcatcttcaggcctctgtttgaggtggccttcctgatgatcccgtggtctgtctatggattcagcctaagtgtggtttacacttgcaaacgagatctttccccacattaagtggactgcttactctctcgcccccggagaaaagcaccttcatcatcttcatgctggtggtgtccttggtgtctcttgccttgaacatcattgcgttattcagtgtctcatttaagagcatttaaggatcatgtgaaggatcaggagagtgatacacctggcctgcagagtccctccaatggctccatatcaactcttcctctctccaccatgtcccctcctggggacaagctagttcctggagaaagaaacaattcctcttgctgtaggcacaacaaggaagtgagcaaaaacccttctagttacagtgcatagcaagattgaatggagcaggcaggaagtaccccctctgactcccagtcttttgatttccctgctgataaacagagttcttaaacaaaagcaaaaacctagctactgggcactagccatggtaggccagcagccatcctgcagagccagtagtcatgccagcagcagcctgatgacctagagatcaagatgcatacttggaagcattatgattctgcttgattgtttaagagaaggaagtcgcagtagaaagcgcacctttgccccagtggaggtggtactcaaaaacctcagtcgtgagacttagcagacacaaagacattagactaccagggttcctgtacaatgagaaatgctaatttgcttaatatttgatagtaaactgctgtcatttttagctttattgcatgcaatgtagacctagttcatcatattacaagttctagagagtattatttattcaatacaggttttttttttttttttttttttttttttttttgagacggagtcccactctgttgcccaggctggagtgcagtggcgtgatttccgcttactgcaacttctgcctcccggttcaagtgattctcctgcctcagcctcctgagtggctgggattatagacgtgcgccaccacccctggctaatttttgtatttttggtagagacggggtttcaccatgctggccaggctggtctcgaacttttgacctcaggtgatctgcctgcctcagcctcccaaagtgctgggattacaggcgtgagccaccgtgcctggcctcaataaagttttaagaaagcaacctgtgtgtctccctcctgagagcttctggctgcaccgatctttcctagacttttaaactcttcattggcacatcttcatttaagcaaaataggctagaatcagaattttagaaatgaaattgcagtgactacattacagaaagttttagtattaacatttttaattatatgtagcaggatcacacatatacccattactttcaaatgtgccaaaaatgtagcttttttttttttttttaactgttgtacttttcatcagaagcttcttcccaccacagggcgctggagggaaggagaagacacagacaacttaaacattaaacctgcccatccagcatcttgctgtgacagtttaaacagtctcatttggaaaactcagtctcttggctaaatttccttctcataaacccttttatgagcatgaggaataatcacagttatttactaatgaaatgtgtgtgcctattggatactacaaaactcctgaaacttttgaatcagattggacgctgctgtcctcacttcctgtttcacattcattttcacatatatcttgctttttttcccttgaacttttaatcttgagataattatagttcacatgtaggtataagaaataatagattccttatatcctttgaccagtttttcccattagtaacatcttgcataattacagtatagtatcgtaactagaaaatggacattgatgtatttccattgaccttattcagatttcaccaattttatctgcactcctgtgtgtgtatgtttagttatgtgtaatggcatcacttgtgtagattcacatgtccaccacagtcaagctacagaacggttttatcacagggatcccttgtgctgcctttttatagccacagccacactcttgccttcccctctttctaacccctggcaaccactaatgtgtacttcatctctataattttgtcatttcaagaatgctattttagtggaatgatacaatatttaaccctttgagactggctttattcactcagcacaactcccttgagattcacccaagttttttgtgtgaaccaatagtttgctcttttttattgctcttttttagtatgctgtagtatagaggtgccagagtttgtttaccttttgaaggatctttagatcatttccagttttcatttccctgtgttaggtgctcaagagtgcagttgctgggttgtatggtatgtgaatgtaatgctttgtaagaaactggtgtatacttttccagactggctgtacaattttaccttcccatcagcaatgtgtgaggaatctagtttcttcacatgcttaccggcattttgtattatcactattattatttttatgttagccattctaatagttgtgtaggtgatcccattgtagtttaaatttgtatttctctaatggctaaaaatgttgaacaccgttcctgtgcttatttggcatctgtctattttcttcagtgaagtacccgtgccatttttccaattttgaattggattgttttattattgttgagtttaagttctttatatattctggatttaaatcttttgttctatatgtttgaaaatattttctcccagattatagcttgctttttcattctcttaacaatgtctttcatggaccaaaaattttaattttgttaaggtcatttatcaattttttttttcctatggactgtgcttttggtgtcaaatctgagaaatctgcctggccctagatcctaaagattttctcctttggttgtttctaaaagttttataagcttacattttacatttaagtccatgatctattttgtcaatttttgtacaaggtgtgagataaaggccaaagttcttttttcttctcccttatggatgtctagttgctccagcaccattcattgaaaagtctattctccctccattgagttccttttgcagtgaaaaatcagttgggcagatttgtgcatctctaattctggattctctgtccctcttctagtttctagatgagactgtataagattgctgttaattcttccttaagtgttaaaattctccagcaaacctatttgagcttgcagatttcttttattggaaacttgataattataattacatattcaatttctttaataattacatgactcttaaagttgtttatttcatcttggttaacttttggtagtttgattttcaaggaaattggtccatttcttctaagttgtcaaatgtaagagtgtaaagtttgtagtgttcctttatttatttttaatgactgcaggatctgtagagatcttccttgttttgttcctgatactgatgatttttgtcttctttctttttatctttaccagtcttgctagaagtttatcaatattaattgttctttttgtggaatcagccttttgcctcattgattttctgttttcaatttcatttatttctgcttttatcatgattatttccttcttgctttgggtttattttctttttctagtcttgagagaagaatttatcttactgatttgtaaccttctctctttttaaaaaatgtatacattgaatactataaatttccctctcaatactgcttaagctgcatcccacatattttgatacatgttgtattttcattttcatcaagttctatgaaattagaatttcctttgagactacttctttgacccatggattatttagaaatgttaggtttcatttctaactatttggagattttcctgttttctttctcttactgatatttaatcggattccattgtggtcagagaaaatactctgtatgatttcagctctttaaaatttgttaaggtttgttttgtggcccaagatgtgttctgtcttggtgaatattttatgggctcttgaaagaaacatgtattctgctgctgttgggtatagtattttatatatgacaatgagaccctgttgggtttcattttcttatttttttgtcttcaggaagttttaggattccatcttatttatacagttcattagtatatcagtttgtattgtgttcttagttactgatctaggtattaaaatatacatttgtatttaccacaatctattatcagtgttttaccactcaagtgaagtgtagaaatcttactctcctttagacccttttgccctccccacttaaaaaatatatatgtcttaagtatttcttctacgtacattgagcaccacatcagatgatgttataatttataatttttgtctcaaccatcaaatctgatttatgaaactcatgagcaaaaggatagtcttatattccccaccttttatttttgtagcctgttctaatatttttttcttaaattccaagcttctttggttatcttttactttcttggttgttgttgttgttgttgttgttgttgtttgagacagggtctcattttgtcacccaggctggagggtcacccagtggtgcaatcacagctcactgtagccttgtgacttcccgggctcaagcgattctcctacctcagcctcctgagtagctgggaccacaggtgtgcaccaccacacctgactaatttttgtgtttttggtatagatagggttttgccatgttgcccaggctggtctccaactcctgggctcaagcagtccacctgcattggcctcccaaagtgctgggattacaggagtgaaccaccacgcctggctggttatcttttacttcctatttagaaaactacctttaaccattctttaagggtaagtttgctagctacttctctttgttttccttcatctgcgattgtctttatttctctttcattcctgaatggtatttttgcttgatacaggatttctgattgacaattcttttcttttcttttttcttttcttttcttttctttccccttccccttccccttcccttctttttttttgagacagagtcttactctgcctccaggctggagtgcagtggcgtgatctcggctcactgcaacctctgcctcccaggttcaagcgattctcctgcctcagcctcccgagtagctgggactacagacacgcaccaccacgcccagctaatttttgtaatttttggtatagacggggtttcaccatgttggccaggatggtcttgatctcttgacctcgtgatccacccgcctcagccttccaaagtgctgggattacaggcgtgagctaccacgcccggccgacagttcttttatttagtgcttgaaaattgtgctgtttccttttagcctctgtggttactgatgagaatacactgtcattcaaattgtttttctcctataggtaaggtgctgtttttttgttttttagttttcaaaagtttcactatgatgtgtcttggctggaattactttgggtttatcttgtttggagtttgcttagctgcatgaatctgtaggttatgtcttttgctaaatttggaacttttccgttgtgatttctttgaatgtattttcagctctactctgtttgtcccatccttctgaacctccagtgacatgaatattaggtcttttgttatagtgccacatgtctctgagtctctgttcatttttcccccatctgtttcttttctgttgttaagattggattatttctattctgtctctaagttcacagattctttcctctgttttctccattctgttgtttagtccattcactgagttttaaatttcagttatttgctttatttttcaattcataaggtttttttgttgttgttgttcgtttttgtttttttgagacagggtgtcactctatcacccaggctggagtgcagttgcacagtcattgctcactgcagccttcacctccctaggctcaggtgatcctccacctcagcctcccaagtagttgggaccacagacgcgcccagctaatttttgtttattttgtagagacaggtttcaccatgttgcccaggctcgtctccaactcctggacttaagcagtcctcctgtcttgccttcccaaagtgctgggataacaggtgtgaaccaccatgcctggcctaaagttttttttttgtatcttctattaatttgttgagagttcctatattttcttatttggttcaagtatgcttgtaattactctaaagtatttgtatgatggcagcttggaaattttttctgtgatgattctaacatctctacagtcttcgctggcacctgttagtcttttttgcatgttgagatttccctactttttagtatgatgaataattttctactgaaacctggacattttggatgttatgtcattagaatctggatcttatttaatctcctgtttttcttggccttctttgacaccccttctggaaaggaggggaatggaagttgagttttctaattccacctccattgacacccactgagaggggctccttgctgctgctttgttgggtgggaattccagctccctaggcctttgctgaccactgtggctggagggccaggagtatcttgtgaccactccccacgttggcctccactgacaccagcctggcgggggattagacatgttctcttcgcagcatttgctggcatgggtagggccccagttttcactgttttgtggctggggtagagtagttattgtctaaggtcttttgtcctgctaggctgttcttttcctggtcctttagctggagaagagaaggcttttgttggggctctttgtctgtgcccatgggctcttctgggttctttattgaagtatttttattagggttgctttaaaatctctgtcagataattccagcacctgcttcatctcagtgttaatgtctcttaattgtcttctttcattcattcaggttgtgattttcatggttcctaatatgatgatttttttttttttttgtatcctggtcattttggatattgcaagactctggatcctatttaatgtgtgttttagcaggtagccacccagttgaggtataggataagggcaaatgtgtatattcaatttccctcttggtcccattgataccacctccgcaaaagctccacttttactcacgctgcctcattgtagatgggtgaggtggatgttcagctcctcatttggccccaccaacacctccccagtgaaatcggatctcagatttgcacctgccttattgcctctgctacatcttgcagacgctaccctggccggggagtcagaggtgctacggcctgatgggcaatgaaagattagctccttggtcagcctcactgatctcatcaggcagggaattctaacagtgccgcctgctttctcgggatgtgtatgtgtaaaagagtgttttcctacttgggcctgctgaaacctcagtggggtggtgctgcagtttttccattgctgcagtttttccattttctttttggcagtaccctccctgttgcctggaatagggagggtattgccagaaagattttcagttgttagcctacccttttcctggtcttttggctgaaagaacaggtttttcttggagctattttttttttatttgtctatcggtgccaggttgaaggcttttgaagcaccttattgggcatatatgggagacaataaggaaacccaggaacttgcctctcaagtgccgaagtccctatgcagtgtgccatcttctttccatcttggcttcctatgtacgtttttgtgtcacggtcaaggatttttagtcttaaggaagaggacctggaaggagtggggctgctccatcttgaccagaatgagaagtctgtgtgtgcatgtgtttaatatataatgaaaattctaaaatctgttaacaccgttttgtataatagtaacatattttaatatttaaagaataaacaataatttattcttcaaatatactatgtatcaggcacagtgattgacccttgggtctgcagataggactgagacataatccttactttcaaatagctgatagttttgtagagttcaaagacctgtggaatcaattttaatttgccccattatactcagatggaaaccactcacaattcttttagaaataaaaacagaatctagcttcatactacctggctggtagtattgtgggagtttcctcccctctcattggttgagataagcctcctttggtttatgaggtactaggcaaatgaggaagtggtctagtgcttagtgccttgttgttactctggttacaattaaaccctttgccaggagctgccatccagtgggtagtgcttccctggccccaactctccaggctatggtgcttagtaatcagacaggtggaatctccgcaagtaccacaactgtcagaagtcctgaacacccctctctgcctcatgcagaagctgtggtcccatgatcctcccactcctggaggaaccttaactctattggatgggaagttcagctctactgcctttgtgagtctgggctttataatcataagggctgttagttctctccatgggcaggagaaactagatctcagggatacaaccccatgatctctgagttcctttggaaatttggttttgatgatttgggaatgcccaaaagtagaacatttctgaactttctccttgatggtagtgggtgataatggtgatactgtttttttaactcatgtgtgttctaagcattttacttgtatcttctcatttaatcctaatagcaacctcaggaataagtgatattattatatctgattttctccggaggaaattgaggcacagagaagttaaggaacttccctaaggccactcaggtagtaggtggtagagccaggattcaaatgcaggcagtctagctcagagctgaagttcttcttacccttctttcagcgacgtgacaacctttgagttttactttgcttttctattatttgcttgaaattaagattgatgtatctaaaataagtgttctaggcttctaaaaagtgtcacacaattaaatgttactaaagtacgtttctaattagaaaagtttttgttttctttcttattaaaccacatagatttggcaagaagagtataaaaaataaccagtaataggttacatttacaactgtttggagtatagtcctttaataatcagatttttttgttcgtttttgtaagtaggaaacaatgattttgttagaaatctctgcttttggccaagtgcagtggctcacacctgtaatcccagcactgtgggaggccaaggcgggaggattgcttgagcctatgagttagagaccagcctggtcaacatagggagaccctgtctctacaaacagtacaaaaattagccttgtgtggtggcacacagatagtagcctgtagtcccagctactcagaggataaggtgggaggatcacctgagcctggggatgtcgaggctgcagtgagccatgatcgagccactgcactcccgcctgggtgacagagtgcaactctgtctcaaataataataataataaagaaaaataaaaggaaatctctgcttttttgtttggttgcttagggctcaataaaaaatttaaccagattatttctgattatgtatatctattatatatcacattttgttatacatttgtgatcatttctattgtttttacatgtctttgtgtttaaatacaggtagtagaataactagaaggatgtgactcacacgtcattatgtaaatattatccatgccagtacatttaaattctatagggacttaattgtaaagcagttataatatagccgtgttcctctgttgagaaaagattcatactgccctttaccttgctttttcagtgaaaatgtttaagttttttcgttcatttgaaatgtagaatcaaagtttcatttacatgcatattctatgtacttggtactataatcttagagtttgttctattctttgtaaacacagaatgtgaatataaattttctgccatgttttgttaggaataatgtatctctccattaatttgcatgttttcataccattgactcttaaatttccatgaacactagcccacaatgtgatttatctgaggcagattttttttcaaattcatattgatttatcttccatgccacttgaatacattttgttgatataataagattctttgctagttctagctcaagagaaaccacaggagtgaactttagaacttccgattagttcattaaatagacatttggtaacacacctactctagtgagtcctgttggttgtttggggtaaagggtgagaagggcatgatcagtgattacagagtgaccacactccagaaaggaaaggcttattatggtggcacagaaattggggtgtactctctgccctggaggtattcatggctgtcagagcatgaaaatgtaaaaaaacaggttatccgtttgaaaactcaggtggttggttcttttaacaagataatatttgtttttactttctgccatgtttaagttacatatcttctacttcttcttttttttttttttttttttgagacagagtttccctcttgtcgcccaagctggagtgcaatggtgcaatctctgctcactgcaatctccgcctcccaggttcaaatgattcttctgtctcagcctccctagtagctgggattacaggcgcccgccaccacacctggctaatttttgtatttttagtagagatggggtttcaccatgttggccaggctggtctcggacctcctgacctcaggtgatccacctgcctcagcctcccaaagtgctggattacaggcgtgagccattgcacccaaacaagttacatatcttctttctttgcccagcatgtcccttgtctcatttcttattggtcactgtaagtttcatcagaggtatttagaacagctgaactgcctaacccatccatcacatccttttggtgggggcctttctgctaggtctcaggggcacagagttaagtgaggtacctaccctcatggatcttaatcaccgtctggctgggaagtgaggccgcatggcaaagcatagattccagtgcagttgtggtgagtggtttgctggaggtgtgaatagggtcttgggatcacgaaaagaggagtacacaaaacaagctggggggatcctgcagtgcttcctgcaggagggttttgaaggagtaaaaggagtgaactagaagtagaagggctggcttcttgtcatttcagtaaagctaaaacatcacctccttaggtactgcaccagtactctattgaattgtctgttttgttaccataatcttgttctgttatttgtttccttgttatatgtctcttccctccagaatgtaacttctttgtattcccagtgcctgttacatagtaggggcttgaaaaatgtttattggttgaataaatgaatgaatgaatgaagaatgaatgcttgaggcagagtgtgagcagataaaagcaagtgtatgtgaaggcttagttgagaaactaactgcaaatgattaggtgtgacatgagcaagggagcttttccttacaaattaggaggtaaagcatggaattagaatgttatcctgaaagcctccaggctgcatgatatgtaatgcagcattcttttcctgaattcctctgattaacagctgtgaatattttaaattttcattatgtgcaaaactgatgatcttactgaggccttttagagaatattatttaaagaggattttaactagagtgcttcagtgatgttcttgacatcaagtaaccagacacaaacattttattcaggtttacagtgttctttggctaattctcttgaaacattgaattgcttgagacttacgtgccactcttgtttcaagacaacagacaaaacttttggtagttttgtctcttcctccttttgctttagtgctcaaggtgtggtgtacattggtcatcaggccaatatgatggtgataaacagttcctcttccaggcctgtgtgataatacagtttaattgagcagacttttagttacatacgtaagataaaatgctagatacttggatgtaagacaaactagacacatgttaggaataacacttaatatcttaaggaaattgaacacttgaacaaaaggatttttagcaaagcaattttgtttttgcgcagaggggtgcctcttcggccagttgtcatgagaatatacttgaacaaagggcacgagagtttttatttttgacgcgagttttgtttttgtatttttttattggccggggttgggttgtataatttaaattaaatttggttggctaaacatttgattttttgttttttagatagggtgggcacttaaaagaaagtagaggaaagggaaggggtgtttgtaatgagctagaaagttttttttttttttaaataagggaaggaatgtgagctggtattgataacgcttggtattgaggcgtgcctgggcatttaacaaaggcaaaaaggaaaaaggagaaaaaagggagggatactatgaattaaagaataaaagattgaccagattatctgaagagaaaccttattatattttacacatagctctttgaaaaataccatgggctgctgatatatatctaatagccttctctttctctgctaagagaaagtaaatctggcattttctagttttctccacaatgtataataagatatgaggagttattacaagcttaactagatgctttgaaaatcagattttaggaaaagaaaataaaaattgttactacctatgttgaatgtatttttcacttttctctgtagatatggttatggcaaaacgctgtgacttggaacctttttcagatttcagttgtcctattctgcttccttgcctgctttgtgagcacatctatcagaaagtgtggtcacaggatttctagagataacccagcgcagtgcttgaatagggagtttctgtgtttctgttctatacgtcacagtctttcacatcttagcagtgttgtagccattgcgcacctgagcaccttgtgcctaggtagcccgaagatgttatacagaaacaaattgctgtttgctttctttgaacttcagtgttttgttaagctcgtgcctgttctaaagcagccatatctctcatgaattggaaaaaattaaaccttggtgcattggctttatttgcgattttagtattctcattttcttattttataagaaaatgtaaaattaggatattgtatttgccagaattcaagacttatagattttatatacatgcatgcacaattcatcagtgtgttgatgaataaaaacaaaacagaatcaagcatttttttattgagcactaatttattaccatttttgctctactgtctctaacgtcagcagaaggtatgagtatatacgcatgggtctggcttttgttcaggctctgagtaagcagtgagcaacttgctctgtagtagctatgctattgttaactacctgtacattgtttatacatgaataattgcaaaaattaagtatactgacttcgatggtctctacataacttactgaaacaattggtcataagaaaggcacagtcagtccctcccttgataaaggaatctctagcaagctctgtcactcattcaacagagcaatagatttttctcttcatttggaccatgcatttttatgctgatcatcagtccataattttaaactttgttttttattctgtcaatattcttgaatctttatttagcagggataatacttttggaatacctgatgatgtatctttggtcaataaattggtttttgtcttctgatcttttcttttatcatgtccccaggaaagagagcaggatgaatgccactttgtagggtaaattccttgagtattaaaggagaaatgaaggacagcccattcaagtgtcaaaggaatgtgggaagaacaggcagagttagagcaggcaggtggtcaggtatatatttcttgtcattccccgcccccatcaccttagggaactgaaattcaaggtttagggggtgggtaggttgaaggtaagccaaaagtgaaggaagcttatgccccatccccctcttgtaactcagggaagaaacagtctttcaaggctgctttaacacaatgtaagcagccacagcagaagaaaatgtagcatgctgtggttaggtaaagaggactgccaggcctcctttagctggtgagtggcttctgaggaatcccaaagttacttcacactccaggtagctgggttgagagccagtgaacctgtcagtgggaaagatgtgttgaggggcaagctgatacccacgctgtagctgacagccacgctgtagctgacactgattgagctaggtcttgggtgtaaatgagattaaggagtctagatgtcttcggcaccaattagagacagatcaactggggtagatccctgggctctgggccaagagagcacacctgagtctacagcctccttgagctccaacagcagcctcaggccagtgtctggggtccacgcgtataaggaaccttgtcttggagacctgagaacctctaccttactacggtgaagttctgtaaccccacccacatccatacccacagctgccatcttggtagaagcagggagaaaatggaaaaacttaacatttacctgaacaagactataaaccagaagggactgcactaccatataatgcaagttaaagtcaagtgtgggggcttgaaaagcaaggttaaaacagttacagaaaatttaaaagctacattttcttggcacgggttaaatttagtgagctataaattactgttcctgccgcagcaagatagtctttgaggatatatttcctgcatttaaatttaaattttgtattcttcattcacagtggaacatagcttttaagtccaatgattatctgaggtttagattgcctgcagttggcatgcctaatgccatcttggtctcagttacttgatcactagaagtgaaattttcattttctcgcctcagtgttataaaataaggacaaaatgaaatagtaacacaattgcacaataactgcagtatagacgtgatggttaatactaaactgaaaggctgtctgacaggcatcactgccatgtagtcttcaaaattctcattcatttgcagacaatttggtgtgaatttggtgtagacaaggtggtttgagggtatctacatataatgtttgaagatgtgggttttaaataaaaatgagatgcatctcaaattttatatgatctataagtatggagctagactgttttgaaagttcacctttctctctttccattgaaaattgttggtattttctgccagagggattaaggaaaattgttctctgaatgtctcatttttcattttgataactatattttactttttgaacattttattaattaccgaatctataatatgaacatagggtagtaaatttatattagtcctggaactatgaggtaaattatttttaagtgattcatcttgaattacccacttatatacaataagatgtacccatttttagtgtatagttctgtgtaaactagccctcttagttcattctttggcattatcagccagcgtcccttcaggctgatactataatagttacaatggagcatattacaagtacttacaaaggatttctggatatgtgggtttgtttgcatttatcaattaagtggtccaaggcttttaatatggttttgttctcacatttgcggcactcaaatatcagccatccaaggtggccccaagtctcatagccttactagataccttgacattattattattattattattattattattattattattattatttgagacagagtctcactgttgctcaggctggagcacagttgcagcgtctcggctcactgcagcctcaaccttcctggcccaaaggatcctcctacctcagcctcccaggtagctgggactataggtgtgcaccaccacacccagctaatcttttgtagtgtgtgtgtgtgcagagacagggtttcaccatgttgcccaggctagtattgaactcctgggctcaagcgatttgcctgcctcggcctccaaaagtgctgagattataggcgtgagccaccacacccttccgaaactttctaaagcatagaaaagcagatctaatatgtctcctagggaatctgtccttaaaaaaaccgaaatgtggccagcttacgactgtaatcccagcactttgggaggccgaggcgggtggatcacaaggtcaggagtttgagacaagcctggccaacatggtgaaaccccgtctctactaaaaatacaaaaattagccgggcatggtggcgtgtgcctgtaatctcagctactcaggaggctgaggcaagagaattgcttgaacctgggaggcggaggttgcagtgagccgagattgtgccattgcactccagcctgggcaacagagtgagactccgtctcaaaaaaaaaaaaaaaagaaagaaagaaagaaagaaaaaacccaaaatgtatatatttgcattctgtgttcttggctggttggtttttccttatgtaccaaggaatgtctttttcttttaaaattatgggaggaaaaagtgttaggctatggtagaattagtaactgatatccaaagagaagaatgagccaggccaacaggatatatgttttacattggcaacacaatacagtaagatgtttggactagctgttctccttttttgctgagcacattttggaccagttgcatttatttctcaactacaagcttgcagtctagtagtagagtcagaccttgatcaagtgatcatgtaaatctgtaaaggtggaactttaatgcaagttataaagaagaggcgcttgctgagagaacaccacagggccttcagatctcatcgaggagccgtgggaaggctcctctgaggaagtgaggattgattgagccaggatctgggggatgagagagggttgagtgggcaagggagggcaaagcttgcaagaacaaagggaatagaccctaaggcagtagagaacatggcaaggagagatgtgactcagcaagcaaaggagacctagggagaggaggtggaagagctacctggcctgccatgtggagcagctgcgacggagttgtcaggttagtggagttagggagaattttaaggggaatggtggagcttgaaatcagatttcctttcccaaggaagaacctggttgctgaggggatgaacatatcagaagggctgtggcagtactgaaggtgaaagtaccaaaggcttgaccaggggtaggaggagcattcaggtacaggacagtggacccatttgaaaacaatgtaggaggcaaaacccaacagcacttagtgatagactggatggatttggtggtgcagacaagggagatgtcaacagtgatcccaaatttctggctagtgtttactgagatatatgggacaggagacaggcccaggttttgtaggggaagatgcagaaatggttaggcattctgtctgaatattttacactcatacattctcattttacatctcaataaaagattcatggagggcagatccagcgcagagatggtagaagagattttatgtcttattggaaataatgagaaaacagagttgttgtgttggaaatttatcactgacttggcttgaaggcagttgtgtgtgtgtgcgtgtgtgtgtgtgtgtgtgtgtgtgtgtgtgtgtgtgttttggagacagagtctcactctgtctgcccggtggctggagtgcagtggcgtgatcttggctcactgcaacctccgcctcctggattcaagcgattctcacgtctcagcctcccgagtagctgggactacaggcgtgtgctaccacgctgggctaatttttttgtatttttagtagagatggggttttaccatgttggccaggctgttctcgaactcctaacctcaagtgatccgcctggaaggcagtcattatctgtacaaagtctctttgtgagatcccacttcccatgtcttcctttttggctacctgctgtctcatgttcttgataaagtattagtattttcataagactatcctctttttagaaacggtacatgaagtaaatacacagtttttcttgtaatgctttctaaattataagagttttcttaaagtactcttagcgtaccatttaattctaattttgagcaggttagagtttacatcaatgtttcctgtaataatagctccatcatgtcaaccttaataggcagttttgccaggtatttatatatatatatttttttttttctattatacttttaagttctagggtacatgtgcacaatgtgcaggtttgttacatatgtatacatgtgccatgttggtgtgctgtacccattaactcgtcatttacattaggtatatctcctaatgctatccctcccccttccccccatcccatgacaggccccggtgtgtgatgttcccctccctgtgtccaagtgttctcattttgccaggtattggtatagacttggtgggactccgctaaattgtttttggcctaatgaaaaccattcctgaaatttttaggaaaaaaaaaaaggatatatgttttcagtataccttttggtatatttcactgtctttttttttttttttttgtgagacagagtctcactctgtcgcccaggctggagtacagtggcgtgatctcagctcagtgcaacctccaccttgcgggttcaagtaattcttctgcctcagcctcccaagtagctgggattacaggccctcaccaccacgccaggctaatttttgtatttttagtagagatgaggttttgccatgttggccaggctggtctcgaactcctgacctcaggtgatccgtccgcttcggcctcccaaagtgctgggattacaggcatgagccactgcgcctggccatttcacggtataatattttaatggaaccgtattacaaaagttattataaaactaatcattgttttataaaaatgagtgtagacattttagtgttgtgataattttaataatttttggagaatggatcttttaatcttctttttcaattaaaattttctttcatagcatattaatcttttcagtaaagctttacctgatctcttcaacaagtgatcattctcaaatttttttttattatcatactttaagttctggggtacatgtgcataacgcgtaggtttgttacgtaggtatacacgtgccatggcattctcacatttttaagggggaatgtttgtacggaaataccacaaaatggttaaaatgaataaactcgagcagagtttcttacccttagcacttttgacatttggggctaggactgttgtagggactgtcccgtgcattgtaggatgtttagtggcactcttggtctctactcactcgatcccagtagcgcccccagcctatgtgacaaccgaaagtgtccccagatgtcttggggggagcacagtcaccccccaagggagaactattgaactagatttagtttttaatgtcagatacagattgtattttttttaagtgtttgaaaaaagatacatgcaatagcatatgctagttacatgatttttagtgcacaaaacgatacaatttatgggcagattcattcgtagtgataaaaatgtgtgggaatgatactatcaacttcaggatagaaattacctctgggtagagggaatgggaatgaatgaagttttatttttggcattttacatttcaaaaggcaggagatccacagcaaataagccaaaatattatcaactgttaaatctgaaggggatatacatttttttctgtatatttgcatgatcttttttgaactcctgtggcatatcatataacacttgttatactttttagcttttgtcatgcatttttaacttactgtcatgcgttattacataccaggttgtagacttctatgtatataagacagcttcatttactcactcatgtcaaacacaggatacaaaagaaaaccttacataaagcagaggtccaataaacatttgttagttgactgattgaaacgctctttttctttggtatagattttttgtgtgtgtgatttggtctgaagtattgaaatttagcagtaaatctaacttttagtattgacaagctatggtagttttcaaataacaaataatataagtcaagatctctaaggaatttcctggagaaatctagcttttatcactgaatatcatggatggtattttatatttctatagtacttggcaaatgcatattagctctgacctgctatagaatgtatcctgtgcttgaatttcctcccattttataattttacttataatgtaaaaataaatacttttggactaagttattttggaaggtttctacacagtaaaaaagataaagatggaagtaatgaaatacttgcctgtacttttcagtgtataaatattataacatattattagaaaactattttgaaatgttcattggtgctaacatttctcttcagtgatgtgtgtgtgtgtgtgtgtttcagaatcactttctacaacaaaatttacatacacatggcttgcaaagacagtatagcatgattatggttgagaaatggcattcagaatcagtcttcctgggtttaaaatctcagctctgctacatcttagctgtgtgatcatgggacaaattatggaacttcattaaaactcagtatcctcatctgtaaaatgagcatgagatctcctcagaatgatgatttgagaattaagtgagataatccacgggaagcacttagggtggggcttggtgcaagagtacttaaaaacaataacttaaaatgaagcttactttttctgggaccatactggtctataaagtagtagtttcccagcctggccaacatggcgaaaccctgtctctactaaaaatacagaaattagctgggcgtggtggcgtgtgcctacaatcccaactactcagaagactgaggcaggagaatcgcttgaatctgggaggcggaggttgaagtgagccgagaccacgccactgcactccagcctgggaaacagagcaagactccgtctcaaaaaaaaaaaaaaaaaaaaaaaagtatcagtttcacttgatcttagccagaaggctgagaagcgataaagtagtaatttctgtgtttgtagggttttacttatgctcagggagcagacaggatatttgcaaataaaacgtgaacagaaatatttaaaatactttagttatgaagttatattccctgctatttggatgatgaaatgaagaatttctcccaagaaagcacttcctcagagagcaattagaaaatgaattgtagactatagatggccctccgtatcagcaggttccacatcgatgaattcaaccatctgaggatcgaaaatattcagaaaagcagacaaacaaaaacaactaaaaatacaacaataaaaaatacaaataaaaataacagtattacaactatttatttgcatggcatttacattgtactaggtagtataagtaatcaaaagataatttaaagtatataggcgaatgtgcataggttatatgcaaatactgtgccattttatgtcagggatgagcatccatggattttggtatcctcggggatcctggaaccagtggccccctctatatcctcgtagatactgaggaataactgttataaccttttgaaatggcttaatccgtgaatagtagaataaaagagtattttattctgttctgtttcatgatacctgttggatattttaacttagcaaaacatttgaaaaataatgactcctgcgacttccttatacagtatatgatcagtttaaagacttcactgttccagagcataattaagttatataactgcattttaaaatgacttagtaaattgtatggctgttaataccaattagttgctttgccagaatcttaagtaaggcacaattaatactgggaataaaacaatgacccagagctttagacagtcagcaacgcaagtgagttgatgattataagtctgtctagtatgattctctagtgattgaggcttgatttttatggggtagagatcttgagaatattgaaggaactgtaggctctccagatatttgtatttgttagtactcataacatttattttttattctctttctgattttttttttccagctggggaaatttattctgggaaatgtgaaatgccttgatatagtttgtttactcatggagacagtagtacaattcaggaacctttatctaaagttacctagtctctctgtttgtgttccaaagtacataatacaattctaattttaaggtagaattaagggtgaggcatggaattatcattaataaattactgatatatttgatcacattcttagtttattgcttaagatgtcggcttttaaatacttcatattttaaataaagacactgaaacaagtaacaaactatgcctatcttgctaactacagctggtgacattctgttgcagacgttgtgggggcaatggtatgcttttatgaataaattaaattcaaaacaagtttttcagagttattttttgtatgtttttctctttgtctacacctttattatatatcgcatctcagggtggtggtagaataagtaataaagcttggcgtgttacttcctacctctccattaaatacccacgaagatgttaaatacccatgaagttctgcagattaagaaactaaacatcgaagattgctagcaaagtccagggagaattaattttattagcaggactgggttgaaaacatagtcttgaacatcatgctgttcatcctactttgtgaacccaaatcaggccagatatccaaagggagtaggaaatgccttggacccatgctcacaggaactgaaaaataagcaaccatctcactgaggttaactataatctgacactgctagagctggagttctcactcccctactagcctgcattaacatctgcatttccagatctttgcagagactaaaatgtcctaaatatagtaagggaagaagcaaagaaggattggaaaaagcatgtaccatcctaggattcggagtccccgtggcaaagtgtggtgaaggtaaagggaagggaacaggctgtgcttggaaatgtggtctccagaatgccacgaggtaaacagctaatgaatggcatgtgctcttctggcttactcagagaaccctgcccaggcagtttagtctcagaccagccaaccccaatgagaaggatgtgtgctagcaagccaggttctaaaatcaggctggggtgcatcagttcatatttgaagttcaagttgaggccaaatgccagtcctggtggatctctttccatcttagtaaggatgaggttttttgttttgttttgttttgttttttgggagatggagtctcgctctgtcatcacgctggagtgcagtggcgtggtctcggctcactgcaacctctgcctcctgggttccagcgattctcctgcctcagcctcccaagtagctgggattataggcacgcgccaccatgccgggctaatttttgtatttgtagtagagatggggtttcaccatgttggccaggctggtcttgaactcatgacctcgtgatccgcccacctcggcctctcagagtgctgggattacaggcatgagccactgcacctggccgtaaggatgagttttaaagggtggagcagagaatacactgaaaagatatgggaagagaaaacatggctgtgaagatttacaagcaacacatggttctgaaaatgaccttttctttttttttttttttctttttattattattatactttaagttttagggtacatgtgcacaatgtgcaggttagttacatatgtatacatgtgccatgctggtgtgctgcgcccattaactcgtcatttagcattaggtatatctcctaatgctatcccttccccctccccccaccccacaacagtccccagagtgtgatgttccccttcctgtgtccatgtgttctcattgttcagttcccatctatgagtgagaacatgcggtgtttggttttttgttcttgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatgcccagtaatggatggctgggtcaaatggtatttctagttctagatccctaaggaatcgccacactaacttccacaatggttgaactagtttacagtcccaccaacagtgtaaaagtgttcctatttctccacatcctctccagcacctgttgtttcctgactttttaacaattgccaaaaatgaccttttctaacaaaccaataaagttaaggcatctgcttagtctcccaaaagaaagccaggaagatatgacctctacagagagtgaataagctaaaacaaggcaaaaaatgcagaagttggctgagataaggacaagtgaaagaagcctaaaatggataaaacaaaattgtttagcactttcgaactgattaatgttcgtttactaaatgtttattgaacacctactatgtgcctgctattctaggtgctgatgatgcaattgtgaactttgcatactaagtacaaaaacttagtacaagactaagcaattatgaaagatccaacctagaagttgtaaggtttgtggtggaaaataatagaaaaataggagtaggaacaacgtttaaggttgctataagaagactttcctaatttcattgatttccaggtattattgattcaaaaaatacacacacacacacacacacacactcctctaaatatattccaaataatttaaaatttttatttcaaagaaaaggaaaagtcctaacagtatttaggcagaaaaaaagaagtgatctatattggaacaaaatccaaataggcctcatacttcttttctactacaaataccagagactgtcaggtcattgttccccatttgatgccttatgtgatagtattataatttctttatgttagaaaatggcagcccttctttttagacccttaattttcttcttcttggaaaaatatcctagtatatagattttgttacaagaagacactttattcctacctgcattaagttgctttaataagcatacagactctggtgtctgtgatgtgaatggcattttccagggctttatggtgcacttaagcttccagtgactctgaagaataaaaggttgccttcccaagaattctgtgcctatcaagttgccatgtatacgtgaagatgttcaaaaatgcaaagacttgaaaaataggacactttgtcagaaaacctttcaaagatgtgctctggctgagctaaacatgaatgcaaatcaatcactcaaatatgtataaaccatacaagaaaaggactggtggtaaacagtgaaggaaactgaatatgtaaaaaaaaaaaaaattatagctcatgtatctataattacaaattaaattcaacagtcaaaccctcctctcaaaaataaatatatttaacaaaatggtataagaagaatcagtgtcaataacctcagattaatttaaaacagtttaaggtcacaatactttaaaaactggttctgacataagaacaaatcagtagcctatactagactaggctagagtccactagaaatctctgaaagcacatctagtatctatatgtgaggatgctaagatgtaacaactaaaaatttctggtaaagggtattgggaaaattgatttagtgtttagaaattatattaaatctggattccctcaacatgtcatatattaaaataaattacaagtgaataaagatttaaggaaagaaataattaaaatatcaagatacataaatgcagatgaatattaaccatgctcaggctaagtaaggactttgagcacaaaagtaatggacataattacaaaggcctatatcagtaaacttgactatgtaataatttatattcaacaacaacaaaactctagtgatcacaacaatctggggaaaagatttgtaacagaatttgtcaacaagttctcatccatgaatcaacaagaaaatattaaccctagtggacccgatttcacttattaaaagaaagcttctctaatctcattgaatgccagagaggtttttttaaatgattttattttgctttggcagtgggtgtagagtaaatattcttatacactgctgaagggaactgtgacatgactttttttggatgtcagtttgtcattatatattgggagcctttaacattcataccctttgaaccaattatatcacttatagaatttactctgtggaaataaagatgcagatgttgaagtatgttcattaatagacttgttaaatagccatccatgaaaaatggtggttttaaaaataacagcttgaaatgttgcttacataatatcaagtgaaataaaaacaacatacaataagatgtccaatattactactaccatttgagaaaaatttactggaagaaaatataccaaaatattaacaagggttaattttgtaaatgtcttctctatatcctttttgtaccctttgtattctttttgtgttttctgtaatgagtttatattatttttataagcagtttgaatacatgtgaaatgttaaattctttccagtatcttctcttaattgcatgtgtttttcactaaacactgaattggtttaatgtagaaaacttcatctgttcgatttcattctttaagtaaatacataaaccatatcgggggaggcagagaaagtgagttttgaggagagaggattttcatggtattcttgaaaggataaataaaagaatacacattttatttgacccccattagccatctgctttatacagtaaattgtgtttatgagatgccagagaaaaataactaatgaatttattcaaggtggtataaatgtgccagttacaaatttaaatttgtagtcatatcagtggacagttttgaactgagtaagatcttttataaaatcagacaaagttttaacgcttaggatgcaatgaaagaaatgtatgtgggagtctttcagttagaatagaatataagatggaacactacctggaacaatattcatttgagatgtgcgcagtttttctctattcctggaagctacatctttgttctgtgagaaaagcaagaggaggttcctgatatggtctgtcctttcagttatgctgtaggtagattgctagctagagccatttgaaaaggagcagggtaagaacatgatatcaatgtattatgggagagtagcatacatgaaagagtcacctttgtactacgtgggataatattccagctgataatctcctgcattacttaaaattggcagttcttccttcccaataataaaatacctggaagaaggagtttctttaagtcagaagatccattaatgtacaaataagttgtaccctatacatacaagtaagttgtctctaccctacaatcctgttccttcattaaaaacaaaaacacagtacctttaagaagtatctttttcctccataatttatagcacttgcctggtattgtgtttaattttaaagtttttgttttgatgcagggacaacgttttattaaatattaaaagatttgatctgaaagtgtccccacttaaagtaaaaaagaacaggcctgagtcattcagaaggcttttatatgacatgttggctttgaagaatttgtattaattattttgccaaaagcttttttattccttttatagaccagaattgaataaaaattgtttagtttagtggtacttagttcttagcatttccatttcctttccagcccttgttttctttcctcccaaccaaaaacaacaaaaaagattttcatattttcttttaaagcagaattctgttatttcttctgttcagaagagataagggcaggacgaaggtgatgattggtatttggtgatggaatgtttatctcactttggatttgcagtggccatcaataggggcgagctggtgaaaattagatatgcttgttagcattctgctaccagcaactactgtgtattggagaggccctttcttggtcttagaaggccaattaaaatgtgtctctggacttcagagggcagtacagatgacagtctgacactcatcctggcacttttgagtatcctcaagacattgacactaatgatttatgagttacgcatattctgtcaccatatctgctctttgctccacaccctctccctttctcctttcccttccttgacaatgtttgtggggtgataagaaagagattttggaaccaagaaatgagaggtggcgggggagaggaagatgatatatttttaacactctggcttcttgctactctgtcccagaatatacccccaggcaactggaatccccagtcggaaaaacactggagaatgactttccttctgcttcttttcccttgcaggaaacacatgaaattgtggcgatcaagaaattcaaggacagtgaaggtagatatatatatatatatatatatatctgtatatatgtatttttccttctgtataaagtttttatacatagagtgtggaagaagtgggatctagctggtcagacactgtctattcctgatattttgaagtcacaatctcagaaagtgaatatagcttatttcttatgctttgctttcaaacatttagttccttttatgtgaatcttttcaaatctcatgatattagaaaattcatctttttattttaaggttgcaagcagcattggaaatcttgctccaaaggctggttagaaggcatgttgtttatgctgtttctaaatattattaaaataaaaaaactggcttcaagtaaatacttctgtgggtccacataaatagcaagtactacatgaaagatttcagtattggttacggtgatctccagctcctagtcagagttagaaatacaaggatatattgagggattgattttatatttagaataatgcattgagagaataaaagctttttaagaagaaatactatgcttaggggccttcatcacatccagaccatttcagacagagttgtaaaattaccccatgctgggcaagaaagtttaaaataatgcatttcagtagttcattagttttaaaatctagactgttggccatccaaagatagccaaatagagaaactgataacaaaaataggtatggcctttaaggtgctctagacaacatttttttcagactttttggactgagacccacagtagaaatatatttcatatcctaacccagtgtccgcacacatatgtaacactatatgtaaatgaagcaaaaatgtcacgaacttcatcttatgaatgtgaagctctctactttctgttctttcctgttcatgtaaatgcctattgtgacatcaaatggattgatttcactactagtaagtcagagcctgctatttgaaaaactatggtctaagagtaagaagtaccaacacagcatcaatcttcatatctaattagaagtgtggaaatagcagtcatagcttaccttcatcagcacacatcccctaagtgatgtaagacaccagcctctatatttatgaacagtttcatcaccctcacctcaaagacttagcaaacattaaataacaaaaagggacttgctccaggatagatgtagtagtatttgatgtaatccatctctgatgtgctagttatatgaaacacatgcatatcagctgggaactttagcagtcattgtatgggcaggcttaaagggaaggtaaaaagtggaaggtaaaaaagaactttttgcttgttctggggggacaaaaaaatcttgcttcaaatgggatatttgtggtctagcaggaagcagtagctccaggctatcccactgtgataccattggaaatgagctctttgagcagtgactttgggtcagcaggtggctgagagacaaatggtgatttcctaaaaagaatggttgcaacagtagatcaaagcacaaccttcgcatgcatgtaaaggcttctggctgtgcattcatctttcagggcatattggcaagcatcagttaccaccaaaaataataactgtcatcaaattttgtaaaaagtacaatctaggccatgtatgccacctttttttgtttatgagacagggtctcacactgtcacccaggctggagtgcagtggcgcaatcttggctcactgcaacctccactccccgggctcaagtgattctacagccacagcctcctgagtagctgggattacaggtgtgcgccaccatgcccagctaattttttgtattttatttgtagagacagggtttcgccatgttgcccaggctggtctcaaactgctgagctcaaagtgatccgcctgccttggcctcccaaagtactgggattacaggcgtgagccaccttgtccagccccattactttctttttaagtaaataccatgttctttataatctctgtcttgtgcataccaattcttagcttcaattatatatttttacctgtgttaatgatacctttagagtggaaatctagtgtatccgttgaaattcattgagcactgagtgaagtgctgtaagagttgaggtgtggatactttcaagaagcatatgacctattaggagaattaagacctgcaaataaataacaataaaacacagtagaaaacagttattgcctgaatggagacatggaacttggatcattttgaggtgagagaaactgtttctggacgtggtattgggagttcatgaatagtctagacgtggaagacatttgatctgcccttattttattgaaccaacaaaacattaatctgctctgccctcatctctgccagacccttatcactcaccatccctcagaggcatgcagccttatcacccaccccaccttgtcaatgacacctacgtaccacctacacatacttctagagggatacttccaaaacatttctgtgctagaacccaaaaacataaccaattattcataaactttttcattccagtctggcccacttacctactgtttacatttctcccagggagatactagtactctcttttttctgtctttacccttttcctctggctggagtagtgtcttgcttaatggaaaaaagggtacatgtttggtgaacaactcttttggagtgtgaagtgtatatagatagtctcattcaggtaaggatgtctattcaacccctgggtaaaccatttaattctcaatcagtttattaaattttagccaattataataaaaaacagtgtcgtgataatattgccctcattgtcatgtagctctcattaatcccctttattagttattcttgaaatattcatttgatattatggcagtgattatctagatctaatgtttaaaagtcttagtgaagataacgaaataatcctgtaaaaatattgttaactgaaataggatctgcacttggtctgagccatgttcaaggtaatccagtgcagatgctccttgacttgtgatgaggccacatcccagtaacccatcataagtggaaaaaattgttacgtacaaaatgctttggctgggtgtggtggctcacacttgtaatcccagcactttgggaagccgaggcaggaggattgcttgagccaggagtttgagaccagcctgggcaacatggcgagaccctgtttctacaaaaaatttttaaaaaaattagccaggcatggtggtgtgtgcctgtaatcctagctactcagtaggctgatgtaggaggctcgcttgagcccagaaggttgaggctgcagtgagccgtgatcatgccactgcactccagcctaggcaacagagtgagactctgtctccaaaaaaaggctttactacacccaacttaccacacatcatagctttagcctagcctcctttaaacatgctcagaacacttatgttagcctatagttgggcaaaatcatataacaaagcctattttatagtaaggtgttgaatatctcatgtaatttattgaatactgtagtgaaagtgaaaaccagaatgattttatgggtattcaaagtatggtttctcatgaacgcatatggctttcatgccattataaagtcaaaaaatcgaagtcaaaccattgtaagtcgggaccatctattctctcactgatatcacggaatattttgtgagaatatatgttaatttctggtagctttaaaagattatgctaatgtcctactttcttgttaaattcatatatattcacaaatttataaaaaatgtttgtgaaactatattttgttagactactatttagttcaagaagtctttattatcccaggatgatagatcactatttaaaatgggaatcaaaatttcatagtaaataaaagtttattttgggactttaagtggataaaatgaaactaaaattatgaaaataagtttatagttaacacaagttaggttatagtagtaactaatatgctatttcaagaaagaatgaagtgttaacctttttgggaggaggaacagtttttacagtaaaattgtaggctaggccaatgaatagcttctatagtaaagagggtcattaagaaatatacaaaaagctttgtcagttttctcttcttcttcttcttctttttttattcctgtctatgtgtcttctttttcaggctgtgtgtgtgtgacagggtcttgctttgtatcccagggtagagtacagtagcatggtcatggctcagtgcagccttgaactcctgggctcaagcagtcttcctgtctcagcctcccaaagtagctgggactacaggtgcgcaccaccactcccagctaattttttcattttttgtagaggcaaggtctcgctatgttgctcaggctggtctcaaactcctgggatcaagagatcctcctgcctcagcctcccaaaatgctgcgattacaggcatgagccaccaagccttgccttttcgaggtttttattttctagttgttagcagatacaattctatcagacaatttatcagtgtctttgcctgtgattctctctgaaagactttgacaccctgacttggggatatagactcctattaaaaaggaagaatgtttgagtaatgaaaaattttgtctgagcttacttcattagttaattttttcttgttttgatgacttctgtttgttgacccttcataaatttggagtctgtgataatgagttctttaagataaccctaaatgatggtattataagtttggctattaagttcctgcagagaaattttatctagtaaacacctgaccaaccagaagtctccattgtattcgttctgctcattgtaatagttctgctcattatttggattttctgagaagggaaaaaatgaccatagatcataaagatactagagattatttagttaaaaggtacttttcagactatgtataaattataaatttagtccagttcttctaccctttctatgactcccatcttctacagtgagatttgatgttcagatgataatgtatcactgttgttttgtcaagacaagtacaagtgtctgctgtcctcaatttattaaataacccaagagcgctgatttagattatatagctttggaccagcaagaattcaaaatattgtctgtccagcctttactttaggaaaacctattgtctagaatttatttttgacatacatttggaccttctttttgcttctttagacttttccatctttccttaaatgtaaggtgatggagtgaggggagagcctctctgcttgtcactgggcctctgtgcatggcaaggaggctgactccagggagctatacactagtctacatttaagatgaaacttaggttgtgtctctgcttttatataaaataaaattacttgcatttcgtattctgctgaatgttttctatagagaactattttcctcttggaatggacatattcttcttaattattagaaaacatttaattgatcatctgttctgtcttctaatttattttattcttctgtttacccagacactggaaagctctatactgatctctggatcaggagtactctggtctcttattttatataatggtacaaaaccagagttcgtaatctggagtccttaaattcaagagcctgatttctgtgtgaaagaggccttgaaacaaaaagtccaacccttgattaaacaaataatttgattaactgagcttgagcattctggctagtcatgattttaccacacttccttttcatgttcaacatggacctccttcagacttcagggattcttctaggatttggtgatcattttgcatcttctgtgatttaataaatttctactgtgcttttacctgttcttcatctctaaagattggagggtcctcatctttcttggtgtatgtaacagtagcactagcattcaaactccctcagccacattgtctgtctattgatgtcccttcttcaataagagcaaccagactcaaatatggtacccccgtggttttgatcaaggatgggttgatttttctttatcagtttatctgtgtaaaggtccatttggggtggggggctctttggctatacaaaaatgtcaggtttgtgatttcacaaagtaggttacagctattcctggatttcctttctaagcccacagttctttaaaaatagagttacaatagagtttctgctcatctttagatttttctcttttcatcagttatctttgaatctcctttgctcctgtgatctttcttcttaagaattgttctctttagcaaatcgctcttgatttttaggtgtgttaacttgccttactggtaagtttagaagtaggacagtttttgggttgtttttacttaacatcctttttccaccctgccattttgtcctcactcagtggggtttctatatatctgcacataactttgtcagagttgatcctgcattcagctaaaccccctcagtggtaactgatgacaagatgggtcagcatgcacataagcagttatcacatagaagtatggactcgggaagagtccttctgaataatccagtataactcagccccagtatacagatgatggacctcaggctcaaagttgcatagcgtgtatgtgaataattgcaactaaaatgctgacccaggatctttgttgagtttttcttccacccatactatgccgccttgccgttcagctaaatggtagcatagttatacctgaacctgggtactgtgactcactttccaaaactcactgtattgtatactatgccacctttgtgcctgtgttctactcagactatgaggttgaatatgaccctccattcatgcaccctgagaaagttatcctttctagacttgatttcttcatttgtaaactggagcccagccttgataaagaatcctagcctagacaaagaatccacggggattatttcaactagatggcagtgatttttgtgctcatttcagtgggctgtgctaccaccctttgaaaatgccttactgaatgctttttgtaaggcattttgtaatgccttgcaaaatgctttcctactttgtgtacctctgagaagagaagcctgtgtaattggaatgtgccttccttctcccctcatctgataatttagttgacagttttcatcataaagtgcagggcaggccaggaaccttcaaagtacttagaaaaacaaaattataggatgtacccagtaataatgaagagtgcccattttgcttgaatttagggaattaactccactttctgcctgttcccattcattgcaatcttagtgctcaagtgtttacctcaacttttaatactatgactggcataaagtagaaaagcctttatttcctaaaaacagctgctccaatgaggttgtttgggcactacattctaggtaattttgtgtgctgctttttgatgattcatttatcttctctaaccattgttaagtggagtcaatacagattcgaataatgtatgtataacaaagcagccaagttccatgaggtttaggctcataatcaatacaattttaatgaaaagaaataatagattattagacttgaaaaaggcaataggatttttgggagatggaggcatttatttgtttcttttactgatgaaaagttaagtggcttgcctaaagttgcatggtgtactgttagttgattaaaagaccgagtccagaatctaggtctccctagttagtcctggtccactgttccttctactaaaaccatcctgatgcagccattctgaagagggtttattcattagcaaagtgaaactgccacaagttggtaataaataatagtacgatgttttttcatttgcatttccagtaccaagaattcacaaagcatcatagtttatggacgctcttaatgattttatttttatttaggtatttgtgtgcatgtacttgtgtgtgttcttgaccctgagcactgtcagtgttctgtatcctccatcatttctaatcacatactgtagaagacacctagggacagaggtgaatagggagaagagaaaattcagtttatcgtactgcctgataagcggtgcttgaggaaattgacagtgctgtaagaaaactgagaggcaaagtgcctattgtttgccctcccgttgctgtggctgaagtgaggaagagttacgcatgtatgggcagagatttccttatggccacaggtgaagcattcatgtaggaagaatgtattgatcacctctccttgtgtcaggtacagtcctggtgtatattgttgaacagaagaattgagtcctgtcctccatgagctcttgatttagcagggatggctgcatagattgcataccactaagcaaacaaatatatcaagaaaaatggtaagaagttctgtgaaagaaaagtccagaactgtgataaggaataatggggatggaggcctacttgcttttgtggtctgggaaaggctctagaggagtgatatttaaactaaaacctgaaggagcaagccctgtcaagagcctatgtagtagactgagcattgtaggcagagggagcaagtctgaaggccattaaggtggaaaaatgaagtttggggctattttgggaactgaaagatggaggtgagggagagggacatgagatggggatggaaaggcaggcacagaccaggtcatgagtaatcagtagacttgtctcttgttaaattagtcccttgttagatcatttgtttcttatttgagatctgtgtgttattctgtttcttagagatagatggattttagtttgattaccccaaccttgagtaactcagaggggatattagagaagcatgttctcgatcttgcttctttaggaaactgccggtgttcctgtgcttcagcagctgcagctaccttagcattctaacagtcacagaacaccactgttctggctcacccccaacttgcagaacacctggacctttgtcccctcccaatgctctaagctactttgggatgtccccgattgcatctcagacattcccccactgccaggtgacatccactgtcatgctcttttccctgtaagtacccagttccctgttgactgccttggtgtgatccaggtaattcgctgcttatgccacagttggcctttcctactgctggttcttgtcttctcataggcagtatctctcttggtcctaatctgtgttccagtgttctccaacagctttctggctaaagtagaatacttcatttatgtaaccagttcacaagggagtgttgactccgtgttcccagtttgttatggatactcgggtgctacaaagcccttgcttttatgtcattcccttttctttaaactcagtttgagttgggggttgggaaagggggctgggatagaaaataatctgaggaaacattcctgggtctgcatttagaatcttccctctccctttggaatccattcagcctttttcctcctgcgtgccttggttagagagcctttcttctagagggcatatcaagtaggcttccgtgcccctatctccacactccattttcctccttctcacactgaaagatgtgtctaatcctgagggtcacacagctctcaagctaggattctggcccttacccaaaagcttgtggctacatgtgttttagacttcataatttttggattttagaatggacgtgtggcatgttataatgcacagcactcagtaatcaagtagtatttctatagcacaacatatgaatgttcatattagattggataaacaaagactttatgtagtctcctgtcagttcaggtgttacctctcagtgaatttgccccaaacttagaaaaagctttcagtttttagactgtgttttggattttggacttgcagatgagggattatgaacctgtatcctggtacatacatgcaaaaacatggtagttaggatttcccgggtaaatctaaaggtataataaaaactaatttaaatagaaatattattttcatcactcccctgccaattaatctattagagttaatatgacttctgtccttcctccataaccacggagattatcatgaatgaagttgatggtatggaagagggtctattggttcagcataagttctccatcccagaacagctacaccatctgggatggacagatggacatgccacagggaggacagcaggaacctacagcagctgctgttcagagagaagattagacactctcagaattccctgcaacttggctgtgacttgaattgtggatgcttggcgcatgacctctgctccctgaggtgactcatgcagcctgaggaataaaatgtttttttaggccaaagtttcaggccatccttaaaaacatcagctactacagatgccggctgcatagaggttcttctgcacactgacagttttgattccttatggcccttttaatctctttccttccttgtatagagtgttatagttcagatgacaatggaggcatatgttgtatctataagtgtgtttttatacatacacgtagtaaaagaagtataagaaaatttttatacatacacatagtaaaaggagtataagaaaatataagcaggaagtcaagtttgtgctgatcaagtaaaccctttcttcgattttcttattcttgatcctttcaacaagaaaacgtgttatttaatattccattcttgtacttcttatgcagaagtactcaaagcagaaggtgaaattgggatgttttcagtgttcttggaattctttgaatagtagcttgaaagttttcattttagtctcttcaccattgtttacattctagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaagtaagtcattaattgccaatgtgcacatttgcccgattcttttatttaaggctgtttctgacattatttaagaaagtactgttatctaatatggcttatcaatgtactcataatctgaggactttaaaaatgaaagtgttgttaataatcattagaaattctgaaatatatttaagaattttgtacaattaaactgtatagagataatcgtaagtttaaacaatatactgatttggcttctgaagtcttaaactctatgttcaacaagtaatttttagacttgacttaactaagcctaaactgagggagaaactggtaaactgacagtgatggtacaggctggaagaggctgtataagataccacactgaatcagacctaggctggggaatgagtgggcccaggaagcagcttatgtgaactgccaatgctttggctttatttgagggaaggagctgtgccaggaggcctaaggtgaggcttgaggtggtagatgagaccgtaaaagaaaagcatgcattgtttgagctgtctacacttgccttagcttgtattaaaaaatgttcaacttgttggagacaattttaataacatgacctaagggcaaatgtatgttacagtaatcaataatgtgtgcctagaaatttcttggagaggggcctggtgcagtggctcacacctgtaatcccagcactttgggaggctgaggcaggcggatcgcttgagcctcaggagtttgagaatagcctgagcaacatagtgagaccctgtctctaaagaaaaagaaaaagagaaatttcttggagagcagctgacctacagcagttgttatggtcaaaaacttaaacagataaacactttaacagtagtagaagaaactggagtggggcaaacctttaagcaagttttcttgatgagtaaataggtggctcctgccgattcctatgctgttgtccaaagaaggttgaagtgggagaagtttatgtttgctgcaggtctatacccaggtgcttgctataccataaatgacagagtatcaacattgtcataaccaaatggaaagcagtattgccagggtaactgaccagtaatgtggctttgaatgcattcagcctttacaaattgttttttgaaataaaaaaaaaaaatacatgtaataatttccttactagaaaaactggaacggtactagcaggttgtttgtaatcttaaaccactgctttatgttccttttccagaatctgttttaagtttctttttctgtgtcaacttatacattcctctaaggtaccttccacaccaaaataaaactaaaagttttttttttttttttaaagttctattaaaaaaaaaggattgctgtattaggattccaggggaaaccagatgctctttattttttaaaaactttttagagatggtgtctcactatgttgcctaggctggagtgtagtggctattcacaggtatgattatagcacactgcagcctcaaactcctgggctcaagcaaatctttcacatcagcctcctgagtcgctaggactacaggtgcgcgccaccatgcctggctgctttttattttttcattatcataaataatcatgcagtttgtagttttcactaccaaataagaaaattttgacatctcttagtttatcctttttatttttgttctattcatggtggttgttcattattaataataatttaatataacaaatggagaagtcacttctgtgtatctgtttcctcactgggagaggcaattttgtgtgtctgagatctccctgctggtaaatggctgagctgctactagaactccagtcttctgacagtcaggcctgagattcttcccccgatcctgtggttcttaggtagaatgtgactgtcacacctgccacattagtggcagtgcgtcataattgacagtgagtctcaggagagcaaggagaaagttctctaagggataagggactggtaacagagacccaggattgcagaggcttaaaatagaagtttctttcaccctcacatataaatacaaaggtagggcagtacaggactagtgtggcagctctgctccaccacagcgaggtgtgacccttgtcctcaaggtcaggatagagttccagctgtcatatcccattggccaggacatagttgcatgaccacattagctgcaaggcagaagagaactgtactcttcgttctgggcagcacttgaaaattgtgttcctgcggagtaagggaagactggatactggaggacaatatgtctgccactgaggaatttagaatagaatgtgaaacaagagatacaatttgttttctatattacaaagccttcttattccacctgtgcatttgggaccatctatgaatttgttaattgaaaaagagaattcaaatggagaatcaaaaaatgatgcatacatacttaaaatgtttattttaattggaaacataaatactgtatgtattcatttaccacgctataaaggtagggtcaaggccttttgcctatcgctcttctgaagttctgattggtcttttttacatacatcatactcgtaatgcatctttaaggtaaagcaaatgtgcaaaaacatctgcaaaggaatctcagtgcagaatccttcaattggacatgcttatccccactagcacccattccttgccagtgttttgtagttgtctcacatttgattagatggcaataagtttagtggcttttcatttattaagcctttctaaagtattcaactttgttttcttataaacaacaactctttttttaaaaaaacattatttcatttgtttatatggtatttaattatattaaaataacaagtgcatcttttataaataggcatgggagtaaatacaactgattcttgataggtatacaacttgactggtgggaacaaaactgtgaggccaaattagagcagtgattttctgactggtcttatggccccttcacactctgaaaattattgggaaccctaagaactttttatttatgtgtattttatctattagtgtttctcatattagtcatgactgagcaatataaaaatattagttcattttaaaataacaataaacgtattgcatgttaacatagataagtttgtatgtcagttattctttcaagtgaaaaatggcattccacataaaaagcagctcattcagcttgcatctcaatcctctaagtgcttttcctcaggacaaccattggacagatggtgcatgtgcagcagaagggctttatgtgcagtctgccattttatcatgcagattccaaaaaagacatgtactcaagaattgaaatttagtcaaagtaatattttgtactgcttcatcaaagatgtccttaactaaaacgtctgttttcttttttaaaggcaaggtttaattggattaaagaatccaatgccttgattcatgctgaggtgccagcagtttacccattgttgctttgtaccattagtgtaaatgccaacacagtgaaaaaggcaaacatcacagtcttattatgaatatagttttgacttcatgggccctccgcaagatctgagaccccacagatccacatgttacactttgagaactgctgtcctagatggttgcttacaaacaataagctgtgattgtaccacgggccttgtactttacagtgagaaaggagaatggttaatctggaaattcagtagagaccggctaagtggaatttctacataataaaaaattttgcatgaattttagttataatggtctctgactccaaattaaggtttttgaatattgaattgtagggggtctgtgactctttatttcaatagtattttctggcctgtttgaatttttgtactaaatgtattgatcatttttaattttggacatttttttttctactaagaatatttcgtggatcttccaggtgtattttcaaggcttgatttttatcacaagattctgttgcagagatacagcacactgtgtttaaaaaggctctttcccccctttatacattacagtgtcatatttctactttgtattgcttttctcttctaattattctaaaataatgcctgaaaacctttagggagagtgaaaagtatacagggttattatttggggtagcattagggaatagtaaaaatggaattcctcataaaagaaagccccaattttaatgctgattcagcatgagaaagttgtagatagaaagcaaaacaattaaaaaaaaaagctctgtattggatgaattattctagatgctttgtaaaattgttaatacataatttacgggcctacctaatttgggaaataatgactctatttaatttttagaatatgctcgaattgctggaagaaatgccaaatggagttccacctgagaaagtaaaaagctacatctatcagctaatcaaggctattcactggtgccataagaatgatattgtccatcgaggtgagtatgagatttttaaaatggaaaatattaaaacatcaaataaagttaagagtatttcacatgttactgtctttaagaatattttcataagcattggcattgccatttaaattaaatatattttgaaagtgcaagacatgagaaatatttgctctccatatctccttttctatcaccaaaaggatggattacaaatttatttggatattgtggtgagatctttacatttgtataactattatagatccactcccaattgtagaaatgcctagtgatataagagaactcaacaaatgtgaactttgaaacttacttggggataggagaagagcaaaatgttgatctctatagccttggtcctgcaggtagaccaggtaatgtgaaacaactctgaatcaggctttatataggtggttcctaagtcactggcccctattggcactcatgtctcattccttcttacaccaacaatctccagtatgtatcttcacctcctaattttctctaccccttagtgaaaagtgcccgttgtctgcagttgcaggcatgatcaaccttgcataaaggtcataattatactcccataaactgttttgtcctttactgccatgaagtgggtggtttatagcaatgaaagggaaattacttgctcagcatcaactttgtctcttctcctgataatctttcttgcactggagagttttacagtagtgggacacaaattgatacaacaatgaccctaaatatttatttaaaaaattgcagtatttactttttgtctttagattagcagataaaagaatgctacattttaatttacctatacacaaatgcacaaggatatcactttaaaaatattctcacttgtgagaatagtttaaaggtcatatgaagaatgccatcgtcttttattcctagaaacagtttatatttctcttgcatttgactctcatagcagttaccttatcaagattgttggtagcatgggtagatctccacgtcaactggacatccagtgtctagggtaatgattctagtaacagtctatactgtagtttggggatattaatgaggagccgagttaggtgcatttccatcatgatactgtgatttgattatgtgcatagtgaatcattggttgcaaattaatggtagaaaccatgatttgaaatctacagatttcactacctctgccctttctccatttgcatctctaccatatgatatagatcatgggtattctactctaaaaatacaattgcgagatgcctcccaaggagagaattcaactgcattttctgtgaatttctacttaactcccaccacatcttcataacatccatggaaaaaattagaaatcttaatttgactcatccagtatggcttcagcattagacattgataattgtgaaccatgcagaaaagctaaagagacgtaaatatagaaattatgtagaagaatgtaacagaaagcatgtcttgtatgtcttctccagtaaatataatgctagctacttattctcatgtatttttaaagtatcttgtgggtgtaaacattttatatttctatctccaaaaatttgtattactagtattttatgaagtaataataggtttttgaaatgtgttggcctatatttaattattcttaaaattctttcagagatccaactaatccttttaatacttaaagaggaaaaaaatatttttgaagttgtggtctgcatgtttctgagaaagaaattcattgaaacttttatgtaccagcataaaatgtgttactttatttttgctgccacagttttctattcaaattactctagatatttctaattagatgctattacagtgatctaacagtgtcaatcaggagaacatagaacatttttactaattttttttttatcttgacactccagatataaaaccagaaaatctcttaatcagccacaatgatgtcctaaaactgtgtgactttggtaagttaaaaagaaattaagtcctggtacttacagaattaatttattgtaacacataggtagcttttaaaggaatattaaaagtaattgttatgttttgacttaaattggtagaggaacattcttttgagtcacatgttgaaaaattgattgctggaggagtactgctctcttcagagtattgtctatttttaaaattttatcatggtttttgtttaatcagaactaattcaaagcaaatacacccatatgcccaatatctaatgacttcacaaaaattttttttgaatgttgatagttgttccaggtttaatcatgaacactaaaatatccctctgtaaatacacataagtattttgtatatgcaattgttatatatctataaagtcaaaagacatttttagaacattttcatttgttccctctaaatgttcaatgaatggggttagtcatgtataatattacagcttttgattgaatgtatagggaaatttttttagttgtactctctcctagtagaaaattgtctgtgtctcccatgtagataactctgtattaagctctattaaacatttaaattaaaataattcagaaaaaattttagattgtatgttagggtcatgggtcactttttaaaataatagttttgcctaacctgtatgctgaaaaatgaacacttgattttttaaatgtcttttttcatatatttaaatataatcacaaatacaatgtaaacctccacatataactaagaatccatctccttataaggaaaaattagattagattagtgcataggagatgaattacacaagcaagaaatagaggcattgtcaaaatttgcttcgtagaatgacccattttgtccagtgtagcaaatggaagcatgtgtagctcttgtcactcagtattttcaaagattttgaatattattaacctgtttgtctgagaaaaaatgttttacaggacttaattttcttcatattttatgataaggaatgatatgtaaaagagtctgtgtcctaaatttataaagaatgtacttaggaaaaaggaaatattgaatactggatctgaaagattttaattgtggcatttttagcattttgttagcattatgattttcaggaacaacatctgtttctgatttcctgtccgtgattgtgattactacccaaaacagagacttaagttactgaaaatataaagcaagttataaatataaaagaatgcccatagaatggttagtagtaggaagagtactcctggtctggcatttctcagagaaaagactgttgtaaatggtcaggaagttcctcctggcagcaccacatgcggtatcctgtgtcctgtgtatccctagcaaggacttcctaattgcttcccctcccagagtacgcactccttggtctgacttgaagaaccccattcaaaaatacaaatatttcttcaaagcgtgtcttatgaagaaacattgattatctgaagttaggggttttgttttacgctgggattgtttttattttttaccgtttcattttaagaaacagtattttccatgtctcaaaactgacgtacaccttgatttttactcttaattttaatgttctgattctctataactattcacagtgaacctatgttgtgtttggtgagttagatgggtgattaacttatcctcctgccttattttgtggctatgcagtagccctaaaaccttttcaaagggtgggggtaaaagtagtggtagagtctgtaattggtaactaagatacccctaatattctcagtcattaggagatgatagtaattttggcctgctttgtttccatcactgtttatgtaaaggctagaattgctcagcaacagtacatatgcaaatactgtgtaagtgccacatagcaaaattaatgaccgtctacaatatgctagtttgactttgattttgatttctagcttttgtggggactttatttcatttttttcctaaggtttgcatttattgggagagctgatttaaaagtatgctctgaataattataaaagcatgggatgacttcgaaaacccggttttctttagcatagtgaagagactggttttgtagtgaatacattgtatgtctttcaattgacatggaacactctactaactttttaagataacaaggatattattaataaatagcccatgcgagaacagtcattacattcttttgatgttgtttaaagtattactagcgctgaaatattttgcccacatgaattattatttctttttcaaagttacaactttggactttgctatctttcaggttttgctcgtaatctgtcagaaggcaataatgctaattacacagagtacgttgccaccagatggtatcggtccccagaactcttacttgggtgagttaccgtcccaaaatagaatgacatttccacatctgctgattctattgtcatttgctttgagttcatctatggaaaataagaacttcagttaattaaatgtgtcagttacatattgcagtataacaaactacctaaaacttaatggtatgaaacaagcacctttttgtttgctcagaattctgggtgtgggggaatcaccagtttgagttcagctggatggttcttctactggtctctcttggagtcactcacgaagttatagtcagctggtaggtcttctgggagctggttagtttaggggtctcagctggatcagaccatctctgatccctggaaacttatcctccagtaagctattccaagtttctaagtgtgatagttggagaattctgtgctattaagagggtaagccccaaagcaacagcagctttcaagcctttttttgtatggcttttgcctcgttggccaaagcatgttacatgaccaacccctgattcatggtatggagaaataaattccatctcttgatggggcaagtggcagagccatattataaaatggtatatgtatggaaatggaagaaattaattgtagccatctttgctaataaacttccacattaagaatgtgaatatccacacagtttgacattctggcttatctatttgttcatttattaattcttcaagtacttatcaagtatctcttatgtccaaccactttgccaggcacatagagtaaatattgaaccagactgagcacagtggctcacgcctgtaatcccagcactttgggaggccaaagccagcagatcgcttgagctcaggagttcaagaccagcccgggcaacatggtgaaaccccgtctctacaaaaaaatacaaaaattagccaggcatggtgatacctgcctgtagtcccatctacttgggaggctaaggcaggagagtcacttgagtccaggaggcagaggtcgcagtgggctgatatcccaccactgcactccaacctgggcgtcagagcaagactccatcacacacacacaaaaaaaccccaaaaaacaaaaaaatggaccaattgccatttttgttctgaacagtgtaaatcctgtttgatgataaatggctattcaaactagcactgcattgatgattttctcagtaacatctctacattgatctactttgtggccaccctttaactttcaatgctctttcattcatctgttaacaccagaaaaaggtcttctgataaggttcttttctttttagtacattttaactttaaagcctaagaaggagcctgtagttctcattaataattctctacctaccctagttgtaggattattttccttagattgtatttccttctttgggaccacccaaaaacagataatttatactccacaaataaaattagatatagtgataatgatgacaagtgcgcaaattgtaggtctcatttctttaatttagcatgccatacgtgtatctgggggacatgaggaatttaatttttaaaaatgttttttatataatagcaatataagtttctggattttttttctgaagagcatgatgacgacatgtttaagttactcactgagggtttattttgatattaactacttattttccagtgtctaccaaccgtctagtagtaattcttgattcattgctgacctaaagcctgtaagaatcattgacattagtttttgaaagctttactattttttttaaatcaaaagcttgctttatcctgaaaaacaaagatgcttagtcactttattatctcttccattgtgtaggcagagtttagagtttttatgctaatttttaatcttagaattaggattgattttctttgtgtttgtctatatttcttccgtgtaccttttggactcattgggatgcatagtccattttcttttgggagaattgaatttactggacactttaccaatggagaaatgagtatgaagtagatcattcttagaaccccatctgaggactcaagtgtagtagaagggcttgttataatatggtggtgtctgtaacatggccccaaaaagtttattttgaggacagccttattgtgaatcttcagagagtatctgctgcttaataatacctgtagaaaaactggagttatgtttagagatgtgtgctagctgctaaaagtatggggacaatgtaactaaattagtgctgaaatgaatattgctaattaagtgattgtcaagtactagttgaagagccatatttgtaaaaatccttttgaaatcaggtatttggttatacattaagaatttaagttttatatattctcaaggctttgtccttgacattcagaatcattccagctgcataaattattcaaatcagatgacagaagaaaaatagcttgtagtgagtatgtgaaaattttccataagtttctccatctagcactatggaacaaattttctctttctcaaacagatacgaaagaaagatcagtatcttgccctgcccaacaaacttaccaaaaagatctaaatgaagtttccttgtgtagttcttaggttgatatgggaaggaaatgagataaatgaaatattgacttattattgcaatgatttgttatcctagaaatttgttctgtataatgttaacagtcctttgatttaaaagttttgtttcactactgtatcattttagcattccaaaatttctttccatattctttttcagatattttcttttggctttcccttcttaaagcttggattatttatgttggaaatgtgtgtgagcgtgcacgcgtgtgtgtgtggtttcttaatttgctgtaaatttaacactctagatataaagctgttttgaggatacctagattttcatatacaacctccatttattaataacagcaacactcctaaagccctctggtaaactcacaccctagaagaagctataaacccctaaataaactggaaaatgttttgagggaaatagctaccataaagctctatatacataggttacatatattatattcaaataaataatatagtagatcttagcacaatcttagtcatcagaaactgtgatgctgagcgatggaaggttaaataatattcagtgttaaggaaacacataaatcagtacatagtaaattttaatagactgaactcataaaatggataagatgtatctttttgacatttagagagctaaaggataattatttgtcttagaaaatacaattatttggaagcatttcattccccaagtgaggtgttacttgccagatatgtatactgtattagggtttattaagccgttcacatttaagatacatatctatttatgtgaataaatttcaaattagtgtatactaactaaattgttattaaattgatggctttattagcataggtttattcacttgtgttctgatgatttgcttttcagccttcttttcacatggaactttttaatttcataaatatacaagtgtgctgcacataaatttgttcacaataatttggaaattatcaaaacattatattttttcagttgccaaaataatctcttcctttatttttcagcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccgggtaagaggttttgctgaaacccaaaatggaatcaatactgcagtatttgagtcattgttcattgcacaatggaatgctaaactatcctttgaatactatttcttttcccattacagtgtttataatccctattataatattttatttccgaattttttaatagtacttgtggatttaaaaagtggttagaattcaaattctaatcttttttctaatttttaagttccagtttttcaaaatcttttttagtgtatacatttttacacactaaactttggttatcttatattgtttctttatccaaaatattaagcatcccccaaatataccaaatgtatgaatgttgaacaaacatatttgtagtgatttgaggaaagccctgaaaacttggattccccagatttgaaggttcttgttttagtagatgtttctggtccactgacggtgaaacatcaaatcttcttttcaaattagtgtattgtcttgggtccgtgcatggtggctcactcctgtaatcccagcactttaggaggccaagttgggcagaacacttaaggccaggagttcgagaccagcctggccaactttgtgaaaccccatctctacaaaaaaatacaaaaattagccaggcatggaggtgcacacctgtagtcccagctactcgggaggcagaggcaggagaattgcttgaacccaagaggcagaggttgcagtgagccgacatcatgccactgcactccagcctgggtgacagagtgagattctgtctcaaaaaaaaaaacaaaaacaaaaaaaaaacaacaactagtgtattgtcttgggcagcctttcctagacttgacaactttgtacaaaacttttctgagaatatgtgaaatagcgtcttagaaagtataaactttccccaaatgaggaggagtcaccttattagagtgcccagtgagttataggctacttcttccacctaccccaaaaacaactttttaagttttcagccagttttttttttttattatactttaagttctagggtacatgtgcacaacatgcaagtttgttacatatgtatacatgtgccatgttggtgtgctgcacccattaacttgtcatttacattaggtatatctcctaatgctattttcccccctcccccaaccccatgacaggccccagtgtgtgatgttccccatcctgtgtccaagtgttctcattgttcatttcccacctatgagtgagaacatgcagtatttggttttctgtccttgggatagtttgctgagaatgatggtttccagctttatccatgtccctacaaaggacatgaactcatccttttttatggctgcatagtattccatggtgtatatgtgccacatttttttaatccagtctatcattgatggacatttgggttgggtccaagtctttgctattgtgaatagtgccgcagtaaacatatgtgtgcatgtgtctttatagcagcatgatttataatcctttatatacctggtaatgggatggctgggtcaaatggtatttctagttctagatccttgaggaatcaccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttccatttctctgatggccagtgatgatgagcattttttcatgtgtctgttggctgcataaatgtcttcttttgagaagtgtctgttcatatccttcacccactttttgatggagtagtttgattttttcttgtaaatttgtttaagttctttgtagattctggatattagccctttgtcagatgggtagattgcaaaaattttctcccattctgtaggttgcctgttcactctgatggtattttcttttgctgtgcagaagctctttagtttaattagatcccatttgtcaattttggcttttgttgccattgcttttggtgttttagtcatgaagtccttgcccatgcctgtgtcctgaatggtattgcctaggttttcttctagggtttatggttttaggtctaacattaagtgtttaatccatcttcagccacttttttgggccagcatggcaattgctggtcattgtgggagctataaaataatctccccaccatttctttcctttctctgaaatgcgtagttctcaaaccatgttaccttgccatttacaaagcactttgtttttttcttttgattttctggcccccagttaatttccctttagagaccaccactgctcaaacctgagtgcccaaccgtccagatccttctaggctcagtgaatgtgggcgaaatgaatggacagaggcatgccagtatcttttttatctcctgctttttgtctgtctttcacatctgtctgagttacctcaggcaagtttgttgtttctccttttatttttgcttttgtaagccagaaatttgccagctatgaccagtaattggggtgccaacagcatatgtggttcagcaggttagctcaacatttttgaacatttgtcatactaggtgttggaaatatgacaataaataggacttgtccccagtctagaagaaagaaaaatctattatactcagaaataaagttagtcataattaatgaattgcattttcactgaaaatcaatctaaactccttgccgtagcctatgagaccttgcctgacctcatctcgtacctatctccattccccccattctccagattctcagcacacttgccttttttgttctttggcttccataaacattccagggtttttccagtttcatcaacttgggacccatggctgcttctcctggcaaggtgcttccctcgtgtggtcccttctcattctgtcaatctcaaagagtgcctctttctctggccacccaacgtaccaccctcacctccatcctagtctttctctcccacagcatcctttttctatcatagaacttaccacagtatggaattattttgtctgtttctttacttgttaattgttaactatctagtcctctcacactggaatatgtttctcaagggcagaaatcaactgttttatcacatcacagatgtgtttccagcatttaacacagtatctaccatatccagtgagtattcactacatatctgagaagtgattaaccagtctgtggcatcagcattgaaactcaactgtatttcttttctctccatctctcatgcttcttttacccttttacctttacctaacctttgaccaccacccccaaatagatcccccgatctttctcttttcactttagccttctcacatttctcaaaccacacaattctcttttttgtttagaaacctctacaaggttactgataaagtttaaactctttagggtagctttaaaaaccccttcttagttctccagcttcatttctgcctccccgctagcccagtttgtgctctttggccacattgaacctctcaccatttccttgacatattgcttttatagtctgcatttccatctctataatgctcccaacactcacctgtctttcttctcctcctccttcctcccctagactcaggccaaatgtcctccctccgtgaagaccttctagactattcgaggggaaactggtgaccctataacactctggttatacctcttttgtagcacccattgcattctcctttaagtagctgtttgcaaatatgtatcctcactggactgaggaaatgaactgttatgttcaccattatatttgcagcacacctagaatagtgcctgctaggctgaatagtgttgaatgattaaatatttgacctcaggattttaacattaactgctggaacattaagcctggtttgctggctgacttgttcttggcctggttaatggggctgtatgccggattctctgaagagagtatgaacagatctgacatgctgcttggccttaataacttacaaactagctgaagaattaagactttcatccatgaaataattagaaaacaatacaatttataagaaagcgtggtatataataaagtactgcattgtttacctcattgtacggttttctaatgtatctccatatggtttagaccatgagagtgtcaaatattctggaaagttagaaatcatcattggggattcattagagaatgctttatgaagcatttgacatttgaaatggatattgaagaacgaggagcatttggattagataggccacacaaaggattatctctttctcatttgtctgtggtcctgtttgttcatagtcttcttccctaaacaatactgtctataaaattctagacagcgtgtgataatgctgcttacaaacatccttcagggaaattgctgcctccatcacactttgacttttataaaccttaatactttacattttagtctgaaagtgtttgtggtgttttaactaaattagtttaatctctttggaggcttgacaatatcttttgagggagaaattttctttcatgatgttatttgaaaatgtctatgacagatagctaagcacatgggacatgtaaactgcatctgctgtgcaccatggactcaccagtaaccagtccagtgtgatgtgcatttgaagttagttgtgtagagacaggaaaatctacaagatgttgctatagtggtttgcattattgggataaagtaacaattgatgccccatagtatagggcctaggctctggagttagattgctgtggttcaaggcctggttccgtatttactattttgaatgatgccaggaagttatttcaccatcctgtgcctctgtttcttcttgtgtaaaatgatgataaccaaaagactgcctgattggattggtgtaaagatgaaatattatttgtaaaatgtctagaccagaacctcacgcatagtgctcagcaaagaggcattctcattggattgtattggattggccaagtgattcagaaagagacaagactgattgagatatactttaaacttctatgcatgagttttggctatttgttgaattatttcatattagaatggtaggtctcactcaaacgcatgtaaattaattctttgaagttaggagtttgcttggtcattttttattataatatttctaatacctttcgactttcagcattaattttcttatcaatgaaatttcactcctagaaaaaataagggggtatctggtagcataagatagacctcatacacaaaatattaacatgtactggtatagggtcttttatcacagcatggtaggtgtctttctatttgggctgatatttaatgctccagtaacatcgaagggagcctctgtacttcccttaggagaggcacctaggtttagaaagagtgtgggtttggatcacaagactgggtgcaaatactagttctactgctgtttaattatgtaacttgccttgaaccagttatttgaactttctgattgtcaccttcttcatctctaaaataagaataatatatccaaaatgcctcgcataacatcacttccctcagaaatcagttttaggttattgcctgtgcatctgtattgagttcatgttattccttctactcctctatctggaaggtgctgtcctacttttctctgtcttcacatttttcatatttttcaaaacccaattcagatattacctatgggttctttcttccacagccataaaccatcttggtctttcctttctctgagcttcaattagaatttatggttgcacagtttaacattgattgctttcccaaccagacagcagattcctcaagagcagggtttgggtcttacctgtattttttgtctcctgctatccagagcatggtgtggagatgatgtcataatcactccttaaatatcttgtttgaaattttactgtataattagtcctcccatttacttatttagcatgtttagggatttcggtacttagaaatgcttgtatgttggtatagaggaaataatgtatggaagcagactagccctgacatttggaagggagtacatggcattgggctctgccagtcatattacccaatactttaacatccactagatattgcagaatgtgagttggcagaggaaagaacaaaaagcacatctaaataaacttgaccccttcccctcattttatttaaaaatgcatttgttaatctaggaacctgtttgtcttcggttccaactttaaaaaaggaagaatttgaaaacaggtcattgtaagagcatattaaaagcgatgacagaatgtgtgtctgaattcactctctacttctgtgaccttttaggtactggccacttactttctctctatttttacttctatgttttcaaaagtaaatggtatgttgttgttaaaaagctataaggattctatctaatgtcttatcatatcctttctgctagaccctcaattactatcagtaattaagaatcatgtgtataagcagacaaattatgtatacactgtattaaaactgaattgtttataatcagatgatattctattttactgcataattagttcaaatttttatattttagtttgtttcacatgccttagtattgtctgcctagatttaagtatcatctttcacctgtgagttttcctattatttgacacccagtcgtagtaatccatataaaaatacatagacggccgggtgtggtggctcacgcctgtaatcccagcactttgggaggctgaggcgggcagatcacaaggtcaggagttcgatgccagcctggccaatgtagtgaaaccccagctctactaaaaatacaaaaaattagccaggcgtggtggcaggtgcctgtaatcccagctactcaggaggctgaagcaggagaatcgcatgaacccgggaggcagaggttgcagtgagcccagatcgcaccattgcattccagcctgggcaacagcatgaaactctgtctcaaaaacaaacaaaaaaaaatacatagacaacaaaagtaatatacaagtatgaatttgactgggattggcatttttgcttatctgctcccttctgcaacactcacaagcacgtgcacacacatgtccttccccaaatgttaacattccctttgtgtatgtctcacagtttccagctgttaaccatcctcagtccttggaaagaagataccttggaattttgaatagtgttctacttgacctaatgaaggtaaggccaattgatattatctctataaaatgtcttttggtttgtggattcttttgtgtctacatgtgaccatagcctgcttttatgaatgaaattttaggagatgtggaatggcaaataatggggaactatgtcatattaaaaggcatgtaacttatttaaaattacaatgggatctggtattgtcacagtccatctagacagaatcatgagacccctaaatgacattcttaaaatggacagaataataaaaatctgttagcatgcaagagctgttcaagcataaggttttaaaacaaatcttaaaatcaatgttgaaagaagaaattcaacaattttttctgacatggtatttgaagcctcccatcgcctacacagatttgatcagtgaatctaatttttctctttttctaacttggtctcttctctcccagactctttctggctctactttagacgtatcaggatcattgctaatgctgtggcctgagtgttcttccttatgctaccctccctgtccagaagtcttcctgctctatactctaaaagcattctcaaatttctttattcaagtttatttttttttctccagtagacagtcggctccttgagtgggaactgtttttcatatttctccagctttcactgcagccagaagtgcataagcaagtgttggttgtttgatagtagaccttcaaagaacacttattaatggatcaattttattttatgcccagtcagtcaactgtcaaaatcagtagaggttacactgtgcatagagcctttaaaaggcatacttagcacagtcggaaatttctgagtggcattctcagaactttgccgtgctttaaactatgttaatctgtgttccagggaacatagtgtacataggtgtgggggtggaggtgggggaggagggtgtgacgtttcggaaaggccacataccatacaaccttttgtagagatgcacaatattcattaatccataaaggctttcagaaatatcacaataaagaggcatttctgtcttacccaatattttccaaatttaattaaatactgaatactgttttttataaaactctaaagctctagtgttcttctgaatacagattgagaaatgctactggcaaaaaagaacccttaaagccttttgtttaattagtcataaattatcacttaaatcaggtaggttttgtcaatacactttttcacacagtcagtcctcatggattgggacctcaataatttggtaacttctaaaatgtgaatagaataaagtaggaacatggaattaaatacaatttcatgttttctgcctttcatctttctttagttaaaaataattgaatgtttttgttaaatcattaccaaatataattgccaagcatcagtgtggtaccagattaaaagctagcacaaataaaagtagaaagattacccgaatcatcctgtgcttctgccagtttagaagttaaacattcaaattcctatttatttaatatctttaccatcagatttctttaagtaaatatttttattgacatgtcctttcagaaggtgcgcaaattgtatctatatgtcagttactttttataatgtaaacatattagtgtaactctacccagatgtagatagagaaaattactaacaccctggaagccttcttatgcccccttccaggctttatgccaccccacccccctcagaaaccagttccgacttctgtcaccaaagattagtattgccttattatcaaatgttatataaatagaatcattccttttgttttttagctttttttgaaaatgaatttgaaaaatgaaaaataccaattatcccttctttgaatatttcaaagagaaatattctctttgccattctctaaagctgccgtgttaattttgtccacatctaagtacctaaaatggccatctcatcctgtcagccaatttagtgggggtacaggtcaccaaaattaattcaagcccctaataaccttaagactagctgtagtaattatattggctctattttagtcttaaaaaacgttttccctccaagtactgaacttaaaagtttatgaaacttttaaaaaaatgtaaaagaagaaactttaaaaccaaaaaattagagttgaggctctttgctgctacagaatgatttttttttttttttttttttttttgagacagagtttcactcttgtgcagactggagtgcaatggtgtgatctcagctcactgcaacctccacctcccaggttcaggcaattctcctacctcagcctcctgagtagctgggattacgggcatgagccaccacgcccagctaattttgtatttttagtagagacgggttttcaccgtgctggtcaggctggtctcgaactcctgacgtcagatgatcctcctgcctcggcctcccaaagtgctgggattacaggcgtgagccaccacacctggccccgaattatttcttaggatcttatgtcaagtgggaagaaagctaaattcaggcaattatgtgtatactactatgtgggtaaaataaaaggaacaggtagagatatgtatagggaatatctatggaaggatgcctaagaaactggtaacctaggctgcctccagaaaagggaactgggtatctgggggataagagaaagattaagaatgtatattctttcaagtgaatatctacttaattaaaagtgtactttaaattttttaattatattgtaaaagtgattttgattaatgataagtgcaggatacaaaactgtgtatattttgtaaaagaaaatatgtatataggatattcaaaaaagggctgggatcatatatacaaagaggaaaatgatgatgagattataggtgatttagatagtctttttttttttatttcctgaactgtgtttacttgatattctgcaatgactgtgtatttcttttataaggaaaaaaataaggtttttattagaacttaaatttgactttgtaatgttcttaacgatcctaaattttatttcctaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaataggtaaatattcccttttaaggaaatacagatgcagtgttggtcttacaagtaggtggaggaggtggctgcttaaatgatgcaattagagaaaagaaggaaagccctctttattcaaaaatatcttccttatgcttattgcatgattcagaaccacaattaaggagttgtgtgggtcttaaagactttcttatctttaactagtatatgatggaaacctatgcattccctgggaaaggtagcattgggttagcaactaagggggtttacagcctcaagagctagaatattctgtgtgaatgaaacccatcagtgatacccggaggaagaaagctgggtgaaggcaaggggattcctggagagagaagaggatgccaaacacagatggtggatggaaatgtacctagtgtaatctttgtgactggaccaaataggtctggctctacagagaggtcttgtgtttttgttgctcttgtcttctaatcattgagttgagaaattaatttttcataagaataagaatatggaaatagtaaagtcagtgattaaaattgttgctctttaaatattatttttcagcataattttttcaaagcctgtttcctgaaaaacacacacacaggatttgggccatacaatcaggttgtctttcagacctgacattcctcaattctgttggttgcatgtccaagaggacagtgtcctagtcatggtctccctgttttccttcatctcccaagaggctgatcttgtcatctggggtcgttggattatggaagataggaaatagtttctctcatctactattacaagataaatagaaaacaatgattctttatttttattttttagtttttttagagacagggcctttgctctgtcgcctaggctggagagcagtggcatgattataactcactgcagccttgaactcccaggctcaagcctccctcccacctcatcctcctgagtagctgggactataggagcatgccatcatgcctggctaattttttaaattttctgtagagatggggtctcactgtgttgctcatgatggtctcaaactcctggcctcaaacaggcctcctgcctcagtctccccatgtgctggagttacaggcatgagccatagcatctggctgaaaacaataattcctaatatgaaggttttttaatataaattttcttcccacctgcaaccccaaattttccatccatatagaaccattgttcttttttgagacagtgtcttgctcgattgctcaggctggaatgcagtggtgcaatcatggcccactgcagcctctgccttcctggcaagcgatcctcccaccttagcctcctgagtagctgggacaacaggcatgtgccaccatggctggctaattttttatcttttgtagagaattcctgggctcaagcgattcgcctgcctcagccttcctaagtgctgggactacaggggtgagccaccacacctggccaatcagttgttcttaatagatcagatttttaaaagctcaagatctggtactatttaggtctgggagagcatccataaactgatgatgaccatttatcgtatgttttctctgcttaactgtgatagtataattgtgttttagagctgtttactcttcttgaaaatgactggtttcagtttgtttcccctcacatcttatagacctttcttagctggctttctttgtttgttgccatgaaatttttaggacactaagtcaaggaatagtagtcatcatttggttgctcctttgcatttagggggtgcaaattagtcctgtgtcttctttggggttactctcagttcaggtgcttttatctcctttttaccttaattgtctcttagctcctttagtttacaccgaaaaattatcccaatgatataaagtccagtagactgataataagtttttgatttgtgctatagtgattagtgatataacccatactgtgaaaagaggctgtgtatttgtcttctagtgactcacttgagagacagagttcttggaattaaccagtggggacctgaggctctcctcgggaacctctttagggatctgttaaggaggatgtgcttggtgatgatgttttcagcagatacagaagatatgatttgtttgggtccttgaggagtcctcccaagtccccttttgaaatagaggagaatagaaattataagtgaatttaaaatctctggaagaatcattttcaggtcttgacactgtattgaatatattaaagaaaaagtcttacatgatttttctaggaatgatcttaccacattttacatatatctgagggcttttgctccacactggtctatggtccatacttattccatggatgcttttttggttagagacattaattctagcttgaatctcaacacaaacgatggctccctaagacttctcaggaccattttagagatgctcacagcaccatatcacattggttgccacgtacaaactcccctgccttgtctctggagacacaaacatgctgttgcataccttgtcttctaaattttttctctctaggagaggcagtggactcttgtgttacttagcccctggctatctccctcaggctctcctgaggttctgcccaccatggacacggtgcaatggtgcatcagctgccccatactgccactctcctggtccttcaccagccttctccatcaaagtgtagctttgcaccttcgacatttgcttttaaaacttactttaactaaatcgttatctatccatccatccatccatccattctgcaaccatttaagaagagtttgtatgtaaaatttttttaactagttggcagtttaacacagattccttacagttgtgtgtcgaagagatctatggaattttcaaagctgttttttattgttgcactttggcagagctccgatgcaaagggagtatgatgccctttccacataggcgttatgtgcaaagctcagtggtttccaactaatcctaagacacaaacactcagaatggcagtttaggctctttgtacacttatggaaaacctaaagctttgacacgttttaccttaactggataacctctcttttcatgttagaattgtctcttacgttgctctgaatgtgttctttctaagatccacatgtacgtttctgcttaacgtcgctaacagtgtttctaagagttccaaaggctcaagcagctgcctttgctgttctctgtccctttatggtctttgtgagctgaggacgtttcccaatatctgtacatgttatctgtctacgattactatttctaggcctgaaggggaatggggatgaaatagggttctgagagtccagggagagctggacctgggtaggaagagccaccctgtagaagctgtcatctagaaggacacagccacgatctgagtcagggtgcagatgcctgcagggaaggagcagggaagacatcccccagcccctctctcctcttgtcttgtgatgccttccactgctaagcccaaccagaagctagctggctaggaagcgtgggtgacaatctgcagcattgggttcctgaggcccagggccgggctcatgggggtggaggacggattggaggttgggcaaatggagaataaccaacacacttagatctatttgtggatgagacagtctatcactatttaggtttgaaaagtcgctgagatatttcagttaccaagatataagttggcaaacaactcaatggtttaaaacctgatgcctttaggatatagggactttattgatctggggatagactctgttaatataatttaacagaaagtgaaacttagcatttttttctttgtaattcctttctaggtctgggctttgccattttagtgctcatatttaggagtccttttatttaatgctgtaattctaatgacctaactggaagagattagtgagtacattcaagagatgaggccccccacactgtcacaggcttgctcgatatcagatttttttttcttttttgacactctcaggtagctttctggcagagattactgactgaaaggtagactaggaaatgggtccttatgttatttaatggctgagcatgcaggttctcatggggaaaattggaagtcagagcttcacagactaccattctacatgaacaaaaaaaagtgacttccaattagtgtgtcatgggaacaaaactctcccaaatcaaaccatctgtagcaatagcaatatttgcagcaaaattttttgaatgcatagtaaaaccagaattgtgtaaatcattattcatttttaaacattctagtctgtcccaaactacaattagatcctttcaatagttacagtagcacaaactggccttgctatggtgtcagtttcagctttcaaatagaggacaagattttcctctggatttatattttgtattttaaaccaagtgtgaaatgaagctttaagtcctaaaggagggctcagtcggtctaggataatgaaatgttaaataaaaaagagaataattgtgtcttttggagagaaacgaactctttcagatctctgtaatccggtatagtacaggattcctgtttactgtacaaagagatatctgaagagccccaagtaattgccacttctccaagacataaacattgatcatcatgttttccaacaaacctcactggacagtttacatttctttttagagggtcattttcttttattaagtacattgctagaattctcattctttgattatgcaggcagaagagacattggtgtctgtgtatgtgctgtgagtatgtatctctgaggcaggctacaagttttacaaataaaaatgaagttcaagaaacatagtaacctttaagtctaaatgttgtcttctgacattcaagcagacaaaagagttataaagagtttatagctcagctctcttcttagcagtcattctatcacaaacactcatatgagtaccaatataatgagagtatgttttaccagattatcatttagaaactgttttgacagcaagttagctgagcatttagcagtgccagaataatttcatcaaggccagtgctttgttacagagtgagttggtctaagaaacttaattgctgttgataggttacttgttattcgaaggcacatgcttgagagaattaatgtttttagtcttccaggtgttttgagtatttgttctttctttttaacaatactttttgtgtgtcagctattgagggaaactgatatacttcttttgtttttaacatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccaggtacagttgagcaccttgactgaatctggtggcccttcaggggaaggtggtacgagggatgtgatgagggtccatctactattttccctactacaggaggttgtgcttttcttgataggatgcatttagggaagcaatacttggcctaatctctgtttttttgttttttgttttttaaatctatttagatcaaccgttgagtactcaagaaaagtcaaattttgtttttagtgatctttttttttttcttaaatgttcttttctggaatattttgttgagagaatcctattttgatttattacagaattcatcagctgtatcagttaggttttagtttttcttaaaatacagtgtgaattcatgggtattttctctgatctctccaaaccacatttgcttaaatcaaaagcttttgctagtaccttactcaatattttaactgaatttaaaagttttaaatttgtccagaactacagataaatttaacttcataccaggataaatgttagttttcagtcttttggattgtttttaaatcttaaaacagcatttttagcataatgcttcctccatcttattcatcgtcaaactctagaactgacctaacctgcttaaaagaagtagcattccttcacttgaacctgggaggcagaggctgcagtgagccaagatcacaccactgcactccagcctgggcaatagaacgagactctgtctcaaaaacaaaaacagaaacaaaaacaaaaaaaacaagaagtagcattcttacagtagagcatgttttaaaaataatgttatcatgatttcatctataaagtactgtgcccagtgcctggcacaaagtaagtgtctaacaaattttagttattcttgctgcttctgtgattgtggaggctgatatttggacattgaacaccttttctatgctgggtgttcccaggcactcaaaagagtctgagagagctcttgcacttgagaaacttacctgctcttggggaagataaactgatacatgataacaatgaaataagtagccaggtgcagtggctcacgcctgtaatcccagcactttgggaggccgaggcaggcagatcacgaggtcaggagatcgagactatcctggccaacatggtgaaaccccgtctctactaaaatacaaaaattggctgggcgtggtggcgtgtgcctgtaattccagctactcaggaggccgaggcactagaatcgcttgaacccaggaggtggaggttgcagtgagccgagatcgtgccactgcacttcagcctggtgacagagcaagactgtcacacacacacacacacacacacacacacacacacaaacacacaatgaaataagtaagacctaagtcaatatggcactggctataaataggaactgagaatagagagaggtcattgtgagcagaagcagttagaaatggctttacaggcaactgaaggtctttctctgggctaggatgtatagacaagctttgaattggctgaagagtgaaggtatgttcaggtacgtcctgagctaggcaacatgaaaagctctagctagaaagatgaaaagaataggttccctgtcgtcttaagtgtgtgggctggcaggggacacttgtcaacagataagttgttccactactgtgaggttacattctggctactgtgctagaggcatgccagtgtggcaagggagcgagacagtccaagttgtgagttgtgggagctcctagaacaggtggcacctgagcagagacttccagaaaggttgggaagaaagtgacagtgacctcaggaaagagggaagaaaagagcattggaaggagaaggaaggtaacagatgttacatagcatggtatgctttgggcattgcaacttgttccactttgctggagtgaaaaatgcaaaatttggagtggcttttgcaataattcaagcacgaggtgaagagaatatgtttgggattaagtcagtgccagtgggaaacggagtggatcttctactcctcagaagtagaaacaataggatttgtgatttgaaggattgaatataggaaaaaggaagacttcatggtttcttttctaggacctcctttttggagtgaaagagagtagttttgaagtcacctaattcaaccccttcatttcacagatgagcatgtcgaagctcagagaagttgggtgagttgctccaagtttacccaaccagctcaggatggagctgggattatgaggcaagctccaggtgctgaggccagctgcttgccactggtgtcttgcggacatgttgaatttgaagtgaccttggcctctaagcagaagtgtgctctaagaggctaaaaagatggtctggcacccaggtgaaaggagaaagcaagaggtgcccatttgcagaggctggaagtggagtcagaggaatggtcagaggagccctgaggagatgctgtcgggagaaagaacctccagagcctagaaagatctggcagcttcctgcagaggagacatggaagggaaaattgggtaaaatgtgctagcattcagcatggtataaaatggagaagaaatcggaaaaacaaatagctttttaacttagaaaaagtaattgctctctgagaattccaggaaaagaatttttgtgaacatggtggtcataaacgaattataaacagttactgtgggctaagcacagatctgttacagactgtgaaggccagttcaggaggtacagtgcccagctgcaagaaagtacaagtttaaaagcacaaagataccagaaggctggaaaagtaacttaagctgtgagtgaatcctaggaatcactcccatgcaaagtatcgggccaccttgaaaagcacagagactcttactgagtttatattagatgttaataatttgttttcttaaaataatttttgtagaggcctttgtaaacagtacaggtggtaaaagtcaaatgagacattttcataaaatagaaagaaggaaggctatgttggatgaattcctgcccagaatcctcagagtacatttggagaatgagagggagaaaaataatcatattttaaatcttaaataaaatgtttttgatatgtcacataggcttaaggtaatgcccttttctgtgcataatatacagatatacgatgcagcgaactccttctaatgacttggtaattttcttccttaatctttttttctgatgatagaaaatgctgtgttttttcccctcggtgaacaccattgtggaccgagtactgttcttagcttgtgactcacttccttgagagagaaagatagtggtatgtctttggagatgagcactatcatgatttggcttcagaaaatacatgaaacataagtgctgttatcctagagaagattaagacaagaatttaagcacataaactatagtagttaagaggattttaacacaaaaaattattaaaaggacttactctattccttgatatattcaaaaatcatttattttcatctgactttgccatataagtcctgcatgaaatatacttttggaactgcacagttcattttggagaactcagacttaaaatctgctagagaaatttcagataaactaatagaattcctaatcagagggccgctcagaaccatgactgtctagatattagaatggtaattttttttgtttttaataattaattgaactattttcagactaatttgttctctgcttgccttaactttaatgagaattttactttccatctgtgtgaaatttgacttatattacattcatcagattattcacttttatgggactatttgtattttagccaactaacattttttattttagctggttatggtcctagttctaccaaataaaggccatgatgagttccatccctaggaacaggatgctcttataaatccttttaaattttacttccagcctggagaacagctccctccagagatgactgtggcaagatcttcggtcaaagagacctccagagaaggcacctcttccttccatacacgccagaagtctgaggtatgtcacaataaaatatgcctgtaaacatttgttcaacatcattactgcctagcttttaaaatgtattaatacccagtctcccacaaataagttgaagtggcttataaagtaagtagttttccttgtggcataattctgagttttctttcaaaaagatcattaagtcaattatagattgattaggtacggttctaaatttgggccaggtggctcacacatgtaatcccagcactttgggaggctgaggtgggaggattgcttgtgtccaggagttcaagaccagcctgggcaacatagcaagaccccatctctacaaaaagtttaaaaaattagctgggtgtagcagcgtgtgcctgtagtcccagctactcgggaggctgaggcaggaggattgcttgaactggggcagtcaaggctacagtaagccatgatcctactactgcactacagcctgggcaatagagtgagaccctgtctcaagaaaaaagtcataggcaatattgtcatcaatgtgtggcttaacttttataaatttctttcctgcctcagggtggagtgtatcatgacccacactctgatgatggcacagcccccaaagaaaatagacacctatacaatgatcctgtgccaaggagagttggtagcttttacagaggtaagcccacccccggcattcaacaggttcccctctcctccctctctcactttatgtgcacactgctttcaccgactcaggccagcggccttctcacctacactgtcgccttccagcggttctccctgcctctgctcctgctaagtcaggccctcctggcttatgaattggcctccttaggtagcctcttaactggtctccctatctccaaggtacccatcaatatagagactagagtgatccttctgaagctgtgttctgaccataccactcattttgttctgtcaagccataacatacttattgatgttacctgtgtgtctggcactgttctggcttagaacttgttggtgaacaagatagtcaaagatcttcaccatcacggaactcacttcctcgggaggagagatggacactaaacataataattatatagagcagtaaaagatattaagtgctacaaggggggaaaaaatagagcaaggcatcccattgcccaccccaccccaccctactcctaatcccctatcactcacctgttgagagtcttttggtggcttcccattggcatcaggacaaaatctgaattctctaggatgtcattccagacttcccatgatctggcccttgccatgctctccagccactttctcccccaccccccaggtctctctcgtacccagcctatgggactgcacaggctgtgccctcctctggcctgtaatgtactcttcctcctgctggaacagcttgtttctgtccctttctttaaggtcctcttcagtataatatcttcccacagtttgttccagatggactgaaacattttcttctccgttctgtctgtcgtaccttgcctgtaactctgatgtaacactgaccacattgcactgattctttgtctgagttctctctcacaaggttgtgagacattcagttctcttcgtgttctcttctttttattctcattgactagtacactgcctcgcacagtttcataaatatttgtcaattgaattaaagaaaaatttcaagtgtacttgcacgggctaaaatgtactttgttatttagcagacaactaaaacagatgcttttggggttgtacaaacttaggagacattgaatgacaaaggcaatcccttttagtaactatgcagtaatagattgtaaagcccttgggcattccaacaccctggtggagaaaatggacagcaagcccacagggccaagagcaaggccttgggtcaggaggcctgtaaagccttcaagagtcaccacagctttctaaagcctcctatgcccatgttgcctaacttcccactatttctgttgttttaagaggatagttggaaaggggcaggatttggggcgggggcatggagaactgcttagtcattttaattaggaaccccagctaaataaatgcacagaagtgttatttaggactaaatgtatatttaatgattaggctactctgttccttcccttccagccccacctttggaaaagcataaggtattgattgaatatgccatttttcctgataccatgattacgctttagtattttatgggactggccgggcgcagtggctcacgcctgtaatcctagcactttgggaggccaaggcaggaggatcacgaggtcaggaaatcgagaccatcctggctaacatggcaaaaccccgtctctactaaaaaaaataaaaaataaaatagccgggtgtggtggtgggtgcctgtagtcccagctacttgggaggctgaggcagaagaatggcgtgaacccgggaggcggagcttgcagtgagccaaaaccgcgccactgcaccccagcctaggcgacagagcaagactccgtctcaaaacaaaaaaaaaaaaaaaaagaattttatgggactaagcttttaattaagatttaatttaattaaaatattgtaacatacatgtgcaaaagccttttcttctatcaccaaagcattacctccaaaatgtagcataggtgtgttatttctatagatgtctggagaatatacattaatataaaatgctaatggagatttaagttagttagtctttgacctctggaaacacggttttattttgattgcaaaaaaaaataaattggttaattcagagaaatacttcatatgtctctacctcattagtagagagggtagtgagagcttggcaggtggaatgttttaattttaaaaatttcagatatagaaggaaaatatttaactagatgaaacatctgaagacatctgtcatttcaatgatactactaagtcctagaggaagatttggtggtatcattgaaataacagatgtttccagaatgcttcctgttttcattcctattggtcaagagtcaagtgaaattgtgtcatttatctttatatacagtctgtatattccttttgtggtaaaatttccagtatatttttattataaccattcttagaaattgacagaaaaagttaataactatccccccaaaagcagaaaagtatttattcacatacattatattttatctttttcttttcatttagaatttagagaaaaataatatttttgtagaaatagctaaatttctgtgtaattttgtttaaaaacgagtgatactacctcccaagtgtcaaggcttaaactgtagtttgtctgtttcagcacacatattaattacttcaaactaagaatagattttacattgttggtctatgataagaaagctttaacttcaaagaatgccaaaacggtggcagggaatggtggtaggggctacaagattcacacttgaaaataccctggccgggcgcggtggttcatgtctgtaatcccagcactttgggaggctgaagtgagcagatcacttgagctcgagagttcgagaccagcctgggcaacgtggtgaaaccttgtctctacaaaaaattagccaggtgtggtggtgtgcacctgtggtcccagctacccaggaggctaaggtgggaggatcacctgagcctgggaggtggagtttgcagtgaaccatgattgtgccactgcactccagcatgagtaacagtctcttatttaaaaaaaaaaaaaaagagagagagaaaaaaaatataatgttcttcactttatcagctggcaggtcagtttactgttttcaatacacattacttggtgttaactaacccttgcaaattagtgtcataagcagtggatggagggacaaggttccctggaatgccttcaccctcagaaaacacaaaagttatgtgaagagctgatgaggatttttatatgtttgtttgttgttttatttgtgttagagaaaatgcagtaggataacgtgaaaactgctttgaccaaaagagaacatcagccgtctgtggtggttcatgtctgtaatctcatcactttgggaggctcaggcaggaggattgcttgagcctgggaggtcaaggctgcactgagccgagatcacgccactgcactccagcctgggtgacagagcgagactctgtctaaaaaaaaaaaaaaaaaaaaagaaaagtccatcagtgacttactttttctttattcagtgccatctccacgtccagacaattctttccatgaaaataatgtgtcaactagagtttcttctctaccatcagagagcagttctggaaccaaccactcaaaaagacaaccagcattcgatccatggtgagcattttggtttgtttttactcttcctttttttaattgtagatttaagagttgaaataaattctggatgagctttttagtgtcctttctcctgctaggcctttttttctctagataaattattgaataaggaaaatgtgatttttcattattggtaacttttttccagtttggcatttagattaaatatcatgtaagggaaaaaaaatctcctggattattaaatacctgatacgctttccactgtgttgttctgatatgaatgatgacttttgcggtctccttttgttgacattgagccaggtacactttgcttagcatttgatgtgcatcgtctcagtcagttctcatagtcacactgtgcttccatgctagtggcagggacactgaagcttggaaaagtcgaggaactggcccggtgttggacagccagtaacatggagaagggagccagggttcaaacttaaatgggctccgactccagagctcatggttgttacctctgtgctacctgtctgtcattcagggtaaaaagaaataggggaacagtcctttatgctaccataaaagcataatggtaatgaaaggcacaaatgatgtggcaacttttcttattcttttatcttttttgtgtcgcatctaataaatatttagggagagaattacagttttatcaagatccattagcaaatctgtctgaggagtaaggactttaagaaaaataataatgtagacttcttctcaactaccctgaaagactgcccaggttctctaccaagagcataaaatgggacatcactgtaagacactggatttggaacaagaccagtctgtcagagagtccctctctggtgtttgttgccagaagtaacagaagggccttatgtcagtactcctgactccatgtgatgtcacaatttggaccctgttgataaagttacatcaaggtttcagtgttgttgtgccctatagtgaaaattacttaattattcttaaaacaatataaaaaatgacttcttaaaagctataaatacacttttgctgtataagcacaatttacatccattgcctatttataaaatgacagtcttaatgttcgtgactaagagtttagactctggaaataggatatcttggttgatggcaacttgtctatcaatcagaggactgtgtctatttgtctcttggtttcctcatgtgtaaaatagggctaagaatggcacctccctcatagggttcatgtgataattaaatgaggcaatgcattaaaagcacctagaataatgcctggctccgtaagcattcattaatgttagtgactgcagttactatcgttgtcatctaacttcaacatcaggtgtttcccctccattttgatgataaactttggtgttctttctccatgtgactgttttaagctccctagtatatagaaaagatctgcgaattaacgtgagaacacaagtataacttctttacttaccagtgttgaccattttctggtgtggctttgataagtcatgacaaaattgtctaaatggtgagaatacagaagtgcagaaggaattggattctcttgattattacataatgaagtggtgatgatttaaaagagtaacaattacagattaccttagtcctgtgaaaattaggtcagatcaaaattaaatccaaatttgagatagacagtgttagtaatgtattatttctgtcttttgataatcagtttaagtagaacttgttttacgcgtggatatgtacagaaacctaaaaagagttgttttaaaaagaatgagaggctcaattgggatgttgaactttagttgagtcttcatcaggtcatccttattctagtattgctgttatgagacttgagagttccagaattgccagtgatgaactggctctattcttttgtttctgttaactcttcgtgataatgctgctatgacgtatttccttccttcatcgcatctcacttagtctgtcattagttcaacttgactcatcttgattttttttcttgaacaagctctcgaattggttcatcagattcttcatatttgagagaaatgcacatttggtaacttacaaaaaacatcaaagagccttgttatggtaatatagtgaattgctattctttgttgcgaggggatggagacagggtctggctctgttgcccaggctgtaatgcagtggtgcaatcttggctaactgcaacctctgcttcctgggctcaagctatcctcctacctcagcctcctgagtagcccagactgtgggtacatgccaccatgtctggctaatttttgtatcttttgtaaacatggggtctcactatgctgctcaggctggactccagctcctgagctcaagtgactgactgcctcagcctcccaaagtcctgggattacaggcatgagccactgtgcctggccgtgaattgctattcctaaataatctcttacctaaggtcagtctgtttttccttggtagttgtacttcagatttacttcaggaagagaatatttgtacagtgtacccctttcttgcaatggaaaagtcaagctactatgttatattttaaagcaataaatagatattgcagtatgatatccagagctgttattctggccatctcagttatgtagaacccacttaagaatcaggagatagccaaaatatctcagaacaagcaaaatagagttaatatggtgggattaatcatctttactaataggataacacccctaccctcatttggagtctgttcttcatttatgctcagttctagcaggcagcactgaggttgtcagggcaagaaatagttcaaggtaatactacagtatgcagagggaaaaggatccaagcaatagctatggagagaagcaggttggaaaatcatacatatcatagatctctatggagtgtgtgtttataaaacaggcagcttcactttgctttgaaagacaaaatgtataaatatgtttagaaagactgctgtcaattgggttaaaaattgatgtttaaagagtaaaccaaattacttagaaatcccactagttggccaggcacggtggctcactcctgtaatcccagcacttagggaggccaaggcgggcagatcacctgaggttgggagttcgagaccagcttgaccaacatgggaaaaccccgtctctactaaaaatacaaaattagctgggcatggtggcgcatgctggtaatcccagctactcgggaggctgaggcaggagaatcatttgaacccaggaggtggaggttgcggtgagccgacattacgccattgcactcgagcctgggcaacaagagcgaaactccgtctaaaaaaaaaaaaaagaaagaaatcccactagttaaatgaagaattgctgtaacttgcacaattccagccttctttttctcgtaaggttatgaatatattgatatccattagtgcttgtcatcataactttcagagttactcccgtagaattattcactgactctctcttctcacacattagctaaccacgcttatcacatcgccaggggaggggcaggtggcagagaaagtgtcacagagtaatgctcctcaccacttcagctcaccttccatgctgctctcagagggattatactgaagtcccataagcctgaccatgatgctcccccgccccattccctagctgtcaaacctgtcccctacccccaacaagagtctgtgagcagcttgagtgagatcagattcgttcttttatttttctctgtttcttcaacacctaacacagggcctgacatgtataaagtacttgctgaatgttggttgagtgattcattggattttaattccttcctttctttaggtgaatctttggaattgtgtctcctcttggacccttatggaaatagctgtcatgttagataacgttagagtcccatgcctgtgtgcctgcttaccacttgtctcattgccctcctcccgtactgttttggtcccaactgctgctctggagaaggtgccaggtgactggatgaatagtccttctcaaagcttctgtctctgagattgatgtgaaccccctatttacccttcttttgtgctgctcctctttaccccactcagcacgaagctgctgtcttccaggtggaatcacaggggccagaatgcgcaaatgagggaaatgaccaaccacacccttacccatatggctcagttccagctgtcaatgtataactcattctgcattcctttatacaacacagcttttcaagtgcctttgttccagccagcctctttccatctgtctctgagtcactctgtcagccttttctcccttccctttctgtgttaattctttgggtatgtatgtttctgcatagcttctcgcttgttttgtttttcctctctgacatccttctttctgtctttggtgatgcaaacacacgcttcgctcctagttttcacccaccagttcaagggtaatttatttctttttttcatttggcctctgggatctttctctgcctggatctttgaaaatgtcccaatcattcctctatccccacctgggctgtggtttatccagtgcctcttgaaaagcccctgtagagggtctttggcccatcttccctgtgtcctggggacccaacgatgcaacatgcaaactgcaaacattgagctttccttttattaccctccccttctcactttcatcttattcaccgtttcatcctgcatagattctcctcttaccatgcaagatcctacttcctcctaggactggtgtctcaagccttcatttcctcttgtgccagcattaacattcttacagtaatgcccattcacattctgagatggcagtcatgatgaatatgtcttccttaaagatttgctggattggcagaaagcacttttaccctcaacacacctgtggtattttgtgagactttcattctgcttggtaaaaacttctacccattaatctgaatattctgttgtgcttctaggttgtgtttttgcagatagtattgtggaacgacatagctttttcataaacgtataattctttaacctctagaagttacagaacgttaaaaatagtattgccatttctactagatgctctctgaggctcctttccatccagagtcatgcttttgtgattccagaaaaccccactcttctgcagtgttccttaccaatggcaagtgactgaatgctgtgtcttggagtttagcttacgacagtctgtctttaagccccatgcaagagggtttcatctccttaattgcaaaagaacttgtcacaagaaacttttaccaaattcccagggcctaggcccagtctgtcattgggtttagaatgtttttcgcaacaatacaacactacatttaaagactcttttggctggccgcggtggctcacacctgtaattccagcactttgggaggctgaggtgggcagatcacttgaggtcaggagttcgagaccagcctgggtaacatggtaaaaccctgtctctactgaaagtaaaaaaattatccaggcctggtggtgcatgcctataatttcagctacttgggaggctgaggcaggagaatcacttgaacccggtaggtggaggttgcagtgagccaaaatcgcaccattttactccagcctgggcaacagagcaagacactgtctcaaaaataaataaataaaaataaagactcttaagttttcaacacttacccatttcatcatgtctgaagttttctggctttcaaaattataaatgtatcattctgagttcagaatacctggtggtgtcagtggtatcaagcttaatgtcagtattttcagttagaagcttttccccccgccccgtgaaagcttttttttttttttttttaaagaaacagggtcttgccgtgttgcccacactggtctaaaactcctgacctcaagcgatcctgtcccagcctcccaaagtgctaggattacaggtgtgagccactgcacctgtccctacatttttttcttaactatttttatttagttttaataaatacataaaaggtttaataagtaggatatttccagtttctggcaaatttttactttcattcaagatgtttttatagctgtattgatctttatgttcagtatcttgacaagtcgctaataataaacttgtcgagctggtttttaaaaggtaaatagaaaaatgaaggtaggtgttgaaaatgttttgctctttcccttgtagagttacagaaaagccatcctttaagctgtgtacttttcataatctcaaactctgaggtcttcaacagcatggaaatagtcttgcagcaacagttacaggtcatataatgctcaaattgctcttttgagtgagcctgtgccagaggataatcactaaccatggttgattaaatttagttcctcctgtgcttttttagaggctctttacccaagtgtttgattcttcccggctataggaacctagtgtcatgcattttcagtccttattatatttgtcacacaatggcaagaaaatgattgaaaaatcaatatgataaaaatgtcttctcatttaggaaaagtcctgaaaatattagtcattcagagcaactcaaggaaaaagagaagcaaggatttttcaggtcaatgaaaaagaaaaagaagaaatctcaaacagtaagtagatgaccagtttctatatataataacatgtttctgcattattcaatggatactttacactttgcacttggcaatcaaagttgattgttttcttattgagacttgacatttttgcactgtattatgtctctttctgaaattctttacaactatcctctcaacagagccttttctacattcaacagaatctccaggaatagaagaaatttaatttggatgacagagaacactttaagcctttctcaatatacttcttatctatgtgggcttatattaatgtaaaaactttgaagacacaggatttgtttctctctggggatttaaagatatgcataaacttaggaaatgggttttggtttacttttaaatgttgaaatttgtaaataaccatcattccttattctctcctggctggttacagaattcctacgttgccaggtgtgtttctgagttatatagtcacaaagatcgtatctgggattttagggcttgcgttagaaggaaaatatgtttgccttttgatcgcgctgtgggttggaatgcaccttatctcctgggagccctttgcctgaacaaagagctggctccatgggaccgttcacatcacttcactgaaccacccaagcaaggatcctgctggtttagtgacatgagaaccttggggaaacccggcctgtaggacagcagcaggagtagttcttcccctagatgaggctgcatcccccttttctttatgacaacttcaaggctaaacaaggtagagttagccgtttttatttatttatttattttagagacagggtctcaccctgttgcccaggctggagtgcagtggcatgatctcagctccctgcaacctctacctcctgggctcaagtgatctcccacctcagcctcccaaataactgggtgcacgccatcacacccagctaattttttgtatttcttgtagagacagggtttcaccatgttgcccaggctggtctcgaactcctgagctcaagcaatctgcccacttaggcctcccaaagtgctaggcatgagccactgtgcctggcctagttagccattttgaatggttttggttctagttttacttcatacgtaatttattcttatttatttgaagaggaaaaagacacaatcaaaatggcctgttcagatggacttcactgatttcatctataagtttagtagattagacccagtgtttctgaggccctttctattatgaaaattatagaattatgactcaatgggaagtagattaggtagatgttcatagcaatgtgtataaataacctgaagtaagcatttttatctcacagatgttctagaaatgttaacaaataccttcctagataatctttctagatcattctttcacttgcttgcttgttaaatttatgtatttccttataaaataaatatgagttcattatagaaaatttgagaaaaagaaaaagatcgttttaaatcttaataccctaccacaactagtattaggattttggtatattttcctccagctgtttagcctatgcatatgtttgtggcaagaaggtggggtttttttttgtttgtttgttttttaagttttaaattagagcaatccttttagtacgattttgtattctggcttttaacagtttatctatctatatctacatgcacagaatatgtatgttactacaaatactttattatcttcaatcctaatggctgcataatatttctgaagtagtcattaaaaaaactgcccatatttttaactgaagcttacttttaaagtgtcaaatcaaaatgccactcagtcagatactactataattgttacttaaactgggtgaacaaatagacctgatttaacataggaatacttaaaatgtttaaagtgttaataaaacttttatcattgtctgtagaacatgtttctctatcatgagcgttaaactttggctacctcctgaccactgttatttttattttgtggtttttgttctaaaccacaggtctcctggcattgtggggtgattaagtggtagaaagtaggaaagattaaggaattgaaggtgtttttgtatatagatttagattttgatgtttactgtagagcaacattaaacctaaagtccctggctcactgtggcacaagtagagtatacatgttggctgactttattattcagaatttagttaaattttagatattttagtaatatagattagagtaaaaaggaaaataaccattctctaacatcctctcgacttaaactttttattaggttttcataagtttcctttttgatattaaagtaactgtagaatatctctgcataggccataatgccttaagctttaccaacccaaaagttgtttgtatctctgcatcttttaattaaatgaaacataaaatttaagggctttgggatttccaaagagcgctcagtacagccttccaaacctcagagtcctacgcctgacattgggttaactctgcctactttgaatgagcatttaaactgttaatagtttttcactttctagaactcagcaaaaagaaactacatagaataagcttcaaaagatttaaggcattgtggcctttgcataagattccaaaagaatgaaaatctgatgcccagtgtacatagagacgcatgacatgttaaagctgaggtggatcctaaatctagttgaatttttttattcactggtataggaactgagcccaagcaagttgtgggcttgcttcaaagcccaaaaatcacataatcaactgggagaaccagaactgcgttctcctaaataccaagtccaggctcaattcataccatggacccgcctctgtggggagcctctaggagctctcctctggcctcttcagcgatgcaagttaaactcttcctcgaggttcctgtcattggaacaagaaaatttgtgggatgttttactcaaatccctttttacatatacccttaaaagattacctaaatacttgaataccttcatagacattctagttctctgacaattgagatatccaaaacagggaaaagtggtgacaaaaaaaaataattctgtattgtaaaggtgcctgcttcgactcaagcaaatctggaagctgccttgggaaatctggctttggttacatatccagagttacataagtcctcagagcatatggtgactttgccaacttggtaattgtatcctagttagttagtatctcaacttgtgatgatgcttccatttaaatattgaaatttctgtttcttctctttgaaaaccagtatctgaattgtgctagatgttttccattgggtaaatatttctagcagtacagaacaaggcctcttactcaacattagtatcccaccacagtgatcaatacctcttcctagtgatgttttcaggcttaaaagttgaccaaattcgaaagggtttccagtatgttgggattttttttctcctaataggcaaattacatggtagattttttacttgctgaagtcctctctagcaattaggagaagattgaagtttatcagtagctctttaacacagttctttataaccatatttctgatagtaagtaaaaattatttaacgttttataagcttaatgtgagtaggtgtgtctaggtctcttggcattcctactagaggtattgatcatgatctcacattatatacttagaagaagtttgtgcttgtcttgaatttgcattattgacatcttcacatccaggtgagaattggcacagaagctctagatgcacagcaccgagattctttcagtgactgttaatatttagcaatttgagggcttccaagggctagtagtttcaataagagcacttttttttttttttgcaattagtttatttgtatcttatattgcagacagattccaccaacggggagaatccaagcatcaagaaatccctctttcctctttttaattcaaagaatcatttaaagcatagttcttctttgaaaaagcttcctgtagtcactccacccatggtacccgtttttatgtatggtagccctgaaaactgctccagtaaacttgttttactgatgacaacagcatgtcttattttcatgaggtcatattctctttatgctagttaagtacgtgagccagttccataaattcactgggatataaattcattgccattcttctgaatcagttaagaaagttgaagcacaaagtctattaagcaaacaaactagtgaaaggctagtttgtcatgtctgattagccagttatgggcagataacatttataaaagcctgtattttatgtaaggaattctgttaacatttacagttaacaaatatctttgcatttgactcacagagtttgttaacacttgattggcaatttgtctttttgaagccaagttgaattgaccaaattgaatgagctaacaggctccatgaaaaaacagcttgtttccttgtctggcttgagcttttgctggtcagtttaaaaccagggcttttgcttggcatttgacattactcttctgtgttcaccaaaactggtgaatagagcaattgcattcatctggaatttgtggcacagatttccagcatttctctagtacataatgatagatccagatatatcagacagtggtttgggaatatgatccaaaccatactttctcactttgctatccttgaaagcctaccagacttctttggcactaccatatacagtgtttggatcattttcccagcaggaaaaaatttctgttttattgaactggttcacaacctaactgcaatatggaatgaggatacgacagcaattcctggtacagccctatttaactgctctctcttacagcgactaaaactaacagcatgggaatgctttaagggttgaggtttaacaaagctgcatgacatctgccaatttttcctaatgcagggaaaattattaagagggcagaagaatttaactagcatcacttgcattgtgaacattgggagagattggggttctatttttactgggttatttgagttttggtttggtttgctttttagtttggttctcctcttgggtgtggttgcatatcttaattaggcttctcagtgtgcttattgaatgcttgtccatattttgctctaggtacccaattccgacagccctgatcttctgacgttgcagaaatccattcattctgctagcactccaagcagcagaccaaaggagtggcgccccgagaagatctcagatctgcagacccaagtgagtggatcctgcaccactgctagactctccaactctccagtaactgtcctgaggagcggggagggcatgctagagaaaacttagcctctcaatgttacagtaaggctgagcacctcctcaaaatagaccctcagttatagccagatgcatctcgtgagccaggatgaatcttgcttcagtgacccatgttctactgggaaagatgcaagcttctgttagccttcacctagctggaggcaactgaagatgtagtcccagcccataaatacagcccaggaaagagctgagctgtgttaaagaaccataattcatggtaaaaaatgaggcatgccataacatttcaggcaggatgaacacagatggtgggaagattaaggtttcattaaaaataatagcatacaaattgaaagacaggtatgataagttttcttgaaagaatatttcaactcctgaaatccatactgtttttgacaggaaacaggcaaacagttgcattaggaactacatattagactgtattatatagtcacatttatcttccgtaatggaggaataagcagaaactgaatcagtaaatttttcaggtatctgaggtttatctcctttaaacaactattttggttggaaattttgtaatgtatcttttcagtatcccataatgagcattttgttttttgatattgagtattttataaatcctttattcttctgcactataatttctgacaatcctcccgagcttttgaggctataggattacttgtgtctgtgatttcttgtgtcacagatttctgtgattgggagagcggactactgtttttttttttttttttgagacagggcctcaatcccattgcccaggctagggtgcaatggcacaaactcggttcactgcatccttaacctccctgtgctcaggcaatcctcccacctcagcctcccaagtagctgtgactataggtgtgcaccaccacacctggctaatttttcgaatttttggtagagacggggttttgccatgttgcccaggctggtctcgaactcctgggctcaagcaagccacctgcctctgcctcccaaagtgctgggattacagggatgagccaccatgcccagcctctgtttactctttttaactgtaagctgttgcatagaactgctggcagaagttccccatattcccattctatttgccccagccatttatattttctgcttctaacataatataagctggggatggtggaagcatagagaaccagatatccaagtttattggatatgtatgcaaactaaagagacaagcctctgagtgagggcctgcttctctattcccaatttcaaaacaaaacaaaaagaatagagagctttagaactttctttgtgaaaccatttcttttaccaagaagccctctctctctctctctctctctctctctctctctctctctctctctctctctctctctctctcccccctctctccccccccctccccccccttctctctttctttctggcagggtcttactcaatcactcaggctggagtgcagtggcaagattatggctcactgcagccttgacctcctgggctcaagccattctcccatctcagcctccagagtaactggaactacaggcacacgccaccatacatggccagttttttaatttttttatagagacggggtctcgccttgttgcccaggctagaagctcttttcaaataactttatagctcttgctgaatgcagcttattgtaattgcttgatagttacatgtggtcaaggctataaaaatcaccaggagtctcatcgtgttataccaatttaattatttttaaaaagccacttttgagcacttagagtgtacagtgtgctctgctacttcctgtagggagcacaaagctttcttgggaagactttgaaatgatgatggagaatactttcccctgaaacaatatctacttgagtcagttctgaagccatttaccttgggtttcagtgcctagttccttcaaatcttgtaatgttccttgagttcgtcaacattttattcaaactttactgagcccttaaatgcatgtcccttataccatgacatttacagcaaaggtactctgagaattggccccagaggggtcccaaggctagggttgtagcccaagtggccaaatccagcagtcatgattggctgtgaatttccaagtgctttccatgtctcttccgagatcgaggaagaggagattgagccatctttcatcgttcaggagcatgaggctcaggaattgtccagtgagcagacggctctgaggctcctcccctctgccctgaagtcagtctccctccttgatgcagcacctggggatgtctagctgcacagtagacagacaggcagggcggaccactgtgagcccatgttaggaattgaaggcctcctgtgaattaattctttagatagttctgatggggttttgcatatttctttgtgctttgcattttcaatgcccaaatgttaccctccccctttcaaaaaaaaagcaaaaaaaaaaaaaaaaaagtgcagcaagggaacatttgaattttgcaatatcgagagagggaaattggggagataagaacgaaaagggctatacgacttgtagttgagtacattgctaactaaaacattccatattttcagcttctcttgctgctagatatggctgtgtacctaagttctagctggtaaaatataagtggaagcattttgtggagcctttgggaagtcttctcaaaacagagaaacatacaccttttgctttctccttcctgctggttgaagcatgagatcccctgattagagataggatgcaaccaggtagatgagcctgggcctttgattggctgccgtaccagctctatatgtcttatctagatttctaggcttttccattaaataataatacagtcttgtttgaaaaaacccgaagaacagatatggctggaccggctcctccttgcacatgcttgcccttcctggccacacccagtcacctcacctctaagcccccttccctccccagccttatggtcgctctaacttgaatcctgtgtgcattctcatcctttctttcagagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccaggtcagatggatcctggttggcatgtgtcctctgtgaccaggagtgccacagagggcccttcctactctgaacagctgggtgccaaaagtgggccaaatgggcacccctataacagaacaaatcgctcacgaatgccaaatctgaatgatttaaaagagacagccttgtaatttgtgctggtaggggggaggggtggacagacaagccagtggggaggggtgggaaagggtgggctgggcttggggcatgggccgggccaagtggtgagccaatattttcagctttatgaaggtgtgtgcaatattgcatgtgttggggccgttgagctcctcgcggccacaaatgctagtcagggatcttagagccacaggagttccttagggatcgccactccccacaggtcttgtgtgagaatagatagagtgtgccattgaggaagaagaaattcttgccagtttctcccctttacattccagctttagtgcaatctctgttgaacttgggaatgccaggatgtgtcctggcactgcaagggataggaaagtcgtgttgaccgatgcccttactacatatttttttctgcctagagtaaatgtggggtttattgtaatccaagagtatccctttgaagggttagcagatgaactgtatgtcttaaattgttttctaaacttccatatttgataggatttgtaacatttatttataattaatattgtactgttaaaatcatatcttttatgttataatgtaaagttattttgagctgtttgaaacattgtgaagcagtgggacagctacagtagtttctataaaaactaaacagtaacatttatatattgcatcaggagtattttattctatatataatatatatatatggtaaatatctgttttataaatatattcatttaaagaaagtatcgttatgacactatctgccatatttttatacatttgtgatatgaagtgagtattatacttctactaaagggagttgaattgtggctacacgtgactgtaacagtatgaaccttgctcaactttgaggccccagcagtagcctctagacatgatccttggtagcagacgagatgcagcatctctttccaaacctgcaggggaagaaagtcagataggccagtgagaattccagcaggcctggtttccgtcctcacacacttggctcctgtttgtgtccagggacgttacttgcacacaggggagaatagattgaggcgttactcgtgggtctttgtagagagaatgtgctcttccacttagcattagtgtagagcgtagaccaaagatttgccagtgaacattccttgttgtgagatcataagaggtacctgtctgcagatcttgcaaaccatctctatgctcctgaatattgtccactgtcccggagactcttggctgatggggtgtgagatatatgtgtggcatttctatttctgaatgccttttttgctattgctctctccaataccatatttaaaaggctcctggagcaattccagatagataaaaaattactctatccatttttttcttcctggggctgtccacttatgacaagattttcatgcacacctgttacgcacacaacccccatcagaacaggacctatcttcccctcatctgatctctttcagctcccaagttactcccaagtatcatcaaaccctttggccatcaagtgttatcctcccatgcctctgggtcatccttgagggaagtcacctcagcaccatcatctatcagtagtagtagatttttggaattagtctctgagcaataatacttttaaaggtccctcccacccctcaaagagataacttctcagtatttattacttgtcctcaaattctgagtgtcagcccctgcatcaagtcagctatgatcaaaatgtgctgttactgttaaccctcccccgagattttgagaatcatagctctgatgattatgaagattataaagactaaggtcctagtttccctgaagcttaaattgtgcacatattgcatttttatataaatactataatgtgtattgattatatagataggtcattttaaggtgctttttatttaattttaatgagtgtaataggcactaaaatgaaactcgactgggtactattactgaaaaaatttgactcaaaccaatagttttgcatgctctttagttctttttctgtcttacttctttcaccagttcagtactgtttgggtagctctgaattctggcttttccaggcagctgcttgatgatacaaatgaggtggaccatcagcagttttgcctggacactaatgactctaaaagggtgtgtatttaactcttctttttcatactagatctctaccttgtattccccccttgcaaaccagaaactacactttttttctctggaaagacttctcactgtgctatgcgcttaggaactgcacggtcccgttgccatgctgtggcattcgaggctcgtcacctaggggctggtttcccatgttgtcatccttgctaacactgggatctcagatgtttgcagaacatttctattcatgacggttcttcaaagaagggctagaatatttgccttctacctagagcaaagtaaacctaattgttgaagagtcaatacgtactttttgtactttcccagatttgagccagaaaatacctacagatatctacaaatgttttcaaccagtgttttcgaggtagctctttaatcctcttctcagcttttgtctgttctgacttttcatccaataagctgtaagtgaactacaatctgcatttccagcatgcaattctcttcctgctcacggagggggatgcaaaagttttctctcacacctaatgggccctctcttagcttttaactgttgttttcccctgttgatgaaaaattactgacatcacaaagattgccatccatggtagaaaggacttgatttaaagtcagaaaaatttgccttttctttaggaaggggaattcatgacatccatgtcctattatcggccgtaacttcctaaagaagaaaaagggtgaatgaaagcttatgttacttttatgaaagtatcactgatctcctttggaaaagaaactctgcttcactgtttttctacctttatttctctgccatcctcgtttttcctctctgaagttctaaataccctttaactgaaccttgttggtcttgctctaaaatttagcctctttctagagcccaagaccaaaagggagtgcttcatgctgaggggctcaagtgagctgactctacaactgtggttctcaactaggggcagatttacccccaagggtacatttggcaatgtctggggacatttggttgtcatagctgggggggaggtgatggtatgctactggcatcaagtggttagaggccacagatgctactaaacaccctgccatgcacaggacagccccccaaacaaacagtggtccagccccaagcactactagtgctgaggttgagaaaccctgccctacaccatcccaagcccaccagtctgcagagcttggctctggccttgttctgtccaggctacagtactgcaggtgtgatttcttcaacatcacattctcttaagagtcttcaaccactatgcctgaatccttggaatcctattgttcgtttccattgtcttgggcctgctaaaaggtgcatactttggaaggagaccagagttactttataggtgttggagaacttaaattctaggttagcatccttagaaaatctttcatagagccatgaggcttatatttagaagcaagcaacagcctggcagattggcatgatttttaccaactgctcaaaggcatccgtggctttcagctgtgtctcccgaaagaaaatgtctttgttttttattcaagtcatttaatagctctttacaaatattagcatatggcagaccaattagaagcaaaaaagtccgtattggtggttgtgatgtggctgttatagaagtatttgtgctgtatgctttggttaaatctgttttaaaacatgctttaagattcaccttacgcagttgtactttaattctaagctcagagctatgctgtcagtctctagtcacgccatgtattataaagtatgttgtggttgtagagttagccagtttagcatgttcctaatctgagaattagtggactatactaggaaatgctatcccattttccctttccagcccctcttagttaagatcatagtatcctcacttcttaaactagtctttagagtaaataaggaaaaaagccatttattttcttctagccatgtattattgagaatgactcatagtacaactttttttcaaaggccagaggattactttgcaagtgtgtagaaagatctgtctatttctgttcacctgggacctggtggtgactgaactctttcagcaagggcaatggctcaatgtgattcggtgctggagctcagctgggactcagtaaatctgcacgttctctgctggtcagaacatgtttcctggagagcattgcttttctatctagaagttcgttacctcctgcatgatagtgggatattgagatgtgggttctaagatccacagactcatacttttgtgaactttggaatgtggtagggtacactgaaccaagtcagaaaatagtgaaatatttccttgcctccttcagttcatcactaagaaagtgtgtaggcagagaaaacttacttatggtttgaagaaccacaattgtttttgaaaggggacatagaaaagacagtacaaaggttgtaagtgtcctgtcgctaattcccagggccagaatctcacaagaagatcctctcaaagacttaaaagcctggcttacaaaaataaccagaaaccaaacttgtaagcagttacaatttcttccttttgcttcttgaccagctgagatacagaatatcttgaggtctggttcagctgatgaaaaattctgtctcagaaacgatgagtaagaaaccatacaagaaaaagaagtccctcatctatctgcatacacgcaatgtgggagaagtggggtggctaggaaactctgggcctgctgcccccttcgattctttttttttttctttgtgaattgaatgtacgatacaaatggtaggccttcatgtgagccagttactacatgaatcttcatttcccacagtggtttgttcattcatcagcgttaggcttggtcctggctccacctttctcctctccgggcactgaccccacctttccgtgtatttactgtaggctattaaatatgatcatgacccgccttgcattttcattcatcacctgtttatgcccaaatttaaaggaagtttgtctcattttgccagaaaaaaattgtaatagtcggcacgctggatttgtagggccagcaaaattgcggcagtgaaactagtttcacttctaaagcccttcatttcccacaaggttaagctctcgaaaccccatttgatccttggttcctatttcgatcctcctttggaatctgaaaatcggtctccatgttgtatgcagattagaagttgccttgtttgttactcttccaacacagggtatcagggagaaagaggccttatctgttcctccatcccccctgttttgacagactgctaagaattcctcaggacttcctttggttggggattttactttcccaaaagtctgatctgatttctttcaggggtagacaagcttgtcctagtgctctgcttcaggtcttatcagaagaaacccaggaatagaaaaggtagatgccttgacttttgtccctgttgtggggactaaagtgttttttgccagaattgtcaaaagctccggttcaaactctgtagagtttcatggaaaaacaaaacaaaacaaaaaagatgcttatcgtcccggagaatgtgtaagtaagttctccagcacggcttaggttttccaaaatggaaagcaaagcttgcagacaacctgttttctctagagacacacaatgattctggccctcagtctgtttccctccccttgtttactctttggtcaccgatcgagtcaggctagaggggtaatacggtgattaaaagaagtaaattctcactgtaaacttggattgattaacagaaacaattaaaccaaacaaaatcattgccccaaatttctatctccaagaattgctttgtgccattttgaattcaggtagttattctgtatatacttagctaactattcagagcttcttcaatctctagtaagcttgaaggtggtgtctgggaagacacagggcagggtgacatttagactctgttcattcttaaaaatagggataagccagaatgatgtgacatctagtatgtggtagatgaagaatcagtggaaattcttaattgcacagactttataatccattatataaagtgtaattccatactttttactgtggcaagggtgtgatgtgattgttaatctttttaatttttgaatccaaactgaatttaaagtgttgaatacttaaatcctcacaagtgaattatgaaccatttgtaaagtgtttctataactctttgtatcatgtgttggtacatcttatcaagttttttctggcatgtaattccattctaaacttatgtaaaatttctattgttgctgtaaatattacacaaatatctattccgtgataaccttcattatcagcatgaaatggttaatttttactgagcacaatgtatttttgaatggatcttcccaaatgtctttaataaaatgcagattttgcactgactgatgtgactgccaggccgtcccaatcttgagcactgtggtccttcgtgtttgaactgcgaacagctccattttagttccttcttgggaagaaagaatgcattcgaattcaaatgagggatgatgggcctttgaggttgtaatcagtttgagacagaaattaatgtaaaactaggcaaatcctgtaacttaatgatgttgatctttgttttcctatttataaagcttttttccccttacggcattttgaaaactttggtttgttttatacttgagtgttgtcacctttgcacgtcgctagacactcacgtggtagtttgaggaggatgggaagagaggccaatcttgtgctaagtgctatggagaaagcaaagatgcacagcttaataagggttttttgattctagaggagaggtgggcaagcttttcctgtaaagggccagatggtaaatattgggggctctgtggcccatcagttccctgtcaacattactcagctctgcctttgtattgcagaggctgcatggataatatgtaaatcagtaagtgtggctgtggtcccgtaaaactttacttatagaaacaggccatagtttactaacccgttttaggccctcagtttcatcatttagggtaacaccaaccgagtacatgttcaatcaggagggaaagaacttagcttttgtgataacttatagatgaaatattccccagttttctttctctttctaaacaaagggtaggagctgaaagtcagtgctctccattcttaaaagtcctctgtcaaccacctcttcactctatctccttaagtgacatggaaacttgtggcctgtgctttcaactataatcttaccaagactgaatgaaagtatttggtgcttatactttttaatgttcatagcacttactatggccaggcacaatgcccaagtgttttgctttattattattattattattattattattattattattattattattttcacaacaacccagcgaaacaggtactattattatcccctttttgtaaatgaggaaacagatttccatacttgacattaacctgcccaaggtcacccagtttggaagtggcagggccaggatttgaagccgaatatgttcattgtaaagcccatatacccttaaaagtcactgcacgtccacgtatggtaatgtggtcacaatcagtattgtttctctttagtaattcagatttattcaagtaactccaaggttcaaattttcaaaaacagtttccaacacaggttatattaaaaactttgcctgaagtttactctaggtgcagaaataaagacaacttagtcaagtgaaggaaagggtaacagacttagaaatggctatctacactgatggaataagtatactaattagagcaggtaacaagtccccacgatgtataacatattcttctctaaaagctcacaacaatttatgtgccaccttccatcccctttcccagcagatggtaattgatgcaatttgagaatagaacacttcattgaaacaagtcactggaggtcctctggggatgcagcttaaaagcccaggatcaggccaggtgtggtggctcacgcctgtaatcccagcactgtgggagactgagacgggcagatcacctgaagtcaggagttcgagaccagcctggccaatatagagaaaccccgtctgtactaaaaatacaaaaattaggtctgggcggtggctcacgcccgtaatcctagcactttgggaggccaaggtgggtggatcacgaggtcaggagttcgagaccagcctggccaacatggtgaaaccccgtctctactaaaaatacaaaaattgggtgtggtggtacatgcctgtaatcccagctgcttaggaggctgaggcaggagaatcacttgaacccaaaaggcagaggttgcagtgagccgagatcacgccactgcactccagcctggcaacagagcgagactctgtctcaaaaaaaaaaaaaaaaaaatacaaaaattagccgggaatggtggtgaatgtctataatcccagccactcgggaggctgaggcaggagaatcacttgaacccaaaaggcagaggttgcagtgagccaagatcgcaccactgcactcccacctggacgacagagcgagacgccatctcaaaaataaataaataaataaatccctaggatatagagtccgcttgcctgggtggagtcttggctccatctcctacatctcatgtgacttgaagcaaggcacttcactatgcctcagtttccttatctttaaatggaggtaatcacagtacctacctcagtgttgttgtgaagatttaatgagataataacctgcagagcacttgagagtctcaagaaatatgagctcttataacattattgctattgtaaaacattgctattacttctgtcccaatttggcagtttcaggaaattgagaaggaatgtcactgaatctttaatgccagttacacagagctcagtaggtgtccgcacagccctttagatgcacgtagcctatttgatcttcgtatcagccctgtaaggttgggcttaagaatgacccagcatggaagtactcttgggaccacaggggaagcaacagtccttgtaagctgtttgtcagtgggccttagcaaccaagccccaagtggacagaaagatggggttctgtgagcatccattccaagggtcactttaggggtgcaatcttctgggctctgagaatggattcacagcagcatctctatctggaaatacctttgctttgtccaagtaacctcctcccacacagagtacccgaatcagctcagattttttttccttaatattggcaacacttaatgctacttctttgttcgtaacatttcatttaattatttaaaaatctgcaaatgttgtgtatattttaccgcaatttttaaacaaactccagtgtagaccgtgctctagcatttctaaaaataaaagtaaatatgttaaaataaggtaagagtgagtttttcctacactatgtataatttttaattgaaagtttcccccacaaaagaaatgatacttggaagcatagtttgtgtgtttgacagcaagattctattaggcttcagatttccctcaataaaagttttagtttttatacattctgtcatgaattgaatgaagtaaataatatgctgttgtaagcaaattatctgcagataaatgtcttatgaatcgtatatcttactgtttattaaattctgaagtattgagcagtttccaatgtgaaatcccagctggcttctttgcaatgatggacaagttagttataattcatatggaaattcaaggaacccagaatagccaaaacaatcccgaagagcaaagttggaggactcacatgccccaatttcaaaacttactacaaagctacaataatgaagaaagtgaggtaatagaatttggagtccagaaataaaccctctcacatttatggtcaattgttttttgacaagggtgccaagatcattcaatgggggaaagaatagtcttttcagcaaatagtggtgggacaactggatatccacatgcaaaagaatgacgttggactcctatttcacaccatatacaaaaattaactcaaaatggaacaaagatctaactgtaagaggtagaactataaaactcatagaagaaaacataggggtaaatcttcatgaccttggatttggcagtggtttctcagatatgacaccaaaggcacaagcaaagagaaaaataaattggacttcatcaaatatttaaaattttgtgcttaagaggactctatcgagagggttaaaaagatccacagaatgggagaaaatatttgcaaatcatatccaataagggaattagaatatacaaagaattcttaaactcagtaagttgtaagccgatttaaaatgggcagaggatctgaaaaacctttatccaaagatgtacaaatggccagtaaacacatgaaaagatgctcaacatcattagtcactagggaaatgcaaatcaaaaccacagttgagatgcaacttcacacattatgggtatagtcaaagatggacagtaacaagtgttgctgaggatgtggagaaagtggaagcctcctacattgctggtggaaatgtaaaatgatgcagccacttgggataatagttcctccaaagattaaacaagagtgactgtgtgtcccagcagttttactcctaagtatatacccaagataaatgaaaacacacatccgcacaaaaacttatacacaaatgttcatagcagcattattcataatagctaaagagtggaaacccaaatatccatcaatggatgaatggataaataacaatgtgctcttgacatgatactgaacaatgatgttcagcaataaaaaggagtgacaagtgacatagtgatacacatgttataacgtggatgaactttaaaacactatgctaagtgaaagaagccagtcacgaaataccacatactatatgatttcatttatgtagaacgtccagaaggccaatctacagagacagtcgattcgtggttgcagagggcttggggtggccgatgggttggggagtgttggctgatgggtgcaggatttctctttggggtgataaactttctaaaattgatctagtgataatggttgcacaactctgaatataccaaaagtcatcaaattgtacactttaaatggatacaaattgtatgtgaacttaatctcaataaagccgtgacaaaagtttccaacatgaactcttatttggaaagcctttctccctgcctcactgtttcctcctctcctttttccctgaactgcactctctcgactcctgtgtttgatgtgccttaactcttaggatactgccattttgtctgacagtccatgtcgtgaccaaagttaattcacctttccaaataagggtctctgttcaggcatttctatccaaaatagatttgtcctgtgtcctaaggccagggataagtccccccaccccccccccccacccccaacaccctgtgtgatgtgtttatatttgagagaagattgggcggggaaaagcattttccgaagttcaagcatacagcatagggactagaaagatgctgggttggatataaaataattgagcccccaaagcatcaagaaggatgtttggggcttttagaaggctgcctgttcacagaaaaggtgaatgtgttgtccagcactgtattagcgcgagtctagtcacttgccttggcatttgaaaatgaaaagtaactcggaaatgagctgctagcaaagactaccctgtgtctggggccagaacagtctttagagcagcctcgtcctctgattccaccacctgctctccatatccctctcctgcccctcccccgtgttaacagcctctcccaggaaggggcctggaaactcaggctgcgctctaagtggccaatgaggcctcccaatctaaggcgccgcctccaggaacggaaagccaggcccattccttcccagagagcttttcaggagcaggcgcagtttgcgtattgcaaggcagagggtggagggtgagaagctttcagggaaaaagctacatggtcctttttatgatgtgagtccttcccacttcctgcgaagcatgtagccagctaatgagcctcctctgagtagccagtggtagctcctgggccagctgttctcgaactatgtttggtttgctaggaaatggtagccctaggtaaagggcaattgtactgtgttgtggtcatttggggtccctacatatactgagatgtgcagcctgtcctgtatgatcacctaaatggtgaccacagacacggggaatttgctggaatggattgcataatggagctgtgtgtattgggcgctctggtccctccccaatccctgtgttcatgagggtggaagcccagatccgccttgaaggtaagaactgtgagcagaggaaactcccctaccttgggcttttggtcatttgtcacgtatagcctctcagggcaccgggattctcacccaccgcactcatccctgccacccagtcacccttgagaccctcagctgcctccccagggctctgaagtcctctttggcgatgatttagtggaaacttaactaggaggagctgctcccttctgcattcaaagccaggctttaggaaactgtatgtttctgtcttgaatgtggtaaagcaaatgaattttcaaattatcagggctgctttgtgttcccctgagactgcacctttcacagtatcactgagacaaaaaatgagcagaaaattacccctgctacttaggcttttgtaagaaaattcgtttcggggacattttctttgttctgactttctctggccctgagtggggaataagttcatttttatttcattgaaatcagaaagctatatcttaaaaaaaaaaaaattatctacccagcactgcagttacaattgctttgcgaaatatagccctgtccatctcggtggtgtgtgagggggtcccctacggcccgctctgtgccagtcaccccctggcaggcgccgagctgaggcaggcatcaggcacacttgctgacgcactccagcagctccatccggatggcaatgcggacgtgccagcccagcgggatgaggcggatgaagcgggagatgatggggggccgcagcaggttctgaaccgtggaggtgcggtccgagttgccatagaagacctagagagatagaggaaatcctgtcaccatcacatcggggagggaaaaggaagaagggttcctttctggagctagccccaacttttaactatagaaatgattaggaagtagttaaagcagtttgcgggtgccccccaaaatctgaccttgagtgattgtcatcacacctacatgcttgggacatctggaactgcaccatccaatagggtggccactagccaatatgtctgtttacacttcaattaattaaaattagataaaaattcagttcctcagtcacatgagccacatttcaagtggccgccatattggacagtgcagatgtgaacatttccatcacagaaagttctattggagggtgctgctagaaaatgccacttgactcatcgcttttgagtttttatcctttgcattttgacattttgaaaaggcccacatcacacttacatgttccaaaggtatccaaagtagggctcaagtgaaaacccgtgcttggctcaggagttgtaagccaaaacttaaatgtgtattcctactttgatacaagtgatgagtacctttccaacttggaaaatgtttttttaaaaagacataaaaacttggccaggcgcagtggctcacgcctgtaatcccagcactttgggaggcggaggcgggcggatcgtttgaggtcaggagtttgagaccagcctggccaacacacagtgagaccccgtctctactaaaaatacaaaaaaattagccaggcgcagtggcaggtgcctgtaaatcccagctactctggaggcggaggcaggagaattacttgaacccgggaggcggaggttacagtgagctgagatcacaccgttgcactccagcctgggcaacagagtgagactccatctcaaaacaaaacaaaaagacataaaaactcgaaggaagattctggaaaggggagggtggtgccagagtaaagagaaagggggtttgcttagtgtttttaaggatgtaacataaaaacatgctgtgggtgtttgacgccatttccaaagaaatcattctttgccctcttaccaaagtcatggtgctctgcctgatgccactaggacatttcatctccttctgggattatctcctgaaaatatctggctgttgcatttggccccatccatccacaaaacgggaagggcctggtctgccatgttcttgcctttctccgcagtggcaccgccccacaccaccctctctattgcagtttgtctttgagcctattcaagtcaggagccaggtgaagagaggggagggtggaacaggctccaccagattgcacaagtgcaggggtgaagtgcctctttgcaaagaaccttcaaggccttcagaagcacagggcttgaaaaacttctcatgtcttttgaagaggccagctaataagaataaaaatgaaattaaatgtccaagtatcaagatggtttttcctcttgtgttcaaactccttggaacaacccatgaacgtcttggccgtacaaattgtcatcagagacttacaaagccttctgaatctcagctgtacatgtctacttaacctgattaaatgttgaaattagcctggggaactccttactcttaggcaaaaggatgtttaccatttccaaagagctagggagtttttaattcatttttattcatagcaaatatatatatatatatatagtcaggagtctactgcgtttagtcaatggtgaagaagacttctgtctcaatccacaaagattaataggatgtagagttgcccaaaggtttaagttcgtctgtgtttgtgctggtgaagtccttttaaccatttggctaatgggtaacttgctaggttctcaaaaggctcccctctgtcagtctcaaacaataggagaggccacatctatataaatggatgattctctacccacatcaataacatcagaccatacccgtgaagcaaagtgcattcaatgatccagtgagttgaaatagtccaaatggtcagtcttaagagttcaggcaactgcatgctgatatggaaactcagacaaattttttttttgagcttaagaatagcattcatttgcaaacaaactgtgctgggcaccaaagcaagcccaggaaagagagcacagcacattgtgggggaaagcgcagatgatccactgtgctgtggagtcggtgctctgacagagggcagtgacaggagctcggggacaggaggggaagtcccagagggtgcgagctgaagttggtttgggataagcccaacttacccggttgtttccagtctggtccttgtagtaaatccagttcaggcgctcatcggtcctgtactgcacgctgtacttggtcatccactcatcgatgtcacagcgcccctgggtgaggatccctgaaatcactttgatctccttcagatctatctgtaaccactggctactgtcctggaacttggagagccaggcacacctgccgagaacataccgagtcaccgagagactccccctgtgcatgtctgcaaaaagcccgcaggtgctggctctcgaggggatgccagcatccaaagagccccctgccaagctcgggcagtctgggctgcagtctgagccttgtctcctaggaatggccagcttccgttatacttaacttgcatctcattctccctctccctgcatctccacctcccaagaaaagatttccagattcgactaatttgtcaaagaaatgcctcagagtgtggctgaaattgcctttgggagtggttgaacatgtctgtctgcaaaacacgcaggtgcatggctgttagaccaccagcccctgccctctgcttgagactcccagggtgaacctttctgcgcatttcactctcttcacacctatttgtgtttccctcggttggtgacattcctgcctcgtgcagagcactgacccatgtggatctagaagggctttgacaagtgtcaagccagataaccgttgaagcaactaagttgtttttttagctacattcctcataaatcgtggaaacctatagtagttccccccgccacctccttttttccttttagtgtgtattttaattagctttgtaggacttaagccctgggccaccttctcttccttttccagacttattccttgggtggctcctgacttttcacttctatcccacaccttttctaaaccccaaatccagagagttcagttgccagctagaggacttctgtatgcctctcagcatctcagatgaaacacgtcccaatgtgagcccctaagtgcccccaccccaccctgctttcagaccccacgtctctgagttaaccccatccttgcatgtgtccatgccggccacctgagaaccatcctgggcccctcctctccacctccagtgcccaatctatctattggctccatctccaagtgcctcaaattcttctacttctgtcggtctccaccgccaccactctagcccgtgtccccctctttcttcccacacctcaactactctccctggattgctctggccccacaggaaccagagaacttttcttaaaacacaaatgtgcttgcgatactcttcgacttaaaatatttatccggcagagtctgctaattatcacccgatactcccttcccatcctcatttggtaatagaacccctgagtttcatctgggcaaatggccatctggctaagatggcatttcctagtctcccttgcaactagatggggccccctaaccaaactctggtcaatgggatgtgggcagaagtggccaatagaatatgtttgtgttcttaaaggcaagtcatgcgcactctgctgctcttttgtttctccccactaactagacggtggatgtgatggcagaagacagagacaccattctggaccccaagatagacgcttcatgttaaggacgacagaacaacaaggtagagtctgggccccgcatgccatcaagctgccataacgaccctagactactgaatgaaacttttttttttcctttctgagacagagtcttgctctgtcgcccaggctggtgtgcagtggcacacaatctcggctcactgcaacctccgcctcccaggttcaagtgattctcctgcctcagcctcctaagtagctgggattatagccacctgccaccatgcccggctaatttttgtatttttagtagagatgaggtttcaccatgttggctaagctggtcttgaactcctgacctcaggtaatctgccccccctcggcctcccaaagtgctaggattacaggcgtaagccactgtgcctggctgatgaatggaacttttaagtgagcaagaaacacacttctacattaagtcactgtactttggtgctctttgttacaacagcatgaacatgtatgctaactaatacgcactcagggtcctcccattatccctacagtacggaccacagtcattaacgtggcttctaaggtcctgcaccatctgacctccgcttgcctctccaccttgtctcacttgtgcttcaggcttgctgccctgcttatgttccccatccacaccctggaggtatcatcccgactcagggcttttgcacctgctgtaccccacgcctcttcccctccctcacctggccaacttcaagccacaggtcaaatatgttttccttagaaagccttccctggctgcatggatgaggtctttcttccttcatctctcccccagcactcataagtacattctgtgtcatttgtttattagagaggcctatattttttttcatttttgagacagggtctcactctgtcgcccaggctgtagtgcagtggtgtgatctcggctcactgtaacctccgcttcccaggttcaagcaattctcctgcctcagcctcctgagtagctgggattacaggcacgtgccaccacgccagttaattttttgtatttttagtagagacggggtttcactgtgttggccacgctggtagagaggcctatttttttttaaaagcacatgaaaaaaaatccccgggccctgcttacccaaagccttgactgttgagccgggccttgtttgcagtccacgaagaataccagcccacatactgctccgggttagagcaggtgatctggtccggtgtgacctcccctgactcgaaacccagaggcttgtgatatgggcattctgggaaaggaaaaagaattcacattcacacatatctcaatactcaacaagcaccaggtgactgaaataacaaaacaaacccatctgctttgcgcttcggagacggagaaggctttacctgtctctgtggttcacaatgggtacagctgtgtcttcaacggttcactactcacgcaagaaaggaatgaaggatgaagtaaaggaattgccatagagactcaacagcctttgtaaaagcagagggaagtggctctatggcaacttcacaaggggtgtgtggaattttgagaaatacttcacctcctccaccaacttagagatctaaaaaccaagaggtgcacagtgaaataccatatttaaatgccatacatctttatttcccccattaacacagatttagccatcctgcctcatgacgtcaggtctcttgttgtccttgggcagcagatcatgccaattatagggacaaaaccacagtgagacgcaagaagggcgatgacatattgagatatagagaatgacttcctacttgtaaattgcagttttctcaccagtctaatgaaaaaaaaaatgggtgaaatgtgcttgggggactgttgagtgagaaacagctaaaaggaactgctttttcccagtggtagtacccaaaggtggttcttctgtgttgattgtctcccccttcctctcgtctgtatgtcccctcacagtaaaaacggtgttgaggctgggcacggtgactcatgcctgtaatcccagctactcgggaggctgaggcaggagaatcgcttgaacccgggaggcagaggtttcagtgagccgaggtggtgcctgcagtggcaggcacagtgtcgagttacctggtcagaggctgccaattttcaacccagtattcattcattctccccttcttctccttttttttttcttttgagacagggtctcgccctgtcctaggctgcagtgcggtgctgctatgtcagcccactgcaacctctgcctcctgggctcaagcgatcctgccacctcagccttctgagtagctgggaccacaggtgcacaccaccacacccagctaatttttgtattttttgtagagacaggattttgccatgttccccaggctggtcttgaactcctgggctcaagggatccacctgcctcggcctcccaaggcactagggattacaggtgtgagccatcacacccagcctccccttctttttgactaaagagctctccttttattgggagcagcaatgtagccagctgaataaagggcctttcccagcctcctttgcagttagaagtgcccaggtgacataacttctgaccagtgagacataaagactgcctgctgggatttctggtcaggttttgcttgccccttcttttttcctgttgcctagatcacatctgatagttggtgtgacagtaaccatcttgcaccatgtgggtaaggccgagagaactgcagaggctgagtgcagtggctcatgcctgtaatcccagtgctttgggaggatcacttgagcccaggagttcaagaccagcctggggcaacatagggagaccccatctcgtggctcacgtctatagtcccagctaccggggaggctgagggaggaggattgcttgagcctaggagtctgtggctgcagtgagccatgatcacaccactgcattccagcctgggtgatagacactgtctcaaaaaaaaaaaaaaaaaagaaaactacagagaccttagccttgataaccttaagtattataactccctacccctaattttttttaccatgtgagttaaaactcctaaatcaataagccagtatttagggggtcttgtgcttataaccaaacccagttcctaactgaatttctacagaaaacaaatggcaaatatattttccttttttggttagagacctggtctcgctgtgtcgcacaggctggagtgctgtggcgcagtcatagctctctgcaactctaactcctgggctcaagtgatcctcccacctcattctcctagttttctgatgatgaatgataaactgcaattaaggcaaatcatagtattttctccagaatttttcaaaagccagtaaagttgaatgaaacatgcttgcagagacggccatgccctgtccccagaggctaaaaacaggccagcttcagacctctggccggggaggcttaacttcctttctgccccaatgcacgaaaggaataggcctgatctcactagtatctgcagctctgtgggtctgagggtgagggcacagaatttgtagtttattgagtactcaagtactcaagaatgcagtttccaggactccaccccagagcaattgcatttttaacaagccaacttttgaaagtgcaccttgaaaaccttggcctgccagggaagacattctttctgtgggctggggatcccgaggactgagtgcctgcggactcgagggctcctcccccacccgcgacacccctccagctgggaagacaagcccgagcgatcagggggaggggcacaaggccaggtggcagggatttttcatgggcaaaattctaaccttgggtgtctctgaggcccctccactttgagcatttgatgactgaacctcctttttgttttccacccccacccgccgccgccgccccgctcagggctactagctctgagagagtaggcagaggggaagggaaaaagccagtgccacctctcccagtcaccttattcttggcactttgctcttcttcatctgtttccccttcacatctcttttgccatttcttcccaaatagctcatctaacactccagagcggtctgtagccctgcaggggtacctggccagggccaatggccttgacagcctgggagggcctgtccaggcagcagagaatgtgtggctcactctgcgatctaaagacccgtgtgtccagacgtggatgctgtacttactccccagggaaggtgacgctctcactgtcaccttggcttcagctggtgtctgggagccgatgcctgcctcccgggccccaagcttcattccactgccctctgaatattttccaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccggtaagcagagactctagaccggtggggctcagcctgggctgtacctcggaattgcccgaggagctgtagaaatgcagatgttcaggccacacccccagggattctgacatcattggcctgggcatggggacaaagctgcaggtgattgtaatgggcagtcaaggtcaagcaggcctgcgtccagccaatgacacctggggtaggggcccaccctctcagcgtgtgcgcaggccagttgcttaacctctctgggtctcagtctcctcatctgtgaaatgggggcatgatgtagtacctgtcttcataaaattgctgtaagattgagtgaaactatttggagattgtagagttcgtagagcacagcgtcttgccaaaaagcagcaggtgcatgacattggtggaggtgaatttgtgagactacgttgataaccttcttgaattttgcatgtttttctggcaaagactcaatagggaggaaatccattgcccctctatcctactctgttctgtccccattaccctccccgtccccccaccaccgcaccccccgccacaccctccagagaatgaggccagcttcatgtgactaatgaatggtttcggctgtccttgccccaggcaggagcaagtgtgtgtgtgtgtgtgtgtgtgtgtgtgtgtgtgtgtgtgtgtgagagagagagagagagagagagacagagagacacagagagagacagagagggatgtgagagagaaacttgtcgacagcatcccttaagcttatggacctggaagatctaggcctcaccaggaattagcgcattgcccaagagaaggaggtcacagccccagctaaagtagcagggatgtggtgagggcctgagcgcagcagagagggacctgattcccctgaggggctggactgggatgggcttgggagccctaagctctgggcacgctcagaaaacttgggaaggtccctcggactgagtatggctcagagggagaggagccacccatgagacgtctgccttccaatggggctgtggccagcctgccctcgcaagctcgtggggggttcatgtagtctaaatagggagaaaagaccttcaaaaatcctgtctgcacactcctcacaggccattacaatggggcactccggctggatttcttctaacgtggaaaaatagaaaatgtgacatttcccacactgtgtgtgtcctgaagaagagcacactccagttctcttattgtgatttttcctgacttcttcttcccctttcctcttccttctgtgggcctggttgagctcttttcaggtccacatgtggcctgcagcccttccctgaggccatcccctcccgtccacacccctccgcctggccccccatgcctcagccttcagatctctgcccgccctgagctggctgaggggccccaggtgctacctccccagcacccttcacacctgtcacgcacccctcctcctcaggcatacttcactgccatctcccctcgcctgcctccctccccattctccccctagctgagcagaatgcccacaggtgctgggcactctctaggtattgactggacagatggatggagagatgaatgaacacacaccatcgccccatcttgggtggccactggggacaagcataggaaatggcatttcgaaacaggcagcagaggcctcagggaagaagtagacactgactgcgacctctggcctaatcaaaagaaaccataaattgagtagatgctagaaggcaacataaatagtgttgtgaaagaattaaggggatccaaggctgggtgcagtggctcacgcctgtaatcccagcactttgggaggccgaggcgggaggatcacttgaggtcaggagttcgagaccagcctggccaacacggtgaaaccccatctctactaaaaatacaaaaattagccgagcgcagtggttggcacctgtaatcccagctacttgggaggctgaaacaggagaatcgcttgaacccaggaggcagagcttgcagtgagccaagatcgtgccactgcactccagcttgggcaacagagccagactacatttcaaaaaaaaaaactaaggggatccttatcagacacacacagaatatgaccttcccaagttttccacccagtgtcactttgctgttgcagctattagacctgtttctatactcatttcacccttagggaaaagcctacatcttctgtggctcaaatggctcttctgagccatgatgtgatcatgagatagataaaggcatatttgcaatatgttaccagcccaaggctgtgtatatttcatattctagcctttttactttagtggctactttctgagtttgtaggcaggcttataaagaatgcagatctaaagaaacacagaattcagggactttcttaacacaagattccagacagatgtgaatagtgttatgcatagatattagacttgaatatatgtgacaatatagtagagtacagaagaaaatatgtagaataatatttctggaagaatggatcataagctcaagcatcatatagaatagaaaatctagaatcaaaaggaaccattagcaaaccagtagatttcttatacttttgataatttccctaccctattttttgctctcagagtgccggggtaatcttggctcaacggtggaagagacagagcttttagtatttttaatagcattaaagtgaagattaggaggccagaatgcatgtggccttctgctccgtggggggcccgggcattagccagagtgcacctgctagcgctcctggcagctctgagtgaccccgctgtccttctgtgctttccagggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaaccattaa

SEQ ID NO: 3147 - DNA, 228046 bp, human; identical to SEQ ID NO: 3146

SEQ ID NO: 3148 - DNA, 16010 bp, human
aacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccaggtacagttgagcaccttgactgaatctggtggcccttcaggggaaggtggtacgagggatgtgatgagggtccatctactattttccctactacaggaggttgtgcttttcttgataggatgcatttagggaagcaatacttggcctaatctctgtttttttgttttttgttttttaaatctatttagatcaaccgttgagtactcaagaaaagtcaaattttgtttttagtgatctttttttttttcttaaatgttcttttctggaatattttgttgagagaatcctattttgatttattacagaattcatcagctgtatcagttaggttttagtttttcttaaaatacagtgtgaattcatgggtattttctctgatctctccaaaccacatttgcttaaatcaaaagcttttgctagtaccttactcaatattttaactgaatttaaaagttttaaatttgtccagaactacagataaatttaacttcataccaggataaatgttagttttcagtcttttggattgtttttaaatcttaaaacagcatttttagcataatgcttcctccatcttattcatcgtcaaactctagaactgacctaacctgcttaaaagaagtagcattccttcacttgaacctgggaggcagaggctgcagtgagccaagatcacaccactgcactccagcctgggcaatagaacgagactctgtctcaaaaacaaaaacagaaacaaaaacaaaaaaaacaagaagtagcattcttacagtagagcatgttttaaaaataatgttatcatgatttcatctataaagtactgtgcccagtgcctggcacaaagtaagtgtctaacaaattttagttattcttgctgcttctgtgattgtggaggctgatatttggacattgaacaccttttctatgctgggtgttcccaggcactcaaaagagtctgagagagctcttgcacttgagaaacttacctgctcttggggaagataaactgatacatgataacaatgaaataagtagccaggtgcagtggctcacgcctgtaatcccagcactttgggaggccgaggcaggcagatcacgaggtcaggagatcgagactatcctggccaacatggtgaaaccccgtctctactaaaatacaaaaattggctgggcgtggtggcgtgtgcctgtaattccagctactcaggaggccgaggcactagaatcgcttgaacccaggaggtggaggttgcagtgagccgagatcgtgccactgcacttcagcctggtgacagagcaagactgtcacacacacacacacacacacacacacacacacacaaacacacaatgaaataagtaagacctaagtcaatatggcactggctataaataggaactgagaatagagagaggtcattgtgagcagaagcagttagaaatggctttacaggcaactgaaggtctttctctgggctaggatgtatagacaagctttgaattggctgaagagtgaaggtatgttcaggtacgtcctgagctaggcaacatgaaaagctctagctagaaagatgaaaagaataggttccctgtcgtcttaagtgtgtgggctggcaggggacacttgtcaacagataagttgttccactactgtgaggttacattctggctactgtgctagaggcatgccagtgtggcaagggagcgagacagtccaagttgtgagttgtgggagctcctagaacaggtggcacctgagcagagacttccagaaaggttgggaagaaagtgacagtgacctcaggaaagagggaagaaaagagcattggaaggagaaggaaggtaacagatgttacatagcatggtatgctttgggcattgcaacttgttccactttgctggagtgaaaaatgcaaaatttggagtggcttttgcaataattcaagcacgaggtgaagagaatatgtttgggattaagtcagtgccagtgggaaacggagtggatcttctactcctcagaagtagaaacaataggatttgtgatttgaaggattgaatataggaaaaaggaagacttcatggtttcttttctaggacctcctttttggagtgaaagagagtagttttgaagtcacctaattcaaccccttcatttcacagatgagcatgtcgaagctcagagaagttgggtgagttgctccaagtttacccaaccagctcaggatggagctgggattatgaggcaagctccaggtgctgaggccagctgcttgccactggtgtcttgcggacatgttgaatttgaagtgaccttggcctctaagcagaagtgtgctctaagaggctaaaaagatggtctggcacccaggtgaaaggagaaagcaagaggtgcccatttgcagaggctggaagtggagtcagaggaatggtcagaggagccctgaggagatgctgtcgggagaaagaacctccagagcctagaaagatctggcagcttcctgcagaggagacatggaagggaaaattgggtaaaatgtgctagcattcagcatggtataaaatggagaagaaatcggaaaaacaaatagctttttaacttagaaaaagtaattgctctctgagaattccaggaaaagaatttttgtgaacatggtggtcataaacgaattataaacagttactgtgggctaagcacagatctgttacagactgtgaaggccagttcaggaggtacagtgcccagctgcaagaaagtacaagtttaaaagcacaaagataccagaaggctggaaaagtaacttaagctgtgagtgaatcctaggaatcactcccatgcaaagtatcgggccaccttgaaaagcacagagactcttactgagtttatattagatgttaataatttgttttcttaaaataatttttgtagaggcctttgtaaacagtacaggtggtaaaagtcaaatgagacattttcataaaatagaaagaaggaaggctatgttggatgaattcctgcccagaatcctcagagtacatttggagaatgagagggagaaaaataatcatattttaaatcttaaataaaatgtttttgatatgtcacataggcttaaggtaatgcccttttctgtgcataatatacagatatacgatgcagcgaactccttctaatgacttggtaattttcttccttaatctttttttctgatgatagaaaatgctgtgttttttcccctcggtgaacaccattgtggaccgagtactgttcttagcttgtgactcacttccttgagagagaaagatagtggtatgtctttggagatgagcactatcatgatttggcttcagaaaatacatgaaacataagtgctgttatcctagagaagattaagacaagaatttaagcacataaactatagtagttaagaggattttaacacaaaaaattattaaaaggacttactctattccttgatatattcaaaaatcatttattttcatctgactttgccatataagtcctgcatgaaatatacttttggaactgcacagttcattttggagaactcagacttaaaatctgctagagaaatttcagataaactaatagaattcctaatcagagggccgctcagaaccatgactgtctagatattagaatggtaattttttttgtttttaataattaattgaactattttcagactaatttgttctctgcttgccttaactttaatgagaattttactttccatctgtgtgaaatttgacttatattacattcatcagattattcacttttatgggactatttgtattttagccaactaacattttttattttagctggttatggtcctagttctaccaaataaaggccatgatgagttccatccctaggaacaggatgctcttataaatccttttaaattttacttccagcctggagaacagctccctccagagatgactgtggcaagatcttcggtcaaagagacctccagagaaggcacctcttccttccatacacgccagaagtctgaggtatgtcacaataaaatatgcctgtaaacatttgttcaacatcattactgcctagcttttaaaatgtattaatacccagtctcccacaaataagttgaagtggcttataaagtaagtagttttccttgtggcataattctgagttttctttcaaaaagatcattaagtcaattatagattgattaggtacggttctaaatttgggccaggtggctcacacatgtaatcccagcactttgggaggctgaggtgggaggattgcttgtgtccaggagttcaagaccagcctgggcaacatagcaagaccccatctctacaaaaagtttaaaaaattagctgggtgtagcagcgtgtgcctgtagtcccagctactcgggaggctgaggcaggaggattgcttgaactggggcagtcaaggctacagtaagccatgatcctactactgcactacagcctgggcaatagagtgagaccctgtctcaagaaaaaagtcataggcaatattgtcatcaatgtgtggcttaacttttataaatttctttcctgcctcagggtggagtgtatcatgacccacactctgatgatggcacagcccccaaagaaaatagacacctatacaatgatcctgtgccaaggagagttggtagcttttacagaggtaagcccacccccggcattcaacaggttcccctctcctccctctctcactttatgtgcacactgctttcaccgactcaggccagcggccttctcacctacactgtcgccttccagcggttctccctgcctctgctcctgctaagtcaggccctcctggcttatgaattggcctccttaggtagcctcttaactggtctccctatctccaaggtacccatcaatatagagactagagtgatccttctgaagctgtgttctgaccataccactcattttgttctgtcaagccataacatacttattgatgttacctgtgtgtctggcactgttctggcttagaacttgttggtgaacaagatagtcaaagatcttcaccatcacggaactcacttcctcgggaggagagatggacactaaacataataattatatagagcagtaaaagatattaagtgctacaaggggggaaaaaatagagcaaggcatcccattgcccaccccaccccaccctactcctaatcccctatcactcacctgttgagagtcttttggtggcttcccattggcatcaggacaaaatctgaattctctaggatgtcattccagacttcccatgatctggcccttgccatgctctccagccactttctcccccaccccccaggtctctctcgtacccagcctatgggactgcacaggctgtgccctcctctggcctgtaatgtactcttcctcctgctggaacagcttgtttctgtccctttctttaaggtcctcttcagtataatatcttcccacagtttgttccagatggactgaaacattttcttctccgttctgtctgtcgtaccttgcctgtaactctgatgtaacactgaccacattgcactgattctttgtctgagttctctctcacaaggttgtgagacattcagttctcttcgtgttctcttctttttattctcattgactagtacactgcctcgcacagtttcataaatatttgtcaattgaattaaagaaaaatttcaagtgtacttgcacgggctaaaatgtactttgttatttagcagacaactaaaacagatgcttttggggttgtacaaacttaggagacattgaatgacaaaggcaatcccttttagtaactatgcagtaatagattgtaaagcccttgggcattccaacaccctggtggagaaaatggacagcaagcccacagggccaagagcaaggccttgggtcaggaggcctgtaaagccttcaagagtcaccacagctttctaaagcctcctatgcccatgttgcctaacttcccactatttctgttgttttaagaggatagttggaaaggggcaggatttggggcgggggcatggagaactgcttagtcattttaattaggaaccccagctaaataaatgcacagaagtgttatttaggactaaatgtatatttaatgattaggctactctgttccttcccttccagccccacctttggaaaagcataaggtattgattgaatatgccatttttcctgataccatgattacgctttagtattttatgggactggccgggcgcagtggctcacgcctgtaatcctagcactttgggaggccaaggcaggaggatcacgaggtcaggaaatcgagaccatcctggctaacatggcaaaaccccgtctctactaaaaaaaataaaaaataaaatagccgggtgtggtggtgggtgcctgtagtcccagctacttgggaggctgaggcagaagaatggcgtgaacccgggaggcggagcttgcagtgagccaaaaccgcgccactgcaccccagcctaggcgacagagcaagactccgtctcaaaacaaaaaaaaaaaaaaaaagaattttatgggactaagcttttaattaagatttaatttaattaaaatattgtaacatacatgtgcaaaagccttttcttctatcaccaaagcattacctccaaaatgtagcataggtgtgttatttctatagatgtctggagaatatacattaatataaaatgctaatggagatttaagttagttagtctttgacctctggaaacacggttttattttgattgcaaaaaaaaataaattggttaattcagagaaatacttcatatgtctctacctcattagtagagagggtagtgagagcttggcaggtggaatgttttaattttaaaaatttcagatatagaaggaaaatatttaactagatgaaacatctgaagacatctgtcatttcaatgatactactaagtcctagaggaagatttggtggtatcattgaaataacagatgtttccagaatgcttcctgttttcattcctattggtcaagagtcaagtgaaattgtgtcatttatctttatatacagtctgtatattccttttgtggtaaaatttccagtatatttttattataaccattcttagaaattgacagaaaaagttaataactatccccccaaaagcagaaaagtatttattcacatacattatattttatctttttcttttcatttagaatttagagaaaaataatatttttgtagaaatagctaaatttctgtgtaattttgtttaaaaacgagtgatactacctcccaagtgtcaaggcttaaactgtagtttgtctgtttcagcacacatattaattacttcaaactaagaatagattttacattgttggtctatgataagaaagctttaacttcaaagaatgccaaaacggtggcagggaatggtggtaggggctacaagattcacacttgaaaataccctggccgggcgcggtggttcatgtctgtaatcccagcactttgggaggctgaagtgagcagatcacttgagctcgagagttcgagaccagcctgggcaacgtggtgaaaccttgtctctacaaaaaattagccaggtgtggtggtgtgcacctgtggtcccagctacccaggaggctaaggtgggaggatcacctgagcctgggaggtggagtttgcagtgaaccatgattgtgccactgcactccagcatgagtaacagtctcttatttaaaaaaaaaaaaaaagagagagagaaaaaaaatataatgttcttcactttatcagctggcaggtcagtttactgttttcaatacacattacttggtgttaactaacccttgcaaattagtgtcataagcagtggatggagggacaaggttccctggaatgccttcaccctcagaaaacacaaaagttatgtgaagagctgatgaggatttttatatgtttgtttgttgttttatttgtgttagagaaaatgcagtaggataacgtgaaaactgctttgaccaaaagagaacatcagccgtctgtggtggttcatgtctgtaatctcatcactttgggaggctcaggcaggaggattgcttgagcctgggaggtcaaggctgcactgagccgagatcacgccactgcactccagcctgggtgacagagcgagactctgtctaaaaaaaaaaaaaaaaaaaaagaaaagtccatcagtgacttactttttctttattcagtgccatctccacgtccagacaattctttccatgaaaataatgtgtcaactagagtttcttctctaccatcagagagcagttctggaaccaaccactcaaaaagacaaccagcattcgatccatggtgagcattttggtttgtttttactcttcctttttttaattgtagatttaagagttgaaataaattctggatgagctttttagtgtcctttctcctgctaggcctttttttctctagataaattattgaataaggaaaatgtgatttttcattattggtaacttttttccagtttggcatttagattaaatatcatgtaagggaaaaaaaatctcctggattattaaatacctgatacgctttccactgtgttgttctgatatgaatgatgacttttgcggtctccttttgttgacattgagccaggtacactttgcttagcatttgatgtgcatcgtctcagtcagttctcatagtcacactgtgcttccatgctagtggcagggacactgaagcttggaaaagtcgaggaactggcccggtgttggacagccagtaacatggagaagggagccagggttcaaacttaaatgggctccgactccagagctcatggttgttacctctgtgctacctgtctgtcattcagggtaaaaagaaataggggaacagtcctttatgctaccataaaagcataatggtaatgaaaggcacaaatgatgtggcaacttttcttattcttttatcttttttgtgtcgcatctaataaatatttagggagagaattacagttttatcaagatccattagcaaatctgtctgaggagtaaggactttaagaaaaataataatgtagacttcttctcaactaccctgaaagactgcccaggttctctaccaagagcataaaatgggacatcactgtaagacactggatttggaacaagaccagtctgtcagagagtccctctctggtgtttgttgccagaagtaacagaagggccttatgtcagtactcctgactccatgtgatgtcacaatttggaccctgttgataaagttacatcaaggtttcagtgttgttgtgccctatagtgaaaattacttaattattcttaaaacaatataaaaaatgacttcttaaaagctataaatacacttttgctgtataagcacaatttacatccattgcctatttataaaatgacagtcttaatgttcgtgactaagagtttagactctggaaataggatatcttggttgatggcaacttgtctatcaatcagaggactgtgtctatttgtctcttggtttcctcatgtgtaaaatagggctaagaatggcacctccctcatagggttcatgtgataattaaatgaggcaatgcattaaaagcacctagaataatgcctggctccgtaagcattcattaatgttagtgactgcagttactatcgttgtcatctaacttcaacatcaggtgtttcccctccattttgatgataaactttggtgttctttctccatgtgactgttttaagctccctagtatatagaaaagatctgcgaattaacgtgagaacacaagtataacttctttacttaccagtgttgaccattttctggtgtggctttgataagtcatgacaaaattgtctaaatggtgagaatacagaagtgcagaaggaattggattctcttgattattacataatgaagtggtgatgatttaaaagagtaacaattacagattaccttagtcctgtgaaaattaggtcagatcaaaattaaatccaaatttgagatagacagtgttagtaatgtattatttctgtcttttgataatcagtttaagtagaacttgttttacgcgtggatatgtacagaaacctaaaaagagttgttttaaaaagaatgagaggctcaattgggatgttgaactttagttgagtcttcatcaggtcatccttattctagtattgctgttatgagacttgagagttccagaattgccagtgatgaactggctctattcttttgtttctgttaactcttcgtgataatgctgctatgacgtatttccttccttcatcgcatctcacttagtctgtcattagttcaacttgactcatcttgattttttttcttgaacaagctctcgaattggttcatcagattcttcatatttgagagaaatgcacatttggtaacttacaaaaaacatcaaagagccttgttatggtaatatagtgaattgctattctttgttgcgaggggatggagacagggtctggctctgttgcccaggctgtaatgcagtggtgcaatcttggctaactgcaacctctgcttcctgggctcaagctatcctcctacctcagcctcctgagtagcccagactgtgggtacatgccaccatgtctggctaatttttgtatcttttgtaaacatggggtctcactatgctgctcaggctggactccagctcctgagctcaagtgactgactgcctcagcctcccaaagtcctgggattacaggcatgagccactgtgcctggccgtgaattgctattcctaaataatctcttacctaaggtcagtctgtttttccttggtagttgtacttcagatttacttcaggaagagaatatttgtacagtgtacccctttcttgcaatggaaaagtcaagctactatgttatattttaaagcaataaatagatattgcagtatgatatccagagctgttattctggccatctcagttatgtagaacccacttaagaatcaggagatagccaaaatatctcagaacaagcaaaatagagttaatatggtgggattaatcatctttactaataggataacacccctaccctcatttggagtctgttcttcatttatgctcagttctagcaggcagcactgaggttgtcagggcaagaaatagttcaaggtaatactacagtatgcagagggaaaaggatccaagcaatagctatggagagaagcaggttggaaaatcatacatatcatagatctctatggagtgtgtgtttataaaacaggcagcttcactttgctttgaaagacaaaatgtataaatatgtttagaaagactgctgtcaattgggttaaaaattgatgtttaaagagtaaaccaaattacttagaaatcccactagttggccaggcacggtggctcactcctgtaatcccagcacttagggaggccaaggcgggcagatcacctgaggttgggagttcgagaccagcttgaccaacatgggaaaaccccgtctctactaaaaatacaaaattagctgggcatggtggcgcatgctggtaatcccagctactcgggaggctgaggcaggagaatcatttgaacccaggaggtggaggttgcggtgagccgacattacgccattgcactcgagcctgggcaacaagagcgaaactccgtctaaaaaaaaaaaaaagaaagaaatcccactagttaaatgaagaattgctgtaacttgcacaattccagccttctttttctcgtaaggttatgaatatattgatatccattagtgcttgtcatcataactttcagagttactcccgtagaattattcactgactctctcttctcacacattagctaaccacgcttatcacatcgccaggggaggggcaggtggcagagaaagtgtcacagagtaatgctcctcaccacttcagctcaccttccatgctgctctcagagggattatactgaagtcccataagcctgaccatgatgctcccccgccccattccctagctgtcaaacctgtcccctacccccaacaagagtctgtgagcagcttgagtgagatcagattcgttcttttatttttctctgtttcttcaacacctaacacagggcctgacatgtataaagtacttgctgaatgttggttgagtgattcattggattttaattccttcctttctttaggtgaatctttggaattgtgtctcctcttggacccttatggaaatagctgtcatgttagataacgttagagtcccatgcctgtgtgcctgcttaccacttgtctcattgccctcctcccgtactgttttggtcccaactgctgctctggagaaggtgccaggtgactggatgaatagtccttctcaaagcttctgtctctgagattgatgtgaaccccctatttacccttcttttgtgctgctcctctttaccccactcagcacgaagctgctgtcttccaggtggaatcacaggggccagaatgcgcaaatgagggaaatgaccaaccacacccttacccatatggctcagttccagctgtcaatgtataactcattctgcattcctttatacaacacagcttttcaagtgcctttgttccagccagcctctttccatctgtctctgagtcactctgtcagccttttctcccttccctttctgtgttaattctttgggtatgtatgtttctgcatagcttctcgcttgttttgtttttcctctctgacatccttctttctgtctttggtgatgcaaacacacgcttcgctcctagttttcacccaccagttcaagggtaatttatttctttttttcatttggcctctgggatctttctctgcctggatctttgaaaatgtcccaatcattcctctatccccacctgggctgtggtttatccagtgcctcttgaaaagcccctgtagagggtctttggcccatcttccctgtgtcctggggacccaacgatgcaacatgcaaactgcaaacattgagctttccttttattaccctccccttctcactttcatcttattcaccgtttcatcctgcatagattctcctcttaccatgcaagatcctacttcctcctaggactggtgtctcaagccttcatttcctcttgtgccagcattaacattcttacagtaatgcccattcacattctgagatggcagtcatgatgaatatgtcttccttaaagatttgctggattggcagaaagcacttttaccctcaacacacctgtggtattttgtgagactttcattctgcttggtaaaaacttctacccattaatctgaatattctgttgtgcttctaggttgtgtttttgcagatagtattgtggaacgacatagctttttcataaacgtataattctttaacctctagaagttacagaacgttaaaaatagtattgccatttctactagatgctctctgaggctcctttccatccagagtcatgcttttgtgattccagaaaaccccactcttctgcagtgttccttaccaatggcaagtgactgaatgctgtgtcttggagtttagcttacgacagtctgtctttaagccccatgcaagagggtttcatctccttaattgcaaaagaacttgtcacaagaaacttttaccaaattcccagggcctaggcccagtctgtcattgggtttagaatgtttttcgcaacaatacaacactacatttaaagactcttttggctggccgcggtggctcacacctgtaattccagcactttgggaggctgaggtgggcagatcacttgaggtcaggagttcgagaccagcctgggtaacatggtaaaaccctgtctctactgaaagtaaaaaaattatccaggcctggtggtgcatgcctataatttcagctacttgggaggctgaggcaggagaatcacttgaacccggtaggtggaggttgcagtgagccaaaatcgcaccattttactccagcctgggcaacagagcaagacactgtctcaaaaataaataaataaaaataaagactcttaagttttcaacacttacccatttcatcatgtctgaagttttctggctttcaaaattataaatgtatcattctgagttcagaatacctggtggtgtcagtggtatcaagcttaatgtcagtattttcagttagaagcttttccccccgccccgtgaaagcttttttttttttttttttaaagaaacagggtcttgccgtgttgcccacactggtctaaaactcctgacctcaagcgatcctgtcccagcctcccaaagtgctaggattacaggtgtgagccactgcacctgtccctacatttttttcttaactatttttatttagttttaataaatacataaaaggtttaataagtaggatatttccagtttctggcaaatttttactttcattcaagatgtttttatagctgtattgatctttatgttcagtatcttgacaagtcgctaataataaacttgtcgagctggtttttaaaaggtaaatagaaaaatgaaggtaggtgttgaaaatgttttgctctttcccttgtagagttacagaaaagccatcctttaagctgtgtacttttcataatctcaaactctgaggtcttcaacagcatggaaatagtcttgcagcaacagttacaggtcatataatgctcaaattgctcttttgagtgagcctgtgccagaggataatcactaaccatggttgattaaatttagttcctcctgtgcttttttagaggctctttacccaagtgtttgattcttcccggctataggaacctagtgtcatgcattttcagtccttattatatttgtcacacaatggcaagaaaatgattgaaaaatcaatatgataaaaatgtcttctcatttaggaaaagtcctgaaaatattagtcattcagagcaactcaaggaaaaagagaagcaaggatttttcaggtcaatgaaaaagaaaaagaagaaa

SEQ ID NO: 3149 - DNA, 228046 bp, human; identical to SEQ ID NO: 3146

SEQ ID NO: 3150 - DNA, 211437 bp, human
cctcaggactctttagagctctgagtgagtggggtgggggagttggaggaggaagaccctacaggaagttgaggtatcatatcctcaatttctgtgacccccagtggtttcacactatcttttcagcaagccacattggatttcacgcatttactgactcttctacccgttctttttggtgtccagctgtactctccaacaggcgagcacatggtcgtctcctctctcccttcaggtactctccttagtttttgagccaactggttgctctgttggtttttttgttttgttttgttttgttttgttttgttttgttttgttttgaggcggagtttcgctctttcgcccaggctgaagtgctgtggcgcgatctcggctcactgcaagctccgcctcccgggttcacgccattctcctgcctcagcctcccgagtagctgggactacaggtgcccgcctccacgcccggctactttttttgtatttttggtagagacggggtttcaccatgttagccaggatgatctcaatctcttgacctcgtgatccgcccgcctcggcctcccaaagtgctgggattacaggtgtgagccaccgcgcctagcgctctgttgggtttaaagaaagtcttgaatttgaaattagttcagctctttttcattgtagttctcttattccagggtttaagccagaaatttggttactcttaaaattttaacatgagcgtttccttaagtctaagcttaattattattcctgtcctcctgaataagaccaagagtttggaatgatttactccttaaccgtcagcccctcttccatgttaatgttatttatgtgttagttttgccttatttaagccaccttacaccaataaaaatagtgaatatttactcatgtgcttttcaggtttctttgctcaccattcttccttcactccatttcttccttcttggttcagtttcttccttctttattaaaaaatgttcttaattatttcagtaagggccccttaatagtaaatttggttttggtgtttgtgaaagtgtctgtacttcactttttcccttgaatggttgttgagctgggtccagaattttgggttaattcctttccccgagtactttgatgttattctcttgtgttttgacaaatttgtaaattttttttaacttttaagtttggggctacatgtgaagttttgttacataggtaaacacatgtcacaggggtttgttgtacatattatttcatcatccaggtaataagcccagtacctagtagttatcttttctgctcctctccttcctctcacccttcccctcaggtagagggggatagttaatgttattcttttgtgttttgacagatttttaaattttgtttaacttttattttaggtttgggggtacacctgaaggtttgttacataggtaaacacatgtcttaggggtttgttgtacagattatttcatcacccaggtattaagcccagtacccaatagtcattttttctgctcctctccctcctcccatcctccaccctcaggtagtccccaatttctgttgtttccttgtgttcataagttcttatcatttagctcccgttaatttttagttttttggtctaggctggtctggaactcctggcttcaagtgatcctcctcagcctcccaaagatctgggattacaggtgtgaaccactgcacctggcctagttttatttgctaatgacaagtcaacagtcagtttagttgtaatttcgttgtaggtaagtaattctctctcctcttgagctacttttaagagcttttccttgtttatttatttattttttatttacagtacttttgagttgctgtttatttccttgtttttttgatcttcagggttttttttttttgcgatatctctaggtgtggatttgttttatgtatcctgcttttatttgatgtattccattagtctgaggacccctgatgtcttcagctgtgggagaaaatcttagccattatcttttaaaatagtttcgtctccattttccatttatggaaccattatttagatatgttttgggatttttcatcacatccttcgtgttgtttaatttacatttctatctcttctggctaatctcttgacatctatcatacgattcactaatttcctctttggctgtgcagttaatttgttaacttattgagggtttcactaaaaacatttggctatatatagtcaaatatataaatattgatatttatacaaatatacaaatatatatgtgtgtacaaacatatatatacatgttttaaagataggatcttgctgtgttgcccaggttggtgttgaactcttggtctcaagtgatcctcccaccttggtcccccaaagtgctgggatgtacaggcatgagccactgtgccccacctcgaatatattttcaaatttaagaatttctgttacattttctttcaaacctgtatttaaattttctttcaaatcagcttttaaattttcataagagcattttctttggacatttaaaaatatagttatgtttaagtcctctttggattattttcttagctgtaatttttgaggaatgaaatctcccatttggcttcccttcttccctccaagatttttgctgtttctccgtgtggtgtgcagtatttgacaatttaacgattgtttgcctatgcccgggttgtggaatgctcttttggtctagttttgcatttgtctctgatgggaccctttgggttcactgcgtctagagaggttttggtctattctcagatgggtctccagcacctggaaagtagtgtaaattttgactccatatttgtgtagaacagacttggggttttcccttctgtttgggtcactttttttttttttttttttgagacggagccttgctctgttgcctaggctggagtgcaatggcacgatctcagctcactgcatcctctggttcccgggttcaagtgattctcctgcctcagcctcttgagtagctgggattacaggcacacgccaccacgccctgctaatttttgtatttttagtagagacagggtttcaccatgttggtcaggctggtctcggactcctgacctcaagggatctgcccgcctcagcctcccaaagtgctgggattacaggcatgagccaccgcatccagcctgtttgggtcactttctctgcacagcgctgggctggtgcttgtagcttttctttttattttttcactcaaggacagtcctttatgtctttgtctttgtgctagtggttcacctccagcttctttcccatgcacaggcttcaggcaactgataatactttggctcagtatctccacccaaatctgatctcgaattgtaatccccacatgtcaaggggagggacttagtgggaagtgactggatcatgggggcggtttcccccgtgctgttcctgtgagttctcatgagatctgatgattttataaggggctcttcaccctttacactctgtgccctgctgccttgtggagaaggtgcctgcttccccttctgccatgattgttaagtttcctgaggcctccccagccatacggaactgggggtcaattcaacctttttcctttataaaataaattacccaatcttgggtagtatctttaaagcagtgtgagaatggactaatacaggaaacttctccagtttcctggtcctgtaatcatttgcatttgcagcccttgatttagagggcaggggtgagcaggtgtttatcatatgaagaatctcatttaatacgtttttctgtctttgcagccactcctttctattctattttcttcctgactgttgatcaggaagtagttctaccagttaagaacaagaaagtaggcttgtaatcccagcactttgggaggccgaggtgggcagatcacctgaggtcaggagtttgagaccagcctggccaacgtggtgaaaccccgtctctactaaaaatacaaaaaaaaaaaaaaaaaattagccagggatggtgggcgggcacctgtaatgggaggctgaggcaggagaatcgcttgaacctgggaggcagaggttgcagtccgtgagctgagaccacgccattgcactccagcctgggcaacaagaacaaaactctgtctcagaaaaaaaaaacaaaaaaacaaaaaaacaaaactgggaagtagttgtaaccacagacaacccccaccttgaacaggttatttaccaaaagttcttttggacattgattgtatagaacacagttcacattatctgataggaactatgttatttaaaaaatggatttgtttcccaggtgagcctgaggagtctgttctctcctttatgcagttgaaattcatatagacttgtgagttctttgggactgtaatcaatatacagtatgtgatttctgtgggaaggtataatacattttaacgttctcagtgaagaagggagtatgctgttttccaaccccagtcggtattccctggtgtgacctgccagctaccagaccccaacagttgttacaaactctagccactgttttcaaatctgccactaaatatcaccactcatactcagcacatgaccttgcctccacttcactgagaactttgagccatctggttgattttcttcacacttctaccagtttgtcatccctgcttctccagagttgccctctcctcctgtctcaggggatgagatgcttcttctgctgtttgaggcagtcctttgccaggagccttaggcttcactgctgcttctttggcagtcttttctcatcagttattccccttcattctccccattctgttcccagtggctgtccacttggggaggaggggtgaagattttgcctccaggagacatttggcagtgtctgcagacatttttggttgtcacaattggggggtggtggtgatgcatgtgctgctagcatctaacgggtagaggcgtgtagatatcctacaatgtacaggacagccccatgacaaaggattacctggtccacaatgtcagtagtgcctgggttgagtaatgttgctgcatcctcagggtctcacttttgactccttcgtttttctctgcccattatcttatgcctaagattctcatcctaggaaaccttccctgaaccacatgtccaatcctctcctagctacctaacttctccccttctcactgaaacttctgaaagagcgatttacacgtagtctctcattcactcttcaaattttagctgttgctttctggcttcccacccccaccgctgcttaaactgtttttgctgagaatgcctgtgacctcttgtgtgctgcatctagtggattcatttagtcctaattttacttgacatttttgttgcacctgacactgttaatcactatccccttgaaccaatgtattccattgtcatccttgttctccatgtccttctcttgtatttctttccctccctcctgtgtgggcttcttgatgatctacttactccttacacactgctgttacctggttttgacttcttagccaagaattatcataggtcattgtctccatgaagtaccttagttaccccaaggatttcagttgcacttatatacagatgtttttctaaatttctaaattctttttttttttctttttgagacagggtctcactctgtttccctggctggagtgcaatggcatgatcacagctcactgtatcctcaccctgtaaaaacggggtttctctgtgttgcccaggctggtctcagaactcctggtttaagcgatccaactgccttgacctcccaaagtactgggattacatgcatcagccaccatgcccggcttaaattcttccatgacttttcccctccaggctttagtgtctcttgtaatctgctggaaatctacacctgaatattctataggtaccttacgctcagcatgtctaatgtgaagtacatcttttcctcaaacttcgttttctgagatccacctgggctcccaagacagatagtggggtcttgtccagttcatatattatctacagttgccaatgtgatataaaatatgatttaggtcatatcacctacttgaaagtctgcactggtgctgtcttggtaacagaaagagaaagactgaattcccttattttgcccatcaggctctccttgatatagtctctgcccacccacctctccaacctcacatcatctctcttctgcctcatacgctatgctccggcacgtataggttcctatacaattttgtttcatacttgatgtctttactttttgtcttttgcctggaatgcagtatttttctattgaatatgtgggttgcttgccttctgagtggtgagattccccattcctcatggaagctacagttaattggcaccttgccccacttctgtggcctcaacattatgaggagtaaggatgtctgaattatttcagagagccagggcttggtaaatgctgcattagtcttgttgaaagaaggtagggaggggacattggcaagggtgtttcacagctcttcagttgtttctttcctcagtccctacttcctctattttattacctttcaggggttcttctggaaaaatgtatctttggagggagagcctcttttctttatttttttaaatttatttatttatttttgagacgaagtctcactctgttgcccaggctggagtgcagtggcacgatctcagctcactgcaacctctgcctcctgggttcaagcaattctctgcctcagcctcctgagtagctgggattacaggcgcccgccaccatgactggctaatttttttgtatttttagtagaggcaggatttcaccatcttggccaagctggtcttgaactcctgacctcatgacccacccgccttggcctcccaaagtgctgggattacaggcgtgagccactgcgcccggcctgagagcctgttttctttgggttttgccatctattttaacttgcttcagtgctccttggaattcctcactgatctatgtgctgagagcatctcctagattctcagggctgctctggattaattttttatttctttcgcttatttcactgagttttggtgtgggaggaaaggtaaatgtgtgtttggtcagccattttaaagtagagcttcagtgccctgtcttcgtgggtttcccccttttctctattgcagacatcatggccgagaatgtcttttaaagtgaatcattgtgtacacctttgatcattttattaagatactggccttatatcctgcccttcccccctgccgccccccagaatcactgggtggtgatggtagatgattcacatgggaatgtgctacacttgtgaaagatgtagaggaaatactgctgattctcctgaaggaaaagtctgttaatttttctctgttggccattctggccgcatggtttctccttattgtttttttgttggattttaaaaattactagtaagattgaacatttataagattcatttgttgcccatttatattttttcctgcattttcttttcatgttaataaaagttttttccccttaatacgattcccttaattctttttttttttttttggagacggaggctcactctgtctccaggctggagtgcagtggcgcaatcttggctcactgcaacctccacctcccatgttcaagcgattcccctgcctcggccttccgagtagctgggactaccggcgcatgccaccacgcgcagctaatttttgtatttttagtagagtcggggtttcaccatgttggccaggatggtctcgatctcttgacctcgtgatctgcccgcctcggcctcccaaagtgctgggattacaggcatgagccactgtgcccggtccccttaattcttttgaagtgaaataagcagatgctgccaaatgtaagatatggcccggtccccttaattcttttgaagtgaaataagcagatgctgccaaatgtaagatatgttgctcagtttttagtgtagatttattatgttctgattcttggaaaatgaaaatctactcctggttttttggttaatacatacctcatgcggtggctgtgaaaattaaactaaataacataggtgaagtgcccaacacagtacttggtacataataggcagcattaaatactagttcctgttattcattctttcttctttgccagattattaaaatgactacagtactccacaccttagacaaaaagttgtttttactgaacccttgttcgatgaaggacagtatgccaaataccttgagggatacagagatgttttaggctgcttcctgtccagggataaatattagcatactatatatatagttacattttgaggctttttttttgagacagagttttgctcttgttgcccaggctggagtgcaatggcgcagtcttggctcactgcaacctccgcctcctgggttcaagcaattctcctgcctcagcctcccaagtagctgcaattacaggcatccgccaccacgcccggtgttttcttgcatttttagtagagatggcgtttcaccatgttggccaggctagtctcaaactcctgacctcaggtgatccacttgcctcggcctcccaaagtgctgggattacaggtgtgagccactgtgcccggcctttttttttttttttaacatgctgttgtgaaaaccttttggtcttttaactgttactttatttgagcacagaacactttaaagtttggttgccacatttaatccatgacacctctgtgagagtagttattagttccattttatagatagggtccctgaagggtggcaggagtaaaaatagggtatattgggatgtagaagaatgctaaccattattgtttccaaccttggtaggtatagagtaaatacttgttgaatgaatgaatgttcttttataagttgtgtattaagcccatacctaaatcttatctctacttcttttcttttttatttttgagccggagttttgctcttgttgcccaggctagagtgcaatggcatgatctcggctcactgcaacctccatcttccgggttcaaacgattctcctgcctcaggctcccgagtagctgggattacaggcgcccgccaccacacaccgctaatttttgtatttttagtagaggcggggtttctccatgtttgtcaggctggtcttgaactcccgacctcaggtgattcacccgccttgcctcccaaagtgctgggtttataggcgtgagccaccacacccagccaatatctctacttcttatagttttattcaaccccttctatgtttaatttaattgattaatttttgtgagacagggtctcactctgttgcctgggctagagtgcagtggcatgatcttggctccctgcagccttgcctccctggttcaagcaattctccagcctcagcctcctgagtagctgggactacaggtgtgcgccaccatgtcctgctaatttttgtaatttttggtagagatggggttttgccatgttgcccaggctggtctcaaactcctgatctcaaaatgatccacttgcctcggcctcccacagtgctgggattacaggcctgagccaccatgcccggcccccttttatattttatctggcaaaaataagcattaatgtttagtggttgatagggaggacattggaagtcggaagagagataacccacactgttttatacataataaaaaggcattaagggaaggtatatgtgctgatactgatttaactttttgcccttgttctgattctttgcaagactacttttctggtttctgtaacaactgcaaagggcttcccaagtttggggctagggtaaatggctcaatttgttgcactctaaggatgattgtattaatagatttttcattctaatctctggtagagtacggaaaatcaattataattaggctcagactcaaggggaaaactttaggtagatgaatttcataatatacaaactttaatagaataagtgattactgtctcagagtttactctgtatttagctgtctgtagttggttgtcttagatagtgaaatatggtcttttagtaaaaatggtaagacccctgtataggatttgaagtaggacatctatgagcttatttcaggtagtaagtagtattaacacatcgctttcactctccacatggaacactgcattatttttttttattttttttgagacagagccttactctgtcacccaggctggagtgcagtggtgcaatcttggctcactgcaacctccgactcccgcattcaagcgattctcccacctcagcctcccaagtagctgggattacaggcacacgctaccacgcccggctaatttttgtatttttagtggagatggggttttgccatgttgcccaggcttaggtattctttttctgtgtttctcctcaagtgtatggttctctagtttgtgaattcactgggtggttgtgatgtccagtcagtaaaatgataaacatgaaagcactttgaaaatgatttaatgtcattgcatggaaatgttatagtatcattgcatcactatttataatagttctcaagtttttttttttttttttttttttttttttgagactgtgtctcgctctgtcacccaggctggagggcagtggcacaatcttggctcactgcaatctccacctcctgggttcaagtgattctcgtgcttcaacctccctagtagctgggattacaggcgtgcaccacgacgcctggctaatttttgtatttttttgtaaagatggggttttaccatgttggccaggctggtctcgaactcctgacctcgtgatccatccgcttcagcctcccaaagtgctgggattacaggcgtgggccactgggcctcaagtgtttttaaccacgtttgagtgccctcttctttttggtcacacaactttactgtaaccccactaattttttcagatgtagttcatatactatctcctgtataaaacataacctcttcagtctgaaaggggtactgtttcctttgaacatttatagctattttgatttgtacagttcatttggtcatcatgagtctgaattgtcacatcttgccttttgtcttgataagttaataatgtaggatcttaagatgtttatctcttagtgagaccagcaaacatttattaggacaataacacctattgtcctaatctctggacataaagtttttgtgtattaattccagtgttcacaactggattgtaaggtactttaaagaaaagaccatgatgtgtatgtacttcctggtttcatgaatgttttctttatatataataaaatgtagcagtgggtaagattagtggatgtatcattaatgttaaaattgagttttaacattttcctttttagaaccagtctagcacttctctggggtaactgaatttttgttaaaattggtccatatatatttcctgtcttttttagtttgtttcacatactttgacttatttcctacttatttctcctccattaaggtataaattctctccttaaattgcttagccttggattttcacagattcttttgaaaaacctacgttttcataggcgtgttgtctttgtaagatctaactctgcagtgatttattgagctcgttttgttttacttattgagcatcaagattgaaagaggaaagtaatgtaattttcattatttataatgcatttggctttttaaagtgttttgaggttaaaaccaatagcagtctagcactagttgaaggtattttgaagaggtggttagtatccttggggctgttaatcaggaggtagcctttatgtagagacttgaaggaatagtgttagcagggtgttcttgtaggagctccccttattcgatggtttggagtccataattggaaaattaattttaaaaattggtaaagctctaagcaatcaaatacgaatgcacatataactattttgccataaagcatacttttctttcttctttctttttttttttgagatggagtcttgctctgtcgcccaggctggagtgcagtggtgtgatctcggctcactgcaacctccgcttcccaggttcaagggattcttgtgtgtcaacctcccgagtagctgggattacaggtgcctgccaccatgcctggctaatttttgtatctttagtagagacatggtttcactgcgttggccaggctggtttcaaactcctgacctcatgatctgcctgcctcggcctcccaaagtgctgggattacaggtgtgagccaccgtgcccagcctaaagcatacttttgattaccagtatttgtttgtttgtttgaggcggagtcttgctctgtctcccaggctggagcgcagtggcgtgatcttggctcactgcaatctctgcctcccaggttcaaacgattctcctgcctcagcctcccgagtagctgggattataggcgcacactaccatgctggctaatttttacatttttagtagagatgaggtttcaccattttggccaggctggtcttctactcctgacctcaaatgatccacctgcctcattatatcatttgaaaatgatataatgtcattgcatggaaatgatataatatcattgcatcactataatagttctcaagtgtattttttttttttttttttttgagaccatgtctcactctgtcacgcaggctggagggcagtggcatgatcttgggtcactgcaacctctgcctcagcctcccaaagtgctgggattagaggcatgagccaccatgcctagctcattgccactattttgacgtatgtctaggatctttctcagttgactgaagttcggtgtcatcttgtataatccatcctatgtgtgcagtaggttcagtttcgacgacttgaaagtagagcaataatttagataacctatgaaactagtgcagaataatagatttttatagttgtctcctgtcttttaacataatctaacccacatccgatttgacaggcacattttttaagtgactcatcacctttgttgaatcttgccaaagcatccaatgtaatttttacaaaattggcactttcttgtaattggtttgcacactatttaaatgaaaaacatgtaatgattgttaccagaggaattgacagttttgggtaagaaatgcaactgacttttggatacaaagcatccagcttaatataagggagcagaagtgtgaagttgaactagatagttaaccattagccaaaaacatttgtactgatggcaacagccagatctctgttttccagaggtaatgaggagtttgatgaggagtttggtaactgttaggttgaggactgttaagaggcctgctggaggccagtatggcacttcagtgcacagtgcaaacccgcttctgtaatgcattttatactttttaaaaattccatttcccatgaataacatgcttttttatgtaacagaagataatcgtaacaattatcatgtaacagaagataactgttatttggaatgcttggagaaaatcactgtttaagatttctgtaaagccttttcctgtccaagatttctgtaaagcctgtttctgtcattgcctgaaacatcattatgcagcacgtgactacctttattttagcacttctcatttggagttaaccctttcacctttactatgaggtcttcctctgaaaaacttttgtatacaacatctgatccacagttgatacccaacaaactgaatgaaacagaagttctggccacttaagtagatgtcacaacccaatctttttctttctttctttctttttttttttttgagacggagttttgctcttgtcacccaggctggagtgtggtggtgctcactgcaatctccgcctcccaggttcaagtgattctcctgccacagcctcctgagtagctgggattacaggtgcccaccaccacgcccagctaatttttgtatttttagtagagacggggtttcaccatgttagccaggctggtcgaactcctgacttcaggtggtccacccaccttggccacccaaagagctgggatttcaggcgtgagccaccgcgcccgcccgtcacaacccaaccttccgtcacaacccaatcttgatgtggtgtagttttcattgatgtgctactgaaaaataagctgttattatttataaactcagttcagagaatattttaggataattatactcagttgagtatattatattccatatgtcaaagatgctgtgctatgtctacagagttctgagcttaataatacatagttcttgtctgtggacatgtatattgttggtacagtgggaatatatgaggaggagagattaattcaagcctgaaggaatttgagaggatttgagagtagataggacctgaactggacttggaatggtaacaataattaggattttttggcagatattttactgctttatggcattggatagtctggatctccttcaaattcttttcccttcttttctgtcaaatacacctagtcttcctacttccatctctagccttcttcctctgcaataatctttattttccttaacaatctattgcttttggccattttcctcttctttcttgcccttggtgtaatgcgttattgttttaaccctaaccctgtgcttctggaaatatgcttttctatcttctacatagccacaacacttcatcagtatccttcttagagcatttatcgtttctttgcactatagttacatacagactccatcctctgctggaccttaacttcttgagggcaagttgcacctttatagttcttaaagtatctagtatatagttttctaagtagtaggcaccacatactattctcttacatttagcttctttcctcaaactcaactcctcttctagacttgcctttttctgtgcatagtactagagttctttcaattccccattctggtcagtgagttctgcttctgtctttgaaatgttatttgtagccccaccattttttccactgtcgtcattgcatgccaattaaaagataaatatttagtgcatattgttctaagcactgtgtaggtgctaggaatacaaatataacagatccaattccttgttcttagaatcctagtcggggattattttggtactttgttgagcaaatgtttattgaacactttctctgtgcggagctctattgtaggcatagatgtattatatcattttccacaggctgctcatcttcaaggggaaaacatggctactggatttcctctgttctaaggtacacttttcttcccattttcttctagcatctctgaaatccagatgcgtctaaaccctggtatgtttaatgtttttttgtttgtttgtttgtttttttttgactgagtctcgctctgttgcccaggctggagtgcagtggtgtgatctcggctcactgcaacctctgcctcctgggttcaagcaattctcctgcctcagcctccttagtagctgggattacaggtgcatgctgccatgcccagctaatttttatatttttaatagagatggggtttcaccatgttggttgggctggtctcgaactcctgacctcgtgattgacctgcctgggcctcccaaagtgctgggattgtagacgtgagccaccatgcccggctttttttttttttttttttttttttgagatggagtttcactcttgttgcccagagtggagtgcaatggtgcgatctcgactcactggaacctccgcctcctgggttcaagagattctcctgcctcagcctcccgagtagctgggattacaggcatgcgccaccatgcctggctaatatttttgtatttttagtagagacagggtttcaccatgttggccaggctggtctcaaactcctgacctcaggtgatccacctgcctcagcctcccaaagtgctgggattacaggcgtgagccaccgcacccagcctgcttaatgttttttattcccccttcaagagctgttaaagtgatgctgcttacaactagtagttgtaactatagtataatttctaattactatactgtatactatagttgaactatagtatatattaatggtaaatatgatggacatgtgtagaattgtgctgtcaaatgtggtagcttctagctacatgtggctatgtaaatatgttaattagacattaaatttattaaattttaattaaaactaaaagattaacttgaacccaggagtttgagaccagcttgggcaacatggtgaaactctgtgtctacaaaaaatccccccccaccccaaaatcagctgggtgtggtggcacatgcctgtagttccagctactgtgggagttatggtggaggtggggctgaggatcatttgggaacgggacatcgaggctgcaatgagctgtgcattattgcaccgctgcattccagcctaggcgacagagcgagaccctgtctcaaaaaaaaaaagaaaaagaaaataaaggttcagttcctcagttgcactggccacagttcagatacccaatagccacatttgactagtggctactgtattagacagtgcagatatagaacattcccatcattgcagagtgttctgttaggtagcactggtctagaatgtggttccacagttgtacctggagggttggaaaagctttggttagtttacttcctggcattattattacctgtatttccttccttcagggaggtcagggaacttttctgtcttttccttctgcctttagttttaccagggcctgggacagtaagtggtaggtacgcagaaataaaaaacaactggagcattaaatagtttagataaaaaggggaaaggctatacatgtgcataacaggaaatagcttagctggctttattcaacgtgtatcctggtgtacttttttaagagggtttttagaacaaatttcatcacattgaaaatttaagaacttttatctaggtttgtatcagttttgttgtcgtgctgctataaagaaatacctgaggccgagcaccatggctcatgcctataatcccagcactttgggaggctgaggcaggcggaccacctgaagtcaggagttcgagaccagcctggctaaaacatggcaaaaccccgtctctactaaaaatacaaaaaaaaattagccaggcatggtagtgggcgactgtaatcccagctactcgggaggctgaggcaggagaatctcttgaacctgggaggtggaggttgcagtgagccaagatcgcgccactgcactccggcctgggcgacagaacgagactgccttaaaaaacaaacaaacaaaaaagaagtacctgagactgggtaatttataaagaaaagaggtttaatatgttcatggatggttctgcaggctttacaggaggcatgactgcttctggggaggcctcaggaagctttctttctttttttttttttttttttttttttgagatggagtctcgttctgtcaccaggctggagtgcagtggtgtgatctcagctcactgcaacctgtgcctcccgggttcaagtgattctcctaccttagcctcctgagtagctgggactacaggtgcatgccaccacacccagctaattttttttttctttttccgagactgagttttgctcttgttgcccaggctggagtgcaatggcacgatctcggctcactgcaacctctgcctcctgggttcaagcgattctcccaccccagcctcccgagtagctgggattacaggtgtgcgccaccatgcctggctaattttgtatttttagtagagacagagtaattttcgtatttttagtagagatggggcttcaccatgttggccaggatggtctcgatctcttgacctcgtgatccgcccgcctcggccttccaaaatgttgagacaggcgtgagccaccgcactcggcctcaggaagctttcaatcatggcagaaagcaaaggggaagctggcaagtcttacatggctggaggaagcggggtgccgtaggggggaccgtactacacacttttaaacaaccaggtcttttgagaactcagtatcacgagaacagtacccaggtagatggtgttaaactattagaaactgcacccattgtctaatcatctcccaccaggccccgcctccaacattgaggattacaattgaacctgagatttgggtgaggacacagatccaaaccatatcaaggttctttttatttatttatttattatttatttattttttggagacagggtctcactctcttgcccaggctggggtgcaggggtgtgatctcagctcactgcagcctctatctatccaggttcaggtgatcctcccacctcagcctccagagtagctgggaccacacaggtgcattccaccatgcccagctaattttgtattttttgtagaagcggggttttgtcatgttgcccaggctagccttgaactcctgggctcaagtgatcctctcaccttggccttccaaagtgctgggattataggtgtgagccaccattcctggcttatctaggtttttatcccttattaagtgggattcaaggaggcccatcatgtcagaatgctgtgggttggcaggaggcatcacaatgaaattttccatgttcccaaatttgatattcacagtactacatataatttctcagggaagatagggttggacacgatggaaatattttggtgaaccattcgttcccttgggtttctttctcatttggggagtgtggtttacaatgattggagcaaaagtttcctgaatctttttcttgtttccattttattgcatggtaaaacacaatttatccactttcttgtcaatgagtatctagttagattcctgttttttggctaattcaaataaaactatgaatgtttttgtaccggtcttttggtgggcagttgctttcctttctcttgggtacatacctaggaaggagggaagttgctgggccacagcatggccagttttctaaaacagttgtagcaatttatgttgctttctttttgaaaggacaaaagattaaagtttgccattaggcatttttactgtccgagtatttccatcaagcctgtgtgagttaagtcattaattaccaaacatcacagacctttggggtcacttgcagataaatctgaaaatagtatagacctaccatatcattcaaaagaccttaaaagaatataaaaactaagcatcttatctctccctctattgtcaatcttgatttactttcaagacacacggtctttgaagaaacttgttcatgcctttgtaaatggattgtgttgagtactgcttcctgttgcttactgttatgggaatgagtgtactttgcctgtcagtgatattactagctactatttgagggcttgcagtgtgtaacagaataaaggacaatgcccttttgaaattctagttcagcataagtcagcaagtttcaaactgagttcttgatatttgcaaggttctgtgctaggcatctccatgtccaaagaccaatgagaatgaatctcctaacctcttgaccttgtctaatggggataggaggcacataccatgatacaagaccaactataattgtcactagaattggaaataaagtgctgccgggcttccatatcacagcatatcacattttatttgggttgcagagaggggaaggtatccttgtaaagtaagcttatccaacccgcggtctgtgggctgcatgtggcccaggatggctttgaatgtggcccagcacaaattcgtaaactttcttaagacatgagattttttttgcggtttttttttttttttcttttttagcttattggttatcgttagtgttagaatatttcctgtgtggcccaagacaattcttccaatgtggcccagggaagccaaaagattcgacacccctgctgtaaagcttcatggaagggttgtggtctaagaggtccaccttgaaaggatttcagtcgcagctgcaatatatgccaggtgaagggaattgcttgatggaatcatgtagcaggaacatatagtctataccaagtggttctcagagtgtggtccccagaccagcagcatcagcatcatctggaaacttgttagaaatgcaaactcttgggctccactccagacctactgattcagaaactcagaaatcccagaaacctgggttttaactagttctctaggtgattgtgatgtgttaaagtttgaaaaccattggtctagacttaattggtcagagaatagttgaagtaaggtttgagaagggaagttatgagaacaagaaggcaggggccttactgcagagaccttgattgagtactagggtgtgagtatatggggctggggaaccgttagggtgaaggaaaggacatccttggagtttactttaggaagagtgagccaacaaactttttttgtaagatgaattaaaactaaaagatactggaggccgggcgtggtggctcacgcctataatctcagcattttgggaggcctaggtgggcggatcacttgaggtcaggagttcgtgaccagcctggccaacatgatgaaaccccgtctctactaaaaatacaaaaattaaccaggcatggtggtgtgcgcctgtaatcccagctactcaggaggctgaggcaggagaatcgcttgaacccaggaggcggaggttgcagtgagccaagattgcgccactgcactccagcctgggtgacggagcaagactctgtctcaaaaataaaaaataaatgaaaaaaataaaagataccggaagctgggagtagcagccttggaaagtgaaaggagcaacacagctgggatgagtgagccttgacagctggctggtcaagtgtcaggaaagaggccacagcctcagaagcagctatggttctgaacctgggtgttgagaggatggtggtgcctttagaagcagtgcaggcagaagacgcaaaggccacatggtgcaggaaaatgggacaagggggaagaggatgttttctacaaataattgcttcttcccctgaatgtacaagtttagtgtaagaaattcaggtacttgaggggacagtgaagaagaatgcagaatcgcctcaaatcccactttacagagattagcaaaacattattctctttaaatattttgagtatacatttgtttctttaaactcagttttgtatgcatggaattatacaattccgtaacaaattttctcagacaaattgaatttgaatacgttagtgttccacacatgaatgatcagtgtgcgtttggaaattggtggattttatatttgggaaacagaatgtttatacaagcagctaattggtaaagattgcaatttcattatccatggtcataaaaacatcctgtccacattagttgttacagaggaaatctggggcaaaacagtttaagatgcttggtgtgctgttagtctggggagaagaactgcaactaagaagaaaaaagatgaaacatttgtggcttttattagaatagcaagtttattacggtgtcttacaagaactaattaatattgggcataaaatagtctcattacataggtcaataccaagttccaaagttctcctttaaaataggcagctagctcctagtgaattttatgagccacaagcaaagatgtggaatagtttgcccatttcttagttttgtgacatgtatgacagaatataccatcttcttaagtatggtgtgtgtgttttttttgtttttgtttttgttttttttttaaagaaattatgggcagaaacctttatatttcttcctacctgatttgaatgtgagttcacattttcccatacctatgagagagcactagatattttccagttactttacttattaccaatctgataggttaaaactgatttctcatttttgttttttttttaatttaattgattactattgcgatggaacagggtttttctttttcttctttttatttaaaatagagatgaggtctcactaagttgcccaggatggtctgtaactcctgaggtcaagtgatcctcccacctcagcttcctaaagtactagaattacagatgtgagccatcatgcctggccaggaacaaacagcttttattagataattgcatttcttttgtgaaaggactgttaatatctctttgtctgttttctctttgggtgtttatattatactgatttgtaagatgctaacatattaaggatattcagcttctgtctttctcttttttttattttaccacttttttaaatcaagaggtgtagatactcattggctttttaaactatgccacagtgaagcatggcaaacacttcataaggtataggagatattcagtgaattatcacaaagccaaaccttatgtaacttgacctaggtgatgacataaacattgcaaaaccccaaaagtcagtagtgtacctaaggctgggggtgaaaggtgaggtctaccccaggttcaggcaataacaaagtgcattttctttagggaatttaaaatcagtaaaattattgactaagagttggtctgctttttgttatcatgtgttggccatttaaaaaatgtcagtgtgtgtacatgtatatataatatctgctttgtggctgaactgttaactttctttttgacaaatagaagttcttaattttaatatagtccagtttatctgtcttttcctttatggtgggtgcttgctgtatccacaaagagatattcttctatattatatttaaggagcattattgttttgacttttatatttaggtctgtaatccacctgaagttagtatttatgtatggtgtaagttggaggttaagttgaattttgttttcccttatgaatagccaaatgacagtgtcatttgaaaagatctgatttgcagtgccaactgtcttgtacagcaagcatccctgtatgatctatttctgggccttctgttcattcttttcatctgtttgtctagtgactgagctttataatatgtcctaatccagagagaaagtctttttgttgtacttcttcaaggacgtcttgtttgccttggctatttgtatttatgtatacatttttaaatcttctgccgggcatggtggcttatgcctgtaatcccagcacttttgggaggccgaggtgggcggatcacttgaggtcagaagttcgagaccagcctggccaacatggtgaaaccccgtctctactaaaaatacaaaaaaaattagctggatatggtggcgggtgcctgtaatcccagctactcgggaggctgaggcaggagaatcccttgaatccgggaaggggaggttgcagtcagccgagattgtgccactgctctccagcctgggcgatagagtgagactctgtctcaaataaataaataaataaataaaatcagcctgtaaatttcgattaaaaatttgttaggattggttgggattgttttgggtctctagatcaatttggatagaattgacatctttacagtgttaaatttcaagaacatgggatatcccttcactttattaggtccctttaatttgtaaaagtattttttgtttgtttaatagctttctacatagaagattttccactttttatttctaggaatttgataatttttgatggtttcaggaatggtattaaaaattcatttcctagctttattgctggtgtatagaaatactgttggtttttgaacattaacttttgtatccctcagctttgataagctaattttttctgctagcttacttgtagattgttttggattttctattgtgtacaatctgtggaaaatgataggttttttggtcattcctagcactcatttttgtctagatttctacctgttctcagtgaagagatttgtctgaattatatataatcattattactggaagcagaaagtcttcctaaatgaaagataaaaactacaccccattctcatttctgaattatctttgaatttaaacccaaatctcaaaggtgcctcaatcccagtgaaagctaatagtattttttgagacagtgttataaatgttcctaatggatttataagcaaatcttatgaaatctttaaaatttaattttttttgagacagcttttaatgtgtatctcaaggacttaaaatatgaaaacttatcagtagtttaaaaaattcttccaagtagtgaagtcactagtgaagccataaggtgtctctgatgtgctcatttttcttttcctttttttgagacagggtcttgctttgtcatccaggttggagtgtggttgctcattgcaacctcagccttgagctcctgggctcaagagatcctcctgcctcagcctcccgagtagctgggactacaggcacccgccaccacgcccagataattttttgtatttttttgtagagacagggtttcgccatgttgcccaggctggtcttaagctcctgggcttaagcagtcctcccaccttggcctcccaaagtgctgggattacaggtgtgagccaccatgcctggctcatttcctagtccttgttcttatgagcctcctactggaagtaccccagggagctctccgcatttgcagagggcattggcttgcttgggtaatgctctgtggtgccaatagagatgcactgcaggaagaactctggaaacttcgttgggagagaagtggcatatgagcatcattgtgagcaagtgtcaggtaatgttttccagaggaaaataccaaattgactagttgtatgccagacacatctgacagtaataacagaggcatactctgaatatgaacctgtatagcatatgtacctgacagcagtaacttacttaagcataccccgagaatgaccctgaggtctaagaacaacttgtgttcatagggtaccgaactaaggaatccagcagtgaccaaccagcagattcattcattatctataaggaacatctgagcccccaggccagtcctgtggatcctgggctttgccggaagattgaggatctttgttttgggttaaatgaaggttgccaggtggaggttggtgggggagggtgctaagtcaaaatgttatataaactgcatgcttttttacaagtgggatcagttcttctttctagcctgctgccactggactggatggccctgcatgtaagttccctcaaaaaccctacatctttttcactagctctgggtctcttctttggcttttcaaacatggtgctgtccctattgaagttaataggggttcaggacaacattagtaatttgatgagttgcagctgagggatcagagtattgtcataggttgtcctgtagcattttcatgcatgctccttgtgaacttgaggagtctgtaagctgctgtagtcaaggaggtcaacaaatgctaagcagcctcagtaaagggattgcaacttaaaacagcccaccattgcaggttcatctccatgaaggaccagcaagagacagttacaatgagcaagggctctgttgactattttgggaattaagggagtgggcaagcaaaagctgtaattgtaattagtgttgtggaaggagaattatcccccacctttttttttgtctttcactgcggtttacatgtgataggtgtttgattaatgtcagttgtatatgtgaattgttatgaagactttagaaaactttagaaactaatgttaagtgatgattgaaatgtgctcagattaaaaaaataattttagtatcttcaaccagtctagctggttaaataattttattattcctgtagattaaaaaattttaaatatcaagtttagagaaaaatcttattctaattttggagtatgattatatttcaattcagtatgtagttttccaatttgaaaaaaatagctatagctataattataatcagcaaatgaatgggatctgagactgatttaagttaaaatttgtgaccttaaaggaattgattcacagtgttctggattcttttcagaatgtgcggatactgtaagtacaatttttcttcatagtaagtgtaaattaaatataaactctatagtaaactcaagcattctataagaagccacataacgtgctatttctttcttttcccagtggtgttttagtgaatcattagttgtatgtttctttcttgagttggagctgaagaaatccttcccactggaaatatgagttctataccattttgtgggtagggatccagcggtgggcctttagtaagcgtaagcactggcttttgcatttatacttgtttttatagaataacaccatcttgtaaaatgatttgttcccagagtttttctagatacggtaattttaaacacaccttatgaatgttcttttaaaataagttataaagtgaattattttgtaaaacaagagttcttttattagcatgaatatctcctaatcttccctcacccccagtactactagctacttctagggttgggttttcagatacaatcaattttcttagtcttacgtagtgctttggagattagtgctcagatctcgtattgaagtatggttcttactcatggcagataatttctgtcttttcacttttgagttgtttttatacccttgaatatagtaggctaactatagaatacctaatgtcacaatcatgaaagaaatagttggtaatttataaaagctgtacgaaaatgtatattagacttttatggtttttaaggtcaaaaagaaactgaagactctttagaaaaggtcacaaaaaatcattgaatagggctgggcgtggtggctaacgcctataattgcagcactttgggaggctgaggcgggcagatcattggaggtcaggagttacagaccagcctggccaacatggtgaaaccccgtgtctactaaaaatacaaaaattagccaggcgtggtggcacacacctgtagtcccagctacttgccaggctgaggtaggagaattgcttgaacctgggaggcagaggttgcagtgagctgagatgctgccactgcactccagcctgggcgacagagtgagactctgtctcaaaaaaaaaaaaaaaaaaaaaaaaaaatagcggggtgcagtggctcatgcctgtaatcccagcactttgggaggccgaggcgggtggatcacctgagttcgggagttcgagaccagcctgaccaacatggagaaaccccatctctactaaaaatgcaaaattagctgggcgtggtggtgcatgcctgtaatttcagctactcgggaggctgaggcaggagaatcgcttgaacccaggaggcggaggttgcaatgagccgagatcgtgccattgcactccagcctgggcaatgagagcaaaactctgtctcaaaaaaaaaaaaaaaaaatttcattgaatcagacctaccagtgtctagttcaggatttgaatgcttagtatatattcattccttttgggggaaaagatatttctaatgactacttcatatgttttgtgtttttataattttctagttagaattcacgggcttatttcaaagaagacttctttaaaattaccaatttttagtccatttgtcttttctcttagcaaatccccaaatgacaaattgattaaaagaacacttagaataaatactgtaagttgtattatttaatatgtatttttatgtgccacatgtagagaaatgattaaagacaaaagtaatgaagcagactttttaaagaatcacttgacagaaagcagagaacatttcttacatatagaagtaaatgggctgggtgtggtggctcacgcttgtaatcccagcactttgggaggccgatgcaggcggatcacctgaggtcaggagttaaagaccagcctggccaacatggtgaaatcctgtctctactaaaatacaaaaattagctgggcatgatggtgggtgcctgtaatcccagctacttgggaggctgagacgggagaagcgcttgaacccaggagatggtggttgcagtgagctgagatcgcacagctgcactccagcctgggtggctgagtgagactccgtctcaaaaaaaaaaagaagaaaagaaaaaaaaaaaaaagaagaaaagaaaaaaaaaaaaaagaagtaaatggatgaggtgaacctcattatcttaggaacattttagcttaatagtaacaggaaaatagctttcagaatgggtttaatcagaataattaaacccattctgtcagtactgctggattacagattaattgctgaattttgagtacattactgagaatttggtcagagaaatagaaccactgtgagtattatgggtaaggaacttatatggtaatcagactgtacacaattataagaggtgctggggatgggaatatctatctgaaaaaggaaagacctgaaaaaatcactaatagatcctcctgaggtactggtacaggttgataaatgagagcttactgggaaaattttaagaagccaaatgtgtacagtcaccaaagtaggcatgcagaaaggcttttttctggagagttctgtggaaggctgtttcctccgtgtagctgctgcctctgtgggtccacagccaagcatttgttgttgggtcttgctctactgttggtcagatcagaagaagagctggacacagaggggacaagaggagagcagggacaagctggaagctgccacacacctctgcatttgtcgtcaccctgtgtgaccttcatgaagatcttgtaagaatttggccatcttgaacttggtgtactgtgcaggaaagggaattctgggaaacacagttcccggcttgatcaagttcacaagagactgatccactacattgagcttctcattttgagcatctcaagtctttttttttatgtgtggttaaaaatttttattttttatttttattttttgtgggtacatagtaggtatatatatttatggggtacatgagatcttttgatacaggtatacaatgcataataatcatatcagggtaaatggagtattcattacctcaagcatttatcctttctttgtgttacaaacaatccagttatactcttttagttatttttaattttaatttagttttattaattttttttgagacagggtcttgttctgttgcccaggcgggagtgcagtggtgcaatcacagctcactgcagccttgacttccagggctcaagccatactcccacttcagcctcctgagtggctgggactacaggcttgcattgccacacccagctaatgtttgtaatttttgtagagacgaggtctccttatgttgtccaggctggtgccttaactcctcagctcaagcaatcccctaccttggtctcccaagcaatcccctaccttagctgggattacaggtatgatccactgtgcccagcctagttattttatttttatcttattttgtttcagtttatgtattttatttattttattttttattgtttttttgaggcggagtctcactctgccacccaggctggagtgcagtggcatgacctcagctcactgcaaccagctcttcccgggttgaagcaatcctccaggctcagcctcccaagtagctgggattacaggtgggcaccaccacgccttgctaatttttgcatttttagtagagacaggagtctcaccatgttggccaggctggtctcgatctcctgacctcaagtgatccacccactttggcctccgaaagttctgggattacaggcatgaggctctgtgcctggctgctgcctagttattttaaaatgtacaataaattattgttgactatagtcaccccgttgtgctatcaattattcattctgtctaactatatttttgaacccattcagtgtctcttttggtctcatctcatcagtagatgatagcaatgttaaaatactttgagcctcaagattttcatttcctgatggtatttactgaggaatttaaaatgctgtactttggatagcttttgttcttttacttattaacaccatggcctttccctagtgtattttaccatacagtgcatctgtatcttattttctgacttttctcattgttgttaaagttttacaatcccagtaaatgaattccaggccagataatatcatttcagttttggagaggaaaacgagtacaaactttaagtagaagtaacttttacatagtctttggtggatttaggttaaaaatacccaagcatgccataagacattgtgctgtccttctgaaacgataatattccactctagcaataatgaataaaaggggatgacctttttcaggagatctaaatttgtgtacttctaggctctttgaaatacagagcatcaaaattttgttggctaggttgatatattcagccagcaaaattaagtggtttgctgttctctgattctgcgacacatcgtttgtgttctgggtctataccttctgtcttctgcagtgcaagtataacatacatgctagatagtttctgatttttttttttttaaatgtggatatctgacggagtaggggattttagggcatgataagatatagaaaatgctgaaaatagttttcatttatttccttcctgcagtccataatggggtgttcatttgcctctttcccatttaatttttcctctctagggttggagaatctcttctaattttttttttttttttttgagacaggatcttgctctgtcacccaggctggagtgcagtggcgtgatctcggctcactgcaacctctgtctcctggatgcaagccactttcctgcctcagcctcctgagtagctgggactacaggcacatgccaccacgcctggctaatttttgtatttttagtagagagaggggggtttcacaatgttggacaggctgatctcgagctcctgacttgaagtgatccatccgcctcggcctcccaaagtgctggaattacaggtgtgagccactgtgcccggccctcttctaatttcttttaagagcattcactgataataactgaagtatcctggagagttacatgaacctcttagatgtagtcatagaatatttaatatattttgttggcttctagtatctgttcacttttagaatagtacagtattttttttttccagtaggtgctcgtcacccaggtaaacactacattttccagtctccgttaaagccaggtgtggtagaggattaaatcttgtccagtaggatatgaatgaagatgttaggtacatcttgggtgttttgcctaaaaggagtggagttttggcctccctgtcctccacttttcccccttctctgtggctgagatatggggaaattggtgagagttgagttagatatctcagactgtgatatggacagtgctggaaccacttacctggacttttacatgaaagataaaaatgaacttctctctcttttttttttttttttggagactcagtcttgctccatcacccaggctagagtgcagtggcgccgatttcggctcactgcaacctatgcctcccggattcaagcaattcttgtggcattttttaaagacctgggggtggggagaggggatggtgtatgaaaagtaggccatcaggggaacttcggttcttttttttttttttgagacggagttttgctcttgtcacagctcactgcaacctctgcctcctgggttcaagtgattctcctgcctcagcctcctgagtagctgggattacaggcacgtgccaccacaccagggtaatttttgtatttttggtagagatggggtttcactgtgttggccaggctggtctctaactcctgaccacagttgatccacccgcaccatcccaaagtgctaggatgacaggcctgagccaccgtgcctggccctgggaactttggtctaatgaaataaaatttctgcaaattaaagtgttcgtttttgttaccttgatagcattagtctagactttcttcatttttacaagaccgtgaggagattattcatggtatagtatggtatcagaaaaattgtaagggtatggtatgtgttgattatttccccgaaaaccatcctattttcatctctgttgcctctacctttattaaggtacataagtccccaagttttataagtccccaagtttctacctcctcggaaccattttccctcatcctcaacaatcctttctgatatagaagtttatcacttgtggtatgactgttctccttaaaaccttcaataatttctaatgcctgaggaccaaagtaaacacagtttataacaaacaataatcaaacacaccttgtagcaatcagtataacaatgcccttttacagcagattaaattattgaagtgacttgttcaaagtagcagaggaagataaaagcataagcgtgttttgctgtacagaattgtgaaaatggaatccccgttcctagggaccttaacttttagtagtggaaaagcaacttaggcaggcaaataattcagagatttggtattgtttagtccaaagttagtgtttgaatgaatataaggtagtgaatgaaatttggagaatctgttgttcaaacttttaaaaagttaaatagtattaccttaaatataggaacacattttctcattttgtattctttgaatttttatttattttaaactttgtaattattttttgttttttggtttttttttttttgagacagaggctcactctgttgcccaggctggagtgcagtggcaatctcagctcactgcaaccgctacctcctgggttcaagcaattctctcctgcctcagcctcctgagtagctaggattacaggcacgcaccaccacacctggctaatttttgtatttttagtagagacggggtttcaccatgttggccaggctggcctcaaactcctgacctcacgtgatccgcccaccttggcctcccaaagtgctgggattataggcgtgagccaccacacctggcttaaactttgtaatttttatttcttttcttttctttttttcttctttgtttttttgagacagtgtcttgctcagttgcccaggctggagtgtagtggcacaatcacggctcactgcatccttgaccttttgggcacaagcgatcctcccacctcagcctcctgagtagctgggaccacaggcatgcccaccatgcttggctaatttttaaaaatttttctgtagactcagggtctccctgtgtggtccaggctggcctcaaactcctgggctcaagccatcctcctgcctctgcttcccaaagttctgggattacaggcatgagccactgtacctggcctgaactttgtaattttgtaagaacattttaagaaaatgctaattggaaaattatcatctctactctttttcctgtcaaatattatatacatcatttataatttattttagccttctaatacttagtattaatacagtgagaactggtggtggtacttcagtgttccaaactcagtctactgcttttcttggaaaagatgatgaaaataactactttaatgtttgtggttattgctcttttctagtatctgaattttaaaaatacattgtatagagttatgtttactcatataacaaattttagattttgttcttacaatgtatttccaaaacaagtaacattactattcctatttcttagtaacttgtgtaactcaagatcagaaaatttatattgatcagaccttgaaatcagggttaagcattcacatttgaacaaaggataggtttcttgagtattttctctgtagttcattccttatgtatttcttactgtgctcatccaaattttctcatttctttggttcaactttcagtactttgtgagctctctcattaggtgcaatatgtttataatttttatcccttcctgttggattgactcttaatgtccttctttatctttttttaatttttgagatggggggtttcactgtgttgcccaggctggagtgcagtggtgtgatctcattgcactgcaaccttcgcctcctgggctcaggcagtcctcctgcctcagcctcccaagtagctaagatcataggcatgcaccacgatgcctggctacttttttgtatttttgatagagacaggttttcaccatgttgctcaggctggtctcgacctcctgggctcaagtgattcacctgccttggcctcccaaagtgctgggattacaggtgtcagccactatacccagcatccctctttacctttagtaattgatttttgattaccaattactgactattggttattgatagtgattattaataaagtccacattcagatttttttagttttttaccttatacttttaaaagtcttaacatctagtttgtttgattttaatatagccattccagctctcttatgcatttatatctttatcctttcaatttccacttatttatagctgaatgtaaaatacgcctcgcatagacaacatatagttgaatctttttttttttgagacggagtctcgctctgtcgccatgctggagtgcagtggtacaatctcagctcactgcaacctctgcctcccgggttcaagcgattctcctgctgccccagcctcctgagtagctgggactacaggcatgtgccaccacgcccagctaatttttgtatttttagtagagatggagtttcaccatgttggccaggatggtttcgatctcttgacctcgtgatccgtccaccctggcctcccaaagtgctgggattacaggcgtgagccactgcacctggccctgaatcttgttttttaattttaatttttattattattttttgagacggagtctcgctctgtcaccgaggctggagcacagtgttgtgagccggattcaagagattctcctgtgtcagcctcccgagtagctgagactgcaggcacgtgccaccacgcctggctaatttttgtatttttagtagagatggtgttttgccatgttggccaacctggtcttgaactcctgacttcaagtgatctgtccaccttggcctcccaaagtgctgggattacagacatgagccactgcacctggctgaatctttttaaaatccagtctgacaatctttgcattttgattggattgtttaatcctttcacatttaatatagttattgatatgtttggatttacatctattattttgctgtttgtttactgtatttttcattttgttgttttgtttttctgtttctcctttactgttttattttgtattaagggaagaatttcaagtgtaacattttaatttctttaatgatttttttttagtttttttggagttattttcttagtgttgctctaggacttaccacatacatgcttatcagaatctacttcagatgtatgctaacttaactccagtaagatatagaaaccgttccttccatgtagctctattctctcttcctttttgtgatgttattatacatgtcttatttatgttaaaacctgagatatgttgttaaaatgataactttatataatttcatattttaaagaagctgggagaataaaggagaggaagtatatatttgtagtttgttatattaactttcttatttaccatttctggtttccttaatttttgaagaaatttgagttaccatctggtatcatttccttactccagtatagctttgttcccacccacctcctttgtgctttagtggccctttaacaaaaattcgtgtggagtcatgttactgtctagtgtcacttgttttcagtatgtaaaacttcctttagtattttttgtaagttggatcttctagcaatgaattctctcaagttttcatttatctgggaatgtctttattttgccatcatttttgaaacatagttttgttggatatgaaattcttggttgacaagtttttttttttccttttctttcatcgctttgaatgtgtcatcttactgccttccagtctccatcgtttgtttcttttctttccttttttttttttttttttgagatggagtctcactcactttgtcgcccaggttggagtgcagtggtgctatgtcagctcactgcagcctctgcctcccgggttcaagtgattttcctgcctcagcctcccaagtagctgggataacaggcatgcaccaccacacctggctaatttttgtaatcttagtagagatggggtttcaccatgttggctaggctggtctcaaactcctgacctcaagtgatctgcccacctcggcctcccaaagtgttgggagtacaggtgtgagccaccgtgcctggccaatctccgttgtttctaatcagaaagtcagctattaattttattgaggattcttcttatgtgataagttgtttttctcttgttgctttctttttttttttttttcttaaatatatattttgttgttgttgttgtttttgagatggagtctggctctgttgcccaggctggagtgcagtggtgtcatcttggctcactgcaacctctccctctcgggttcaagtgattctcctgcctcagcctcccgagtagagtagctggggctacaggtgtgcaccaccatgccccgccaatttttgtatttttagtagagacggggtttcactatgttggccaggctggtcttgaactcctgacctcaagtgatctgcctgccttggcctcccaaagtgctggtattacaggcatgagccaccacacctggccttaaatgtattttttgatatagagatggggtcttgctgtgttgaccaggctggtcttgaactcctggcctgaagcaatcctcctatcttggcctcccaaagtgttaggattataggtgtaagacaccgtgcctggcctctcctgctgctttcaagactttctatgcctttcagcattttgactatgatgtttctgggtgtggatctctttgtgtttattgtatttggagtttgttgagtttcttggatatgtagttaaatgtttttcatcacatttgagaagttctcagccactatttctttttttttttttttttttttttgagatggagtctcacactctcgcccaggctggagtgcagtggcacgatctccgctcactgcaagctccgcctcccaagttcacgccattctcctgcgtcagcctccctagtagttgggactacaggcacccgccaccatgcctggctaattttttgtatttttagtagagacggggtttcactgtgttagccaggatggtctcgatctcttgaccttgtgttccgcccacctcggcctcccaaagtgctgggattacagacgtgagccaccacgcccggccagccactatttcttaagtatttttttctgttctttcttctcctctggtattcccattacatgtatgttgttgtgtattagtccaggctctccagagaaacaaccaaaaggggatgatgagatagatagatatgtttagtggtatcccatttttctctgaggttctgttcatttttcatttttttctgtgttcttcagattgcataatctctatcaatcagtcttcaagttcactgattcttctgccagctgaaatctattcatctcctctagtgagtttttaaaaataagcttcataatttagaataggttttggtttacagaaacattgcaaagatagtggagagtttccatgtaccccacatgtagttttccctattattaacatcttatattggtatgatacattcattctaattaataaaccatattgttagtgattattgattactgatattcaaagttcatactttattcaaatttcctgttttaatctaatgtctttttttttctgctctaggatctcatgtaggatatcacattacatttagttgtcatatcttcttagactcctcttggctgttacagattctcagactttctgtgtttttgatgaacagttttgagtaatactgcttaggtgttttgtggagtatccctcagttgggatttgtctgatgttttccttgtgattagactggtgttgcaggtttttgggaggaagaccacgtaagtaaagtgtcattttcatcacatcgtatcaaagggacatactatcaacatgcttatcactattgatgttaattaaccttgatcacctggctgaggcggtgtttgtcaggtttctgcattgtaaaactactctttttctccctttccataatgtcctctttggaagaaagttactatgtgcagcccacatttaaggactatggagttatgttccaccttattgaagatggggtatttacataaattatttagaattcttctgcacaggggatttgtcaactctgactctctcatttacttatttaaaaaatcattatggactcatggatttctttttaatactttggttaataatccaaatgtagtactactttattttgttgctaaaattgtccctgctttggctactgggggccccttcagttaactagtgtgatttgacatagcacacttcttcttccttcttcctttcttctttcttcttcttcctcttcctcttctttcttcctttttttttttttttttggagaggaagtctcgttctatcccctaggctggagtgcggtggcgtgatctccgctcactgcaacctccacctcctgggttcaagcgattctcctgtctcagcctcttgagtagcttggattacaggtgtgtgccaccacgcctggctaaatttttgtatttttaatagagatggggtttcaccatgttggccaggctggtctccaactcctgacctcagatgatccacccgcctcggcctcccaaagtgttgggatgacaggcgtgagccactgcgcctggccttcttttttctttctctctttctcctcctcctcctccttctctctctctctttttttttaaacctacttctttattttctggcactagaatatgctccaggctcatcttgtacatttttatgccccagtcctagtttcagccatttcaccaaagagtcctggtttctttctttctttctttctttctttctttctttctttctttctttcttttgaggcagggcgtcactctcacccaggctggagtgcagttgcatgatcgcggctcaccacagccttgacctcctaggctcaggtgatcctcccacctcagcctccagagtaactggggctacaggtgcgggccaccacacctggctaatttttgtattttttttttttttttgtagagaaggggttttaccatgttgcccaggctggtctcgaactcttgggctcaagtgatctgcccggcctgtctcccaaagtgctaggattacagacatgagccactgtgcccgactcctggtttatttttatcacagaatggtattagaaagcaggatctaggtgctaggtgggtgctaatgaatctttcattttggttatttactttcctattccagaatttccatttggttccattttcagtattctcagccttccttgcctggggtagaggtgctgccctataaatgaggctaggtggaggtagctctgcttgaccggaatagttcctgcaacatgaaacagaggctgcgaggggtggcaggggatgtgaaattctggtaacctactgctcctggggagaaactttcgtcttggctacactcactgggcatagagctgggggtgagggagagggaatgggcatgtaaggaagtgagtcctggttcaaatttttccaacttggtctttttaccaagattcagtagattttcttgactaaatattgctgcgtttgccccatgtccttagggcaatttctgcagactgtaaatagtttcttctctttccttctttttttgtatcctttgtaccagttaaggttgttttgctgaggagagggtccagggtccacatggaccacctcacactgccattctggaagtgcttttctttggtttaattttgttggaataaagtattacttatggaaacagcattaggtaaatatatttcacgtattctaaatagtaatcttcattgccccatcttgttttctatatcctttgatactaatttataacaacagttctttagaatttagacactaactcacctcttctctttgtattttatcttttgagaatgaagcttcattttatttttcatagccctggcagactacttccatttatagtcctgtaaccatcccttttgtgtgtgtattgtttctgtgatgtctttcatgaaacttcttagggctaaaggtaattgaagcacatttgcttttcctcccactcaaatgtttttatttccttcaaacaaataccttagcaattctgcatctagatgttcttcaatttgtcagttcttgtttttttttttttttcttggcacaacagaagatgttctatttcatacagttaatgaaaggtatctttacttacgtaactataaatgatcaataatgatgatagtgcaatgcaatttcagaagttgttctagatttagcatagttctaaattgttgaggccgagtagaaaaattttcagtgatattgttcaacttgataaagtaacattactttgcagataatataattgtcatcagaactggcaagactaaaattgtttgctttaaaatattttattttccttaataaaaatattgctttaaaaatgttaatgacatttcatgaatctattcttttgggcattgacataaattactggtctcatttggggaatccatttaaatgtaggctctttgagatgatataataaatccctctttctaaagttattggccttcttattacatcatctattgtgtttcattagtgttatcttttaattagtaataatctctattatgtggcttctatgcatcagaggctttatataatcttgaatcctcttcattagcctataagtaggtggtatcagttcttcttaatgaatgagaaaataggcttgaagggactacataacttgctcatggtcacataattagtgagggatgacacccagatgtgtcagtattctcaaaagactagaaagaagggtccaggtagaggaagggtttgtggcaaaagcagtgcatggactgcttgttcatcatctttttttttttgagatggagtctcgctctgttgcccaggctggagtgcagtggcacaattttggctcactgcaacctctgcctcccgggttcaagcaattctctgcctcagcctcccaagtagctgggattacaggcacccaacaccacacctggctaattttttttttgcaattttagtagagacggggtttcaccatgttggcctggctggtcttgaactcctgacctcgtgatccacccgcctcggcctctcaaagtgttgggattacaggtgtgagccacctcacctggcctcatcatcttaattggtcttggattgttgaaataagttttcatcttctaaggaggacatatcaaaatctagaaactaaaaagttaaaaaaaatttttatgttagcctaaacaattgaaaatagcagataacaaacaatatttaaatttgaaatgtctgtgggtttctatattgaatcctgtgtctatgattatataaactaggagttacttcaaggaaaatgatgacaccacattgagaagtaggctccttagtcaccaggaggctatctgattttcccacttactctattgtgaatggagaagaatcctttggtcaagccagagcatagctcctcctcagctgattaggagacctggagatgagatctgtttcctctttgctataatgaatgtgtagggtttattctctctatcagattctggattccctgaaaacaaagatggtggtttgtatttcaatgcactttacatgtcatttgcatgaaatgagaagcgcaagtaactaactagttggtattgtggaactataaaatagaatgcagtattgtttacaagttcattctctgttagatactgttataaatatgcataatcaattctttttttttgggggggggacagtctcgccctgtcgcccaggctgaagtgcagtggtggcgcgatctcggctcgctgtaacctctgcctcctgggttcaagtgattctcctgcctcagcctcctgagtagctgggattataggagtgtaccaccatgcccagcgaatttttgtatttttagtagagatggggtttcacaatattggccaggctggtctcgaattcctgacctcaagtgatccacctatcttggtctcccaaggtgctgggattacaggcatgagccaccaccactcctggctgcataatcaattcttaattatttatgaattgttagaatggtttatcccaagcccatttctttctctgtatcttttttttgtttgtttttgacacaggatctcaaaaatcatcactagatggtaaatctgtagggaattattattttgagtcaggatcttcctctgtcatcccggctagaatgcgggggtggtggggggcaggatctctcctcacagcagcctctgtctttcagactcaagcgatccttctacctcagcctcctgagtagctgggaccacagggacataccaccatgcccggctgactttgtaatttttagtagagccagggtctcgccatgttgcccataataaataacaactaagacctcatagttgtcagtcatgtaatattattttccatttgctccatctctattcccagtttcagttagtagagtcctgatatacccagtagtcaaggcagaatttttttttcttttttttttttaatataatttttgattttacaaaccctggcctacaggtcacagcagaaattttagcatcattttagacttttccatttctcattcatcaactatttttaaattgtcgctgtgtcttttgattacatctcttaaatatctcaactttatctgcctttctttgttcccactgttgctgctttagtttaaatttcatcattttgtgcctggcctctataaatcagtagctttctgactagtgtctgccctaactctcttcctgcctccatggtgatttttctgaagtataacactggtaaaatgctcaacttaaaccttctcttgatttcttgttgtctatggcagtagccttcaaacttcttgtaaggcagttagaccccttcttcaaatatagggtgtcaacaaaatttcaacaaattgagtctcagagatctgattgggttttattaacgattcatggaccaggtagcatccagtctacgaaacagaaagagctctaatgacctagacttagtgggtacattttgtatgcacaaaaaagtggaggaaagcaggaccaaggatcaaatagtgggttggtcatttcaaggttactttccttatagggaatcttggcttaagggaatttagctatcatctttctcctgatttcttaggtggtcagattttacaagtaaataagttaggttttggtttggtaacttggaaccttagcctgagtgactccatttgggcctgctgttctttctttaactaaggcaaatacaatgtttaaaatagattttttttaaaaagagagagcgcaacactattgtctgattgaagcaggacaggaatgtaggaactctgcttttgcttctacctttctcaaaaagccccttgagccatatagggcaaagtttgaaaaccaccatcctgaagcagaacctagacttcttagcatggtatagaagccttttatgattttgtccatgccttttttcgtgttattcctggacttttgccctggatttcagatatgctgcattacttgcattcaccgaacactcattttttttgcctatatttttgcacaaacttttcatagaatgcctttacccattttgtctatcagctaaacttctgttcttgtctcaagtattaattcagatatcacctcttcaatgaagctttctctgattttccaagtcaaagttaatcttttttttctgcttttctagtatctcttcacattggaaagcaggaagactttgttatatgtgattcagcactagtagcttgaacttacaacctgttatatgacttacaatatttgcatttaaaatgcctgaaccaaacttttgccaacatttaattgtctattttttgctttctcatgaaagaaaatgtcagatgttttgcttaaaaagcggtcaagcacaatggcatatagccttaacttggttatgaaattgggcaattaaatcttttcattttaggtaaagtcctttatattctgtggtattgtagatggcattattaaagtactgaagtttccttttgttatctattttaaaggattgaatatgtactatgattatcatgtattgtgactcgcataaagagtagcaaatttatgacatgattggttcccttcaatcaaggcaccttgttgaaactcttttgaggaaatttttcattcagatttatctttaatgcagcttccaaataagtgcttgatgaatattttatttaatgagtaaattgtgaattaccttgtggtcgaagatattgtctccttattcactactttattctctcctccttctccatattccacttagctacatctttctcctcattcctaaaaaaaaaaaaatctctaaatatcttggtgcataagaaaagaagaaagaccagtgaattttcttgtttcttgcctgctttaagaggtggaattgactgtagataagaattgtggttaggctaaatattgcatatatgaacagcaagcatgccataatagatgcttaataaatgtttgttgaatttgagtagggtagatcttaggctctcagtgctttaaatgattactgagatttgaggatttcttcactttgccattgaataaacttaaggcttagagaggtagaagtggctttgcagatttctggtgaataggaatttttcaataattagaacgatctgaaattggagtgagctgttttgttttgtttagacaggatcttcctctgtcaccggagtgcactagtgatcatagcttactgcaggcttgaactcctaagctcaagctatccttctgtgtcaacctcccaagtagctgggactacaggcatggaccagcacacacggctaatttttgaaattttttgtagagacaaagcctcgctgtgttgcccaggcttgtcttgaactccaggccttaaacagccctcctgccatggcctcccaaagtgctgggtttagaggcatgagccgctgtgcctggctgtgagctgtttttgtaggcactaagtttcatatcacacctggcacggtggctcattcctgtaatcccagcactttgggaggctgaggcgggaggatcacttgaggtcaggagttcaagaccagcctggccaacatggtgaaacactgtctgtagtaaaaatacaaaaattagctgggcgtgatggcgtgtgcctgtaatcccagctacttgggaggctgaggcaggagaatctcttgaacccgggaggcggaggttgcaatgagcctagatccccctactgcactccagcctgggcgacagagtgagactccgtctcgggggaagaaaaaaaatcacttcctagctagaccaatgtgaaaaaattatttgtttgagctcttgttttgatattaacatgatgtagctaagtggtatttttctgctaattgaccttttgaaattcaaatactacttaattctattatggaacagtagaggaaatggggattctggccagagaaaacaaggaaaaagtacctcttgaaggtacttgacagtgaaatgatgaaacctaaaatgttgagatgaattgcaacaaaactttgatatttaataatgcatttgaagggaggccctgttctgttgatgaggcagaccatcaagagcagtgtagacgttgccaactcataatggcaagctaagagttcaggattttcaactgaatttattaaatctggatattcaaaatttttgtcattttgccatatattgggggtgtcttaattaaagggattttatgtagttcaaaataaatgttacaattgttgtattatactagtactatgaagatgactatgataagagtgtcttttgtatgctaattgggtgactcctggcagaacctcctagatagcttctgatgggggctggtcaaccagaaagaagaaggcactattagagatttaggactttcatcttcaccccagactttctgggaggggaaaagggaaggagaatgagctcaatcaccaatggctagtgctttaatcagtcatgcctacataatgaaaccttcctaaatgatggtgccctggagccttgtgggttggtgaacacactgtaaagcaaaacaaaattctaagccgcccagccaactgaatgaaaccctcctctcagccaagggcactctaacctgaatgctagttcaggccatgataggaaagacatgcctcattatacctttgtccctttggaattcaggcatggctaaccagcattaatgttaaaacagactctttgtagcagtaagataccaacatgatacataaaatgtatcacactttgtagcagtaagataccaacatgattgcaggccctgaaagaaatagaagtattttaccctgaaatatatttctctattttgaaatggccctggcaaagctgtctctcatggggaaaaaaatctacattctatagataatccccttccctttccaggtctttttcctggtccaggagagaatactgtctggcacctttttaagtctgttttttttgggaacaaagtctccgctctgtcacccaggctggaatgcagtggcatgatcttggctcactgcaacctccgcctcccaggttcaagcaattctcgtggtattttttaaagacctggggtggggacaggggattctcctgcctcagcctcccgagtagctgggattacaggcatgcgccaccacgcccggcaagtttttgtatttttagtagagacggggtttctccatgttggccacgctggtcttgtactcctgacctcaagtgatcctcccgcctcagcctcccaaagtgctgggattacaagcaggagccactgcacagactgccttcttaagtctgataagaaacatttacaatctgttccataggaagcctctgcataataagaaccttggtctccacaaccccttatcttaacccaaatcatagaagggagattctattgattccaggtctttaggtaaactcaaccaattgccaatcaggaaatctctgaatccacttatgacctggaagcacccccctccccacctttgagttattctacctttctggaccaaaccaatgtacatcttacatgtattgattgatgtcttatgtctccctgaaatgtacaaaaccaagctgtagggggccaggcgtggtggccttatacctgcaatcccagcactttgggaggctgaggcgggaggatcactggagtccaggaattggagaccagctgggcaacatggtgagacctcttctctacccccaactctccctcaaaataatagtaattaaaaccaagctgtagcctgaccaccttgggcacatatatattctcagcatctcctggggctgtatcacagttcgtggtcttcatatttcgctcagaataaatctcttaaaatattttagagtttgactctgtcaaaatcatcgaggtgctgggaggctggtgtgctctgagaaggcacggaaggcctgtgctggctccccaacccctcataccttgccctgtgcatctcttccatttggctgttcctgagttgtatcctttataagaagctggtagtaaatgtaagtaatgcatttccttgagttctgtgagtcacgctagcaaattatcaaacttgaggagagtgagttgtgggaacccccaaatttgtagccaagttggatagaagtatgaatagcctggggacctgggacttgtgacaggaatccgaagtgagggcagttttgtgagactgagtccttaaacctgtggattgaattgaaggatactcagttggtgtcagagaatcagaattggtgttggaaaagataccacgcatttgctgtctggggaaaaaaaaaaagccctcaggtaggcacatgaatcttcagcttacaaatggaaacgtaccaaagcttcaagagactgctgagctcatcattaaggtagtatgcgggaaagctataactcaaaagtgctcttaaccatatctttttaaaaaattgtatcctctttgagggaaagaatctatcttttcttttttaaattgttattatttattagtcagcttctcagatctctttggaatttaattgaatgcttttatcaattaatggtcttgatgaaattgcttgtatttttgactattatttgtatggccaaagtaattttacgtacccttctgaagttagcagcacaaacaattgaggaagtgcaaagattttcgcttgatttttcttcagtttcttctatattttaaataggacacaaatatctctgtaaataaaaataacttccaatacatttggaaaacatcccagacttcctgtccatgcctcgcaaagttgctgctgtctagtcattattactatgttttttccctttgacataagtgaccctcacaggaatagcttcatcaccagctgtttggccagtggtattccacttactttgtttttcctgtttctctgaaatatgctgaaagataatcactccgtgccttcccttgtttagaatgaatttactcaattgctctggaagcttaccttggtaaatgatttggaaccgtaatgaaaaaagagggtaggctttatatattttatattggtgccttaggaattgacatttatttattgaggatttttgtgctcattttcaatttgaaagggtcctagtgtttagaattaaattgtgggacttgaaagctaaaaaggaacttggagatcgtccaactgaggagccttattttttaaatgaggaaacaaaagttgtcaagatcaaccataaatctgatagtttggcttggtgaaagaaacctaggtttcagaaaatctctcatgtagtttgcagtttatagccacaaggaccaggagtctgaagacttgataagagggtctgtttttcaaaatattaacaaagtttagcctggaagctccctttgtgaattttccatgtcattgacagtgtttgaaatctcgtcatgtcttcaggatcaataacctctaccatgtacttttatactttttaattagcggattttcaaacttttaaaaacagtaactcctttttttcaatataatcttatattgaaccacaggatacaaaaaagatacgtgatatttaattaaaatagttttaagcacaattttaatttgttggataataaattaatgatgacatagctaaaatttatgaaatgctgattagagtactgtacatacatatttcacttctctctctagcttaaaatatttgaatgggtgtactgtaattcatttaactaggcccttgttgatgtgtatttagactgtttccattcttgtttttgcaaacaatgttgcagtgaataatgtatgtatacattatgtggtgtgtgtgtatgtgtttctggggataaattctggaaatgtaattgctgtgtcattagaatatgtttttagttttgaaggattttatcaaattggtttccaatttgatatatattcccaccagcagtgtatgagcaagcttaattctctcatgctctcatcagcatggtatgttatttttggtttttgctaatgtaaaaaattgtatctcagtgtggttttaatcttctatttgtattatatgtaaatttgagtaacttttttatgtttaagagccatttgtgtttctttttctctgaactatttgttcatatcactttgcccattttaaaaattgggtttccgcccctcttaatgagcaggagtagccttctgtgtattgagtttaactttgtgatataagttgcagattcttttcctcaggttttcatttctatttttcctgtagtttgtaccttttccatttttatggatatctaaactcaaccttaacttgacaaatggaaccttggatttctatccttcctttaacctccttctcttctagtcttcctcagtgaagaaacagcacctctcatgtgtctctactcatacatagcccaagcccaaaaccaagaagttatccttgcctcctctttccctccctccctgtctctaatccatcctcagtggtattgacttcctctccaacatgtcccaaatctattcatttctcttaatatccaccaatttagtccatcctccccttatctttcacctgggtggctgccatggcttcctagctgttctaccccaaaactgatgtctcccgttccaggtactgagccattctctactctgtagcttatgtgatcttttcaaactgcaaataatcagattgtcataccactccctgaatccacccctcctattcttgttcaaaaccctcctgtaagtccttatgtcccatggcaaagattatgcttcttgaaatagcccaacctgctgtttctccagcctcaccttgtactatgttattgacccccacccctccccacctcacctgtgggtctcttgtgtcaccctgttccctcctgacttggggctttagcataaattattttctcctggagcatcccccttcttccatgagtttatgttgaattattctacaggcctcagctcactaattgctttctctaagagagccaacaactcttcctaataggtgggaaacccctgtcataagcccttccagcaacttatatctctttcatagcactaatatttactgttttatacttactgtgtgagtctttgattaagctctatgagatagggatcttgtctgttttctttactgttatgtcccagaatctatcatagtacccggtacatggttagctctcaaaacattgaatgattgcttaactataaacccttaggtgtagagtttacagaatgtactgttttgccctttctggaaaatgggacatttgctcttggccagtctttgttctcctcttcttttccctgtgattttcccaagactactaaatttcagcaattccattttgaaagtcttaaagcatttcaaacatgaaatttatccaggtcaatggtcttgaattcatttaaagcctgtaggtgttcttcaagtcttggacttcagttccttccattcctttttcatgtgaagtttatttttcttggagttgaggacaataactcagaccacattttctgacccacatcaatccagcaaaatctaggtggtccccaacttctgtaagtttattttaaattcagttacttagaatttgcagttcagaaaatattaccccaaagaaaccgtgttaaaattgatctttatattttcatgaagatgtcttcaaaatccttttaaccaatagggtatctgaaatagtacagttttagtatgaactctgagtttctctgatcctattttattgaggcagggtcttgctcatcacccaggctagagtgcagtggcgtgatcatggctctctgcagcttcgacttcctgtgttcaaatgattctcccacctcagcctcctgagtagctgggagtagctgggactcaggcatgcaccaccacgcttggttaattttttgtagatgcagggttttgccatgttgcccaggctggtctcaaactcctggagtcaagcgattggcctgcctcagcgtcccaaagtggtgggattacaggcgtgagccagcgcccctggctctgatcccattttagctctgtttttctttttctttctttctttttttttggggacaaagtcttgctccgtcgcccaggctggagtgcaatggcaagatcttggctcactgcaacctccgcctcctgggttcaagtgattctcctgcctcagccttccaagtagctgggattacaggcatgtgccaccataccccgttaattttttgtatttcttttttttttagtagagatggggtttttgccacgttggccaggctggtctctaatgcctgacctcaggtgatccacccgccttggcctcccatagtgctgggattacaggcgttagccacccagcccagccttagctctgtttttcaatctgaatccaaagaccctcatattaggaagggctgggagtttaggaggattggcagtgctgggagaagtatcaagtagctggtagaagatacattgggttgatactggatttcctcccttgtggaaggattctgaaggtcaagggtagggaggcacataacatatttggtagtttgaaatttttatgctagtaaattgtgtataactcatgataatcaaatatctgtttgatttaataaggggggactgaattataaaggatggattgataaatcaagttactctccacttttgggagaataaagcaaaatgaagatcctattaattatgggtcagatggtcccatctagaaagaaaactaagtaggagtgcttcatctccttgcttgtattcagcatggagaagtctttacaaaagggtaattaattagggtgtttttcacaaggccgtgccttccatagaaatggttttcttctgtatgtggatcttgagttttaagatgctttccaaccatttgaactctcttattataacagaagtttagtcatgtaccaaatgtattcctatgcaattttcagtgacaaaatggttctctcatttggatgtgtaaaaacaatgccaggaacaaaaacaaaactcatgattcaactgattttgtactctctttgggaagaagaaaagacccgttgagatgaagattataatttcagtaacaaagaaaacattcaaggcccaggcagctcttaaattcaatactaataatctatgaaataaattataagcctacgtttctgtcagttctttagatacctgcttgtttgctaatacagaaacattgcttaattttacatgtattttcttagtgtgagtcaaatccaacctaaaatgcatttggttatttgtttacacagttagtgactggtaatcaaaaacgcaaacaatttttgagggagttagaatcttcactttagtaggtaccttagagggcatctagtttagtacaggattcctttctaccagggacaaactgtttacagaggccccttcctgcctcttgcgaggttcctccttgtctgttctgcttcagatatacaggccttctgtgttccttgaatttatcaaactctctaagactctttgtactgccttgaacactcttctcatagccctggtggcttggaatttttacatgggacagatttctctgaaatactgccttctcagacaaccttccccagatctcctacctaaaggacctctccccttcccaactgccataactctatcataagactctgttttatttccttataatacttgtcactgtctgaaattatcatatttattgtctatctcctttagctccatgagagcaggagcatggtccatgttgttcaccgctatatcctgaagtatctacaatagtggctgtcccattgtaggcatctgacaagtatgacaaaaatgagaatgaatgaataaccattgatgattgatcattttgttaatgttaaaaccaaactctgtaaaatattttaaagaggtttattctgagctaatgtgagtgaccatggtctggggaacagtctcaagagccctgacaaaatatgtcctaggctatcagattgcagtctgcttttatatgttttagggagagaattgtaggtaaaatcatcagtcagtacttggaggatgatgtacattggttcagccaaggtagtgggggatcataggtggattaaaggattttctgattcgcagttggttgaaagagttaagctttttctaaagacttgaagtcagtagaaagaaatggtaaagttaagataagggggttgtggaggccaaggttcttgttatgtagtaaagcctcataggtagcagctttcagggagaatagatggtaaatgtctcttttcagaccttaaaggtgtcaggctctcagttaatgtctcctaggttgggggaaaggcccagaaagggaaggcttggctgcactatggagattctgttggccccgtgacagttattttaaaatatgtcaaagaaatatattttggggtaaaatattttgattgccttcagggtctgctatttgtcatgtgatgctataacacagtcagattggaaagtaagccacattatactttatactaggttaatcatctctgatgaggctttatggtttgtagggcgtgacttaacccctgctttgcctgaccttaggtgttgtttataatttgttatcttattgccacagtgtctggtttgccagtcttaggatcgccatccaaaaagagggagtataacgaggtatgtctgacctctcttcctggctgggaattcagtttttcaggtttctctggggtgcccttggccaagaaggagtttgttcagtcagctggggggtttaggatttttttttttttctttttgagatggagtcttgctctgttttccaggctggagtgcagtggcgctatctcggcttactgtaacctctgcctcctgggttcaagcaattctcctgcctcagcctcccgagtagctgggattgcagacatacgccaccacccccggctaatttaggattttatttttggtttacatgttccaatcactactgagctgaaatttgtctcctttttgcttctactactgaacttagttctgtcccctggaataaatcactggctcgattccattttttccaaagtcttcagacatttggatgtcagtcatctctcactgaggccaaactcacctggtttccttaccagttcctcatctggcatggttttaggtgagtggtcactatccaggttatcagttgttggcaatttttggttttgttgttgtgatacccagcactaaacatagtgcattatgtggtgtcttgaacttccgagagagagaacagttaaactttcttgtttaatgtgatactgcaatgctttgtctttgataaaaattattttttaataccatataaatgacgaaggaactatttatatatgaaatcattatcagaaatattctgaggtcttaaaagcttgttttataatggaatataacaacgtagaaatacattaaacataagtatatactctaatgaacaattataagtgaatgtctatttaaccatcactcaagacatagaaatagtgccccaggaacccctcctgtgttgtgttgtgttgtgttgtcttgtctagcctttccctttccctttctctttccctttcttccttcctttctttcctttctttctctgtcaccccggcagtgcacagtgcacagtgcacaatcacggctcaccgcagctgtgatcacctaggctcaaggaatcctcccacttcagcctcccaagtagctgggactagaggtgttcgccaccaacgcccagctaattaaaaaaaaaaaaaaaaagttgttgtagagacaaggtctcattatgttgcccaggctggtctcaaactcctgggtttaagtgatccttccgcctcagccttccaaagtgccgcctcagccttccaaaatgccgggctgccatatgtcttttctcaatctcagtccctccttagaggtaattaatatcctgatttttttacaataaacacttccttgatcacttttttatacagttaccacttacatgtacatacttaatatagtttatagttcagctttgcctgtttttaaactgtatataaaagaaacaatgctgttgtatcagttttctgttgcataataacttaccacatgcttagccatgttaagacaccatatattattagctcacagttctgtaggttcccagcctgatctttttattacttgtgttttctgtttcatgaatttttgctcttactcatttctttcttcacattttcattgggctcattttgtgtttcttttgtttagcctcttgagtttgatgcttagttcatgtttccagtttttagtattttctgatatatgcatataagattctcaatttcctccttaagcattgttttctttctatagatttgtatttttgttattgttaagtgtattatgttttcttccttgattgacatatggattattttgggagtgtatttatttccaaacataagaattattttctaactacttcttttgtgattgatcaactttagttgtggaaagagaccatccttttacttcagtccttgtaatttattttatttatttatttatttttgagatggagttttgctctgttgctcaggctggagtgcagtggcgccatttggctcactgcatcctctgtgattctcgtgcctcagcctcctgagtagctgggactacaggcacgtggtcatcacacctggctaagttttgtgtttttagtagagacaggatttcaccatgttaaccaggctggtctcgaactcctggcctcaagtaatctgcctacctcagcctcccaaaatactgggattacaggcccgagccactgtgcccggcccttgtaatttattttgaattgctttatggcctagcatatgatcagtttttgtgaatgttgtatgtgtgcttggagaggagaaaaagatattttgcagttctttgctatagttgatatgttcatttggtcaaattttaaaaacatgttcaatgtcttctttatcctaatatttttctctttcatttagttctctttttttgttatgctctctatctagcattctaatttatttttatagtttgatctttcaccttttggaccttttagttctgtcacaatgttcagtctttgtttttttttttttttttgagatggagtctcgctctgtcgccgaggctagagtgcagtggctcgatctcggctcactgtaagctccgcctcccgggttcatgccattctcctgcctcagcctcccgagtagctgggactacaggcgcccaccacaatgcccggctaatttttttgtattttttcagtagagacagggtttcaccatgttaaccaggatggtctggatctcctgacctcgtgatccacccgcctcggcctcggcctcctaaagtgctgggattacaggcgtgagccactgcacccggccagtctggtttttattgcatcaaccctaccgttgttttgtaggctattgctgatcatttataggctatccctgacccaaagtcttttgggatcattttctttttcagttgtttctattggttcttgttcgtggtatcttaccttgcgtgtttggccatctttgattatgtactgcacattgtaaatgagaaactatctgtagcagtattgtgaggcctggttgatgccatcttccctcagagcgttgctttttttctttgtttcacccagacaactggtggctttaacaatctgaatgtggaaccaccttaatccaaagtacatttaaagattttatctagatcgcccagatgacataaacctacagttcaagtttgtccaagggctgatttatttctgttttttcttatcctgggagtatattctggggttttggcttcaagtgagtggtgatttatcaaactttctccttatttataaaaattttatttttaatgattatagctacttaatagttgtatatatttatgggatacatgttatattttgatacaagcatacaatatgtaatgatcagggtaattggggtatccatcatttcaagcatttatcatttctttgtgttaggaacctcccaattccactcttttagttattttgaaatatacaataaattattgctaacaaactttctcattttgagacacccttgactttgaattttgtgttccttgatctctaacgatttcaagagcaaacctgtttttctctcattttctggatcttcaaataccagaaaagctaaaatagttttgggtggtttggattatctctctggattctattcttttgctttgattgctttgattttagccaggtaattcttcacaatcttgttaagtgtttggagcttttaagatgtttctgaaaagtattccctctagcatttgtatttgtctgtaaagggacatttcatccaagatatgtagtttgccatcaccagaactaaaacgttttagtttttatgccttaaaaaaaaagattaatcagttatattcatataaaattgcagctaaatccaatatggcataatttttttcttcagtatgaatactggtatttaaaagaccattcttgacatccaagataagtatccactcacatcattattattttttttatttgttttgagaccgactctccttctgttgcccaggctggagtgcagtgacgtgatcttggctcactgcaaccatcacctcccaagctcaaaaaattctcgtgccttagcctcctgtgtagctgggactacaggcacccaccatcacacccggctaattttttggtattttatctggagatggggtttcaccatgttggccaggttggtctccaactcctgaccttaagcagtctgcctgcctcagcctcccaaagtgctaggattacagacgtgagccactgtagccggccccactcacattctgattcccagtttttttgtttgtttgtttttgtttttgagacggagttttcactcttgtcatccaggcttaagtacaatggcaatatctcagctcactgcaacttctgcctcccgggttcaagtgattttcgtgtctcagtctcccgagtagctgggattacaggtgcctgccaccgcacctggctaatttttgtatttttagtagagacggggttgtaccatgttggccaggctggtctcgagctcctgacctcaggttattcaccctcctcagcctcccaaagtgctgggattacaggcatgagccatctcacctggcctaattcccagtttttattactcagttttgactgccacaaagaatagtgagaccaaatgttttttttaaaaaatttttatttttttttatttttttgagacagtctcgctctgtcgcccaggctggagtgcagtagtaagatctcggtttactgcaacctctgccttccgggttcaagcaattctcctgtctcagcctctcgagtagctggcactacaggcgcgcaccaccatacccagctaatttttgtatttttagtagagatcgggtttcatcatattggtcatgctggtctcgaactcctgacctcaggtcatctacctgccttggcctcccaaagtgctgggattacaggcgtgagccaccacgcccggccacaaatgttctttacaaatacttttatacagaactttttgggtcttcttagtgagaatgattaatttttatctcaagtttcctttgaaatgaaccataccattattggcagagagtagaatatttaaatatttcctgagtgttctttcaaaccagccgtagaaaatgaaagagtgattcgttttcagaaatgctctgagcatcttttaccaggaatgtgactgacatagatcctcatatagctggctccttgtcattgccatctcagctcaaatgttacctttttagagaagccctccctgtctatcattctttttccctctttcataacaaaatacaagataatagtctcgtattttttctccaccagcaaaatgtaaagttccatgagggtaaggaccttgcctgtcttgtttaccactatgttgtgtgtcttatcctgaaaacatgggaggcagtcagtaattatttgcttaatgaattaataaatatttcatctcaaattgtgacatctttttctctaaatatcagaataatccttaaaaaatttttgattccagtgaactaaagttttctaagctaagtatagcgaaaggaggtcagtgtagctggagtgaagctagtcaagggagagtctagtaggagatgatatcaggaggggaggtcaaggcctgtggctcatgtggattttgcttttcactcttaatgatatgggaggccattagagggttttgaatgagaagtttatgagaagtgacatggtctgagttatcttcaagagttactctgacttctttaaggtctgtaggaatctgtagggatactgaagtatggtctattctgggctctcacatctgttctattggttatttatccgtgccagaaccaccctgtcttaatttccctcactctattataatcctcaacctattcagtagggcatcctgccagatcctaccctcaaagcctagtgctcttgtaacttttcttatctttcttactcttttctttttcttattctttgctgctcatacttgtagtaggagggtgttgcttctacttggaactctgcccttccatatatattttaaaatcagcttgtcttaattctttagaaaaccttgttgggattgtgattggaattgcattgactatatagatcaatatggaaagaattgatacctttatagttttgaatcttcctagctgtaaaatttggataacttatttacgtgttttttaatgtcttgagtaaagttacatatatatttgaaaagtcgttttgaatatcttttgttaaatcttaggtgctttttaaaattattgtaaatgtggtttgtttttgtttttctttgagacaaggtctggctctattgtccaggctagagtgcaatggcacaatcttggcttactgcagcctccgcttcccgggctcaaaccatcctcccatctcagcctctggagtagctgggactacaggcatgctctgccacatgcagctaatttttatatattttgttgaggctggattttgccatgttgcccagtctggtctcgaactcgtgagctcaagcagtctgcttgcctcagcctcccaaagtgctgtgattataggcgtgagccattgtgccccgcccataaatgtgatttttaaaaattgcattttctatttcttacaaatgctctttacagatgctgctgatatttgtgtattaagcttatgttcagctaccttgccaaacactaataattccaataatttatgaattcttttgaattttctatgaggtaatatatgcaaattctgttttcgtttccctcttttcaatcatacattttattcatttattgtttcttattttactaagccagctataacccacaaggatgtttttgttttgtttttgtttttgagacagggtcttgcggtgttgcccaggctggagtgcagtggtgcgatcacggctcaccgcagcttcgccctcctgggctcaagcaatcctccctcctcaccatctgagagtagctgggactacaggcgtgcacaaccacacccggctagtttttgtagtttttctagagaaagggtttcaccacatttcctaggctggtcttgaattcctgagcatgagtgatccgtccacctcagcctcccagcagcctcccaaagtgctgggattatggacacgagccactgtgcctggctaggatgtttaatactaatgttaataagtattaatagtagaactccttgtcatgtttttgtttgtttggtggagacagggtctcacactgttgcccaggctagtgtccggtggcgcaatcacagctcactgcagctttgacctcctgggctcaagtgatcctcccgtctcagcctcccacaaccatgcccaccaggctaggttttttttgtttttgtttgttttttttgtttttgtagagactgggtctccctgtgttgctcaggctggtctctaattcctgggctcaagcgatccttctgccttggcttcctaaagtgctgggattatatgcgtgaaccatggtgcctgggcacatgttcttaagttttaaagggactatgtctactgcttcacatttaagaatgatgtttgttgtaggtttttgtcagatgcccttatcaggatatgcacattttaaaatcacctaattatgtatatattgctttttagaaaatttgcaccaatttacatttctaccatcagtgtatggaagggcactccttgacaatacttacccacatcacatggggtattcttgttaaaagtttcagattttggccgggcgcggtggctcacgcctgtaatcccagcactttgggaggccgagacgggcggatcacgaggtcaggagagcgagaccatcctggctaacacggtgaaaccccgtctctactaaaaaaaatacaaaaattagccgggcatggtggcgcgtgcctgtagtcccagctacacgggaggctgaggcaggagaatggtgtgaacccgggaggcggagcttgcagtgagtcgagatcgcgccactgcactccagcctgggcgacagagcgaaactccgtctcaaaaaaaaaaaaaaaaagaaagtttcagattttataggcagtaaggaacttcttgtttagatttgtttcttccttttaaaacaatattttgtgttgttaccactgttattcttagagatgggataagctttttgaaacaaagcttattttgaaaatatttcagatttagagaaaaactgcaaaaatagtgcaaagaatttcctacttcctatacccttgacctagattttccaagtgtgttaatattttatcatatttgctttatcattctttctgtcttttttctcttccctcatacacacatataatttttctcagtggtttaagttgtaaacatgatgcccctttaaaaactttagtgctgtttcttaaaaatgagagcattgttttatataaccgaagtactaatatgaaaattagaaaactactgacaacagtactataatctgtgaacatttgaattgtatcaattgttcttcatagcgaaaaaagaacaaaagctttttcttgtccaggatgtaatccaggatcatgcaatgtatttcattgtcatatctcttaatcttctttaatctggaatagtcgcttcttgttactcagttgtttcttgtctttcatgaccttgacattttaaaagaatatgggccaattatttagtaaaatgtccctcagcttgggcttgtctcttgcttcttgtgattagattcaggttttgcatttctggcaggaatgccacagaagtggtgatgtgatacatcctatcagggggcatataatgttggtttgtccccttattgatgacgttaacttgatcatttaattaaggtggtgtctggcaggattcttcagtgtaaaattactatttttcttcttgtaattaataggtatcttgtggatactttgagattagataatatcctgttttccatcaaattttcaaccactagttttagcatgtattgatcatacttgcttgaaataattattaccagagtgattgccaaatggcgatcttctaattttatcactacatttattatttggaattatacttcgcaaaagagctttctcttctcccccatttatttatttatgtcagtaaggacttttaaaaaaattatatgggttataatctgttactgtgcttatttactttgttgctcaaatattcccgattaggccagtgggagtcacatcagtctgactcctgtgtccttttgaggtacccctatcattctttgagcatttccttactttctggcaccacaaaaatatgccctaggctcctatggtccttctcctgccccacccttggaatcagccatttcttcaaggaaccctagttccttttatcagagcaccagctgtgttcatagctataggggtatcattgcttctaggccttctcagcagacagagctaggaaatatatgtatgtgagtgcacatttacacaaacacctttatatctgtctatactcctatatattaaaaactgagcttatattgttaactccaactccaagccttctccctttttatatttgttactcccttttatgagaataagaaaccaaggtcagtatattcacagaatatttacctatttgcccaatcttagaacacacacaaacaagtttcatgtcattgtataaaagcaggtagctaagtagaatatagtatttgtttataattctttttatttttagctttaggagagtagatagtgaaaatgctgtttttaaaagttagctgtggttaattcatttgtccttgtccccaaaagtgtggttatattattcatttcaaatacagagaggttcatttgtttgtattcattccattttgggttcttcgctcctattactgttggtttcttcttcattttaagtgtataaaacattaaaatggattgaaaaataactctacaaaaaggtaagattggttactagagtactgcaaatataaaacttacagcttttaattgtgtttgtttttttcagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggtaagttggaatttttgcgttccttgagttttgagcaatgaacagttagttattcctaccaccaaaaagttactaattagatcctgttaatttaacctatatcaattcacatgtgtgtctaagagtaaaatattaaaaataaaattactcttaaacaatttgggtctcactctccaataaaaaattaataactttttaaaaccctttaaagtttaataaatcaaagatttttttcccttttcttttaaaaagagccccagtgttacaacagtctttgccttcattctttttttttttttttttttagcaatcatgagttccttagtctgcattttttttcttggttccattttatttttatatcagctaggcttattttgaataacttaaatttcattcattcattcattcattcattcattcattcattcaagacagagtctcactgttacccagactggagtgcagtggcatgatctcggctcactgcagcctctgcctcctgggttcaagcgattctcctgcctcagcctcctgagattacaggcgtgagccactgtgcccagctaatttttgtattttcagtagagactgggtttcaccatgttggtgaaattttacttaatacctggtaaataaacaaataagtaaattctgtttctttgaaaatgggagactatgttttgtaaattctgaggcatacaattttatctctgaaatcagggtgtatcttataatcagtatcatgtcacagtttaattggcagcattctccctttcctaatagtacataaaataatgctcatgaccaatgatataccattgatttgatgaaatatgatgtcattttgtataaactgactcctaaaaaaaaatcatttcttctgatttttcctgcttagtgatttttgctctagacttaaagataactttggaaattttgataaatgattctgttaacagaagataagtgattataattatggtttcttagcatttatatctttaaagcatatgttacaaaaatttcatatttcagaattttcaaataaactctgaattcctaaaggactaaaaaagttcacctatgtgaacagcaaagctgttattaagttttaaagttggcaaatcctttcaaatacatagaaacaattaaaataaagagtttaatcattggatgcttgtttcaaggtctgaaattcaaaccatacaaaacaaataggtctttgttccttcactagtcaactcctcttccatttcttcatcgatgttatgtaaaaatttcattttcagtgtcttgcttaccatctgttctggaatagcctattttatttttcaaaagtattagaattagagaccaatgcaataaagctgctgactggagaaggctagcacatacggtgtaacaaggttagaatgctccagattctgggcctaagtttttctggatcataactagtttttctcattatagccataggtgatcatcttctttgggattggctcaaaattaccagactgttatatatatatatatatatcagaatatgttactttgttatcagaactaccattgctgtatgtttctttctttggaaagcacctcacatgtatttttggctaggatatacatataaagtatataacaatctgtcaccaggaacggtgactcatgcctataatcccagcactttgggaggctgaggtggtggatcacaaggtcaagagatccagaccatcttggccaacatggtgaaaccctgtctctactaaaaatacaaaaattagctgggtgtggtggcgggcgcctgtagtcccagctactcaggaggctgaggcaggagaatcgcttgaacctaggaggtggaggttgcagtgagtgagcttgtgccactgcactccagcctgatgagagagcgagactgtctcaaaacacacacacacacacacacacacacacacacacacaggttgcagtgagtgagcttgtgccactgcactccagcctgatgagagagcgagactgtctcaaaacacgcacacacacacacacacacacacacacacacacacacacacacacacacccctgtcaagcaaactctgcattcttgtagtttagacagtgtattttttaccccatagaataactggcataggcagttagaattggacaattgcctggcaattgtggagttaagttagatggttataatggctggttctatgctaactgtgataataggattcatccatctctaccaaagtgagggagacttgttcaggtcccatagactgtgttggagacacatttcccaattttgtatccgtgaagcccccttctcatagatgaatgcaggcttgccagtctgctaatgttaatgttcttgatgtttctgcaaagctcagctatcattcattacattttgattctcttaattagatttttcacattataattttaacctcagtttcctgagtactttgctgtcaactctgtcctacttctaaggaagaagtctattgcctagataataggataagtaaccccaaaggtagttacttgttgaaatacaccaaagacagtgggagtgcttgtcgcctttgtgcatgaactgagtctttatttatggcaaaaggtagcaaatcctactagctattaattggaatactgaggcctggactactttgccagtcaggagagacattcagctgggtgtggtggtgcatgcctataatcccagcactttgggaggctgaggtgggaggattgcttgaggccaggagtttgagaccagcctgggcaacatagtgagaccatgtctctacaaaaaaaacttaaaaaacaaaacaaaacagaaaaaaaaaaaaaaagaggggcatttcagtatcctagaggaagattttaatgtcttctagaacagataatgtatttggtgggctctgtgcttgagcttactactgggatgtcattagctcttaaggtttttttgtttgtttgtttgtttgttttcgagatggagtcttgctctgttgcccaggctggagtgcagtggcgcgatctggactactgcaacctctgcctcctgggttcaaacgattctcctgcctcagcctcctgagtagctgggattacaggcacctgcaactatacccaactaatttttgtatttttagtagagatgggtttttgccatgttggccaggctggtcctgaactcctgacctcaggtgatctgccagcctcggcctcccaaagtgctgggattataggcgtgagccactgtgcctggcctagctcttaagttttaagttccacagaatcttctgagttaattttcctttattctcaaagttcttgagaccaaatcttgtctccataaatgtgtaaccctacatttaaacgtatcgccagtgaaattttctttaaaaagaaacatttaaaaatacttgttggaagaaatgacttgtctatactcttgatttataataaatgtataataaagtatgttccatttgtatgtggctcattattgcattatcactatagaatcttgtcactttagtagtcattattataacactgagaagcaatgtcagtatagcagagctttgtagtttgtatgcgtgcccttgattgtttacttctttttattataggagcctatggagttgtacttaaatgcagacacaaggcaagtacattatttttaaaaagaaatatctgtatatgtttaactgttttgaaactaatgtagtggtctttgcgtgtgggcatgtacaggttgagcattccttatctgaaatgcttgagaccagaaatgttttggatttttttggattttggaatatttccatatatgtaatgagataccttggggatgggacccaaggctagacacaaaattcatttatgtttcatatatacttaatacatatagcttgaaggtaattttatgcaatattttaagtttttgcctaaaacaaagtttaaatacttatatgtggaattttccacttgtggcatcatatcagtactcaaagttttggattttggagcattttggatttttgaattagggatgctcaacctgtaattaaaactctggttatgaggatgttgtttaatgaagtggaattaatatgtgaatgctgccagaaagagactacttttagataagcttgatcatggttgggtagtccttagttcttagcaatcacgtgctatttttttttttcaactgacctatgccgtgcacctcataatgacatttagatcaacagtggacagcatgtatgatggtggtcccgtaagattatgatatggtattttttgtttagataaaaaacattttcagatacacaaatacttatcattgactatggtactcagtaaggtaacatgctatacaggtttgtagccttgaaacaataggctataccatgtagcctagatgtgtagtaggctataccatctaggtttgtgtaagtacactctatgatgtttgcacagtgataaaaatcacctaatgacatatttttcagaatgtattcttgtcattaagtgatgcatgactgtataagtgaaaagctgcctaatgggaaaagagaaaaggtggtgggacaggaataagaaggcagggcagtgacagatttaatttatgttcaagtacttatgagcaaagagtttttttaaaaattatttttcatgtagacccattaacttagattgcttgatgcatttgaatccagattttgaagggtaataaggtaggtgtttggatatgagctagaacttgggataatagtgtagattatgattactggctatagttgattacccttgaacagctgtgaaatgaaccttactagaaattattttactatggtaataatcacaaattattcagagaagttatttgaagtttccatagctgttattcagttgtaagcatgttttactgggagagtaactttcagatggcaagtgttgaaactgtaacaaacattagtttaaatatttttctattatggcatacctagtctgagtatttggcttcatttgcatataatttgttaagaccaaggttttaagttttttcgtgatgtttcagaatgatataatttatgtctgtggtgattttagcaatttaacccaaaacatttaaactcttgaatctgtcgtctattgaaaataatgtatgtgtgtgtatgtatgtaaatatgcacacacataaataaagatgatactcttatatttgctttttctttcctattgtacaaaatactacctgccttttgaatttaagccttcgtgacacttaatatatttttgtgtttagatcacagatctcttacttccatgcaatggcttttgtattcttcttgaaattgggtgattgaactattttatgttaataatagttatctgaagatctctttgccattaaattttcaaaaatggttcgaatactattggttcttgattaaggatgattaagaatttaaaataataaatataataaaaataaatttagcaccttgaacaccttgttaagaaatattactgtagtttgaaattaaacaaatgaaaagctccctaataaaatgctaaatgctatacttttaatgacttgcctttagttataagtttctgaagcttaaaaaaaattcctgggtggatattacttgggagaaataggttattagtttctaagttaaatttgactttttcccgaacataaaacctccttttatacaatggctctgtttatgcaacattgcaaatggaaacttcagttcttacttctaatcttgggttttaaaactcaaagatttatgagatatgtacatatcttacatatgtacatacacatatgcatacatgtattatacgtatacatatatctgatatatattacacatcatgtacagagtccaaatgttttctcctagtcattgtcatacttcaacctgtgaccttttcctctatactttcatgtaactttaagctctccttctgccttttatataaaaatagtttattatttaaatatgttgtttttatctttctatttactcatttgttaaaatggttgtttcatatacctggttctcaaaacacacactgttagtgccagcaggatgggcccagtgtgaaagtggatgagaatggacatctctactcttaggaaaccaactctaaatgtgaactctgatttttagttactgtgtgtagggaactttgaattacaaggataaataaaccatacttttcttgcctttatatggcttatggtctgtctgaagagatagaagaatagataacttaaaaaaaaaacaagtctgtgaggttgctgcaaatgagatacatctaaaacatttctctctttgctgtccttcactacatgaggtcacacaccagctctttaagtattgtagctttctccttgcatgtgtctaaaaagatatcactggatggaaaatttaaagcataaattagtgcctatctcagagtattataaaactcttttttagaatctgcagctgtttagtcattaggcttgttatagatagtatatccttttctcagctaaaatcagaccttcaaatctataccccattatccaaaaatagagaatttgatgcttctggcaagattgatgctttagggtcaaacaaatggattattatgaaactcatattataattaaaaatgtatgtaatcttcccgattgtacttatgtaaagtaatcaggccaatatcttttgcatacctttaaaaatttagtgaaatgtttataaaaatgtataagtcaggtctgtgtgattgtttatgcataaattgggtatctttttgaaaaggttgactgggggtgtatatataattaattcttagcatgttgtatatttgaacaagtatagaagaaagtcacttttttaatctgtgtactgttgcagtaattgagagatcatgctgataaataggtgtattttgcttttgtgcatagaatatgatgttgggctgatccagaccaaagatcatacttcctaatttactgaaattaatgctgctcaatttcaaaggaaaaatatagcttttactttttttttgacagctgaacaaaattaagctgtatatatttattgtatatataataataagttgttatatatacacattgacatgcatatgaaaactcttagcagtgactaagcttctttttaggactcattatgactactcacatttgaaagatgttctaggctgggcacagtggctcacgcctgtaatcccagcaccttaggaggccaaggtgggcagatcacctgaggtgaggagttcaagatcagcctggccaacgtggtgaaacctggtctctactaaaaatacaaaaattagccgggcgtgggggcgcatgcttttagtcccagctactcgggaggctgaggcaagagagtcacttgaacctgggaggcggaggttgcagtgaaccgatatcgcaccactgcactccagcctgggtgacaagagtgaaactccatctcaaaaaaaaaaaaaaaaagatattctggtttggacctttaccctgcagatatgcatagttaattatctttttatttgtatgtgtttgttttttttgttttttggttttttttgtgacgaagtctcactctcacccaggctggaacgcagtgatgtgatcttggctcactgcagcctccacctcatgggttcaagcgattcttgtgcctcagcctcccgagtatctgggactataggcgcgcaccaacatgcccggctaatttttgtattttcagtagagacggggcttcattacgttggccaggctggtcttggactcctgacctcaagtgatctgcctgcctcggcctcccgaagtgctgggatttacaggcgtgagccaccgcgcccagcctcgtgtgtctgttttaaagtgcctgtgaaataggcatgttttgtagcatgctcttcttagcaaaaacacgaaaaggtcatgcttacaacaaggcaaggataattgaatggggttgaaataaagacattcaattagaacttgaggaaagtgggcttgtacagcttgatagagagaggctggagggtgatgctcattgagcccaggacaggaaagtggtgattcatgtaatttgtttcctgtgactatggttgacttatgagaagtttttgtttgttttgaagcagtaggtgacatatgcttttgagatagctagttatacaaagctgtgaacatccaacattggggtacagcctataagtgttcaataaataataatcttacgttagagaactgaaaatgaaggatgcagtagagagctgttgcagagtagcagggacctggtatgtgtggagggatgaaagatgatcccagggacttgaatgtggtaaactagaaaagctttggtattatttatcaggctgggaaacttaataaaagatatatgagtttggggggagaaataatgagtttggctttaataaagaataaaaatggcagcagaacataaaacctagtattaacaaatactacctattgagcatctaccacatgctagacactctactagatgtctcaaccactacaacaagataactctattcttagcctcattttacacatgaggagactgagtcttagagggtctgtgtaatagggccaaaatcatgtggctgataaattgtggaactaggctttgatctgactccagaaatagctaacttgagcatgagataggagccttctcttctcttctcttttccttccttccttcctcccttccttcctttcttctttccttctttctctctctctctctctcactgtgttgcccaggttggagtgcagtggcacaatctctgctcactgcaacctccgcttcccgggttcaaacaattcttatacctcagccttccgagtatctgggattacaggcatgagccaccaccatgcgtggctaatttttgtatttttaatagagatggggtttcaccatgttggccatgctggtcttgaactcctgacctcaagtgatcagcctcccaaagtgctgggatgacaggcgtgagccattgcgcctggcctacgtttttttttttttttttattgctaaacaattttaagaagatacttgaggaaaaagatctgtctcctcttagagaagcactcatagagaaccattgtgtgtggtttctgctcttgtcctgggttttgttgctgatccaattaattgtagaacagtgcctggaacgctgaaatagtctcacccaaattctaattctttgtattttaatattttgtatttgagattttgctagactgttgataccggaaaaactacaaatgctgctgttgtctttttttttttctaataagataggatctcgctatgttgaccaggctggtctcgaactcctggcctcaagcaatcctcccatcttggcctcccaaagtactgggattacaggcgcctggccacttgtgttgtctttttatctattaaagaaataatgggtcatgtgtcattttccatgctgatctgactttttgtttttttgagatgaagttttgctcttgtcacccaggctggagtccaatggcgctatctcggctcactgcaacctccgcctcctgggttcaagtgatctcctgcctcagcctcccaagtagctgggattacaggcatgtgccaccacactgactaattttttgtatttttagtagagacagggtctcaccatgttggtcaggctggtcttgaacccctgacctcatgtgatccacaacgcctgggcctcccaaagtgctgcaattacaggcgtgagcacctggcctgacctaacttttttagggagctagaagagttttgggcctttgcaagcctcctgtttgcctttatcctcatcatccgaatctacatttagtttattgtttgtgagttttttagtaaacagagtaagggaatggtcatgttacaattagtattacctctttctactctgaaaacttttcctcattcctcctttttacagtgattcagttcctaaatcatcgtttccccgctcacttctagaggatgaattggctggaatgcttttccagtgtaccactttcaaatccttgggattatctttcatccctcttcagggactgagttcctgctactctgcaacagctctctactacatctttcatcttcagttctctaatttaagttaacattcttatttattgaatacttatagttaactttaaagtccttttatggtaatcataaaaatataattagttcaaagaagagaacatctcttctgtactataaggtgaataatttcattaggctctgataaatgtgcttaagtgatttatactagctccttaatgccacttttcttcaaaacttcagaaacaaaaatgagtgtgaatcatttttccccccacaggcctgcaatatataggcactgatgaacaaatacctatatagtggaaactcttgagtaatttaagcatagctctttatcagttgttgaaacttcttcaaagtagtgcatggatcccagcactttgggaggccaaggcaggcagatcacctgaggtccaagagttcaagaccagcctggccaacatggtgaaaccccatctctactaaaaatacaaaaaaatttgctgggcatggtggcggacacctgtaatcccagctactcaggaggccgaggcagaattgcttgaacccgggaggcggaggttgcagtgagcggagattgggccactgcactccagcctgcgcgacagagcaagactccgtctcagaaaacaacagagtagtacgtcgtgatctatttctacataaaaagtaatccaacactgatttactgtgtaattagaagctgtagttcatattttacaatttaaaggtgtatttcatatattaaagcattttaatttaaaaaaaatcaacttttttttttgtttttaaagttacttcctatacttaaaacactgtgttctaggcatgacatcataaagtaaaattcaaccagacatctaaggaaaatctgttgaatgcctatcaaatatcaggcacttagctaggcactgactacaaaaaaaaataagatgtaatttttacttttaaggaatttaacatggataaattaacaaatataaagtcatgttttcttttcttttcttatttttttttttttttttttttttttttttttttttgtgacagagtctcgctctgtcgccaggctggagtgcagtgggacaatctcagctcactgcaacctctgcctcccgggttcaagtgattctcctgcctcagcctcccgagtagctgggactacaggtgcccgctaccatgcctggctaattttttttatttttagtagagatggcgttttaccatgttggccaggatgatctcgatctcttgacctcatgatccaccctcggcctcccagagtgctgggattataggcgtgagccatcgccccagccctaaagtcatgttttctgttgtcaggaagtttaacatatagtttgggaggtgaatttgagataagatggtagttgacatgatagtgtgaaacctttcccttttttttttttccaataaatttctccattgaagcctgccttaggaaaaattcatgtcaataataaagcgggaggggaaaagcatttcccagaaccccacatgagaactaccataaagctgggaatagaattaaggagtaacattattagctgataatggactgaatgagaatggtatagtgagaacctctgttttacctctgtgtgtcagagggcccagaatccttggtgtagtaatgatggattgtagaaccttccccaaatggcacagttgaaacttgatccaggaagcccaagtcattgccgttaagactctaccatattaggatgggcaggagaacctctcctagctgtatagatccggagttggcaaactactgcctgtgggctctattttataaataaagttttgttggaatgcagccacagtcatttaagtattttttgtgcatgcttttgcaatacaatgacggttgagtagttgtgatagagactgacccacaaagcctgaaatatttattatctgactttgtatagaaagagtttgctgacttctgatattgagcaagccctaactaggagaatattgtgggaacagcgtagtggccttagtgaaccacagtcttaatttctatttgactctttgcccttggtgctctaagagcctgaggaataaggttaataaggtgggggacttcagtgaaaattacttttccgttgatctggacttgagtaaatcctttgaatggctgggcaggaagttttgtattggttacctctttcacgtgtcaactgtcacagcagagatgtggaatttgctgggtactgggcatacagagacgcatatagtctatttaccttctgtcacatcactggcctgcatagtaccctttccacccaaagacgaatacgaagaagaaaacagtcctcattgagattgtgaaaaaattcttcagctcaagagaaggacattctcataaatatgaagagatttatgagtgtaaaatactttggagaaaaatatgtgagattcaaaggaacgtaaataagaaattaagacgaaacagttaacttttgtttcaagtgcctcttccaggcgttgtgctagctgctttattttcgtgtctctttcaatcctcacattaaccataaaagttagaaggaattatcctcctcttatgtgggggaaactggtgctcgaataggttaatttcctgaaagccatacaagtcagtagatggttgagccgggaattagtcacattttaggctccccttctttcttaaaaaaattgaggtaaaagtcacataacatgaaattaaccattttaaagtatacaagtatgtgacattgagtacattcataatgttgtgcaaccaccacctctttgaagttccaaaacattttcatcacctcaaaagaaaaccctgtactcactatttaccccccattttcccttgcccctggcaaccaccaatctgctttctgtatttacctattttggatatttcatataaatggaatcatacaaatcatacaacatgtgaccgtttgtgtttggcttctttgacctatgttttcaaagtttatccacgttgtagcatgtaacagtacttcattccattttatgcctgcatgatactgtttcgtgttgtatgaatatacctcatcgtgtttatcttttcatcagtcatggacatttgagttgtttctaccttttgtctattgtgactattactgctatgaacattcatgtacaagtgttgtttgaatttctattttcaattctctggggtatataccccaaagtagagtggaaatgccatgtttaattttttgaaaaattgcttaaactgttttccacagcagctgccctcctttacattcccaccagcaatgtatgagagttccaatttctcaacatcctcaccaactcttgtttcctcctccttctcctcctcctcattgagacaaagtctcactctgtcgcccaggctggagtgcagtgtctccctgcaacctccgcctcccaggttcgagtgattcttgtgcctcagcctcccgagtaactgggattacagttgtgcaagccaccatgcctgactaatttttgtatttttattagagatggggttttgccatgttggccaggctggtctcaaactcctggcctccagcgatccacctaccttggcctcccaaagtgttgggactataggtgtgagccaccacgcctggccaccttattattactttttaattgttgccaccctagtggatgtagtgtggtatcttattgtggttttgatttccatttccccaatgatgagtgattttgagcatcttttcatgcgcttttggtcatttgtatatcttctttggagaaatgtctattccaatccattgagcattttaaaattgggttgtctttttggttgaattgtaagagttattcatataatctgaatatagattccttatcagatatatggcttgcaaatattttctctaattttgtaggttgccttttcactttcttaatagtgtgctagatgatgtacaaggtttttaattttgatgaagtccagtttattttttcctttattgctcatatttttaaaaccattgccgaatccaatgtcatgaagatttatggctgtcttttttttaatggtacagtagtatagttttagctcttatgttaggttgttgatccattttgaattgttgtttgtacagttaaaaattgttttaatgaaattttatttttatatatttaaggcgtacaagtacagttttgttacatgggtttatttgcgtagtggatgaagtctgaggtttttgtgtaaccatacccaaataatgtacattgtacccattaagtaatttctcataacgtttgtactgtttttgtatatgttgtgagatagaggtctaacttcattcttttgcttgtggatattcagttgtcccagcacctggatttgttgaagagatcattctttccccatttactggtgctagcacccttgttgaaaatcagttggccatagacatgtgggtttgtttgtggactctcacttttattcctctgggctatgtgcctgtctttatgtcagcacttcactggttcgattactataaatttgtggtaaatattgaaattcggaagtgtgagtcttccaactttgttattctttttcaatactattttgtctatcaagggctccttgcaattctgtatgaatttgaaattttttttttcatttctgggaaaaaaagctgttgaaattttgatagagattgcagtgactctgtagattgctttgggtagtactgtcatcctaactataaattcttccaatccatgggacctttccatatatttaagtgtttaacttcttttagcaatgttttgtagttttcagtgtgctagtcttttacctcattggttagatttattcttagatgttttattcattcggatgccttttttgtttttgaggcagagtcttgctctgttgcccaggctggagctttttttttttttttttttttttttttgagacagactttcggtgtgttgcccgggctggagtgaagtgttgtgatcttggctcactgcaacctctgcctcctgggttcaagcaattctcatgcctcagcctcctgagtagctggtattacagatgtgcaccaccacgcccagctaatttttatatttttagtagagacagggttttgccatgttggccaggctggtctcaaactcttggcctcacgtaatccacccaccttggcctcccaaagtgctaggattgcaagcgtaagccaccgcacctcgctgctattttaaatgaaatagctctgttaatttcttttttaagaaattttttaaagatttttttaagctattttaaatgaaattgctgttaatttctttttaagaaatttttttaagattgtttgttgccagtgtatagaaatattatcgatttttttttttttttttttggagacagaggctctgtcacccaggctggctgtagtgcagtagtgtgatctcggctcactgcaacctctgcctcccaggttcaagccattctcctggctcagtcccccatgcagctgggattacaggtgcatgccaccacacccagctaatttttgtatttttagtagagacagagtttcaccatgttggccaggctggttttgaactccagacctcaagtgatctgcctgccttggcctcccaaagtgctgggattacaggcgtgagccaccacacccggccccagtttatttttttttattgtggtaaaatatatgtaatataaaatttgccgttttaactatttctaaggccgcagtttgacattaattgtattcacggtgttacgtaaccatcactactatgtatttgcacatttttttcattaccccaaacaggaactctctgccaattaagcaataactctctaattcccctatccccagtagttgtaacttccaacctactttctgtctctgtgatttttgcctattctagatattttatataagtggaatattacagtatttgtccttttgtgtccgatttctttcacttagcatgatgtttttaaggttcattcatgtagagtatatcagaacttcattcctttatatgactgaacaatattggaacaacatataacaatattatatggttgaaccttgaaaacatcatgttcattgtatatgtatacaacgaacaaaatgtgttgtatacatgtaattagacatcatctattaccattgagtattcgtgctgttacctgtgggttttataaatgttctttatcaggttgaggaacttgccctctatttatagtcttctcatctgccatggatatgatatgtggggggagaatgtacaccacattttgtttatccatttgtttcttcgtggacacttgagttatttatacctttggttattatgaataatgctgctatgaacattcacatacaagtatctgagtccttgttttcaattcttttgaatatatacctaggagtagcattgttgggtcatatggtaattacatgtttaatattttggggcccactggtttttgtgttttgatcttgtattatgcaactttgctgaattcgtttattagttctaatatttttgtgtgtggattctttagaattttctctgtataaggtaccatctgtgaataggggtagttctacttatccatttacaatttggacaccttttatttcttctacttgtcaaattgctctggctagaacttccagtgctttgttgaatagaagtggtgaaagtgggcatctttgtcttgttcctgatcttgagaggaggggttttagtctattaccattgagtattcatgatgttagctatgggttttaaaaatgtcctttaacaggttgaggaagttgtcctctatttctagtcttctcatctgccatggatatgatatgtgggtaaaggtaggtgggcagtttaaaatgcacagtgttatcacaaagcagctacctctttcaccaagccttcctctggtagttgtgagtttttgaatacctgcagagttgtggaaaagttgattctgatactttttgcaagctcattagttgtttttgtggagggacagagtcctagatttcccagttctgccattttcagtgctaacactctccagatatgtgttttgcacatatttccttccagtctgtggcatgtcttttcattcttacaatggtatgtttaccagagcagaagtttttaattttaatgaaatcctacttagcaattttgtctttcatggacagtccttttggtgttacatctgaaacctcattgccaaactgaaggtcacctagattttctaggttatcttctggaagttttatacatttgcattttacgtttaggtgtatgatccattttgatttagtttttgtgagacttgtaaggtctgtgtctagatcctttcttttgcatttggacatctagcaccgtttgttgaaaagattgctttccccattggattgcctgtgctcctttgtcaaagatctgctgattgtaattgtgtcgagtctattttttgtttgtttgtttgttttagagatggggtcttgctttgtcatccaggctgcaatacagtgatgcagtcatggctcactacagcttcaaactcctgggctcaagtaatcctcccatctcagtctcctaagtggttgggactataggctcatgccaccatgccctgctaatttttaaattaactaattaattatttttgagatggagtctcgctctgtcacccaggctggagtgcagtggcgcaatcttggctcactgcaacctccacatcctgggttcaagcacgtcctagtctcagcctcctgagttgcaaggactacaggtacatgccaccacgcctggctaatttttatatttttagtagagatggggtttcagcatattgatcatgctggtcttgaattcctgaccccaggtgatctacccacttcagcctcccaaagtgctgggactacaggcgtgagccaccgcgcccagcctaatttttaaattttttatagggacagggtcttgctatgttgaccaggctggctcttgagtctgtttttgtgctttattctgttccattgatgtctgtgtctatttttcaccaataccatattgtcttgattactgtagttttgtgttatcttaaaggggagtagtagtatcagtcctttcactttgtcattcttcagtattgggttggctgttttgggcctttcaatacaccctttgactttagtttgtcaatattcacagaatagcttctggggatttggattgggattgcattgaatctgcagatcaagttgagaagaactgacatcttaacaatattgagtctttttttttttttttttttttaattggagtctcactctgttgcccaggctggagtgcaatggtgcgatctcggcccactgcaacctccgcctcctgggctcaagcgcttctcctgcctcagcctcccgagtagttgggattgcaggctcccaccaccacgcctggctaatttttgtatttttagtagagctggggtttcgccatgttggtcaggctggtctcaaactcctgacctcagatgatccacccgcctgggcctcccaaagtactgggattataggcgtgagccaccgcacccggccaacaatattgagtcttataatctgtgaacacaaaatctctctccatttatttagatcatctttgattttcaacagcaatgaataatttttcacatacagatcctgcaaatattttgttaggtttataccttagcactatttttggggtgctaatataaattgtattgtgttttcaatttcaaattctagttgttctttgctggtatacaggaaagtaattgacttctgtctgttaactttgcatcctgtgaccttgctgtaattgtttagtagttccaggtttttctttttcttttttttgtttttgtagattctttgggattttctacatagacagtcatgtcatctgtgaacaaaacagttttatttctttcttcccaatttgtatatcttttctttccttttcttatcttattgtatttcttatgacttccagtacagtgttgaatatgacttatgaggtggggcatccttctgatcttaaggggaaggcgtgcagtttcttactgttaagtaccaataatgttaggttttctgtagatgttcttcatctgaggaagttcctctctatgcctagattgctgggaggtttgttttttttcttaaatcggtgacggagattgagtttcaaaaaacgcttttctgtatccagtgataagaccatgtgatttttctacttagcatggtggtggtggtatattacatggcttgattttggaatgctgaagcagcctttctttctttttttttttttgagagggagtttcactcttgttgcccaggctggagtgcaatggtgcgatctcagctcaccgcaacctccgcctcctgggttcaggcgattctcctgcctcagcctcccgagtagctgggattacaggcacctgccaccatgcctggctaattttgtatttttagtaaagatggggtttctccaagttggtcaggctggtctcgaactcccgacctcaggtgatccgcccgcctcagcctcccaaagtgctgggattacaggcgtgagccaccgcgcctggccttgaagcagcctttcatacctggtgtatagttgttttcatatattggcggatttgattcccttaatatttgttgtggatttttgcatctgtattcatgagaggtattggtctgtagtttgccttttgaaaaatatatttagcttattttggtattaggatgatactgacctcatagaatgagttaggaagtattccctctgctcctgttgtctggaagagattgtagataattggtataatttcttaaatgtttgctagaattcaccagtgaaaccatgtgagaatggagctttcttttttggaatattaataattattgatcaattttcatatacacaggcctattcagattattattttatgtgtaaattttggtaatttgtatgtttcaaggaattggtccattttatctaagttgtcaaatttttaggcatagatttatttataataatctgttattttccttttaatgtccatgtgatttggtagtgatgactcttcattcaaatctgatgtgaataatttgtgtttttttttctcttggttaatttggctagaggtttatcagctttattgatttcagagaagcagcttttgtttttactgttgattgttttcagttcattgatttctactgtaattaaaaattttttttcttctccgtgttttaggcttaagttgcccttctttcttttctttcctaaggtaaagcgtagattattgattttacgtctgttttctaataacgcacttgatgctataaacttttctctaagtgctgctttcatagtattgcacaagttttgacttgtatttttatttagtccaaaatattttaaaatttctcttcagacttctttgactcatgtgttatttagtagtttgttgtttattctctaaacattttgagattttccagctatgtttttgttactgatttctatttttattccgttgtggtatgatagcatacttagtatgatagctacaaatttattaaggtatatgttatggcccagttgtggtctatcttggtaattgttccatgtaagcttgagaagaatgtgtattctgctgttactaaagtattatataaatgtcaagtagatccagttgcttgatggtattgttcaattcatagatacccatactcattttttttttttttttttttttgcctgctgtatctatcggttactgaaaggggctgttaaagtatccaactatagtagtggatttgtctatttctgtttgcagttatatcagtattttcctcatgtattttgatgctctctagtttggtacattcatattaaggattgttatgtcttcttggagaattttgcattttgtaatgctattctttatcccaatgattttccttgttctgaaatctgctttgtctaaaatttatataactacttcaacttcctcttgattagtgttatcgtggtataactttctccatccctttacttttatcctatcccttccctccctgcctctctctctctctctctctctttctcttgctttgctttgctttctatttatttattaattatttttagatacagtcttgctctgttgcccagcctggaatacagtggcacaatcatggttcactgcagcctccgcctcctaggctcaagtgatccttctacctcagccttctgtgtagctgggactacaggtgtgcactgccatgcctggctaactttttgtattttttgtagagacagggttttgccatgttgcccaggctggtctcaaactcctgggcctcaagtgatcctcccacctcagcctcgcaaagtgctgggattacaggcatgagccaccacacctggcccattcctttatattcatttttttaaatctactctgataatttcttttaactggtgtattgaggccattcacagttaaaatgatattaatatggttgtattaatatgaaccatgtttataactgattttctatttgttgtacttactttttttttttaatcccctctttttctgccttctggttttaactgaccgttttacaggattccattttctctcctgttttagtgtctattatacttgtttttactttttttttttttcggtcattgccctagagtttgcagtgtacatttacaacttatctaagtacactttcagataactctatactgcttcttgaggagtgtaggtaacttttactagaatttttgaactcctccctccagtcccttataacgttactattattcatattgcttatccatatgctatactcagtcaataatagttactattattattttgaacagttatcaattaagaataggaaaaatagattttatcttatttattccttctccaatgctcttttctttctgtagatcccagtttcttacctatataattttgctttctctctgaataactttttaaagcatttttaaagggcaggtctactggtgacaaattcactcagcatttatctgagaaactctccttcagttttgaaggatcatttcactgagtaactttgaggtagagttttttttttctttcaacattttataaatatttcactctactttcttacttgcatggtttctgacaggacatcagaggtaattcttatccttgttctctataggtaaggtgttttttttcctctgatttctttcacaattttctccttgtgtttagttttgtgtagtttgaatatgatgtacttaggtgtagatcttttggtatttattctgcttggtgttctctgagtttcctggatatgcagtttggcacccttaattttgaaagattctttgccattattctttcaaatatttcttctcccttgtctcacttttctcttcgtattccaattacatatgttacaccttttgtaattttcccataattcttggatgttctgttttgctttttaaaaatctttattttgccgggcacggtggctcacgcctgtaatcccagcactttgggaggctgaggcaggcggatcacaaggtcaaaagatcgagaccatcctggcgaacgtggtgaaaccccgtctctactaaaaatacaaaaaaaaaattagccgggcatggtggtgcacgcctgtaatcccagctactcaggaggctgaggcaggaagaattgcttgaacctgggaggcgacagaggttgcagtgagccaagatcacaccactgcactccagccttggcgacagagtgaggctccgtctcaaaaaaaaaaaaaaaaagaaaaaaaatttcttttttcctctttccattttagttttggaagtttctactgacatatcttacagcctagtgattttttgctcagccgtgtccagtttactgtcgagtccattaaaagcattcttcatttttgttacagtgattttgatttctagcattttcttttaattcttccttagagttatgtatgcttacattacccatctgttcttgcgtgctgtctacttttcctattagagcccttaacatattaatcacagttattttaaattccctatctgataatccccaagtctgtgccatatctgagtctggttctgatgcttactttgtctctttagactatgctttttcttgctttttggcctgccttgtaatttttttaaagctggatatgatatattaggcaataggaactgaataaataggcctttagtgtaaggttatatgttaatctgtctagaagctaggtcatgtttaatgatgtaggtatagatgccagaggcttcagtttcctctagtgtctttgttattttatttttcctagtctgttgtctgtgggttctcctaagaactcctttataaatagtgagtctgtgtcttgcaactctttcagttgtaattctctgttaatgtactggagctctgttgacatgatgggaagagtatggcgaagggaagaaagtgttctataatctcattcttctgtaagacctgagtctttggctacaaccttcagaagtgtttccagccaccccttcccctccttttcttctgttagatgaaacaagaaggctagagggactgtctttggctgatttcctttctccctggacaccaaggctctggtaaattttctcttggactgttgacctttgttatgaaaaacattctggccttatttcaaaatggttactttcttcctctccctacctaaaagaagaggagatttttattagatcttacccctgggtgtatttcaaattaattttccttgtgtcttacacaaaaggggaggagttttttcttgggtcttcatagtcagaacctggtgagatttcctggaggtaaaactgcaagaacttagagggcctcctaagatttagtccccaggagttctcattcacaagctagtctcagttagcctttgtcaaaattatcatttaagttttcttactagtgtatgattccagtgccttctgctccaggtactgctgatcttggatgtgattctttgtatttgcctgtttctctagatttcaggcgattggttcaccctctgacctcaattccgtaaatccaagaaatttgctgattttcaatttgttagggttttttctttttttcttttttcttttttttttgagatggagtctcgctctgtcgcccaggccggactgcggactgcagtggcgcaatctcggctcactgcaagctctgcttcccgggttcacgccattctcctgcctcagcctcccgagtagctgggactacaggcgcctgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccagggttttttcttaatgtaaggacaggagtgatggtatccaagcactgtatgggttgatgctgaaactggaagtcctgtttacattttaaaattggaaatatcttgtccagtttataaataatattcagcaagaggttttttaactttcctgtgaaccattttcttagctgaaatgactcattcccagttattttcatccctttgaatttcaaatctctgtattttcatatgcttagtaagaactttttcagaacaaaatatttggaaaacttaagaactttatgtagttcttgcaaatggctactaactttaccctaaagaaactagaattattacacattttgatttccttttctcccctacagcattgttttttttttttaaccttctgtaaaccatgctcaagtagttctagggattattttcttcacttatttcaccccacttatttttgaagaagaactcagttttctaaggcactttgaaatctctagagactaagcacggcttaaatttgaaaaactaatgagaataaatgtggaactcttatgctgccaatggtttattttcaattaaccttgaagaatgtagtaattataaactacagatcgtggtgactttagcttaataggattagtttgagaatctgtgtgatagaggacaatttggctaaaatgtgttatttaagcaaccgagaaagtagtgtgtgtgtactttaaagccttataatttgattactggctacaaatttgcattttggtaggctttagttcttatccttggataacagttgtaactaacctcagtcatttgagacattataaatttcgttaaccttgcttcttttttagggttcattttaagttttatttttctcactgaacgtactgtgagaaacagccattaaaccaagaaacaaattagcagtatatttaaagatcgcttattagttagcagattaatgtgtttaataaatattttcctcttttctcatttgattaaaatgaatatttgtctttgagaattaaatatatttttaaaagaattaaaatgttaaatagaatgtaattttttttgtttttctctataaatgtaattttaatatactaaataaaatgtgttttaaaatgatttgccgtactgaaaggatttggttgaaaataattaatttttgctgtgtaataatcaattagctgtggcccattttacaataagatctatttgtgtagcatgctgtgaattagagacagaaaccttttactatgcttttgcttagagacctttattataaagaagtaagggccgtagagtggaaatggataaagactagcaggtcttcaggagtggcatgcttatgagttaagcaccatgccaggttccaccacccttagcagattagtgggtggtatcagtgttgctcctcccaaaatgtttttttaagaactcttcatgtattatgacagtaccctagaagaaacccacaagaatgaacacaatgtatagtaatatagtcttaacaaaatagcttccatgtgctaacaattcaactgaagatagatggtctatgttcagtaaatacatatttaagttgggacccctattgtcagggacttgacctccaattcccagataatgagggagcagcagctcattttttgtcctgatcttactacttcatgctatctgggctggcagatacccttggaaaatgccatttcattcactaaagcttcagtaccacagtgccaggattgattgcctgttcctctctccagagattctcaggaccagccccatcattcttgacatcccttactttttgtcaccaccaaaactcactggccatctgttagcacagaatacccatccttgtgctgctctgtaggttcctcagtctgatccagtttcctccaaccctcccactggcccctagaactcttgaataatttctcccatggcctccgtcttgccccagcatcacagtgtaatctcactttctgtccctggttctctgctgctgccaaatggatgcctgagggtagcccctgctctggcatcagtctcaggctgtgctgtttcttcctttgcctactacctggtaacctcactgcctgccttttagttccttgaatacagtgaggtcttcactcttaaaaatctttgcacaggctgcttccttcatctgcagcaattttctcagtgttttgacctggccgaccctatccagtctgatctgggtgtcttcgcgttgtcctctgctggggcctcctatttgttttcttcttggcacttaattaaatttgaagttgtatattcacttgctcactgagccttttttctggattctatgatatatatttttcctcatatttctgaaattgtgatgtatcttaaactggatttcttgattcctttctgaatggtaggtaaaataatggtttatcttacaattgtcttacatttaataaaatattgcacttttaattattgtttcccccggttgattgtgagttccacacgtataggaatttcattttactcaccaatgaaccagtgcctagcacagtacctggcacctaggaggctctaaataaatagtagttgaatgaatatcattatctatttgggagattttggccctaattttctcaagatgaattagtcagtgtgtaagtatgaattgttaattcagtttctgttgttgaatcattgttttcgagattcctttattctggaattgaaagagacctttagatttgtctattttgttcctccatctatgtaacttgccctattataggtatatgtacatccttgtttagaagtacttactcaccttgcatgaaaatgaattcacataaacttctacctggtgtgagcaattttctttcattagggagaaggagcgaggaaggtaccaaacagcagcagacttttgaacttgagacagttttggctgcttgaacttaacttttttcattttacttagtcccccaatgagtgcaatcatttggcatgcctacttcactttttttaagtgaactaacagcgaacaggcaacgttggtgactggagtgcctcaggcacctcctagagaaggttcaagcttagtccccagctggaggtaaggtgtggttctcagtccttttcatttccccaatcctgctcctgagtactgcagttgagtcagcctgggataatgagcagtttgcctttcattgaacactcaacagcctggttgtgaaaatgtctgctatgaccagtctttgccaatctcccatgtatgcttctgggttctgcagataatacttgtgtctcttcccccactcttgtacctgacacacatgttctacgtgatgtgaaaagaagagaagttgaacaggcaattgggagaactcgaagttgcccaaattgatgatgtcagtgtggagatgcacttgcagggaattgaaataaagaagttcaagtgtggccttgagaaacatggaagggtgagaatcccagggagcttgctgcgaacgtgtaccattggtgtcatcttcaggcctctgtttgaggtggccttcctgatgatcccgtggtctgtctatggattcagcctaagtgtggtttacacttgcaaacgagatctttccccacattaagtggactgcttactctctcgcccccggagaaaagcaccttcatcatcttcatgctggtggtgtccttggtgtctcttgccttgaacatcattgcgttattcagtgtctcatttaagagcatttaaggatcatgtgaaggatcaggagagtgatacacctggcctgcagagtccctccaatggctccatatcaactcttcctctctccaccatgtcccctcctggggacaagctagttcctggagaaagaaacaattcctcttgctgtaggcacaacaaggaagtgagcaaaaacccttctagttacagtgcatagcaagattgaatggagcaggcaggaagtaccccctctgactcccagtcttttgatttccctgctgataaacagagttcttaaacaaaagcaaaaacctagctactgggcactagccatggtaggccagcagccatcctgcagagccagtagtcatgccagcagcagcctgatgacctagagatcaagatgcatacttggaagcattatgattctgcttgattgtttaagagaaggaagtcgcagtagaaagcgcacctttgccccagtggaggtggtactcaaaaacctcagtcgtgagacttagcagacacaaagacattagactaccagggttcctgtacaatgagaaatgctaatttgcttaatatttgatagtaaactgctgtcatttttagctttattgcatgcaatgtagacctagttcatcatattacaagttctagagagtattatttattcaatacaggttttttttttttttttttttttttttttttttgagacggagtcccactctgttgcccaggctggagtgcagtggcgtgatttccgcttactgcaacttctgcctcccggttcaagtgattctcctgcctcagcctcctgagtggctgggattatagacgtgcgccaccacccctggctaatttttgtatttttggtagagacggggtttcaccatgctggccaggctggtctcgaacttttgacctcaggtgatctgcctgcctcagcctcccaaagtgctgggattacaggcgtgagccaccgtgcctggcctcaataaagttttaagaaagcaacctgtgtgtctccctcctgagagcttctggctgcaccgatctttcctagacttttaaactcttcattggcacatcttcatttaagcaaaataggctagaatcagaattttagaaatgaaattgcagtgactacattacagaaagttttagtattaacatttttaattatatgtagcaggatcacacatatacccattactttcaaatgtgccaaaaatgtagcttttttttttttttttaactgttgtacttttcatcagaagcttcttcccaccacagggcgctggagggaaggagaagacacagacaacttaaacattaaacctgcccatccagcatcttgctgtgacagtttaaacagtctcatttggaaaactcagtctcttggctaaatttccttctcataaacccttttatgagcatgaggaataatcacagttatttactaatgaaatgtgtgtgcctattggatactacaaaactcctgaaacttttgaatcagattggacgctgctgtcctcacttcctgtttcacattcattttcacatatatcttgctttttttcccttgaacttttaatcttgagataattatagttcacatgtaggtataagaaataatagattccttatatcctttgaccagtttttcccattagtaacatcttgcataattacagtatagtatcgtaactagaaaatggacattgatgtatttccattgaccttattcagatttcaccaattttatctgcactcctgtgtgtgtatgtttagttatgtgtaatggcatcacttgtgtagattcacatgtccaccacagtcaagctacagaacggttttatcacagggatcccttgtgctgcctttttatagccacagccacactcttgccttcccctctttctaacccctggcaaccactaatgtgtacttcatctctataattttgtcatttcaagaatgctattttagtggaatgatacaatatttaaccctttgagactggctttattcactcagcacaactcccttgagattcacccaagttttttgtgtgaaccaatagtttgctcttttttattgctcttttttagtatgctgtagtatagaggtgccagagtttgtttaccttttgaaggatctttagatcatttccagttttcatttccctgtgttaggtgctcaagagtgcagttgctgggttgtatggtatgtgaatgtaatgctttgtaagaaactggtgtatacttttccagactggctgtacaattttaccttcccatcagcaatgtgtgaggaatctagtttcttcacatgcttaccggcattttgtattatcactattattatttttatgttagccattctaatagttgtgtaggtgatcccattgtagtttaaatttgtatttctctaatggctaaaaatgttgaacaccgttcctgtgcttatttggcatctgtctattttcttcagtgaagtacccgtgccatttttccaattttgaattggattgttttattattgttgagtttaagttctttatatattctggatttaaatcttttgttctatatgtttgaaaatattttctcccagattatagcttgctttttcattctcttaacaatgtctttcatggaccaaaaattttaattttgttaaggtcatttatcaattttttttttcctatggactgtgcttttggtgtcaaatctgagaaatctgcctggccctagatcctaaagattttctcctttggttgtttctaaaagttttataagcttacattttacatttaagtccatgatctattttgtcaatttttgtacaaggtgtgagataaaggccaaagttcttttttcttctcccttatggatgtctagttgctccagcaccattcattgaaaagtctattctccctccattgagttccttttgcagtgaaaaatcagttgggcagatttgtgcatctctaattctggattctctgtccctcttctagtttctagatgagactgtataagattgctgttaattcttccttaagtgttaaaattctccagcaaacctatttgagcttgcagatttcttttattggaaacttgataattataattacatattcaatttctttaataattacatgactcttaaagttgtttatttcatcttggttaacttttggtagtttgattttcaaggaaattggtccatttcttctaagttgtcaaatgtaagagtgtaaagtttgtagtgttcctttatttatttttaatgactgcaggatctgtagagatcttccttgttttgttcctgatactgatgatttttgtcttctttctttttatctttaccagtcttgctagaagtttatcaatattaattgttctttttgtggaatcagccttttgcctcattgattttctgttttcaatttcatttatttctgcttttatcatgattatttccttcttgctttgggtttattttctttttctagtcttgagagaagaatttatcttactgatttgtaaccttctctctttttaaaaaatgtatacattgaatactataaatttccctctcaatactgcttaagctgcatcccacatattttgatacatgttgtattttcattttcatcaagttctatgaaattagaatttcctttgagactacttctttgacccatggattatttagaaatgttaggtttcatttctaactatttggagattttcctgttttctttctcttactgatatttaatcggattccattgtggtcagagaaaatactctgtatgatttcagctctttaaaatttgttaaggtttgttttgtggcccaagatgtgttctgtcttggtgaatattttatgggctcttgaaagaaacatgtattctgctgctgttgggtatagtattttatatatgacaatgagaccctgttgggtttcattttcttatttttttgtcttcaggaagttttaggattccatcttatttatacagttcattagtatatcagtttgtattgtgttcttagttactgatctaggtattaaaatatacatttgtatttaccacaatctattatcagtgttttaccactcaagtgaagtgtagaaatcttactctcctttagacccttttgccctccccacttaaaaaatatatatgtcttaagtatttcttctacgtacattgagcaccacatcagatgatgttataatttataatttttgtctcaaccatcaaatctgatttatgaaactcatgagcaaaaggatagtcttatattccccaccttttatttttgtagcctgttctaatatttttttcttaaattccaagcttctttggttatcttttactttcttggttgttgttgttgttgttgttgttgttgtttgagacagggtctcattttgtcacccaggctggagggtcacccagtggtgcaatcacagctcactgtagccttgtgacttcccgggctcaagcgattctcctacctcagcctcctgagtagctgggaccacaggtgtgcaccaccacacctgactaatttttgtgtttttggtatagatagggttttgccatgttgcccaggctggtctccaactcctgggctcaagcagtccacctgcattggcctcccaaagtgctgggattacaggagtgaaccaccacgcctggctggttatcttttacttcctatttagaaaactacctttaaccattctttaagggtaagtttgctagctacttctctttgttttccttcatctgcgattgtctttatttctctttcattcctgaatggtatttttgcttgatacaggatttctgattgacaattcttttcttttcttttttcttttcttttcttttctttccccttccccttccccttcccttctttttttttgagacagagtcttactctgcctccaggctggagtgcagtggcgtgatctcggctcactgcaacctctgcctcccaggttcaagcgattctcctgcctcagcctcccgagtagctgggactacagacacgcaccaccacgcccagctaatttttgtaatttttggtatagacggggtttcaccatgttggccaggatggtcttgatctcttgacctcgtgatccacccgcctcagccttccaaagtgctgggattacaggcgtgagctaccacgcccggccgacagttcttttatttagtgcttgaaaattgtgctgtttccttttagcctctgtggttactgatgagaatacactgtcattcaaattgtttttctcctataggtaaggtgctgtttttttgttttttagttttcaaaagtttcactatgatgtgtcttggctggaattactttgggtttatcttgtttggagtttgcttagctgcatgaatctgtaggttatgtcttttgctaaatttggaacttttccgttgtgatttctttgaatgtattttcagctctactctgtttgtcccatccttctgaacctccagtgacatgaatattaggtcttttgttatagtgccacatgtctctgagtctctgttcatttttcccccatctgtttcttttctgttgttaagattggattatttctattctgtctctaagttcacagattctttcctctgttttctccattctgttgtttagtccattcactgagttttaaatttcagttatttgctttatttttcaattcataaggtttttttgttgttgttgttcgtttttgtttttttgagacagggtgtcactctatcacccaggctggagtgcagttgcacagtcattgctcactgcagccttcacctccctaggctcaggtgatcctccacctcagcctcccaagtagttgggaccacagacgcgcccagctaatttttgtttattttgtagagacaggtttcaccatgttgcccaggctcgtctccaactcctggacttaagcagtcctcctgtcttgccttcccaaagtgctgggataacaggtgtgaaccaccatgcctggcctaaagttttttttttgtatcttctattaatttgttgagagttcctatattttcttatttggttcaagtatgcttgtaattactctaaagtatttgtatgatggcagcttggaaattttttctgtgatgattctaacatctctacagtcttcgctggcacctgttagtcttttttgcatgttgagatttccctactttttagtatgatgaataattttctactgaaacctggacattttggatgttatgtcattagaatctggatcttatttaatctcctgtttttcttggccttctttgacaccccttctggaaaggaggggaatggaagttgagttttctaattccacctccattgacacccactgagaggggctccttgctgctgctttgttgggtgggaattccagctccctaggcctttgctgaccactgtggctggagggccaggagtatcttgtgaccactccccacgttggcctccactgacaccagcctggcgggggattagacatgttctcttcgcagcatttgctggcatgggtagggccccagttttcactgttttgtggctggggtagagtagttattgtctaaggtcttttgtcctgctaggctgttcttttcctggtcctttagctggagaagagaaggcttttgttggggctctttgtctgtgcccatgggctcttctgggttctttattgaagtatttttattagggttgctttaaaatctctgtcagataattccagcacctgcttcatctcagtgttaatgtctcttaattgtcttctttcattcattcaggttgtgattttcatggttcctaatatgatgatttttttttttttttgtatcctggtcattttggatattgcaagactctggatcctatttaatgtgtgttttagcaggtagccacccagttgaggtataggataagggcaaatgtgtatattcaatttccctcttggtcccattgataccacctccgcaaaagctccacttttactcacgctgcctcattgtagatgggtgaggtggatgttcagctcctcatttggccccaccaacacctccccagtgaaatcggatctcagatttgcacctgccttattgcctctgctacatcttgcagacgctaccctggccggggagtcagaggtgctacggcctgatgggcaatgaaagattagctccttggtcagcctcactgatctcatcaggcagggaattctaacagtgccgcctgctttctcgggatgtgtatgtgtaaaagagtgttttcctacttgggcctgctgaaacctcagtggggtggtgctgcagtttttccattgctgcagtttttccattttctttttggcagtaccctccctgttgcctggaatagggagggtattgccagaaagattttcagttgttagcctacccttttcctggtcttttggctgaaagaacaggtttttcttggagctattttttttttatttgtctatcggtgccaggttgaaggcttttgaagcaccttattgggcatatatgggagacaataaggaaacccaggaacttgcctctcaagtgccgaagtccctatgcagtgtgccatcttctttccatcttggcttcctatgtacgtttttgtgtcacggtcaaggatttttagtcttaaggaagaggacctggaaggagtggggctgctccatcttgaccagaatgagaagtctgtgtgtgcatgtgtttaatatataatgaaaattctaaaatctgttaacaccgttttgtataatagtaacatattttaatatttaaagaataaacaataatttattcttcaaatatactatgtatcaggcacagtgattgacccttgggtctgcagataggactgagacataatccttactttcaaatagctgatagttttgtagagttcaaagacctgtggaatcaattttaatttgccccattatactcagatggaaaccactcacaattcttttagaaataaaaacagaatctagcttcatactacctggctggtagtattgtgggagtttcctcccctctcattggttgagataagcctcctttggtttatgaggtactaggcaaatgaggaagtggtctagtgcttagtgccttgttgttactctggttacaattaaaccctttgccaggagctgccatccagtgggtagtgcttccctggccccaactctccaggctatggtgcttagtaatcagacaggtggaatctccgcaagtaccacaactgtcagaagtcctgaacacccctctctgcctcatgcagaagctgtggtcccatgatcctcccactcctggaggaaccttaactctattggatgggaagttcagctctactgcctttgtgagtctgggctttataatcataagggctgttagttctctccatgggcaggagaaactagatctcagggatacaaccccatgatctctgagttcctttggaaatttggttttgatgatttgggaatgcccaaaagtagaacatttctgaactttctccttgatggtagtgggtgataatggtgatactgtttttttaactcatgtgtgttctaagcattttacttgtatcttctcatttaatcctaatagcaacctcaggaataagtgatattattatatctgattttctccggaggaaattgaggcacagagaagttaaggaacttccctaaggccactcaggtagtaggtggtagagccaggattcaaatgcaggcagtctagctcagagctgaagttcttcttacccttctttcagcgacgtgacaacctttgagttttactttgcttttctattatttgcttgaaattaagattgatgtatctaaaataagtgttctaggcttctaaaaagtgtcacacaattaaatgttactaaagtacgtttctaattagaaaagtttttgttttctttcttattaaaccacatagatttggcaagaagagtataaaaaataaccagtaataggttacatttacaactgtttggagtatagtcctttaataatcagatttttttgttcgtttttgtaagtaggaaacaatgattttgttagaaatctctgcttttggccaagtgcagtggctcacacctgtaatcccagcactgtgggaggccaaggcgggaggattgcttgagcctatgagttagagaccagcctggtcaacatagggagaccctgtctctacaaacagtacaaaaattagccttgtgtggtggcacacagatagtagcctgtagtcccagctactcagaggataaggtgggaggatcacctgagcctggggatgtcgaggctgcagtgagccatgatcgagccactgcactcccgcctgggtgacagagtgcaactctgtctcaaataataataataataaagaaaaataaaaggaaatctctgcttttttgtttggttgcttagggctcaataaaaaatttaaccagattatttctgattatgtatatctattatatatcacattttgttatacatttgtgatcatttctattgtttttacatgtctttgtgtttaaatacaggtagtagaataactagaaggatgtgactcacacgtcattatgtaaatattatccatgccagtacatttaaattctatagggacttaattgtaaagcagttataatatagccgtgttcctctgttgagaaaagattcatactgccctttaccttgctttttcagtgaaaatgtttaagttttttcgttcatttgaaatgtagaatcaaagtttcatttacatgcatattctatgtacttggtactataatcttagagtttgttctattctttgtaaacacagaatgtgaatataaattttctgccatgttttgttaggaataatgtatctctccattaatttgcatgttttcataccattgactcttaaatttccatgaacactagcccacaatgtgatttatctgaggcagattttttttcaaattcatattgatttatcttccatgccacttgaatacattttgttgatataataagattctttgctagttctagctcaagagaaaccacaggagtgaactttagaacttccgattagttcattaaatagacatttggtaacacacctactctagtgagtcctgttggttgtttggggtaaagggtgagaagggcatgatcagtgattacagagtgaccacactccagaaaggaaaggcttattatggtggcacagaaattggggtgtactctctgccctggaggtattcatggctgtcagagcatgaaaatgtaaaaaaacaggttatccgtttgaaaactcaggtggttggttcttttaacaagataatatttgtttttactttctgccatgtttaagttacatatcttctacttcttcttttttttttttttttttttgagacagagtttccctcttgtcgcccaagctggagtgcaatggtgcaatctctgctcactgcaatctccgcctcccaggttcaaatgattcttctgtctcagcctccctagtagctgggattacaggcgcccgccaccacacctggctaatttttgtatttttagtagagatggggtttcaccatgttggccaggctggtctcggacctcctgacctcaggtgatccacctgcctcagcctcccaaagtgctggattacaggcgtgagccattgcacccaaacaagttacatatcttctttctttgcccagcatgtcccttgtctcatttcttattggtcactgtaagtttcatcagaggtatttagaacagctgaactgcctaacccatccatcacatccttttggtgggggcctttctgctaggtctcaggggcacagagttaagtgaggtacctaccctcatggatcttaatcaccgtctggctgggaagtgaggccgcatggcaaagcatagattccagtgcagttgtggtgagtggtttgctggaggtgtgaatagggtcttgggatcacgaaaagaggagtacacaaaacaagctggggggatcctgcagtgcttcctgcaggagggttttgaaggagtaaaaggagtgaactagaagtagaagggctggcttcttgtcatttcagtaaagctaaaacatcacctccttaggtactgcaccagtactctattgaattgtctgttttgttaccataatcttgttctgttatttgtttccttgttatatgtctcttccctccagaatgtaacttctttgtattcccagtgcctgttacatagtaggggcttgaaaaatgtttattggttgaataaatgaatgaatgaatgaagaatgaatgcttgaggcagagtgtgagcagataaaagcaagtgtatgtgaaggcttagttgagaaactaactgcaaatgattaggtgtgacatgagcaagggagcttttccttacaaattaggaggtaaagcatggaattagaatgttatcctgaaagcctccaggctgcatgatatgtaatgcagcattcttttcctgaattcctctgattaacagctgtgaatattttaaattttcattatgtgcaaaactgatgatcttactgaggccttttagagaatattatttaaagaggattttaactagagtgcttcagtgatgttcttgacatcaagtaaccagacacaaacattttattcaggtttacagtgttctttggctaattctcttgaaacattgaattgcttgagacttacgtgccactcttgtttcaagacaacagacaaaacttttggtagttttgtctcttcctccttttgctttagtgctcaaggtgtggtgtacattggtcatcaggccaatatgatggtgataaacagttcctcttccaggcctgtgtgataatacagtttaattgagcagacttttagttacatacgtaagataaaatgctagatacttggatgtaagacaaactagacacatgttaggaataacacttaatatcttaaggaaattgaacacttgaacaaaaggatttttagcaaagcaattttgtttttgcgcagaggggtgcctcttcggccagttgtcatgagaatatacttgaacaaagggcacgagagtttttatttttgacgcgagttttgtttttgtatttttttattggccggggttgggttgtataatttaaattaaatttggttggctaaacatttgattttttgttttttagatagggtgggcacttaaaagaaagtagaggaaagggaaggggtgtttgtaatgagctagaaagttttttttttttttaaataagggaaggaatgtgagctggtattgataacgcttggtattgaggcgtgcctgggcatttaacaaaggcaaaaaggaaaaaggagaaaaaagggagggatactatgaattaaagaataaaagattgaccagattatctgaagagaaaccttattatattttacacatagctctttgaaaaataccatgggctgctgatatatatctaatagccttctctttctctgctaagagaaagtaaatctggcattttctagttttctccacaatgtataataagatatgaggagttattacaagcttaactagatgctttgaaaatcagattttaggaaaagaaaataaaaattgttactacctatgttgaatgtatttttcacttttctctgtagatatggttatggcaaaacgctgtgacttggaacctttttcagatttcagttgtcctattctgcttccttgcctgctttgtgagcacatctatcagaaagtgtggtcacaggatttctagagataacccagcgcagtgcttgaatagggagtttctgtgtttctgttctatacgtcacagtctttcacatcttagcagtgttgtagccattgcgcacctgagcaccttgtgcctaggtagcccgaagatgttatacagaaacaaattgctgtttgctttctttgaacttcagtgttttgttaagctcgtgcctgttctaaagcagccatatctctcatgaattggaaaaaattaaaccttggtgcattggctttatttgcgattttagtattctcattttcttattttataagaaaatgtaaaattaggatattgtatttgccagaattcaagacttatagattttatatacatgcatgcacaattcatcagtgtgttgatgaataaaaacaaaacagaatcaagcatttttttattgagcactaatttattaccatttttgctctactgtctctaacgtcagcagaaggtatgagtatatacgcatgggtctggcttttgttcaggctctgagtaagcagtgagcaacttgctctgtagtagctatgctattgttaactacctgtacattgtttatacatgaataattgcaaaaattaagtatactgacttcgatggtctctacataacttactgaaacaattggtcataagaaaggcacagtcagtccctcccttgataaaggaatctctagcaagctctgtcactcattcaacagagcaatagatttttctcttcatttggaccatgcatttttatgctgatcatcagtccataattttaaactttgttttttattctgtcaatattcttgaatctttatttagcagggataatacttttggaatacctgatgatgtatctttggtcaataaattggtttttgtcttctgatcttttcttttatcatgtccccaggaaagagagcaggatgaatgccactttgtagggtaaattccttgagtattaaaggagaaatgaaggacagcccattcaagtgtcaaaggaatgtgggaagaacaggcagagttagagcaggcaggtggtcaggtatatatttcttgtcattccccgcccccatcaccttagggaactgaaattcaaggtttagggggtgggtaggttgaaggtaagccaaaagtgaaggaagcttatgccccatccccctcttgtaactcagggaagaaacagtctttcaaggctgctttaacacaatgtaagcagccacagcagaagaaaatgtagcatgctgtggttaggtaaagaggactgccaggcctcctttagctggtgagtggcttctgaggaatcccaaagttacttcacactccaggtagctgggttgagagccagtgaacctgtcagtgggaaagatgtgttgaggggcaagctgatacccacgctgtagctgacagccacgctgtagctgacactgattgagctaggtcttgggtgtaaatgagattaaggagtctagatgtcttcggcaccaattagagacagatcaactggggtagatccctgggctctgggccaagagagcacacctgagtctacagcctccttgagctccaacagcagcctcaggccagtgtctggggtccacgcgtataaggaaccttgtcttggagacctgagaacctctaccttactacggtgaagttctgtaaccccacccacatccatacccacagctgccatcttggtagaagcagggagaaaatggaaaaacttaacatttacctgaacaagactataaaccagaagggactgcactaccatataatgcaagttaaagtcaagtgtgggggcttgaaaagcaaggttaaaacagttacagaaaatttaaaagctacattttcttggcacgggttaaatttagtgagctataaattactgttcctgccgcagcaagatagtctttgaggatatatttcctgcatttaaatttaaattttgtattcttcattcacagtggaacatagcttttaagtccaatgattatctgaggtttagattgcctgcagttggcatgcctaatgccatcttggtctcagttacttgatcactagaagtgaaattttcattttctcgcctcagtgttataaaataaggacaaaatgaaatagtaacacaattgcacaataactgcagtatagacgtgatggttaatactaaactgaaaggctgtctgacaggcatcactgccatgtagtcttcaaaattctcattcatttgcagacaatttggtgtgaatttggtgtagacaaggtggtttgagggtatctacatataatgtttgaagatgtgggttttaaataaaaatgagatgcatctcaaattttatatgatctataagtatggagctagactgttttgaaagttcacctttctctctttccattgaaaattgttggtattttctgccagagggattaaggaaaattgttctctgaatgtctcatttttcattttgataactatattttactttttgaacattttattaattaccgaatctataatatgaacatagggtagtaaatttatattagtcctggaactatgaggtaaattatttttaagtgattcatcttgaattacccacttatatacaataagatgtacccatttttagtgtatagttctgtgtaaactagccctcttagttcattctttggcattatcagccagcgtcccttcaggctgatactataatagttacaatggagcatattacaagtacttacaaaggatttctggatatgtgggtttgtttgcatttatcaattaagtggtccaaggcttttaatatggttttgttctcacatttgcggcactcaaatatcagccatccaaggtggccccaagtctcatagccttactagataccttgacattattattattattattattattattattattattattattatttgagacagagtctcactgttgctcaggctggagcacagttgcagcgtctcggctcactgcagcctcaaccttcctggcccaaaggatcctcctacctcagcctcccaggtagctgggactataggtgtgcaccaccacacccagctaatcttttgtagtgtgtgtgtgtgcagagacagggtttcaccatgttgcccaggctagtattgaactcctgggctcaagcgatttgcctgcctcggcctccaaaagtgctgagattataggcgtgagccaccacacccttccgaaactttctaaagcatagaaaagcagatctaatatgtctcctagggaatctgtccttaaaaaaaccgaaatgtggccagcttacgactgtaatcccagcactttgggaggccgaggcgggtggatcacaaggtcaggagtttgagacaagcctggccaacatggtgaaaccccgtctctactaaaaatacaaaaattagccgggcatggtggcgtgtgcctgtaatctcagctactcaggaggctgaggcaagagaattgcttgaacctgggaggcggaggttgcagtgagccgagattgtgccattgcactccagcctgggcaacagagtgagactccgtctcaaaaaaaaaaaaaaaagaaagaaagaaagaaagaaaaaacccaaaatgtatatatttgcattctgtgttcttggctggttggtttttccttatgtaccaaggaatgtctttttcttttaaaattatgggaggaaaaagtgttaggctatggtagaattagtaactgatatccaaagagaagaatgagccaggccaacaggatatatgttttacattggcaacacaatacagtaagatgtttggactagctgttctccttttttgctgagcacattttggaccagttgcatttatttctcaactacaagcttgcagtctagtagtagagtcagaccttgatcaagtgatcatgtaaatctgtaaaggtggaactttaatgcaagttataaagaagaggcgcttgctgagagaacaccacagggccttcagatctcatcgaggagccgtgggaaggctcctctgaggaagtgaggattgattgagccaggatctgggggatgagagagggttgagtgggcaagggagggcaaagcttgcaagaacaaagggaatagaccctaaggcagtagagaacatggcaaggagagatgtgactcagcaagcaaaggagacctagggagaggaggtggaagagctacctggcctgccatgtggagcagctgcgacggagttgtcaggttagtggagttagggagaattttaaggggaatggtggagcttgaaatcagatttcctttcccaaggaagaacctggttgctgaggggatgaacatatcagaagggctgtggcagtactgaaggtgaaagtaccaaaggcttgaccaggggtaggaggagcattcaggtacaggacagtggacccatttgaaaacaatgtaggaggcaaaacccaacagcacttagtgatagactggatggatttggtggtgcagacaagggagatgtcaacagtgatcccaaatttctggctagtgtttactgagatatatgggacaggagacaggcccaggttttgtaggggaagatgcagaaatggttaggcattctgtctgaatattttacactcatacattctcattttacatctcaataaaagattcatggagggcagatccagcgcagagatggtagaagagattttatgtcttattggaaataatgagaaaacagagttgttgtgttggaaatttatcactgacttggcttgaaggcagttgtgtgtgtgtgcgtgtgtgtgtgtgtgtgtgtgtgtgtgtgtgtgtgtgttttggagacagagtctcactctgtctgcccggtggctggagtgcagtggcgtgatcttggctcactgcaacctccgcctcctggattcaagcgattctcacgtctcagcctcccgagtagctgggactacaggcgtgtgctaccacgctgggctaatttttttgtatttttagtagagatggggttttaccatgttggccaggctgttctcgaactcctaacctcaagtgatccgcctggaaggcagtcattatctgtacaaagtctctttgtgagatcccacttcccatgtcttcctttttggctacctgctgtctcatgttcttgataaagtattagtattttcataagactatcctctttttagaaacggtacatgaagtaaatacacagtttttcttgtaatgctttctaaattataagagttttcttaaagtactcttagcgtaccatttaattctaattttgagcaggttagagtttacatcaatgtttcctgtaataatagctccatcatgtcaaccttaataggcagttttgccaggtatttatatatatatatttttttttttctattatacttttaagttctagggtacatgtgcacaatgtgcaggtttgttacatatgtatacatgtgccatgttggtgtgctgtacccattaactcgtcatttacattaggtatatctcctaatgctatccctcccccttccccccatcccatgacaggccccggtgtgtgatgttcccctccctgtgtccaagtgttctcattttgccaggtattggtatagacttggtgggactccgctaaattgtttttggcctaatgaaaaccattcctgaaatttttaggaaaaaaaaaaaggatatatgttttcagtataccttttggtatatttcactgtctttttttttttttttttgtgagacagagtctcactctgtcgcccaggctggagtacagtggcgtgatctcagctcagtgcaacctccaccttgcgggttcaagtaattcttctgcctcagcctcccaagtagctgggattacaggccctcaccaccacgccaggctaatttttgtatttttagtagagatgaggttttgccatgttggccaggctggtctcgaactcctgacctcaggtgatccgtccgcttcggcctcccaaagtgctgggattacaggcatgagccactgcgcctggccatttcacggtataatattttaatggaaccgtattacaaaagttattataaaactaatcattgttttataaaaatgagtgtagacattttagtgttgtgataattttaataatttttggagaatggatcttttaatcttctttttcaattaaaattttctttcatagcatattaatcttttcagtaaagctttacctgatctcttcaacaagtgatcattctcaaatttttttttattatcatactttaagttctggggtacatgtgcataacgcgtaggtttgttacgtaggtatacacgtgccatggcattctcacatttttaagggggaatgtttgtacggaaataccacaaaatggttaaaatgaataaactcgagcagagtttcttacccttagcacttttgacatttggggctaggactgttgtagggactgtcccgtgcattgtaggatgtttagtggcactcttggtctctactcactcgatcccagtagcgcccccagcctatgtgacaaccgaaagtgtccccagatgtcttggggggagcacagtcaccccccaagggagaactattgaactagatttagtttttaatgtcagatacagattgtattttttttaagtgtttgaaaaaagatacatgcaatagcatatgctagttacatgatttttagtgcacaaaacgatacaatttatgggcagattcattcgtagtgataaaaatgtgtgggaatgatactatcaacttcaggatagaaattacctctgggtagagggaatgggaatgaatgaagttttatttttggcattttacatttcaaaaggcaggagatccacagcaaataagccaaaatattatcaactgttaaatctgaaggggatatacatttttttctgtatatttgcatgatcttttttgaactcctgtggcatatcatataacacttgttatactttttagcttttgtcatgcatttttaacttactgtcatgcgttattacataccaggttgtagacttctatgtatataagacagcttcatttactcactcatgtcaaacacaggatacaaaagaaaaccttacataaagcagaggtccaataaacatttgttagttgactgattgaaacgctctttttctttggtatagattttttgtgtgtgtgatttggtctgaagtattgaaatttagcagtaaatctaacttttagtattgacaagctatggtagttttcaaataacaaataatataagtcaagatctctaaggaatttcctggagaaatctagcttttatcactgaatatcatggatggtattttatatttctatagtacttggcaaatgcatattagctctgacctgctatagaatgtatcctgtgcttgaatttcctcccattttataattttacttataatgtaaaaataaatacttttggactaagttattttggaaggtttctacacagtaaaaaagataaagatggaagtaatgaaatacttgcctgtacttttcagtgtataaatattataacatattattagaaaactattttgaaatgttcattggtgctaacatttctcttcagtgatgtgtgtgtgtgtgtgtgtttcagaatcactttctacaacaaaatttacatacacatggcttgcaaagacagtatagcatgattatggttgagaaatggcattcagaatcagtcttcctgggtttaaaatctcagctctgctacatcttagctgtgtgatcatgggacaaattatggaacttcattaaaactcagtatcctcatctgtaaaatgagcatgagatctcctcagaatgatgatttgagaattaagtgagataatccacgggaagcacttagggtggggcttggtgcaagagtacttaaaaacaataacttaaaatgaagcttactttttctgggaccatactggtctataaagtagtagtttcccagcctggccaacatggcgaaaccctgtctctactaaaaatacagaaattagctgggcgtggtggcgtgtgcctacaatcccaactactcagaagactgaggcaggagaatcgcttgaatctgggaggcggaggttgaagtgagccgagaccacgccactgcactccagcctgggaaacagagcaagactccgtctcaaaaaaaaaaaaaaaaaaaaaaaagtatcagtttcacttgatcttagccagaaggctgagaagcgataaagtagtaatttctgtgtttgtagggttttacttatgctcagggagcagacaggatatttgcaaataaaacgtgaacagaaatatttaaaatactttagttatgaagttatattccctgctatttggatgatgaaatgaagaatttctcccaagaaagcacttcctcagagagcaattagaaaatgaattgtagactatagatggccctccgtatcagcaggttccacatcgatgaattcaaccatctgaggatcgaaaatattcagaaaagcagacaaacaaaaacaactaaaaatacaacaataaaaaatacaaataaaaataacagtattacaactatttatttgcatggcatttacattgtactaggtagtataagtaatcaaaagataatttaaagtatataggcgaatgtgcataggttatatgcaaatactgtgccattttatgtcagggatgagcatccatggattttggtatcctcggggatcctggaaccagtggccccctctatatcctcgtagatactgaggaataactgttataaccttttgaaatggcttaatccgtgaatagtagaataaaagagtattttattctgttctgtttcatgatacctgttggatattttaacttagcaaaacatttgaaaaataatgactcctgcgacttccttatacagtatatgatcagtttaaagacttcactgttccagagcataattaagttatataactgcattttaaaatgacttagtaaattgtatggctgttaataccaattagttgctttgccagaatcttaagtaaggcacaattaatactgggaataaaacaatgacccagagctttagacagtcagcaacgcaagtgagttgatgattataagtctgtctagtatgattctctagtgattgaggcttgatttttatggggtagagatcttgagaatattgaaggaactgtaggctctccagatatttgtatttgttagtactcataacatttattttttattctctttctgattttttttttccagctggggaaatttattctgggaaatgtgaaatgccttgatatagtttgtttactcatggagacagtagtacaattcaggaacctttatctaaagttacctagtctctctgtttgtgttccaaagtacataatacaattctaattttaaggtagaattaagggtgaggcatggaattatcattaataaattactgatatatttgatcacattcttagtttattgcttaagatgtcggcttttaaatacttcatattttaaataaagacactgaaacaagtaacaaactatgcctatcttgctaactacagctggtgacattctgttgcagacgttgtgggggcaatggtatgcttttatgaataaattaaattcaaaacaagtttttcagagttattttttgtatgtttttctctttgtctacacctttattatatatcgcatctcagggtggtggtagaataagtaataaagcttggcgtgttacttcctacctctccattaaatacccacgaagatgttaaatacccatgaagttctgcagattaagaaactaaacatcgaagattgctagcaaagtccagggagaattaattttattagcaggactgggttgaaaacatagtcttgaacatcatgctgttcatcctactttgtgaacccaaatcaggccagatatccaaagggagtaggaaatgccttggacccatgctcacaggaactgaaaaataagcaaccatctcactgaggttaactataatctgacactgctagagctggagttctcactcccctactagcctgcattaacatctgcatttccagatctttgcagagactaaaatgtcctaaatatagtaagggaagaagcaaagaaggattggaaaaagcatgtaccatcctaggattcggagtccccgtggcaaagtgtggtgaaggtaaagggaagggaacaggctgtgcttggaaatgtggtctccagaatgccacgaggtaaacagctaatgaatggcatgtgctcttctggcttactcagagaaccctgcccaggcagtttagtctcagaccagccaaccccaatgagaaggatgtgtgctagcaagccaggttctaaaatcaggctggggtgcatcagttcatatttgaagttcaagttgaggccaaatgccagtcctggtggatctctttccatcttagtaaggatgaggttttttgttttgttttgttttgttttttgggagatggagtctcgctctgtcatcacgctggagtgcagtggcgtggtctcggctcactgcaacctctgcctcctgggttccagcgattctcctgcctcagcctcccaagtagctgggattataggcacgcgccaccatgccgggctaatttttgtatttgtagtagagatggggtttcaccatgttggccaggctggtcttgaactcatgacctcgtgatccgcccacctcggcctctcagagtgctgggattacaggcatgagccactgcacctggccgtaaggatgagttttaaagggtggagcagagaatacactgaaaagatatgggaagagaaaacatggctgtgaagatttacaagcaacacatggttctgaaaatgaccttttctttttttttttttttctttttattattattatactttaagttttagggtacatgtgcacaatgtgcaggttagttacatatgtatacatgtgccatgctggtgtgctgcgcccattaactcgtcatttagcattaggtatatctcctaatgctatcccttccccctccccccaccccacaacagtccccagagtgtgatgttccccttcctgtgtccatgtgttctcattgttcagttcccatctatgagtgagaacatgcggtgtttggttttttgttcttgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatgcccagtaatggatggctgggtcaaatggtatttctagttctagatccctaaggaatcgccacactaacttccacaatggttgaactagtttacagtcccaccaacagtgtaaaagtgttcctatttctccacatcctctccagcacctgttgtttcctgactttttaacaattgccaaaaatgaccttttctaacaaaccaataaagttaaggcatctgcttagtctcccaaaagaaagccaggaagatatgacctctacagagagtgaataagctaaaacaaggcaaaaaatgcagaagttggctgagataaggacaagtgaaagaagcctaaaatggataaaacaaaattgtttagcactttcgaactgattaatgttcgtttactaaatgtttattgaacacctactatgtgcctgctattctaggtgctgatgatgcaattgtgaactttgcatactaagtacaaaaacttagtacaagactaagcaattatgaaagatccaacctagaagttgtaaggtttgtggtggaaaataatagaaaaataggagtaggaacaacgtttaaggttgctataagaagactttcctaatttcattgatttccaggtattattgattcaaaaaatacacacacacacacacacacacactcctctaaatatattccaaataatttaaaatttttatttcaaagaaaaggaaaagtcctaacagtatttaggcagaaaaaaagaagtgatctatattggaacaaaatccaaataggcctcatacttcttttctactacaaataccagagactgtcaggtcattgttccccatttgatgccttatgtgatagtattataatttctttatgttagaaaatggcagcccttctttttagacccttaattttcttcttcttggaaaaatatcctagtatatagattttgttacaagaagacactttattcctacctgcattaagttgctttaataagcatacagactctggtgtctgtgatgtgaatggcattttccagggctttatggtgcacttaagcttccagtgactctgaagaataaaaggttgccttcccaagaattctgtgcctatcaagttgccatgtatacgtgaagatgttcaaaaatgcaaagacttgaaaaataggacactttgtcagaaaacctttcaaagatgtgctctggctgagctaaacatgaatgcaaatcaatcactcaaatatgtataaaccatacaagaaaaggactggtggtaaacagtgaaggaaactgaatatgtaaaaaaaaaaaaaattatagctcatgtatctataattacaaattaaattcaacagtcaaaccctcctctcaaaaataaatatatttaacaaaatggtataagaagaatcagtgtcaataacctcagattaatttaaaacagtttaaggtcacaatactttaaaaactggttctgacataagaacaaatcagtagcctatactagactaggctagagtccactagaaatctctgaaagcacatctagtatctatatgtgaggatgctaagatgtaacaactaaaaatttctggtaaagggtattgggaaaattgatttagtgtttagaaattatattaaatctggattccctcaacatgtcatatattaaaataaattacaagtgaataaagatttaaggaaagaaataattaaaatatcaagatacataaatgcagatgaatattaaccatgctcaggctaagtaaggactttgagcacaaaagtaatggacataattacaaaggcctatatcagtaaacttgactatgtaataatttatattcaacaacaacaaaactctagtgatcacaacaatctggggaaaagatttgtaacagaatttgtcaacaagttctcatccatgaatcaacaagaaaatattaaccctagtggacccgatttcacttattaaaagaaagcttctctaatctcattgaatgccagagaggtttttttaaatgattttattttgctttggcagtgggtgtagagtaaatattcttatacactgctgaagggaactgtgacatgactttttttggatgtcagtttgtcattatatattgggagcctttaacattcataccctttgaaccaattatatcacttatagaatttactctgtggaaataaagatgcagatgttgaagtatgttcattaatagacttgttaaatagccatccatgaaaaatggtggttttaaaaataacagcttgaaatgttgcttacataatatcaagtgaaataaaaacaacatacaataagatgtccaatattactactaccatttgagaaaaatttactggaagaaaatataccaaaatattaacaagggttaattttgtaaatgtcttctctatatcctttttgtaccctttgtattctttttgtgttttctgtaatgagtttatattatttttataagcagtttgaatacatgtgaaatgttaaattctttccagtatcttctcttaattgcatgtgtttttcactaaacactgaattggtttaatgtagaaaacttcatctgttcgatttcattctttaagtaaatacataaaccatatcgggggaggcagagaaagtgagttttgaggagagaggattttcatggtattcttgaaaggataaataaaagaatacacattttatttgacccccattagccatctgctttatacagtaaattgtgtttatgagatgccagagaaaaataactaatgaatttattcaaggtggtataaatgtgccagttacaaatttaaatttgtagtcatatcagtggacagttttgaactgagtaagatcttttataaaatcagacaaagttttaacgcttaggatgcaatgaaagaaatgtatgtgggagtctttcagttagaatagaatataagatggaacactacctggaacaatattcatttgagatgtgcgcagtttttctctattcctggaagctacatctttgttctgtgagaaaagcaagaggaggttcctgatatggtctgtcctttcagttatgctgtaggtagattgctagctagagccatttgaaaaggagcagggtaagaacatgatatcaatgtattatgggagagtagcatacatgaaagagtcacctttgtactacgtgggataatattccagctgataatctcctgcattacttaaaattggcagttcttccttcccaataataaaatacctggaagaaggagtttctttaagtcagaagatccattaatgtacaaataagttgtaccctatacatacaagtaagttgtctctaccctacaatcctgttccttcattaaaaacaaaaacacagtacctttaagaagtatctttttcctccataatttatagcacttgcctggtattgtgtttaattttaaagtttttgttttgatgcagggacaacgttttattaaatattaaaagatttgatctgaaagtgtccccacttaaagtaaaaaagaacaggcctgagtcattcagaaggcttttatatgacatgttggctttgaagaatttgtattaattattttgccaaaagcttttttattccttttatagaccagaattgaataaaaattgtttagtttagtggtacttagttcttagcatttccatttcctttccagcccttgttttctttcctcccaaccaaaaacaacaaaaaagattttcatattttcttttaaagcagaattctgttatttcttctgttcagaagagataagggcaggacgaaggtgatgattggtatttggtgatggaatgtttatctcactttggatttgcagtggccatcaataggggcgagctggtgaaaattagatatgcttgttagcattctgctaccagcaactactgtgtattggagaggccctttcttggtcttagaaggccaattaaaatgtgtctctggacttcagagggcagtacagatgacagtctgacactcatcctggcacttttgagtatcctcaagacattgacactaatgatttatgagttacgcatattctgtcaccatatctgctctttgctccacaccctctccctttctcctttcccttccttgacaatgtttgtggggtgataagaaagagattttggaaccaagaaatgagaggtggcgggggagaggaagatgatatatttttaacactctggcttcttgctactctgtcccagaatatacccccaggcaactggaatccccagtcggaaaaacactggagaatgactttccttctgcttcttttcccttgcaggaaacacatgaaattgtggcgatcaagaaattcaaggacagtgaaggtagatatatatatatatatatatatatctgtatatatgtatttttccttctgtataaagtttttatacatagagtgtggaagaagtgggatctagctggtcagacactgtctattcctgatattttgaagtcacaatctcagaaagtgaatatagcttatttcttatgctttgctttcaaacatttagttccttttatgtgaatcttttcaaatctcatgatattagaaaattcatctttttattttaaggttgcaagcagcattggaaatcttgctccaaaggctggttagaaggcatgttgtttatgctgtttctaaatattattaaaataaaaaaactggcttcaagtaaatacttctgtgggtccacataaatagcaagtactacatgaaagatttcagtattggttacggtgatctccagctcctagtcagagttagaaatacaaggatatattgagggattgattttatatttagaataatgcattgagagaataaaagctttttaagaagaaatactatgcttaggggccttcatcacatccagaccatttcagacagagttgtaaaattaccccatgctgggcaagaaagtttaaaataatgcatttcagtagttcattagttttaaaatctagactgttggccatccaaagatagccaaatagagaaactgataacaaaaataggtatggcctttaaggtgctctagacaacatttttttcagactttttggactgagacccacagtagaaatatatttcatatcctaacccagtgtccgcacacatatgtaacactatatgtaaatgaagcaaaaatgtcacgaacttcatcttatgaatgtgaagctctctactttctgttctttcctgttcatgtaaatgcctattgtgacatcaaatggattgatttcactactagtaagtcagagcctgctatttgaaaaactatggtctaagagtaagaagtaccaacacagcatcaatcttcatatctaattagaagtgtggaaatagcagtcatagcttaccttcatcagcacacatcccctaagtgatgtaagacaccagcctctatatttatgaacagtttcatcaccctcacctcaaagacttagcaaacattaaataacaaaaagggacttgctccaggatagatgtagtagtatttgatgtaatccatctctgatgtgctagttatatgaaacacatgcatatcagctgggaactttagcagtcattgtatgggcaggcttaaagggaaggtaaaaagtggaaggtaaaaaagaactttttgcttgttctggggggacaaaaaaatcttgcttcaaatgggatatttgtggtctagcaggaagcagtagctccaggctatcccactgtgataccattggaaatgagctctttgagcagtgactttgggtcagcaggtggctgagagacaaatggtgatttcctaaaaagaatggttgcaacagtagatcaaagcacaaccttcgcatgcatgtaaaggcttctggctgtgcattcatctttcagggcatattggcaagcatcagttaccaccaaaaataataactgtcatcaaattttgtaaaaagtacaatctaggccatgtatgccacctttttttgtttatgagacagggtctcacactgtcacccaggctggagtgcagtggcgcaatcttggctcactgcaacctccactccccgggctcaagtgattctacagccacagcctcctgagtagctgggattacaggtgtgcgccaccatgcccagctaattttttgtattttatttgtagagacagggtttcgccatgttgcccaggctggtctcaaactgctgagctcaaagtgatccgcctgccttggcctcccaaagtactgggattacaggcgtgagccaccttgtccagccccattactttctttttaagtaaataccatgttctttataatctctgtcttgtgcataccaattcttagcttcaattatatatttttacctgtgttaatgatacctttagagtggaaatctagtgtatccgttgaaattcattgagcactgagtgaagtgctgtaagagttgaggtgtggatactttcaagaagcatatgacctattaggagaattaagacctgcaaataaataacaataaaacacagtagaaaacagttattgcctgaatggagacatggaacttggatcattttgaggtgagagaaactgtttctggacgtggtattgggagttcatgaatagtctagacgtggaagacatttgatctgcccttattttattgaaccaacaaaacattaatctgctctgccctcatctctgccagacccttatcactcaccatccctcagaggcatgcagccttatcacccaccccaccttgtcaatgacacctacgtaccacctacacatacttctagagggatacttccaaaacatttctgtgctagaacccaaaaacataaccaattattcataaactttttcattccagtctggcccacttacctactgtttacatttctcccagggagatactagtactctcttttttctgtctttacccttttcctctggctggagtagtgtcttgcttaatggaaaaaagggtacatgtttggtgaacaactcttttggagtgtgaagtgtatatagatagtctcattcaggtaaggatgtctattcaacccctgggtaaaccatttaattctcaatcagtttattaaattttagccaattataataaaaaacagtgtcgtgataatattgccctcattgtcatgtagctctcattaatcccctttattagttattcttgaaatattcatttgatattatggcagtgattatctagatctaatgtttaaaagtcttagtgaagataacgaaataatcctgtaaaaatattgttaactgaaataggatctgcacttggtctgagccatgttcaaggtaatccagtgcagatgctccttgacttgtgatgaggccacatcccagtaacccatcataagtggaaaaaattgttacgtacaaaatgctttggctgggtgtggtggctcacacttgtaatcccagcactttgggaagccgaggcaggaggattgcttgagccaggagtttgagaccagcctgggcaacatggcgagaccctgtttctacaaaaaatttttaaaaaaattagccaggcatggtggtgtgtgcctgtaatcctagctactcagtaggctgatgtaggaggctcgcttgagcccagaaggttgaggctgcagtgagccgtgatcatgccactgcactccagcctaggcaacagagtgagactctgtctccaaaaaaaggctttactacacccaacttaccacacatcatagctttagcctagcctcctttaaacatgctcagaacacttatgttagcctatagttgggcaaaatcatataacaaagcctattttatagtaaggtgttgaatatctcatgtaatttattgaatactgtagtgaaagtgaaaaccagaatgattttatgggtattcaaagtatggtttctcatgaacgcatatggctttcatgccattataaagtcaaaaaatcgaagtcaaaccattgtaagtcgggaccatctattctctcactgatatcacggaatattttgtgagaatatatgttaatttctggtagctttaaaagattatgctaatgtcctactttcttgttaaattcatatatattcacaaatttataaaaaatgtttgtgaaactatattttgttagactactatttagttcaagaagtctttattatcccaggatgatagatcactatttaaaatgggaatcaaaatttcatagtaaataaaagtttattttgggactttaagtggataaaatgaaactaaaattatgaaaataagtttatagttaacacaagttaggttatagtagtaactaatatgctatttcaagaaagaatgaagtgttaacctttttgggaggaggaacagtttttacagtaaaattgtaggctaggccaatgaatagcttctatagtaaagagggtcattaagaaatatacaaaaagctttgtcagttttctcttcttcttcttcttctttttttattcctgtctatgtgtcttctttttcaggctgtgtgtgtgtgacagggtcttgctttgtatcccagggtagagtacagtagcatggtcatggctcagtgcagccttgaactcctgggctcaagcagtcttcctgtctcagcctcccaaagtagctgggactacaggtgcgcaccaccactcccagctaattttttcattttttgtagaggcaaggtctcgctatgttgctcaggctggtctcaaactcctgggatcaagagatcctcctgcctcagcctcccaaaatgctgcgattacaggcatgagccaccaagccttgccttttcgaggtttttattttctagttgttagcagatacaattctatcagacaatttatcagtgtctttgcctgtgattctctctgaaagactttgacaccctgacttggggatatagactcctattaaaaaggaagaatgtttgagtaatgaaaaattttgtctgagcttacttcattagttaattttttcttgttttgatgacttctgtttgttgacccttcataaatttggagtctgtgataatgagttctttaagataaccctaaatgatggtattataagtttggctattaagttcctgcagagaaattttatctagtaaacacctgaccaaccagaagtctccattgtattcgttctgctcattgtaatagttctgctcattatttggattttctgagaagggaaaaaatgaccatagatcataaagatactagagattatttagttaaaaggtacttttcagactatgtataaattataaatttagtccagttcttctaccctttctatgactcccatcttctacagtgagatttgatgttcagatgataatgtatcactgttgttttgtcaagacaagtacaagtgtctgctgtcctcaatttattaaataacccaagagcgctgatttagattatatagctttggaccagcaagaattcaaaatattgtctgtccagcctttactttaggaaaacctattgtctagaatttatttttgacatacatttggaccttctttttgcttctttagacttttccatctttccttaaatgtaaggtgatggagtgaggggagagcctctctgcttgtcactgggcctctgtgcatggcaaggaggctgactccagggagctatacactagtctacatttaagatgaaacttaggttgtgtctctgcttttatataaaataaaattacttgcatttcgtattctgctgaatgttttctatagagaactattttcctcttggaatggacatattcttcttaattattagaaaacatttaattgatcatctgttctgtcttctaatttattttattcttctgtttacccagacactggaaagctctatactgatctctggatcaggagtactctggtctcttattttatataatggtacaaaaccagagttcgtaatctggagtccttaaattcaagagcctgatttctgtgtgaaagaggccttgaaacaaaaagtccaacccttgattaaacaaataatttgattaactgagcttgagcattctggctagtcatgattttaccacacttccttttcatgttcaacatggacctccttcagacttcagggattcttctaggatttggtgatcattttgcatcttctgtgatttaataaatttctactgtgcttttacctgttcttcatctctaaagattggagggtcctcatctttcttggtgtatgtaacagtagcactagcattcaaactccctcagccacattgtctgtctattgatgtcccttcttcaataagagcaaccagactcaaatatggtacccccgtggttttgatcaaggatgggttgatttttctttatcagtttatctgtgtaaaggtccatttggggtggggggctctttggctatacaaaaatgtcaggtttgtgatttcacaaagtaggttacagctattcctggatttcctttctaagcccacagttctttaaaaatagagttacaatagagtttctgctcatctttagatttttctcttttcatcagttatctttgaatctcctttgctcctgtgatctttcttcttaagaattgttctctttagcaaatcgctcttgatttttaggtgtgttaacttgccttactggtaagtttagaagtaggacagtttttgggttgtttttacttaacatcctttttccaccctgccattttgtcctcactcagtggggtttctatatatctgcacataactttgtcagagttgatcctgcattcagctaaaccccctcagtggtaactgatgacaagatgggtcagcatgcacataagcagttatcacatagaagtatggactcgggaagagtccttctgaataatccagtataactcagccccagtatacagatgatggacctcaggctcaaagttgcatagcgtgtatgtgaataattgcaactaaaatgctgacccaggatctttgttgagtttttcttccacccatactatgccgccttgccgttcagctaaatggtagcatagttatacctgaacctgggtactgtgactcactttccaaaactcactgtattgtatactatgccacctttgtgcctgtgttctactcagactatgaggttgaatatgaccctccattcatgcaccctgagaaagttatcctttctagacttgatttcttcatttgtaaactggagcccagccttgataaagaatcctagcctagacaaagaatccacggggattatttcaactagatggcagtgatttttgtgctcatttcagtgggctgtgctaccaccctttgaaaatgccttactgaatgctttttgtaaggcattttgtaatgccttgcaaaatgctttcctactttgtgtacctctgagaagagaagcctgtgtaattggaatgtgccttccttctcccctcatctgataatttagttgacagttttcatcataaagtgcagggcaggccaggaaccttcaaagtacttagaaaaacaaaattataggatgtacccagtaataatgaagagtgcccattttgcttgaatttagggaattaactccactttctgcctgttcccattcattgcaatcttagtgctcaagtgtttacctcaacttttaatactatgactggcataaagtagaaaagcctttatttcctaaaaacagctgctccaatgaggttgtttgggcactacattctaggtaattttgtgtgctgctttttgatgattcatttatcttctctaaccattgttaagtggagtcaatacagattcgaataatgtatgtataacaaagcagccaagttccatgaggtttaggctcataatcaatacaattttaatgaaaagaaataatagattattagacttgaaaaaggcaataggatttttgggagatggaggcatttatttgtttcttttactgatgaaaagttaagtggcttgcctaaagttgcatggtgtactgttagttgattaaaagaccgagtccagaatctaggtctccctagttagtcctggtccactgttccttctactaaaaccatcctgatgcagccattctgaagagggtttattcattagcaaagtgaaactgccacaagttggtaataaataatagtacgatgttttttcatttgcatttccagtaccaagaattcacaaagcatcatagtttatggacgctcttaatgattttatttttatttaggtatttgtgtgcatgtacttgtgtgtgttcttgaccctgagcactgtcagtgttctgtatcctccatcatttctaatcacatactgtagaagacacctagggacagaggtgaatagggagaagagaaaattcagtttatcgtactgcctgataagcggtgcttgaggaaattgacagtgctgtaagaaaactgagaggcaaagtgcctattgtttgccctcccgttgctgtggctgaagtgaggaagagttacgcatgtatgggcagagatttccttatggccacaggtgaagcattcatgtaggaagaatgtattgatcacctctccttgtgtcaggtacagtcctggtgtatattgttgaacagaagaattgagtcctgtcctccatgagctcttgatttagcagggatggctgcatagattgcataccactaagcaaacaaatatatcaagaaaaatggtaagaagttctgtgaaagaaaagtccagaactgtgataaggaataatggggatggaggcctacttgcttttgtggtctgggaaaggctctagaggagtgatatttaaactaaaacctgaaggagcaagccctgtcaagagcctatgtagtagactgagcattgtaggcagagggagcaagtctgaaggccattaaggtggaaaaatgaagtttggggctattttgggaactgaaagatggaggtgagggagagggacatgagatggggatggaaaggcaggcacagaccaggtcatgagtaatcagtagacttgtctcttgttaaattagtcccttgttagatcatttgtttcttatttgagatctgtgtgttattctgtttcttagagatagatggattttagtttgattaccccaaccttgagtaactcagaggggatattagagaagcatgttctcgatcttgcttctttaggaaactgccggtgttcctgtgcttcagcagctgcagctaccttagcattctaacagtcacagaacaccactgttctggctcacccccaacttgcagaacacctggacctttgtcccctcccaatgctctaagctactttgggatgtccccgattgcatctcagacattcccccactgccaggtgacatccactgtcatgctcttttccctgtaagtacccagttccctgttgactgccttggtgtgatccaggtaattcgctgcttatgccacagttggcctttcctactgctggttcttgtcttctcataggcagtatctctcttggtcctaatctgtgttccagtgttctccaacagctttctggctaaagtagaatacttcatttatgtaaccagttcacaagggagtgttgactccgtgttcccagtttgttatggatactcgggtgctacaaagcccttgcttttatgtcattcccttttctttaaactcagtttgagttgggggttgggaaagggggctgggatagaaaataatctgaggaaacattcctgggtctgcatttagaatcttccctctccctttggaatccattcagcctttttcctcctgcgtgccttggttagagagcctttcttctagagggcatatcaagtaggcttccgtgcccctatctccacactccattttcctccttctcacactgaaagatgtgtctaatcctgagggtcacacagctctcaagctaggattctggcccttacccaaaagcttgtggctacatgtgttttagacttcataatttttggattttagaatggacgtgtggcatgttataatgcacagcactcagtaatcaagtagtatttctatagcacaacatatgaatgttcatattagattggataaacaaagactttatgtagtctcctgtcagttcaggtgttacctctcagtgaatttgccccaaacttagaaaaagctttcagtttttagactgtgttttggattttggacttgcagatgagggattatgaacctgtatcctggtacatacatgcaaaaacatggtagttaggatttcccgggtaaatctaaaggtataataaaaactaatttaaatagaaatattattttcatcactcccctgccaattaatctattagagttaatatgacttctgtccttcctccataaccacggagattatcatgaatgaagttgatggtatggaagagggtctattggttcagcataagttctccatcccagaacagctacaccatctgggatggacagatggacatgccacagggaggacagcaggaacctacagcagctgctgttcagagagaagattagacactctcagaattccctgcaacttggctgtgacttgaattgtggatgcttggcgcatgacctctgctccctgaggtgactcatgcagcctgaggaataaaatgtttttttaggccaaagtttcaggccatccttaaaaacatcagctactacagatgccggctgcatagaggttcttctgcacactgacagttttgattccttatggcccttttaatctctttccttccttgtatagagtgttatagttcagatgacaatggaggcatatgttgtatctataagtgtgtttttatacatacacgtagtaaaagaagtataagaaaatttttatacatacacatagtaaaaggagtataagaaaatataagcaggaagtcaagtttgtgctgatcaagtaaaccctttcttcgattttcttattcttgatcctttcaacaagaaaacgtgttatttaatattccattcttgtacttcttatgcagaagtactcaaagcagaaggtgaaattgggatgttttcagtgttcttggaattctttgaatagtagcttgaaagttttcattttagtctcttcaccattgtttacattctagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaagtaagtcattaattgccaatgtgcacatttgcccgattcttttatttaaggctgtttctgacattatttaagaaagtactgttatctaatatggcttatcaatgtactcataatctgaggactttaaaaatgaaagtgttgttaataatcattagaaattctgaaatatatttaagaattttgtacaattaaactgtatagagataatcgtaagtttaaacaatatactgatttggcttctgaagtcttaaactctatgttcaacaagtaatttttagacttgacttaactaagcctaaactgagggagaaactggtaaactgacagtgatggtacaggctggaagaggctgtataagataccacactgaatcagacctaggctggggaatgagtgggcccaggaagcagcttatgtgaactgccaatgctttggctttatttgagggaaggagctgtgccaggaggcctaaggtgaggcttgaggtggtagatgagaccgtaaaagaaaagcatgcattgtttgagctgtctacacttgccttagcttgtattaaaaaatgttcaacttgttggagacaattttaataacatgacctaagggcaaatgtatgttacagtaatcaataatgtgtgcctagaaatttcttggagaggggcctggtgcagtggctcacacctgtaatcccagcactttgggaggctgaggcaggcggatcgcttgagcctcaggagtttgagaatagcctgagcaacatagtgagaccctgtctctaaagaaaaagaaaaagagaaatttcttggagagcagctgacctacagcagttgttatggtcaaaaacttaaacagataaacactttaacagtagtagaagaaactggagtggggcaaacctttaagcaagttttcttgatgagtaaataggtggctcctgccgattcctatgctgttgtccaaagaaggttgaagtgggagaagtttatgtttgctgcaggtctatacccaggtgcttgctataccataaatgacagagtatcaacattgtcataaccaaatggaaagcagtattgccagggtaactgaccagtaatgtggctttgaatgcattcagcctttacaaattgttttttgaaataaaaaaaaaaaatacatgtaataatttccttactagaaaaactggaacggtactagcaggttgtttgtaatcttaaaccactgctttatgttccttttccagaatctgttttaagtttctttttctgtgtcaacttatacattcctctaaggtaccttccacaccaaaataaaactaaaagttttttttttttttttaaagttctattaaaaaaaaaggattgctgtattaggattccaggggaaaccagatgctctttattttttaaaaactttttagagatggtgtctcactatgttgcctaggctggagtgtagtggctattcacaggtatgattatagcacactgcagcctcaaactcctgggctcaagcaaatctttcacatcagcctcctgagtcgctaggactacaggtgcgcgccaccatgcctggctgctttttattttttcattatcataaataatcatgcagtttgtagttttcactaccaaataagaaaattttgacatctcttagtttatcctttttatttttgttctattcatggtggttgttcattattaataataatttaatataacaaatggagaagtcacttctgtgtatctgtttcctcactgggagaggcaattttgtgtgtctgagatctccctgctggtaaatggctgagctgctactagaactccagtcttctgacagtcaggcctgagattcttcccccgatcctgtggttcttaggtagaatgtgactgtcacacctgccacattagtggcagtgcgtcataattgacagtgagtctcaggagagcaaggagaaagttctctaagggataagggactggtaacagagacccaggattgcagaggcttaaaatagaagtttctttcaccctcacatataaatacaaaggtagggcagtacaggactagtgtggcagctctgctccaccacagcgaggtgtgacccttgtcctcaaggtcaggatagagttccagctgtcatatcccattggccaggacatagttgcatgaccacattagctgcaaggcagaagagaactgtactcttcgttctgggcagcacttgaaaattgtgttcctgcggagtaagggaagactggatactggaggacaatatgtctgccactgaggaatttagaatagaatgtgaaacaagagatacaatttgttttctatattacaaagccttcttattccacctgtgcatttgggaccatctatgaatttgttaattgaaaaagagaattcaaatggagaatcaaaaaatgatgcatacatacttaaaatgtttattttaattggaaacataaatactgtatgtattcatttaccacgctataaaggtagggtcaaggccttttgcctatcgctcttctgaagttctgattggtcttttttacatacatcatactcgtaatgcatctttaaggtaaagcaaatgtgcaaaaacatctgcaaaggaatctcagtgcagaatccttcaattggacatgcttatccccactagcacccattccttgccagtgttttgtagttgtctcacatttgattagatggcaataagtttagtggcttttcatttattaagcctttctaaagtattcaactttgttttcttataaacaacaactctttttttaaaaaaacattatttcatttgtttatatggtatttaattatattaaaataacaagtgcatcttttataaataggcatgggagtaaatacaactgattcttgataggtatacaacttgactggtgggaacaaaactgtgaggccaaattagagcagtgattttctgactggtcttatggccccttcacactctgaaaattattgggaaccctaagaactttttatttatgtgtattttatctattagtgtttctcatattagtcatgactgagcaatataaaaatattagttcattttaaaataacaataaacgtattgcatgttaacatagataagtttgtatgtcagttattctttcaagtgaaaaatggcattccacataaaaagcagctcattcagcttgcatctcaatcctctaagtgcttttcctcaggacaaccattggacagatggtgcatgtgcagcagaagggctttatgtgcagtctgccattttatcatgcagattccaaaaaagacatgtactcaagaattgaaatttagtcaaagtaatattttgtactgcttcatcaaagatgtccttaactaaaacgtctgttttcttttttaaaggcaaggtttaattggattaaagaatccaatgccttgattcatgctgaggtgccagcagtttacccattgttgctttgtaccattagtgtaaatgccaacacagtgaaaaaggcaaacatcacagtcttattatgaatatagttttgacttcatgggccctccgcaagatctgagaccccacagatccacatgttacactttgagaactgctgtcctagatggttgcttacaaacaataagctgtgattgtaccacgggccttgtactttacagtgagaaaggagaatggttaatctggaaattcagtagagaccggctaagtggaatttctacataataaaaaattttgcatgaattttagttataatggtctctgactccaaattaaggtttttgaatattgaattgtagggggtctgtgactctttatttcaatagtattttctggcctgtttgaatttttgtactaaatgtattgatcatttttaattttggacatttttttttctactaagaatatttcgtggatcttccaggtgtattttcaaggcttgatttttatcacaagattctgttgcagagatacagcacactgtgtttaaaaaggctctttcccccctttatacattacagtgtcatatttctactttgtattgcttttctcttctaattattctaaaataatgcctgaaaacctttagggagagtgaaaagtatacagggttattatttggggtagcattagggaatagtaaaaatggaattcctcataaaagaaagccccaattttaatgctgattcagcatgagaaagttgtagatagaaagcaaaacaattaaaaaaaaaagctctgtattggatgaattattctagatgctttgtaaaattgttaatacataatttacgggcctacctaatttgggaaataatgactctatttaatttttagaatatgctcgaattgctggaagaaatgccaaatggagttccacctgagaaagtaaaaagctacatctatcagctaatcaaggctattcactggtgccataagaatgatattgtccatcgaggtgagtatgagatttttaaaatggaaaatattaaaacatcaaataaagttaagagtatttcacatgttactgtctttaagaatattttcataagcattggcattgccatttaaattaaatatattttgaaagtgcaagacatgagaaatatttgctctccatatctccttttctatcaccaaaaggatggattacaaatttatttggatattgtggtgagatctttacatttgtataactattatagatccactcccaattgtagaaatgcctagtgatataagagaactcaacaaatgtgaactttgaaacttacttggggataggagaagagcaaaatgttgatctctatagccttggtcctgcaggtagaccaggtaatgtgaaacaactctgaatcaggctttatataggtggttcctaagtcactggcccctattggcactcatgtctcattccttcttacaccaacaatctccagtatgtatcttcacctcctaattttctctaccccttagtgaaaagtgcccgttgtctgcagttgcaggcatgatcaaccttgcataaaggtcataattatactcccataaactgttttgtcctttactgccatgaagtgggtggtttatagcaatgaaagggaaattacttgctcagcatcaactttgtctcttctcctgataatctttcttgcactggagagttttacagtagtgggacacaaattgatacaacaatgaccctaaatatttatttaaaaaattgcagtatttactttttgtctttagattagcagataaaagaatgctacattttaatttacctatacacaaatgcacaaggatatcactttaaaaatattctcacttgtgagaatagtttaaaggtcatatgaagaatgccatcgtcttttattcctagaaacagtttatatttctcttgcatttgactctcatagcagttaccttatcaagattgttggtagcatgggtagatctccacgtcaactggacatccagtgtctagggtaatgattctagtaacagtctatactgtagtttggggatattaatgaggagccgagttaggtgcatttccatcatgatactgtgatttgattatgtgcatagtgaatcattggttgcaaattaatggtagaaaccatgatttgaaatctacagatttcactacctctgccctttctccatttgcatctctaccatatgatatagatcatgggtattctactctaaaaatacaattgcgagatgcctcccaaggagagaattcaactgcattttctgtgaatttctacttaactcccaccacatcttcataacatccatggaaaaaattagaaatcttaatttgactcatccagtatggcttcagcattagacattgataattgtgaaccatgcagaaaagctaaagagacgtaaatatagaaattatgtagaagaatgtaacagaaagcatgtcttgtatgtcttctccagtaaatataatgctagctacttattctcatgtatttttaaagtatcttgtgggtgtaaacattttatatttctatctccaaaaatttgtattactagtattttatgaagtaataataggtttttgaaatgtgttggcctatatttaattattcttaaaattctttcagagatccaactaatccttttaatacttaaagaggaaaaaaatatttttgaagttgtggtctgcatgtttctgagaaagaaattcattgaaacttttatgtaccagcataaaatgtgttactttatttttgctgccacagttttctattcaaattactctagatatttctaattagatgctattacagtgatctaacagtgtcaatcaggagaacatagaacatttttactaattttttttttatcttgacactccagatataaaaccagaaaatctcttaatcagccacaatgatgtcctaaaactgtgtgactttggtaagttaaaaagaaattaagtcctggtacttacagaattaatttattgtaacacataggtagcttttaaaggaatattaaaagtaattgttatgttttgacttaaattggtagaggaacattcttttgagtcacatgttgaaaaattgattgctggaggagtactgctctcttcagagtattgtctatttttaaaattttatcatggtttttgtttaatcagaactaattcaaagcaaatacacccatatgcccaatatctaatgacttcacaaaaattttttttgaatgttgatagttgttccaggtttaatcatgaacactaaaatatccctctgtaaatacacataagtattttgtatatgcaattgttatatatctataaagtcaaaagacatttttagaacattttcatttgttccctctaaatgttcaatgaatggggttagtcatgtataatattacagcttttgattgaatgtatagggaaatttttttagttgtactctctcctagtagaaaattgtctgtgtctcccatgtagataactctgtattaagctctattaaacatttaaattaaaataattcagaaaaaattttagattgtatgttagggtcatgggtcactttttaaaataatagttttgcctaacctgtatgctgaaaaatgaacacttgattttttaaatgtcttttttcatatatttaaatataatcacaaatacaatgtaaacctccacatataactaagaatccatctccttataaggaaaaattagattagattagtgcataggagatgaattacacaagcaagaaatagaggcattgtcaaaatttgcttcgtagaatgacccattttgtccagtgtagcaaatggaagcatgtgtagctcttgtcactcagtattttcaaagattttgaatattattaacctgtttgtctgagaaaaaatgttttacaggacttaattttcttcatattttatgataaggaatgatatgtaaaagagtctgtgtcctaaatttataaagaatgtacttaggaaaaaggaaatattgaatactggatctgaaagattttaattgtggcatttttagcattttgttagcattatgattttcaggaacaacatctgtttctgatttcctgtccgtgattgtgattactacccaaaacagagacttaagttactgaaaatataaagcaagttataaatataaaagaatgcccatagaatggttagtagtaggaagagtactcctggtctggcatttctcagagaaaagactgttgtaaatggtcaggaagttcctcctggcagcaccacatgcggtatcctgtgtcctgtgtatccctagcaaggacttcctaattgcttcccctcccagagtacgcactccttggtctgacttgaagaaccccattcaaaaatacaaatatttcttcaaagcgtgtcttatgaagaaacattgattatctgaagttaggggttttgttttacgctgggattgtttttattttttaccgtttcattttaagaaacagtattttccatgtctcaaaactgacgtacaccttgatttttactcttaattttaatgttctgattctctataactattcacagtgaacctatgttgtgtttggtgagttagatgggtgattaacttatcctcctgccttattttgtggctatgcagtagccctaaaaccttttcaaagggtgggggtaaaagtagtggtagagtctgtaattggtaactaagatacccctaatattctcagtcattaggagatgatagtaattttggcctgctttgtttccatcactgtttatgtaaaggctagaattgctcagcaacagtacatatgcaaatactgtgtaagtgccacatagcaaaattaatgaccgtctacaatatgctagtttgactttgattttgatttctagcttttgtggggactttatttcatttttttcctaaggtttgcatttattgggagagctgatttaaaagtatgctctgaataattataaaagcatgggatgacttcgaaaacccggttttctttagcatagtgaagagactggttttgtagtgaatacattgtatgtctttcaattgacatggaacactctactaactttttaagataacaaggatattattaataaatagcccatgcgagaacagtcattacattcttttgatgttgtttaaagtattactagcgctgaaatattttgcccacatgaattattatttctttttcaaagttacaactttggactttgctatctttcaggttttgctcgtaatctgtcagaaggcaataatgctaattacacagagtacgttgccaccagatggtatcggtccccagaactcttacttgggtgagttaccgtcccaaaatagaatgacatttccacatctgctgattctattgtcatttgctttgagttcatctatggaaaataagaacttcagttaattaaatgtgtcagttacatattgcagtataacaaactacctaaaacttaatggtatgaaacaagcacctttttgtttgctcagaattctgggtgtgggggaatcaccagtttgagttcagctggatggttcttctactggtctctcttggagtcactcacgaagttatagtcagctggtaggtcttctgggagctggttagtttaggggtctcagctggatcagaccatctctgatccctggaaacttatcctccagtaagctattccaagtttctaagtgtgatagttggagaattctgtgctattaagagggtaagccccaaagcaacagcagctttcaagcctttttttgtatggcttttgcctcgttggccaaagcatgttacatgaccaacccctgattcatggtatggagaaataaattccatctcttgatggggcaagtggcagagccatattataaaatggtatatgtatggaaatggaagaaattaattgtagccatctttgctaataaacttccacattaagaatgtgaatatccacacagtttgacattctggcttatctatttgttcatttattaattcttcaagtacttatcaagtatctcttatgtccaaccactttgccaggcacatagagtaaatattgaaccagactgagcacagtggctcacgcctgtaatcccagcactttgggaggccaaagccagcagatcgcttgagctcaggagttcaagaccagcccgggcaacatggtgaaaccccgtctctacaaaaaaatacaaaaattagccaggcatggtgatacctgcctgtagtcccatctacttgggaggctaaggcaggagagtcacttgagtccaggaggcagaggtcgcagtgggctgatatcccaccactgcactccaacctgggcgtcagagcaagactccatcacacacacacaaaaaaaccccaaaaaacaaaaaaatggaccaattgccatttttgttctgaacagtgtaaatcctgtttgatgataaatggctattcaaactagcactgcattgatgattttctcagtaacatctctacattgatctactttgtggccaccctttaactttcaatgctctttcattcatctgttaacaccagaaaaaggtcttctgataaggttcttttctttttagtacattttaactttaaagcctaagaaggagcctgtagttctcattaataattctctacctaccctagttgtaggattattttccttagattgtatttccttctttgggaccacccaaaaacagataatttatactccacaaataaaattagatatagtgataatgatgacaagtgcgcaaattgtaggtctcatttctttaatttagcatgccatacgtgtatctgggggacatgaggaatttaatttttaaaaatgttttttatataatagcaatataagtttctggattttttttctgaagagcatgatgacgacatgtttaagttactcactgagggtttattttgatattaactacttattttccagtgtctaccaaccgtctagtagtaattcttgattcattgctgacctaaagcctgtaagaatcattgacattagtttttgaaagctttactattttttttaaatcaaaagcttgctttatcctgaaaaacaaagatgcttagtcactttattatctcttccattgtgtaggcagagtttagagtttttatgctaatttttaatcttagaattaggattgattttctttgtgtttgtctatatttcttccgtgtaccttttggactcattgggatgcatagtccattttcttttgggagaattgaatttactggacactttaccaatggagaaatgagtatgaagtagatcattcttagaaccccatctgaggactcaagtgtagtagaagggcttgttataatatggtggtgtctgtaacatggccccaaaaagtttattttgaggacagccttattgtgaatcttcagagagtatctgctgcttaataatacctgtagaaaaactggagttatgtttagagatgtgtgctagctgctaaaagtatggggacaatgtaactaaattagtgctgaaatgaatattgctaattaagtgattgtcaagtactagttgaagagccatatttgtaaaaatccttttgaaatcaggtatttggttatacattaagaatttaagttttatatattctcaaggctttgtccttgacattcagaatcattccagctgcataaattattcaaatcagatgacagaagaaaaatagcttgtagtgagtatgtgaaaattttccataagtttctccatctagcactatggaacaaattttctctttctcaaacagatacgaaagaaagatcagtatcttgccctgcccaacaaacttaccaaaaagatctaaatgaagtttccttgtgtagttcttaggttgatatgggaaggaaatgagataaatgaaatattgacttattattgcaatgatttgttatcctagaaatttgttctgtataatgttaacagtcctttgatttaaaagttttgtttcactactgtatcattttagcattccaaaatttctttccatattctttttcagatattttcttttggctttcccttcttaaagcttggattatttatgttggaaatgtgtgtgagcgtgcacgcgtgtgtgtgtggtttcttaatttgctgtaaatttaacactctagatataaagctgttttgaggatacctagattttcatatacaacctccatttattaataacagcaacactcctaaagccctctggtaaactcacaccctagaagaagctataaacccctaaataaactggaaaatgttttgagggaaatagctaccataaagctctatatacataggttacatatattatattcaaataaataatatagtagatcttagcacaatcttagtcatcagaaactgtgatgctgagcgatggaaggttaaataatattcagtgttaaggaaacacataaatcagtacatagtaaattttaatagactgaactcataaaatggataagatgtatctttttgacatttagagagctaaaggataattatttgtcttagaaaatacaattatttggaagcatttcattccccaagtgaggtgttacttgccagatatgtatactgtattagggtttattaagccgttcacatttaagatacatatctatttatgtgaataaatttcaaattagtgtatactaactaaattgttattaaattgatggctttattagcataggtttattcacttgtgttctgatgatttgcttttcagccttcttttcacatggaactttttaatttcataaatatacaagtgtgctgcacataaatttgttcacaataatttggaaattatcaaaacattatattttttcagttgccaaaataatctcttcctttatttttcagcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccgggtaagaggttttgctgaaacccaaaatggaatcaatactgcagtatttgagtcattgttcattgcacaatggaatgctaaactatcctttgaatactatttcttttcccattacagtgtttataatccctattataatattttatttccgaattttttaatagtacttgtggatttaaaaagtggttagaattcaaattctaatcttttttctaatttttaagttccagtttttcaaaatcttttttagtgtatacatttttacacactaaactttggttatcttatattgtttctttatccaaaatattaagcatcccccaaatataccaaatgtatgaatgttgaacaaacatatttgtagtgatttgaggaaagccctgaaaacttggattccccagatttgaaggttcttgttttagtagatgtttctggtccactgacggtgaaacatcaaatcttcttttcaaattagtgtattgtcttgggtccgtgcatggtggctcactcctgtaatcccagcactttaggaggccaagttgggcagaacacttaaggccaggagttcgagaccagcctggccaactttgtgaaaccccatctctacaaaaaaatacaaaaattagccaggcatggaggtgcacacctgtagtcccagctactcgggaggcagaggcaggagaattgcttgaacccaagaggcagaggttgcagtgagccgacatcatgccactgcactccagcctgggtgacagagtgagattctgtctcaaaaaaaaaaacaaaaacaaaaaaaaaacaacaactagtgtattgtcttgggcagcctttcctagacttgacaactttgtacaaaacttttctgagaatatgtgaaatagcgtcttagaaagtataaactttccccaaatgaggaggagtcaccttattagagtgcccagtgagttataggctacttcttccacctaccccaaaaacaactttttaagttttcagccagttttttttttttattatactttaagttctagggtacatgtgcacaacatgcaagtttgttacatatgtatacatgtgccatgttggtgtgctgcacccattaacttgtcatttacattaggtatatctcctaatgctattttcccccctcccccaaccccatgacaggccccagtgtgtgatgttccccatcctgtgtccaagtgttctcattgttcatttcccacctatgagtgagaacatgcagtatttggttttctgtccttgggatagtttgctgagaatgatggtttccagctttatccatgtccctacaaaggacatgaactcatccttttttatggctgcatagtattccatggtgtatatgtgccacatttttttaatccagtctatcattgatggacatttgggttgggtccaagtctttgctattgtgaatagtgccgcagtaaacatatgtgtgcatgtgtctttatagcagcatgatttataatcctttatatacctggtaatgggatggctgggtcaaatggtatttctagttctagatccttgaggaatcaccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttccatttctctgatggccagtgatgatgagcattttttcatgtgtctgttggctgcataaatgtcttcttttgagaagtgtctgttcatatccttcacccactttttgatggagtagtttgattttttcttgtaaatttgtttaagttctttgtagattctggatattagccctttgtcagatgggtagattgcaaaaattttctcccattctgtaggttgcctgttcactctgatggtattttcttttgctgtgcagaagctctttagtttaattagatcccatttgtcaattttggcttttgttgccattgcttttggtgttttagtcatgaagtccttgcccatgcctgtgtcctgaatggtattgcctaggttttcttctagggtttatggttttaggtctaacattaagtgtttaatccatcttcagccacttttttgggccagcatggcaattgctggtcattgtgggagctataaaataatctccccaccatttctttcctttctctgaaatgcgtagttctcaaaccatgttaccttgccatttacaaagcactttgtttttttcttttgattttctggcccccagttaatttccctttagagaccaccactgctcaaacctgagtgcccaaccgtccagatccttctaggctcagtgaatgtgggcgaaatgaatggacagaggcatgccagtatcttttttatctcctgctttttgtctgtctttcacatctgtctgagttacctcaggcaagtttgttgtttctccttttatttttgcttttgtaagccagaaatttgccagctatgaccagtaattggggtgccaacagcatatgtggttcagcaggttagctcaacatttttgaacatttgtcatactaggtgttggaaatatgacaataaataggacttgtccccagtctagaagaaagaaaaatctattatactcagaaataaagttagtcataattaatgaattgcattttcactgaaaatcaatctaaactccttgccgtagcctatgagaccttgcctgacctcatctcgtacctatctccattccccccattctccagattctcagcacacttgccttttttgttctttggcttccataaacattccagggtttttccagtttcatcaacttgggacccatggctgcttctcctggcaaggtgcttccctcgtgtggtcccttctcattctgtcaatctcaaagagtgcctctttctctggccacccaacgtaccaccctcacctccatcctagtctttctctcccacagcatcctttttctatcatagaacttaccacagtatggaattattttgtctgtttctttacttgttaattgttaactatctagtcctctcacactggaatatgtttctcaagggcagaaatcaactgttttatcacatcacagatgtgtttccagcatttaacacagtatctaccatatccagtgagtattcactacatatctgagaagtgattaaccagtctgtggcatcagcattgaaactcaactgtatttcttttctctccatctctcatgcttcttttacccttttacctttacctaacctttgaccaccacccccaaatagatcccccgatctttctcttttcactttagccttctcacatttctcaaaccacacaattctcttttttgtttagaaacctctacaaggttactgataaagtttaaactctttagggtagctttaaaaaccccttcttagttctccagcttcatttctgcctccccgctagcccagtttgtgctctttggccacattgaacctctcaccatttccttgacatattgcttttatagtctgcatttccatctctataatgctcccaacactcacctgtctttcttctcctcctccttcctcccctagactcaggccaaatgtcctccctccgtgaagaccttctagactattcgaggggaaactggtgaccctataacactctggttatacctcttttgtagcacccattgcattctcctttaagtagctgtttgcaaatatgtatcctcactggactgaggaaatgaactgttatgttcaccattatatttgcagcacacctagaatagtgcctgctaggctgaatagtgttgaatgattaaatatttgacctcaggattttaacattaactgctggaacattaagcctggtttgctggctgacttgttcttggcctggttaatggggctgtatgccggattctctgaagagagtatgaacagatctgacatgctgcttggccttaataacttacaaactagctgaagaattaagactttcatccatgaaataattagaaaacaatacaatttataagaaagcgtggtatataataaagtactgcattgtttacctcattgtacggttttctaatgtatctccatatggtttagaccatgagagtgtcaaatattctggaaagttagaaatcatcattggggattcattagagaatgctttatgaagcatttgacatttgaaatggatattgaagaacgaggagcatttggattagataggccacacaaaggattatctctttctcatttgtctgtggtcctgtttgttcatagtcttcttccctaaacaatactgtctataaaattctagacagcgtgtgataatgctgcttacaaacatccttcagggaaattgctgcctccatcacactttgacttttataaaccttaatactttacattttagtctgaaagtgtttgtggtgttttaactaaattagtttaatctctttggaggcttgacaatatcttttgagggagaaattttctttcatgatgttatttgaaaatgtctatgacagatagctaagcacatgggacatgtaaactgcatctgctgtgcaccatggactcaccagtaaccagtccagtgtgatgtgcatttgaagttagttgtgtagagacaggaaaatctacaagatgttgctatagtggtttgcattattgggataaagtaacaattgatgccccatagtatagggcctaggctctggagttagattgctgtggttcaaggcctggttccgtatttactattttgaatgatgccaggaagttatttcaccatcctgtgcctctgtttcttcttgtgtaaaatgatgataaccaaaagactgcctgattggattggtgtaaagatgaaatattatttgtaaaatgtctagaccagaacctcacgcatagtgctcagcaaagaggcattctcattggattgtattggattggccaagtgattcagaaagagacaagactgattgagatatactttaaacttctatgcatgagttttggctatttgttgaattatttcatattagaatggtaggtctcactcaaacgcatgtaaattaattctttgaagttaggagtttgcttggtcattttttattataatatttctaatacctttcgactttcagcattaattttcttatcaatgaaatttcactcctagaaaaaataagggggtatctggtagcataagatagacctcatacacaaaatattaacatgtactggtatagggtcttttatcacagcatggtaggtgtctttctatttgggctgatatttaatgctccagtaacatcgaagggagcctctgtacttcccttaggagaggcacctaggtttagaaagagtgtgggtttggatcacaagactgggtgcaaatactagttctactgctgtttaattatgtaacttgccttgaaccagttatttgaactttctgattgtcaccttcttcatctctaaaataagaataatatatccaaaatgcctcgcataacatcacttccctcagaaatcagttttaggttattgcctgtgcatctgtattgagttcatgttattccttctactcctctatctggaaggtgctgtcctacttttctctgtcttcacatttttcatatttttcaaaacccaattcagatattacctatgggttctttcttccacagccataaaccatcttggtctttcctttctctgagcttcaattagaatttatggttgcacagtttaacattgattgctttcccaaccagacagcagattcctcaagagcagggtttgggtcttacctgtattttttgtctcctgctatccagagcatggtgtggagatgatgtcataatcactccttaaatatcttgtttgaaattttactgtataattagtcctcccatttacttatttagcatgtttagggatttcggtacttagaaatgcttgtatgttggtatagaggaaataatgtatggaagcagactagccctgacatttggaagggagtacatggcattgggctctgccagtcatattacccaatactttaacatccactagatattgcagaatgtgagttggcagaggaaagaacaaaaagcacatctaaataaacttgaccccttcccctcattttatttaaaaatgcatttgttaatctaggaacctgtttgtcttcggttccaactttaaaaaaggaagaatttgaaaacaggtcattgtaagagcatattaaaagcgatgacagaatgtgtgtctgaattcactctctacttctgtgaccttttaggtactggccacttactttctctctatttttacttctatgttttcaaaagtaaatggtatgttgttgttaaaaagctataaggattctatctaatgtcttatcatatcctttctgctagaccctcaattactatcagtaattaagaatcatgtgtataagcagacaaattatgtatacactgtattaaaactgaattgtttataatcagatgatattctattttactgcataattagttcaaatttttatattttagtttgtttcacatgccttagtattgtctgcctagatttaagtatcatctttcacctgtgagttttcctattatttgacacccagtcgtagtaatccatataaaaatacatagacggccgggtgtggtggctcacgcctgtaatcccagcactttgggaggctgaggcgggcagatcacaaggtcaggagttcgatgccagcctggccaatgtagtgaaaccccagctctactaaaaatacaaaaaattagccaggcgtggtggcaggtgcctgtaatcccagctactcaggaggctgaagcaggagaatcgcatgaacccgggaggcagaggttgcagtgagcccagatcgcaccattgcattccagcctgggcaacagcatgaaactctgtctcaaaaacaaacaaaaaaaaatacatagacaacaaaagtaatatacaagtatgaatttgactgggattggcatttttgcttatctgctcccttctgcaacactcacaagcacgtgcacacacatgtccttccccaaatgttaacattccctttgtgtatgtctcacagtttccagctgttaaccatcctcagtccttggaaagaagataccttggaattttgaatagtgttctacttgacctaatgaaggtaaggccaattgatattatctctataaaatgtcttttggtttgtggattcttttgtgtctacatgtgaccatagcctgcttttatgaatgaaattttaggagatgtggaatggcaaataatggggaactatgtcatattaaaaggcatgtaacttatttaaaattacaatgggatctggtattgtcacagtccatctagacagaatcatgagacccctaaatgacattcttaaaatggacagaataataaaaatctgttagcatgcaagagctgttcaagcataaggttttaaaacaaatcttaaaatcaatgttgaaagaagaaattcaacaattttttctgacatggtatttgaagcctcccatcgcctacacagatttgatcagtgaatctaatttttctctttttctaacttggtctcttctctcccagactctttctggctctactttagacgtatcaggatcattgctaatgctgtggcctgagtgttcttccttatgctaccctccctgtccagaagtcttcctgctctatactctaaaagcattctcaaatttctttattcaagtttatttttttttctccagtagacagtcggctccttgagtgggaactgtttttcatatttctccagctttcactgcagccagaagtgcataagcaagtgttggttgtttgatagtagaccttcaaagaacacttattaatggatcaattttattttatgcccagtcagtcaactgtcaaaatcagtagaggttacactgtgcatagagcctttaaaaggcatacttagcacagtcggaaatttctgagtggcattctcagaactttgccgtgctttaaactatgttaatctgtgttccagggaacatagtgtacataggtgtgggggtggaggtgggggaggagggtgtgacgtttcggaaaggccacataccatacaaccttttgtagagatgcacaatattcattaatccataaaggctttcagaaatatcacaataaagaggcatttctgtcttacccaatattttccaaatttaattaaatactgaatactgttttttataaaactctaaagctctagtgttcttctgaatacagattgagaaatgctactggcaaaaaagaacccttaaagccttttgtttaattagtcataaattatcacttaaatcaggtaggttttgtcaatacactttttcacacagtcagtcctcatggattgggacctcaataatttggtaacttctaaaatgtgaatagaataaagtaggaacatggaattaaatacaatttcatgttttctgcctttcatctttctttagttaaaaataattgaatgtttttgttaaatcattaccaaatataattgccaagcatcagtgtggtaccagattaaaagctagcacaaataaaagtagaaagattacccgaatcatcctgtgcttctgccagtttagaagttaaacattcaaattcctatttatttaatatctttaccatcagatttctttaagtaaatatttttattgacatgtcctttcagaaggtgcgcaaattgtatctatatgtcagttactttttataatgtaaacatattagtgtaactctacccagatgtagatagagaaaattactaacaccctggaagccttcttatgcccccttccaggctttatgccaccccacccccctcagaaaccagttccgacttctgtcaccaaagattagtattgccttattatcaaatgttatataaatagaatcattccttttgttttttagctttttttgaaaatgaatttgaaaaatgaaaaataccaattatcccttctttgaatatttcaaagagaaatattctctttgccattctctaaagctgccgtgttaattttgtccacatctaagtacctaaaatggccatctcatcctgtcagccaatttagtgggggtacaggtcaccaaaattaattcaagcccctaataaccttaagactagctgtagtaattatattggctctattttagtcttaaaaaacgttttccctccaagtactgaacttaaaagtttatgaaacttttaaaaaaatgtaaaagaagaaactttaaaaccaaaaaattagagttgaggctctttgctgctacagaatgatttttttttttttttttttttttttgagacagagtttcactcttgtgcagactggagtgcaatggtgtgatctcagctcactgcaacctccacctcccaggttcaggcaattctcctacctcagcctcctgagtagctgggattacgggcatgagccaccacgcccagctaattttgtatttttagtagagacgggttttcaccgtgctggtcaggctggtctcgaactcctgacgtcagatgatcctcctgcctcggcctcccaaagtgctgggattacaggcgtgagccaccacacctggccccgaattatttcttaggatcttatgtcaagtgggaagaaagctaaattcaggcaattatgtgtatactactatgtgggtaaaataaaaggaacaggtagagatatgtatagggaatatctatggaaggatgcctaagaaactggtaacctaggctgcctccagaaaagggaactgggtatctgggggataagagaaagattaagaatgtatattctttcaagtgaatatctacttaattaaaagtgtactttaaattttttaattatattgtaaaagtgattttgattaatgataagtgcaggatacaaaactgtgtatattttgtaaaagaaaatatgtatataggatattcaaaaaagggctgggatcatatatacaaagaggaaaatgatgatgagattataggtgatttagatagtctttttttttttatttcctgaactgtgtttacttgatattctgcaatgactgtgtatttcttttataaggaaaaaaataaggtttttattagaacttaaatttgactttgtaatgttcttaacgatcctaaattttatttcctaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaataggtaaatattcccttttaaggaaatacagatgcagtgttggtcttacaagtaggtggaggaggtggctgcttaaatgatgcaattagagaaaagaaggaaagccctctttattcaaaaatatcttccttatgcttattgcatgattcagaaccacaattaaggagttgtgtgggtcttaaagactttcttatctttaactagtatatgatggaaacctatgcattccctgggaaaggtagcattgggttagcaactaagggggtttacagcctcaagagctagaatattctgtgtgaatgaaacccatcagtgatacccggaggaagaaagctgggtgaaggcaaggggattcctggagagagaagaggatgccaaacacagatggtggatggaaatgtacctagtgtaatctttgtgactggaccaaataggtctggctctacagagaggtcttgtgtttttgttgctcttgtcttctaatcattgagttgagaaattaatttttcataagaataagaatatggaaatagtaaagtcagtgattaaaattgttgctctttaaatattatttttcagcataattttttcaaagcctgtttcctgaaaaacacacacacaggatttgggccatacaatcaggttgtctttcagacctgacattcctcaattctgttggttgcatgtccaagaggacagtgtcctagtcatggtctccctgttttccttcatctcccaagaggctgatcttgtcatctggggtcgttggattatggaagataggaaatagtttctctcatctactattacaagataaatagaaaacaatgattctttatttttattttttagtttttttagagacagggcctttgctctgtcgcctaggctggagagcagtggcatgattataactcactgcagccttgaactcccaggctcaagcctccctcccacctcatcctcctgagtagctgggactataggagcatgccatcatgcctggctaattttttaaattttctgtagagatggggtctcactgtgttgctcatgatggtctcaaactcctggcctcaaacaggcctcctgcctcagtctccccatgtgctggagttacaggcatgagccatagcatctggctgaaaacaataattcctaatatgaaggttttttaatataaattttcttcccacctgcaaccccaaattttccatccatatagaaccattgttcttttttgagacagtgtcttgctcgattgctcaggctggaatgcagtggtgcaatcatggcccactgcagcctctgccttcctggcaagcgatcctcccaccttagcctcctgagtagctgggacaacaggcatgtgccaccatggctggctaattttttatcttttgtagagaattcctgggctcaagcgattcgcctgcctcagccttcctaagtgctgggactacaggggtgagccaccacacctggccaatcagttgttcttaatagatcagatttttaaaagctcaagatctggtactatttaggtctgggagagcatccataaactgatgatgaccatttatcgtatgttttctctgcttaactgtgatagtataattgtgttttagagctgtttactcttcttgaaaatgactggtttcagtttgtttcccctcacatcttatagacctttcttagctggctttctttgtttgttgccatgaaatttttaggacactaagtcaaggaatagtagtcatcatttggttgctcctttgcatttagggggtgcaaattagtcctgtgtcttctttggggttactctcagttcaggtgcttttatctcctttttaccttaattgtctcttagctcctttagtttacaccgaaaaattatcccaatgatataaagtccagtagactgataataagtttttgatttgtgctatagtgattagtgatataacccatactgtgaaaagaggctgtgtatttgtcttctagtgactcacttgagagacagagttcttggaattaaccagtggggacctgaggctctcctcgggaacctctttagggatctgttaaggaggatgtgcttggtgatgatgttttcagcagatacagaagatatgatttgtttgggtccttgaggagtcctcccaagtccccttttgaaatagaggagaatagaaattataagtgaatttaaaatctctggaagaatcattttcaggtcttgacactgtattgaatatattaaagaaaaagtcttacatgatttttctaggaatgatcttaccacattttacatatatctgagggcttttgctccacactggtctatggtccatacttattccatggatgcttttttggttagagacattaattctagcttgaatctcaacacaaacgatggctccctaagacttctcaggaccattttagagatgctcacagcaccatatcacattggttgccacgtacaaactcccctgccttgtctctggagacacaaacatgctgttgcataccttgtcttctaaattttttctctctaggagaggcagtggactcttgtgttacttagcccctggctatctccctcaggctctcctgaggttctgcccaccatggacacggtgcaatggtgcatcagctgccccatactgccactctcctggtccttcaccagccttctccatcaaagtgtagctttgcaccttcgacatttgcttttaaaacttactttaactaaatcgttatctatccatccatccatccatccattctgcaaccatttaagaagagtttgtatgtaaaatttttttaactagttggcagtttaacacagattccttacagttgtgtgtcgaagagatctatggaattttcaaagctgttttttattgttgcactttggcagagctccgatgcaaagggagtatgatgccctttccacataggcgttatgtgcaaagctcagtggtttccaactaatcctaagacacaaacactcagaatggcagtttaggctctttgtacacttatggaaaacctaaagctttgacacgttttaccttaactggataacctctcttttcatgttagaattgtctcttacgttgctctgaatgtgttctttctaagatccacatgtacgtttctgcttaacgtcgctaacagtgtttctaagagttccaaaggctcaagcagctgcctttgctgttctctgtccctttatggtctttgtgagctgaggacgtttcccaatatctgtacatgttatctgtctacgattactatttctaggcctgaaggggaatggggatgaaatagggttctgagagtccagggagagctggacctgggtaggaagagccaccctgtagaagctgtcatctagaaggacacagccacgatctgagtcagggtgcagatgcctgcagggaaggagcagggaagacatcccccagcccctctctcctcttgtcttgtgatgccttccactgctaagcccaaccagaagctagctggctaggaagcgtgggtgacaatctgcagcattgggttcctgaggcccagggccgggctcatgggggtggaggacggattggaggttgggcaaatggagaataaccaacacacttagatctatttgtggatgagacagtctatcactatttaggtttgaaaagtcgctgagatatttcagttaccaagatataagttggcaaacaactcaatggtttaaaacctgatgcctttaggatatagggactttattgatctggggatagactctgttaatataatttaacagaaagtgaaacttagcatttttttctttgtaattcctttctaggtctgggctttgccattttagtgctcatatttaggagtccttttatttaatgctgtaattctaatgacctaactggaagagattagtgagtacattcaagagatgaggccccccacactgtcacaggcttgctcgatatcagatttttttttcttttttgacactctcaggtagctttctggcagagattactgactgaaaggtagactaggaaatgggtccttatgttatttaatggctgagcatgcaggttctcatggggaaaattggaagtcagagcttcacagactaccattctacatgaacaaaaaaaagtgacttccaattagtgtgtcatgggaacaaaactctcccaaatcaaaccatctgtagcaatagcaatatttgcagcaaaattttttgaatgcatagtaaaaccagaattgtgtaaatcattattcatttttaaacattctagtctgtcccaaactacaattagatcctttcaatagttacagtagcacaaactggccttgctatggtgtcagtttcagctttcaaatagaggacaagattttcctctggatttatattttgtattttaaaccaagtgtgaaatgaagctttaagtcctaaaggagggctcagtcggtctaggataatgaaatgttaaataaaaaagagaataattgtgtcttttggagagaaacgaactctttcagatctctgtaatccggtatagtacaggattcctgtttactgtacaaagagatatctgaagagccccaagtaattgccacttctccaagacataaacattgatcatcatgttttccaacaaacctcactggacagtttacatttctttttagagggtcattttcttttattaagtacattgctagaattctcattctttgattatgcaggcagaagagacattggtgtctgtgtatgtgctgtgagtatgtatctctgaggcaggctacaagttttacaaataaaaatgaagttcaagaaacatagtaacctttaagtctaaatgttgtcttctgacattcaagcagacaaaagagttataaagagtttatagctcagctctcttcttagcagtcattctatcacaaacactcatatgagtaccaatataatgagagtatgttttaccagattatcatttagaaactgttttgacagcaagttagctgagcatttagcagtgccagaataatttcatcaaggccagtgctttgttacagagtgagttggtctaagaaacttaattgctgttgataggttacttgttattcgaaggcacatgcttgagagaattaatgtttttagtcttccaggtgttttgagtatttgttctttctttttaacaatactttttgtgtgtcagctattgagggaaactgatatacttcttttgtttttaacatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccaggtacagttgagcaccttgactgaatctggtggcccttcaggggaaggtggtacgagggatgtgatgagggtccatctactattttccctactacaggaggttgtgcttttcttgataggatgcatttagggaagcaatacttggcctaatctctgtttttttgttttttgttttttaaatctatttagatcaaccgttgagtactcaagaaaagtcaaattttgtttttagtgatctttttttttttcttaaatgttcttttctggaatattttgttgagagaatcctattttgatttattacagaattcatcagctgtatcagttaggttttagtttttcttaaaatacagtgtgaattcatgggtattttctctgatctctccaaaccacatttgcttaaatcaaaagcttttgctagtaccttactcaatattttaactgaatttaaaagttttaaatttgtccagaactacagataaatttaacttcataccaggataaatgttagttttcagtcttttggattgtttttaaatcttaaaacagcatttttagcataatgcttcctccatcttattcatcgtcaaactctagaactgacctaacctgcttaaaagaagtagcattccttcacttgaacctgggaggcagaggctgcagtgagccaagatcacaccactgcactccagcctgggcaatagaacgagactctgtctcaaaaacaaaaacagaaacaaaaacaaaaaaaacaagaagtagcattcttacagtagagcatgttttaaaaataatgttatcatgatttcatctataaagtactgtgcccagtgcctggcacaaagtaagtgtctaacaaattttagttattcttgctgcttctgtgattgtggaggctgatatttggacattgaacaccttttctatgctgggtgttcccaggcactcaaaagagtctgagagagctcttgcacttgagaaacttacctgctcttggggaagataaactgatacatgataacaatgaaataagtagccaggtgcagtggctcacgcctgtaatcccagcactttgggaggccgaggcaggcagatcacgaggtcaggagatcgagactatcctggccaacatggtgaaaccccgtctctactaaaatacaaaaattggctgggcgtggtggcgtgtgcctgtaattccagctactcaggaggccgaggcactagaatcgcttgaacccaggaggtggaggttgcagtgagccgagatcgtgccactgcacttcagcctggtgacagagcaagactgtcacacacacacacacacacacacacacacacacacaaacacacaatgaaataagtaagacctaagtcaatatggcactggctataaataggaactgagaatagagagaggtcattgtgagcagaagcagttagaaatggctttacaggcaactgaaggtctttctctgggctaggatgtatagacaagctttgaattggctgaagagtgaaggtatgttcaggtacgtcctgagctaggcaacatgaaaagctctagctagaaagatgaaaagaataggttccctgtcgtcttaagtgtgtgggctggcaggggacacttgtcaacagataagttgttccactactgtgaggttacattctggctactgtgctagaggcatgccagtgtggcaagggagcgagacagtccaagttgtgagttgtgggagctcctagaacaggtggcacctgagcagagacttccagaaaggttgggaagaaagtgacagtgacctcaggaaagagggaagaaaagagcattggaaggagaaggaaggtaacagatgttacatagcatggtatgctttgggcattgcaacttgttccactttgctggagtgaaaaatgcaaaatttggagtggcttttgcaataattcaagcacgaggtgaagagaatatgtttgggattaagtcagtgccagtgggaaacggagtggatcttctactcctcagaagtagaaacaataggatttgtgatttgaaggattgaatataggaaaaaggaagacttcatggtttcttttctaggacctcctttttggagtgaaagagagtagttttgaagtcacctaattcaaccccttcatttcacagatgagcatgtcgaagctcagagaagttgggtgagttgctccaagtttacccaaccagctcaggatggagctgggattatgaggcaagctccaggtgctgaggccagctgcttgccactggtgtcttgcggacatgttgaatttgaagtgaccttggcctctaagcagaagtgtgctctaagaggctaaaaagatggtctggcacccaggtgaaaggagaaagcaagaggtgcccatttgcagaggctggaagtggagtcagaggaatggtcagaggagccctgaggagatgctgtcgggagaaagaacctccagagcctagaaagatctggcagcttcctgcagaggagacatggaagggaaaattgggtaaaatgtgctagcattcagcatggtataaaatggagaagaaatcggaaaaacaaatagctttttaacttagaaaaagtaattgctctctgagaattccaggaaaagaatttttgtgaacatggtggtcataaacgaattataaacagttactgtgggctaagcacagatctgttacagactgtgaaggccagttcaggaggtacagtgcccagctgcaagaaagtacaagtttaaaagcacaaagataccagaaggctggaaaagtaacttaagctgtgagtgaatcctaggaatcactcccatgcaaagtatcgggccaccttgaaaagcacagagactcttactgagtttatattagatgttaataatttgttttcttaaaataatttttgtagaggcctttgtaaacagtacaggtggtaaaagtcaaatgagacattttcataaaatagaaagaaggaaggctatgttggatgaattcctgcccagaatcctcagagtacatttggagaatgagagggagaaaaataatcatattttaaatcttaaataaaatgtttttgatatgtcacataggcttaaggtaatgcccttttctgtgcataatatacagatatacgatgcagcgaactccttctaatgacttggtaattttcttccttaatctttttttctgatgatagaaaatgctgtgttttttcccctcggtgaacaccattgtggaccgagtactgttcttagcttgtgactcacttccttgagagagaaagatagtggtatgtctttggagatgagcactatcatgatttggcttcagaaaatacatgaaacataagtgctgttatcctagagaagattaagacaagaatttaagcacataaactatagtagttaagaggattttaacacaaaaaattattaaaaggacttactctattccttgatatattcaaaaatcatttattttcatctgactttgccatataagtcctgcatgaaatatacttttggaactgcacagttcattttggagaactcagacttaaaatctgctagagaaatttcagataaactaatagaattcctaatcagagggccgctcagaaccatgactgtctagatattagaatggtaattttttttgtttttaataattaattgaactattttcagactaatttgttctctgcttgccttaactttaatgagaattttactttccatctgtgtgaaatttgacttatattacattcatcagattattcacttttatgggactatttgtattttagccaactaacattttttattttagctggttatggtcctagttctaccaaataaaggccatgatgagttccatccctaggaacaggatgctcttataaatccttttaaattttacttccagcctggagaacagctccctccagagatgactgtggcaagatcttcggtcaaagagacctccagagaaggcacctcttccttccatacacgccagaagtctgaggtatgtcacaataaaatatgcctgtaaacatttgttcaacatcattactgcctagcttttaaaatgtattaatacccagtctcccacaaataagttgaagtggcttataaagtaagtagttttccttgtggcataattctgagttttctttcaaaaagatcattaagtcaattatagattgattaggtacggttctaaatttgggccaggtggctcacacatgtaatcccagcactttgggaggctgaggtgggaggattgcttgtgtccaggagttcaagaccagcctgggcaacatagcaagaccccatctctacaaaaagtttaaaaaattagctgggtgtagcagcgtgtgcctgtagtcccagctactcgggaggctgaggcaggaggattgcttgaactggggcagtcaaggctacagtaagccatgatcctactactgcactacagcctgggcaatagagtgagaccctgtctcaagaaaaaagtcataggcaatattgtcatcaatgtgtggcttaacttttataaatttctttcctgcctcagggtggagtgtatcatgacccacactctgatgatggcacagcccccaaagaaaatagacacctatacaatgatcctgtgccaaggagagttggtagcttttacagaggtaagcccacccccggcattcaacaggttcccctctcctccctctctcactttatgtgcacactgctttcaccgactcaggccagcggccttctcacctacactgtcgccttccagcggttctccctgcctctgctcctgctaagtcaggccctcctggcttatgaattggcctccttaggtagcctcttaactggtctccctatctccaaggtacccatcaatatagagactagagtgatccttctgaagctgtgttctgaccataccactcattttgttctgtcaagccataacatacttattgatgttacctgtgtgtctggcactgttctggcttagaacttgttggtgaacaagatagtcaaagatcttcaccatcacggaactcacttcctcgggaggagagatggacactaaacataataattatatagagcagtaaaagatattaagtgctacaaggggggaaaaaatagagcaaggcatcccattgcccaccccaccccaccctactcctaatcccctatcactcacctgttgagagtcttttggtggcttcccattggcatcaggacaaaatctgaattctctaggatgtcattccagacttcccatgatctggcccttgccatgctctccagccactttctcccccaccccccaggtctctctcgtacccagcctatgggactgcacaggctgtgccctcctctggcctgtaatgtactcttcctcctgctggaacagcttgtttctgtccctttctttaaggtcctcttcagtataatatcttcccacagtttgttccagatggactgaaacattttcttctccgttctgtctgtcgtaccttgcctgtaactctgatgtaacactgaccacattgcactgattctttgtctgagttctctctcacaaggttgtgagacattcagttctcttcgtgttctcttctttttattctcattgactagtacactgcctcgcacagtttcataaatatttgtcaattgaattaaagaaaaatttcaagtgtacttgcacgggctaaaatgtactttgttatttagcagacaactaaaacagatgcttttggggttgtacaaacttaggagacattgaatgacaaaggcaatcccttttagtaactatgcagtaatagattgtaaagcccttgggcattccaacaccctggtggagaaaatggacagcaagcccacagggccaagagcaaggccttgggtcaggaggcctgtaaagccttcaagagtcaccacagctttctaaagcctcctatgcccatgttgcctaacttcccactatttctgttgttttaagaggatagttggaaaggggcaggatttggggcgggggcatggagaactgcttagtcattttaattaggaaccccagctaaataaatgcacagaagtgttatttaggactaaatgtatatttaatgattaggctactctgttccttcccttccagccccacctttggaaaagcataaggtattgattgaatatgccatttttcctgataccatgattacgctttagtattttatgggactggccgggcgcagtggctcacgcctgtaatcctagcactttgggaggccaaggcaggaggatcacgaggtcaggaaatcgagaccatcctggctaacatggcaaaaccccgtctctactaaaaaaaataaaaaataaaatagccgggtgtggtggtgggtgcctgtagtcccagctacttgggaggctgaggcagaagaatggcgtgaacccgggaggcggagcttgcagtgagccaaaaccgcgccactgcaccccagcctaggcgacagagcaagactccgtctcaaaacaaaaaaaaaaaaaaaaagaattttatgggactaagcttttaattaagatttaatttaattaaaatattgtaacatacatgtgcaaaagccttttcttctatcaccaaagcattacctccaaaatgtagcataggtgtgttatttctatagatgtctggagaatatacattaatataaaatgctaatggagatttaagttagttagtctttgacctctggaaacacggttttattttgattgcaaaaaaaaataaattggttaattcagagaaatacttcatatgtctctacctcattagtagagagggtagtgagagcttggcaggtggaatgttttaattttaaaaatttcagatatagaaggaaaatatttaactagatgaaacatctgaagacatctgtcatttcaatgatactactaagtcctagaggaagatttggtggtatcattgaaataacagatgtttccagaatgcttcctgttttcattcctattggtcaagagtcaagtgaaattgtgtcatttatctttatatacagtctgtatattccttttgtggtaaaatttccagtatatttttattataaccattcttagaaattgacagaaaaagttaataactatccccccaaaagcagaaaagtatttattcacatacattatattttatctttttcttttcatttagaatttagagaaaaataatatttttgtagaaatagctaaatttctgtgtaattttgtttaaaaacgagtgatactacctcccaagtgtcaaggcttaaactgtagtttgtctgtttcagcacacatattaattacttcaaactaagaatagattttacattgttggtctatgataagaaagctttaacttcaaagaatgccaaaacggtggcagggaatggtggtaggggctacaagattcacacttgaaaataccctggccgggcgcggtggttcatgtctgtaatcccagcactttgggaggctgaagtgagcagatcacttgagctcgagagttcgagaccagcctgggcaacgtggtgaaaccttgtctctacaaaaaattagccaggtgtggtggtgtgcacctgtggtcccagctacccaggaggctaaggtgggaggatcacctgagcctgggaggtggagtttgcagtgaaccatgattgtgccactgcactccagcatgagtaacagtctcttatttaaaaaaaaaaaaaaagagagagagaaaaaaaatataatgttcttcactttatcagctggcaggtcagtttactgttttcaatacacattacttggtgttaactaacccttgcaaattagtgtcataagcagtggatggagggacaaggttccctggaatgccttcaccctcagaaaacacaaaagttatgtgaagagctgatgaggatttttatatgtttgtttgttgttttatttgtgttagagaaaatgcagtaggataacgtgaaaactgctttgaccaaaagagaacatcagccgtctgtggtggttcatgtctgtaatctcatcactttgggaggctcaggcaggaggattgcttgagcctgggaggtcaaggctgcactgagccgagatcacgccactgcactccagcctgggtgacagagcgagactctgtctaaaaaaaaaaaaaaaaaaaaagaaaagtccatcagtgacttactttttctttattcagtgccatctccacgtccagacaattctttccatgaaaataatgtgtcaactagagtttcttctctaccatcagagagcagttctggaaccaaccactcaaaaagacaaccagcattcgatccatggtgagcattttggtttgtttttactcttcctttttttaattgtagatttaagagttgaaataaattctggatgagctttttagtgtcctttctcctgctaggcctttttttctctagataaattattgaataaggaaaatgtgatttttcattattggtaacttttttccagtttggcatttagattaaatatcatgtaagggaaaaaaaatctcctggattattaaatacctgatacgctttccactgtgttgttctgatatgaatgatgacttttgcggtctccttttgttgacattgagccaggtacactttgcttagcatttgatgtgcatcgtctcagtcagttctcatagtcacactgtgcttccatgctagtggcagggacactgaagcttggaaaagtcgaggaactggcccggtgttggacagccagtaacatggagaagggagccagggttcaaacttaaatgggctccgactccagagctcatggttgttacctctgtgctacctgtctgtcattcagggtaaaaagaaataggggaacagtcctttatgctaccataaaagcataatggtaatgaaaggcacaaatgatgtggcaacttttcttattcttttatcttttttgtgtcgcatctaataaatatttagggagagaattacagttttatcaagatccattagcaaatctgtctgaggagtaaggactttaagaaaaataataatgtagacttcttctcaactaccctgaaagactgcccaggttctctaccaagagcataaaatgggacatcactgtaagacactggatttggaacaagaccagtctgtcagagagtccctctctggtgtttgttgccagaagtaacagaagggccttatgtcagtactcctgactccatgtgatgtcacaatttggaccctgttgataaagttacatcaaggtttcagtgttgttgtgccctatagtgaaaattacttaattattcttaaaacaatataaaaaatgacttcttaaaagctataaatacacttttgctgtataagcacaatttacatccattgcctatttataaaatgacagtcttaatgttcgtgactaagagtttagactctggaaataggatatcttggttgatggcaacttgtctatcaatcagaggactgtgtctatttgtctcttggtttcctcatgtgtaaaatagggctaagaatggcacctccctcatagggttcatgtgataattaaatgaggcaatgcattaaaagcacctagaataatgcctggctccgtaagcattcattaatgttagtgactgcagttactatcgttgtcatctaacttcaacatcaggtgtttcccctccattttgatgataaactttggtgttctttctccatgtgactgttttaagctccctagtatatagaaaagatctgcgaattaacgtgagaacacaagtataacttctttacttaccagtgttgaccattttctggtgtggctttgataagtcatgacaaaattgtctaaatggtgagaatacagaagtgcagaaggaattggattctcttgattattacataatgaagtggtgatgatttaaaagagtaacaattacagattaccttagtcctgtgaaaattaggtcagatcaaaattaaatccaaatttgagatagacagtgttagtaatgtattatttctgtcttttgataatcagtttaagtagaacttgttttacgcgtggatatgtacagaaacctaaaaagagttgttttaaaaagaatgagaggctcaattgggatgttgaactttagttgagtcttcatcaggtcatccttattctagtattgctgttatgagacttgagagttccagaattgccagtgatgaactggctctattcttttgtttctgttaactcttcgtgataatgctgctatgacgtatttccttccttcatcgcatctcacttagtctgtcattagttcaacttgactcatcttgattttttttcttgaacaagctctcgaattggttcatcagattcttcatatttgagagaaatgcacatttggtaacttacaaaaaacatcaaagagccttgttatggtaatatagtgaattgctattctttgttgcgaggggatggagacagggtctggctctgttgcccaggctgtaatgcagtggtgcaatcttggctaactgcaacctctgcttcctgggctcaagctatcctcctacctcagcctcctgagtagcccagactgtgggtacatgccaccatgtctggctaatttttgtatcttttgtaaacatggggtctcactatgctgctcaggctggactccagctcctgagctcaagtgactgactgcctcagcctcccaaagtcctgggattacaggcatgagccactgtgcctggccgtgaattgctattcctaaataatctcttacctaaggtcagtctgtttttccttggtagttgtacttcagatttacttcaggaagagaatatttgtacagtgtacccctttcttgcaatggaaaagtcaagctactatgttatattttaaagcaataaatagatattgcagtatgatatccagagctgttattctggccatctcagttatgtagaacccacttaagaatcaggagatagccaaaatatctcagaacaagcaaaatagagttaatatggtgggattaatcatctttactaataggataacacccctaccctcatttggagtctgttcttcatttatgctcagttctagcaggcagcactgaggttgtcagggcaagaaatagttcaaggtaatactacagtatgcagagggaaaaggatccaagcaatagctatggagagaagcaggttggaaaatcatacatatcatagatctctatggagtgtgtgtttataaaacaggcagcttcactttgctttgaaagacaaaatgtataaatatgtttagaaagactgctgtcaattgggttaaaaattgatgtttaaagagtaaaccaaattacttagaaatcccactagttggccaggcacggtggctcactcctgtaatcccagcacttagggaggccaaggcgggcagatcacctgaggttgggagttcgagaccagcttgaccaacatgggaaaaccccgtctctactaaaaatacaaaattagctgggcatggtggcgcatgctggtaatcccagctactcgggaggctgaggcaggagaatcatttgaacccaggaggtggaggttgcggtgagccgacattacgccattgcactcgagcctgggcaacaagagcgaaactccgtctaaaaaaaaaaaaaagaaagaaatcccactagttaaatgaagaattgctgtaacttgcacaattccagccttctttttctcgtaaggttatgaatatattgatatccattagtgcttgtcatcataactttcagagttactcccgtagaattattcactgactctctcttctcacacattagctaaccacgcttatcacatcgccaggggaggggcaggtggcagagaaagtgtcacagagtaatgctcctcaccacttcagctcaccttccatgctgctctcagagggattatactgaagtcccataagcctgaccatgatgctcccccgccccattccctagctgtcaaacctgtcccctacccccaacaagagtctgtgagcagcttgagtgagatcagattcgttcttttatttttctctgtttcttcaacacctaacacagggcctgacatgtataaagtacttgctgaatgttggttgagtgattcattggattttaattccttcctttctttaggtgaatctttggaattgtgtctcctcttggacccttatggaaatagctgtcatgttagataacgttagagtcccatgcctgtgtgcctgcttaccacttgtctcattgccctcctcccgtactgttttggtcccaactgctgctctggagaaggtgccaggtgactggatgaatagtccttctcaaagcttctgtctctgagattgatgtgaaccccctatttacccttcttttgtgctgctcctctttaccccactcagcacgaagctgctgtcttccaggtggaatcacaggggccagaatgcgcaaatgagggaaatgaccaaccacacccttacccatatggctcagttccagctgtcaatgtataactcattctgcattcctttatacaacacagcttttcaagtgcctttgttccagccagcctctttccatctgtctctgagtcactctgtcagccttttctcccttccctttctgtgttaattctttgggtatgtatgtttctgcatagcttctcgcttgttttgtttttcctctctgacatccttctttctgtctttggtgatgcaaacacacgcttcgctcctagttttcacccaccagttcaagggtaatttatttctttttttcatttggcctctgggatctttctctgcctggatctttgaaaatgtcccaatcattcctctatccccacctgggctgtggtttatccagtgcctcttgaaaagcccctgtagagggtctttggcccatcttccctgtgtcctggggacccaacgatgcaacatgcaaactgcaaacattgagctttccttttattaccctccccttctcactttcatcttattcaccgtttcatcctgcatagattctcctcttaccatgcaagatcctacttcctcctaggactggtgtctcaagccttcatttcctcttgtgccagcattaacattcttacagtaatgcccattcacattctgagatggcagtcatgatgaatatgtcttccttaaagatttgctggattggcagaaagcacttttaccctcaacacacctgtggtattttgtgagactttcattctgcttggtaaaaacttctacccattaatctgaatattctgttgtgcttctaggttgtgtttttgcagatagtattgtggaacgacatagctttttcataaacgtataattctttaacctctagaagttacagaacgttaaaaatagtattgccatttctactagatgctctctgaggctcctttccatccagagtcatgcttttgtgattccagaaaaccccactcttctgcagtgttccttaccaatggcaagtgactgaatgctgtgtcttggagtttagcttacgacagtctgtctttaagccccatgcaagagggtttcatctccttaattgcaaaagaacttgtcacaagaaacttttaccaaattcccagggcctaggcccagtctgtcattgggtttagaatgtttttcgcaacaatacaacactacatttaaagactcttttggctggccgcggtggctcacacctgtaattccagcactttgggaggctgaggtgggcagatcacttgaggtcaggagttcgagaccagcctgggtaacatggtaaaaccctgtctctactgaaagtaaaaaaattatccaggcctggtggtgcatgcctataatttcagctacttgggaggctgaggcaggagaatcacttgaacccggtaggtggaggttgcagtgagccaaaatcgcaccattttactccagcctgggcaacagagcaagacactgtctcaaaaataaataaataaaaataaagactcttaagttttcaacacttacccatttcatcatgtctgaagttttctggctttcaaaattataaatgtatcattctgagttcagaatacctggtggtgtcagtggtatcaagcttaatgtcagtattttcagttagaagcttttccccccgccccgtgaaagcttttttttttttttttttaaagaaacagggtcttgccgtgttgcccacactggtctaaaactcctgacctcaagcgatcctgtcccagcctcccaaagtgctaggattacaggtgtgagccactgcacctgtccctacatttttttcttaactatttttatttagttttaataaatacataaaaggtttaataagtaggatatttccagtttctggcaaatttttactttcattcaagatgtttttatagctgtattgatctttatgttcagtatcttgacaagtcgctaataataaacttgtcgagctggtttttaaaaggtaaatagaaaaatgaaggtaggtgttgaaaatgttttgctctttcccttgtagagttacagaaaagccatcctttaagctgtgtacttttcataatctcaaactctgaggtcttcaacagcatggaaatagtcttgcagcaacagttacaggtcatataatgctcaaattgctcttttgagtgagcctgtgccagaggataatcactaaccatggttgattaaatttagttcctcctgtgcttttttagaggctctttacccaagtgtttgattcttcccggctataggaacctagtgtcatgcattttcagtccttattatatttgtcacacaatggcaagaaaatgattgaaaaatcaatatgataaaaatgtcttctcatttaggaaaagtcctgaaaatattagtcattcagagcaactcaaggaaaaagagaagcaaggatttttcaggtcaatgaaaaagaaaaagaagaaatctcaaacagtaagtagatgaccagtttctatatataataacatgtttctgcattattcaatggatactttacactttgcacttggcaatcaaagttgattgttttcttattgagacttgacatttttgcactgtattatgtctctttctgaaattctttacaactatcctctcaacagagccttttctacattcaacagaatctccaggaatagaagaaatttaatttggatgacagagaacactttaagcctttctcaatatacttcttatctatgtgggcttatattaatgtaaaaactttgaagacacaggatttgtttctctctggggatttaaagatatgcataaacttaggaaatgggttttggtttacttttaaatgttgaaatttgtaaataaccatcattccttattctctcctggctggttacagaattcctacgttgccaggtgtgtttctgagttatatagtcacaaagatcgtatctgggattttagggcttgcgttagaaggaaaatatgtttgccttttgatcgcgctgtgggttggaatgcaccttatctcctgggagccctttgcctgaacaaagagctggctccatgggaccgttcacatcacttcactgaaccacccaagcaaggatcctgctggtttagtgacatgagaaccttggggaaacccggcctgtaggacagcagcaggagtagttcttcccctagatgaggctgcatcccccttttctttatgacaacttcaaggctaaacaaggtagagttagccgtttttatttatttatttattttagagacagggtctcaccctgttgcccaggctggagtgcagtggcatgatctcagctccctgcaacctctacctcctgggctcaagtgatctcccacctcagcctcccaaataactgggtgcacgccatcacacccagctaattttttgtatttcttgtagagacagggtttcaccatgttgcccaggctggtctcgaactcctgagctcaagcaatctgcccacttaggcctcccaaagtgctaggcatgagccactgtgcctggcctagttagccattttgaatggttttggttctagttttacttcatacgtaatttattcttatttatttgaagaggaaaaagacacaatcaaaatggcctgttcagatggacttcactgatttcatctataagtttagtagattagacccagtgtttctgaggccctttctattatgaaaattatagaattatgactcaatgggaagtagattaggtagatgttcatagcaatgtgtataaataacctgaagtaagcatttttatctcacagatgttctagaaatgttaacaaataccttcctagataatctttctagatcattctttcacttgcttgcttgttaaatttatgtatttccttataaaataaatatgagttcattatagaaaatttgagaaaaagaaaaagatcgttttaaatcttaataccctaccacaactagtattaggattttggtatattttcctccagctgtttagcctatgcatatgtttgtggcaagaaggtggggtttttttttgtttgtttgttttttaagttttaaattagagcaatccttttagtacgattttgtattctggcttttaacagtttatctatctatatctacatgcacagaatatgtatgttactacaaatactttattatcttcaatcctaatggctgcataatatttctgaagtagtcattaaaaaaactgcccatatttttaactgaagcttacttttaaagtgtcaaatcaaaatgccactcagtcagatactactataattgttacttaaactgggtgaacaaatagacctgatttaacataggaatacttaaaatgtttaaagtgttaataaaacttttatcattgtctgtagaacatgtttctctatcatgagcgttaaactttggctacctcctgaccactgttatttttattttgtggtttttgttctaaaccacaggtctcctggcattgtggggtgattaagtggtagaaagtaggaaagattaaggaattgaaggtgtttttgtatatagatttagattttgatgtttactgtagagcaacattaaacctaaagtccctggctcactgtggcacaagtagagtatacatgttggctgactttattattcagaatttagttaaattttagatattttagtaatatagattagagtaaaaaggaaaataaccattctctaacatcctctcgacttaaactttttattaggttttcataagtttcctttttgatattaaagtaactgtagaatatctctgcataggccataatgccttaagctttaccaacccaaaagttgtttgtatctctgcatcttttaattaaatgaaacataaaatttaagggctttgggatttccaaagagcgctcagtacagccttccaaacctcagagtcctacgcctgacattgggttaactctgcctactttgaatgagcatttaaactgttaatagtttttcactttctagaactcagcaaaaagaaactacatagaataagcttcaaaagatttaaggcattgtggcctttgcataagattccaaaagaatgaaaatctgatgcccagtgtacatagagacgcatgacatgttaaagctgaggtggatcctaaatctagttgaatttttttattcactggtataggaactgagcccaagcaagttgtgggcttgcttcaaagcccaaaaatcacataatcaactgggagaaccagaactgcgttctcctaaataccaagtccaggctcaattcataccatggacccgcctctgtggggagcctctaggagctctcctctggcctcttcagcgatgcaagttaaactcttcctcgaggttcctgtcattggaacaagaaaatttgtgggatgttttactcaaatccctttttacatatacccttaaaagattacctaaatacttgaataccttcatagacattctagttctctgacaattgagatatccaaaacagggaaaagtggtgacaaaaaaaaataattctgtattgtaaaggtgcctgcttcgactcaagcaaatctggaagctgccttgggaaatctggctttggttacatatccagagttacataagtcctcagagcatatggtgactttgccaacttggtaattgtatcctagttagttagtatctcaacttgtgatgatgcttccatttaaatattgaaatttctgtttcttctctttgaaaaccagtatctgaattgtgctagatgttttccattgggtaaatatttctagcagtacagaacaaggcctcttactcaacattagtatcccaccacagtgatcaatacctcttcctagtgatgttttcaggcttaaaagttgaccaaattcgaaagggtttccagtatgttgggattttttttctcctaataggcaaattacatggtagattttttacttgctgaagtcctctctagcaattaggagaagattgaagtttatcagtagctctttaacacagttctttataaccatatttctgatagtaagtaaaaattatttaacgttttataagcttaatgtgagtaggtgtgtctaggtctcttggcattcctactagaggtattgatcatgatctcacattatatacttagaagaagtttgtgcttgtcttgaatttgcattattgacatcttcacatccaggtgagaattggcacagaagctctagatgcacagcaccgagattctttcagtgactgttaatatttagcaatttgagggcttccaagggctagtagtttcaataagagcacttttttttttttttgcaattagtttatttgtatcttatattgcagacagattccaccaacggggagaatccaagcatcaagaaatccctctttcctctttttaattcaaagaatcatttaaagcatagttcttctttgaaaaagcttcctgtagtcactccacccatggtacccgtttttatgtatggtagccctgaaaactgctccagtaaacttgttttactgatgacaacagcatgtcttattttcatgaggtcatattctctttatgctagttaagtacgtgagccagttccataaattcactgggatataaattcattgccattcttctgaatcagttaagaaagttgaagcacaaagtctattaagcaaacaaactagtgaaaggctagtttgtcatgtctgattagccagttatgggcagataacatttataaaagcctgtattttatgtaaggaattctgttaacatttacagttaacaaatatctttgcatttgactcacagagtttgttaacacttgattggcaatttgtctttttgaagccaagttgaattgaccaaattgaatgagctaacaggctccatgaaaaaacagcttgtttccttgtctggcttgagcttttgctggtcagtttaaaaccagggcttttgcttggcatttgacattactcttctgtgttcaccaaaactggtgaatagagcaattgcattcatctggaatttgtggcacagatttccagcatttctctagtacataatgatagatccagatatatcagacagtggtttgggaatatgatccaaaccatactttctcactttgctatccttgaaagcctaccagacttctttggcactaccatatacagtgtttggatcattttcccagcaggaaaaaatttctgttttattgaactggttcacaacctaactgcaatatggaatgaggatacgacagcaattcctggtacagccctatttaactgctctctcttacagcgactaaaactaacagcatgggaatgctttaagggttgaggtttaacaaagctgcatgacatctgccaatttttcctaatgcagggaaaattattaagagggcagaagaatttaactagcatcacttgcattgtgaacattgggagagattggggttctatttttactgggttatttgagttttggtttggtttgctttttagtttggttctcctcttgggtgtggttgcatatcttaattaggcttctcagtgtgcttattgaatgcttgtccatattttgctctaggtacccaattccgacagccctgatcttctgacgttgcagaaatccattcattctgctagcactccaagcagcagaccaaaggagtggcgccccgagaagatctcagatctgcagacccaagtgagtggatcctgcaccactgctagactctccaactctccagtaactgtcctgaggagcggggagggcatgctagagaaaacttagcctctcaatgttacagtaaggctgagcacctcctcaaaatagaccctcagttatagccagatgcatctcgtgagccaggatgaatcttgcttcagtgacccatgttctactgggaaagatgcaagcttctgttagccttcacctagctggaggcaactgaagatgtagtcccagcccataaatacagcccaggaaagagctgagctgtgttaaagaaccataattcatggtaaaaaatgaggcatgccataacatttcaggcaggatgaacacagatggtgggaagattaaggtttcattaaaaataatagcatacaaattgaaagacaggtatgataagttttcttgaaagaatatttcaactcctgaaatccatactgtttttgacaggaaacaggcaaacagttgcattaggaactacatattagactgtattatatagtcacatttatcttccgtaatggaggaataagcagaaactgaatcagtaaatttttcaggtatctgaggtttatctcctttaaacaactattttggttggaaattttgtaatgtatcttttcagtatcccataatgagcattttgttttttgatattgagtattttataaatcctttattcttctgcactataatttctgacaatcctcccgagcttttgaggctataggattacttgtgtctgtgatttcttgtgtcacagatttctgtgattgggagagcggactactgtttttttttttttttttgagacagggcctcaatcccattgcccaggctagggtgcaatggcacaaactcggttcactgcatccttaacctccctgtgctcaggcaatcctcccacctcagcctcccaagtagctgtgactataggtgtgcaccaccacacctggctaatttttcgaatttttggtagagacggggttttgccatgttgcccaggctggtctcgaactcctgggctcaagcaagccacctgcctctgcctcccaaagtgctgggattacagggatgagccaccatgcccagcctctgtttactctttttaactgtaagctgttgcatagaactgctggcagaagttccccatattcccattctatttgccccagccatttatattttctgcttctaacataatataagctggggatggtggaagcatagagaaccagatatccaagtttattggatatgtatgcaaactaaagagacaagcctctgagtgagggcctgcttctctattcccaatttcaaaacaaaacaaaaagaatagagagctttagaactttctttgtgaaaccatttcttttaccaagaagccctctctctctctctctctctctctctctctctctctctctctctctctctctctctctctctcccccctctctccccccccctccccccccttctctctttctttctggcagggtcttactcaatcactcaggctggagtgcagtggcaagattatggctcactgcagccttgacctcctgggctcaagccattctcccatctcagcctccagagtaactggaactacaggcacacgccaccatacatggccagttttttaatttttttatagagacggggtctcgccttgttgcccaggctagaagctcttttcaaataactttatagctcttgctgaatgcagcttattgtaattgcttgatagttacatgtggtcaaggctataaaaatcaccaggagtctcatcgtgttataccaatttaattatttttaaaaagccacttttgagcacttagagtgtacagtgtgctctgctacttcctgtagggagcacaaagctttcttgggaagactttgaaatgatgatggagaatactttcccctgaaacaatatctacttgagtcagttctgaagccatttaccttgggtttcagtgcctagttccttcaaatcttgtaatgttccttgagttcgtcaacattttattcaaactttactgagcccttaaatgcatgtcccttataccatgacatttacagcaaaggtactctgagaattggccccagaggggtcccaaggctagggttgtagcccaagtggccaaatccagcagtcatgattggctgtgaatttccaagtgctttccatgtctcttccgagatcgaggaagaggagattgagccatctttcatcgttcaggagcatgaggctcaggaattgtccagtgagcagacggctctgaggctcctcccctctgccctgaagtcagtctccctccttgatgcagcacctggggatgtctagctgcacagtagacagacaggcagggcggaccactgtgagcccatgttaggaattgaaggcctcctgtgaattaattctttagatagttctgatggggttttgcatatttctttgtgctttgcattttcaatgcccaaatgttaccctccccctttcaaaaaaaaagcaaaaaaaaaaaaaaaaaagtgcagcaagggaacatttgaattttgcaatatcgagagagggaaattggggagataagaacgaaaagggctatacgacttgtagttgagtacattgctaactaaaacattccatattttcagcttctcttgctgctagatatggctgtgtacctaagttctagctggtaaaatataagtggaagcattttgtggagcctttgggaagtcttctcaaaacagagaaacatacaccttttgctttctccttcctgctggttgaagcatgagatcccctgattagagataggatgcaaccaggtagatgagcctgggcctttgattggctgccgtaccagctctatatgtcttatctagatttctaggcttttccattaaataataatacagtcttgtttgaaaaaacccgaagaacagatatggctggaccggctcctccttgcacatgcttgcccttcctggccacacccagtcacctcacctctaagcccccttccctccccagccttatggtcgctctaacttgaatcctgtgtgcattctcatcctttctttcagagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccaggtcagatggatcctggttggcatgtgtcctctgtgaccaggagtgccacagagggcccttcctactctgaacagctgggtgccaaaagtgggccaaatgggcacccctataacagaacaaatcgctcacgaatgccaaatctgaatgatttaaaagagacagccttgtaatttgtgctggtaggggggaggggtggacagacaagccagtggggaggggtgggaaagggtgggctgggcttggggcatgggccgggccaagtggtgagccaatattttcagctttatgaaggtgtgtgcaatattgcatgtgttggggccgttgagctcctcgcggccacaaatgctagtcagggatcttagagccacaggagttccttagggatcgccactccccacaggtcttgtgtgagaatagatagagtgtgccattgaggaagaagaaattcttgccagtttctcccctttacattccagctttagtgcaatctctgttgaacttgggaatgccaggatgtgtcctggcactgcaagggataggaaagtcgtgttgaccgatgcccttactacatatttttttctgcctagagtaaatgtggggtttattgtaatccaagagtatccctttgaagggttagcagatgaactgtatgtcttaaattgttttctaaacttccatatttgataggatttgtaacatttatttataattaatattgtactgttaaaatcatatcttttatgttataatgtaaagttattttgagctgtttgaaacattgtgaagcagtgggacagctacagtagtttctataaaaactaaacagtaacatttatatattgcatcaggagtattttattctatatataatatatatatatggtaaatatctgttttataaatatattcatttaaagaaagtatcgttatgacactatctgccatatttttatacatttgtgatatgaagtgagtattatacttctactaaagggagttgaattgtggctacacgtgactgtaacagtatgaaccttgctcaactttgaggccccagcagtagcctctagacatgatccttggtagcagacgagatgcagcatctctttccaaacctgcaggggaagaaagtcagataggccagtgagaattccagcaggcctggtttccgtcctcacacacttggctcctgtttgtgtccagggacgttacttgcacacaggggagaatagattgaggcgttactcgtgggtctttgtagagagaatgtgctcttccacttagcattagtgtagagcgtagaccaaagatttgccagtgaacattccttgttgtgagatcataagaggtacctgtctgcagatcttgcaaaccatctctatgctcctgaatattgtccactgtcccggagactcttggctgatggggtgtgagatatatgtgtggcatttctatttctgaatgccttttttgctattgctctctccaataccatatttaaaaggctcctggagcaattccagatagataaaaaattactctatccatttttttcttcctggggctgtccacttatgacaagattttcatgcacacctgttacgcacacaacccccatcagaacaggacctatcttcccctcatctgatctctttcagctcccaagttactcccaagtatcatcaaaccctttggccatcaagtgttatcctcccatgcctctgggtcatccttgagggaagtcacctcagcaccatcatctatcagtagtagtagatttttggaattagtctctgagcaataatacttttaaaggtccctcccacccctcaaagagataacttctcagtatttattacttgtcctcaaattctgagtgtcagcccctgcatcaagtcagctatgatcaaaatgtgctgttactgttaaccctcccccgagattttgagaatcatagctctgatgattatgaagattataaagactaaggtcctagtttccctgaagcttaaattgtgcacatattgcatttttatataaatactataatgtgtattgattatatagataggtcattttaaggtgctttttatttaattttaatgagtgtaataggcactaaaatgaaactcgactgggtactattactgaaaaaatttgactcaaaccaatagttttgcatgctctttagttctttttctgtcttacttctttcaccagttcagtactgtttgggtagctctgaattctggcttttccaggcagctgcttgatgatacaaatgaggtggaccatcagcagttttgcctggacactaatgactctaaaagggtgtgtatttaactcttctttttcatactagatctctaccttgtattccccccttgcaaaccagaaactacactttttttctctggaaagacttctcactgtgctatgcgcttaggaactgcacggtcccgttgccatgctgtggcattcgaggctcgtcacctaggggctggtttcccatgttgtcatccttgctaacactgggatctcagatgtttgcagaacatttctattcatgacggttcttcaaagaagggctagaatatttgccttctacctagagcaaagtaaacctaattgttgaagagtcaatacgtactttttgtactttcccagatttgagccagaaaatacctacagatatctacaaatgttttcaaccagtgttttcgaggtagctctttaatcctcttctcagcttttgtctgttctgacttttcatccaataagctgtaagtgaactacaatctgcatttccagcatgcaattctcttcctgctcacggagggggatgcaaaagttttctctcacacctaatgggccctctcttagcttttaactgttgttttcccctgttgatgaaaaattactgacatcacaaagattgccatccatggtagaaaggacttgatttaaagtcagaaaaatttgccttttctttaggaaggggaattcatgacatccatgtcctattatcggccgtaacttcctaaagaagaaaaagggtgaatgaaagcttatgttacttttatgaaagtatcactgatctcctttggaaaagaaactctgcttcactgtttttctacctttatttctctgccatcctcgtttttcctctctgaagttctaaataccctttaactgaaccttgttggtcttgctctaaaatttagcctctttctagagcccaagaccaaaagggagtgcttcatgctgaggggctcaagtgagctgactctacaactgtggttctcaactaggggcagatttacccccaagggtacatttggcaatgtctggggacatttggttgtcatagctgggggggaggtgatggtatgctactggcatcaagtggttagaggccacagatgctactaaacaccctgccatgcacaggacagccccccaaacaaacagtggtccagccccaagcactactagtgctgaggttgagaaaccctgccctacaccatcccaagcccaccagtctgcagagcttggctctggccttgttctgtccaggctacagtactgcaggtgtgatttcttcaacatcacattctcttaagagtcttcaaccactatgcctgaatccttggaatcctattgttcgtttccattgtcttgggcctgctaaaaggtgcatactttggaaggagaccagagttactttataggtgttggagaacttaaattctaggttagcatccttagaaaatctttcatagagccatgaggcttatatttagaagcaagcaacagcctggcagattggcatgatttttaccaactgctcaaaggcatccgtggctttcagctgtgtctcccgaaagaaaatgtctttgttttttattcaagtcatttaatagctctttacaaatattagcatatggcagaccaattagaagcaaaaaagtccgtattggtggttgtgatgtggctgttatagaagtatttgtgctgtatgctttggttaaatctgttttaaaacatgctttaagattcaccttacgcagttgtactttaattctaagctcagagctatgctgtcagtctctagtcacgccatgtattataaagtatgttgtggttgtagagttagccagtttagcatgttcctaatctgagaattagtggactatactaggaaatgctatcccattttccctttccagcccctcttagttaagatcatagtatcctcacttcttaaactagtctttagagtaaataaggaaaaaagccatttattttcttctagccatgtattattgagaatgactcatagtacaactttttttcaaaggccagaggattactttgcaagtgtgtagaaagatctgtctatttctgttcacctgggacctggtggtgactgaactctttcagcaagggcaatggctcaatgtgattcggtgctggagctcagctgggactcagtaaatctgcacgttctctgctggtcagaacatgtttcctggagagcattgcttttctatctagaagttcgttacctcctgcatgatagtgggatattgagatgtgggttctaagatccacagactcatacttttgtgaactttggaatgtggtagggtacactgaaccaagtcagaaaatagtgaaatatttccttgcctccttcagttcatcactaagaaagtgtgtaggcagagaaaacttacttatggtttgaagaaccacaattgtttttgaaaggggacatagaaaagacagtacaaaggttgtaagtgtcctgtcgctaattcccagggccagaatctcacaagaagatcctctcaaagacttaaaagcctggcttacaaaaataaccagaaaccaaacttgtaagcagttacaatttcttccttttgcttcttgaccagctgagatacagaatatcttgaggtctggttcagctgatgaaaaattctgtctcagaaacgatgagtaagaaaccatacaagaaaaagaagtccctcatctatctgcatacacgcaatgtgggagaagtggggtggctaggaaactctgggcctgctgcccccttcgattctttttttttttctttgtgaattgaatgtacgatacaaatggtaggccttcatgtgagccagttactacatgaatcttcatttcccacagtggtttgttcattcatcagcgttaggcttggtcctggctccacctttctcctctccgggcactgaccccacctttccgtgtatttactgtaggctattaaatatgatcatgacccgccttgcattttcattcatcacctgtttatgcccaaatttaaaggaagtttgtctcattttgccagaaaaaaattgtaatagtcggcacgctggatttgtagggccagcaaaattgcggcagtgaaactagtttcacttctaaagcccttcatttcccacaaggttaagctctcgaaaccccatttgatccttggttcctatttcgatcctcctttggaatctgaaaatcggtctccatgttgtatgcagattagaagttgccttgtttgttactcttccaacacagggtatcagggagaaagaggccttatctgttcctccatcccccctgttttgacagactgctaagaattcctcaggacttcctttggttggggattttactttcccaaaagtctgatctgatttctttcaggggtagacaagcttgtcctagtgctctgcttcaggtcttatcagaagaaacccaggaatagaaaaggtagatgccttgacttttgtccctgttgtggggactaaagtgttttttgccagaattgtcaaaagctccggttcaaactctgtagagtttcatggaaaaacaaaacaaaacaaaaaagatgcttatcgtcccggagaatgtgtaagtaagttctccagcacggcttaggttttccaaaatggaaagcaaagcttgcagacaacctgttttctctagagacacacaatgattctggccctcagtctgtttccctccccttgtttactctttggtcaccgatcgagtcaggctagaggggtaatacggtgattaaaagaagtaaattctcactgtaaacttggattgattaacagaaacaattaaaccaaacaaaatcattgccccaaatttctatctccaagaattgctttgtgccattttgaattcaggtagttattctgtatatacttagctaactattcagagcttcttcaatctctagtaagcttgaaggtggtgtctgggaagacacagggcagggtgacatttagactctgttcattcttaaaaatagggataagccagaatgatgtgacatctagtatgtggtagatgaagaatcagtggaaattcttaattgcacagactttataatccattatataaagtgtaattccatactttttactgtggcaagggtgtgatgtgattgttaatctttttaatttttgaatccaaactgaatttaaagtgttgaatacttaaatcctcacaagtgaattatgaaccatttgtaaagtgtttctataactctttgtatcatgtgttggtacatcttatcaagttttttctggcatgtaattccattctaaacttatgtaaaatttctattgttgctgtaaatattacacaaatatctattccgtgataaccttcattatcagcatgaaatggttaatttttactgagcacaatgtatttttgaatggatcttcccaaatgtctttaataaaatgcagattttgcactgactgatgtgactgccaggccgtcccaatcttgagcactgtggtccttcgtgtttgaactgcgaacagctccattttagttccttcttgggaagaaagaatgcattcgaattcaaatgagggatgatgggcctttgaggttgtaatcagtttgagacagaaattaatgtaaaactaggcaaatcctgtaacttaatgatgttgatctttgttttcctatttataaagcttttttccccttacggcattttgaaaactttggtttgttttatacttgagtgttgtcacctttgcacgtcgctagacactcacgtggtagtttgaggaggatgggaagagaggccaatcttgtgctaagtgctatggagaaagcaaagatgcacagcttaataagggttttttgattctagaggagaggtgggcaagcttttcctgtaaagggccagatggtaaatattgggggctctgtggcccatcagttccctgtcaacattactcagctctgcctttgtattgcagaggctgcatggataatatgtaaatcagtaagtgtggctgtggtcccgtaaaactttacttatagaaacaggccatagtttactaacccgttttaggccctcagtttcatcatttagggtaacaccaaccgagtacatgttcaatcaggagggaaagaacttagcttttgtgataacttatagatgaaatattccccagttttctttctctttctaaacaaagggtaggagctgaaagtcagtgctctccattcttaaaagtcctctgtcaaccacctcttcactctatctccttaagtgacatggaaacttgtggcctgtgctttcaactataatcttaccaagactgaatgaaagtatttggtgcttatactttttaatgttcatagcacttactatggccaggcacaatgcccaagtgttttgctttattattattattattattattattattattattattattattattttcacaacaacccagcgaaacaggtactattattatcccctttttgtaaatgaggaaacagatttccatacttgacattaacctgcccaaggtcacccagtttggaagtggcagggccaggatttgaagccgaatatgttcattgtaaagcccatatacccttaaaagtcactgcacgtccacgtatggtaatgtggtcacaatcagtattgtttctctttagtaattcagatttattcaagtaactccaaggttcaaattttcaaaaacagtttccaacacaggttatattaaaaactttgcctgaagtttactctaggtgcagaaataaagacaacttagtcaagtgaaggaaagggtaacagacttagaaatggctatctacactgatggaataagtatactaattagagcaggtaacaagtccccacgatgtataacatattcttctctaaaagctcacaacaatttatgtgccaccttccatcccctttcccagcagatggtaattgatgcaatttgagaatagaacacttcattgaaacaagtcactggaggtcctctggggatgcagcttaaaagcccaggatcaggccaggtgtggtggctcacgcctgtaatcccagcactgtgggagactgagacgggcagatcacctgaagtcaggagttcgagaccagcctggccaatatagagaaaccccgtctgtactaaaaatacaaaaattaggtctgggcggtggctcacgcccgtaatcctagcactttgggaggccaaggtgggtggatcacgaggtcaggagttcgagaccagcctggccaacatggtgaaaccccgtctctactaaaaatacaaaaattgggtgtggtggtacatgcctgtaatcccagctgcttaggaggctgaggcaggagaatcacttgaacccaaaaggcagaggttgcagtgagccgagatcacgccactgcactccagcctggcaacagagcgagactctgtctcaaaaaaaaaaaaaaaaaaatacaaaaattagccgggaatggtggtgaatgtctataatcccagccactcgggaggctgaggcaggagaatcacttgaacccaaaaggcagaggttgcagtgagccaagatcgcaccactgcactcccacctggacgacagagcgagacgccatctcaaaaataaataaataaataaatccctaggatatagagtccgcttgcctgggtggagtcttggctccatctcctacatctcatgtgacttgaagcaaggcacttcactatgcctcagtttccttatctttaaatggaggtaatcacagtacctacctcagtgttgttgtgaagatttaatgagataataacctgcagagcacttgagagtctcaagaaatatgagctcttataacattattgctattgtaaaacattgctattacttctgtcccaatttggcagtttcaggaaattgagaaggaatgtcactgaatctttaatgccagttacacagagctcagtaggtgtccgcacagccctttagatgcacgtagcctatttgatcttcgtatcagccctgtaaggttgggcttaagaatgacccagcatggaagtactcttgggaccacaggggaagcaacagtccttgtaagctgtttgtcagtgggccttagcaaccaagccccaagtggacagaaagatggggttctgtgagcatccattccaagggtcactttaggggtgcaatcttctgggctctgagaatggattcacagcagcatctctatctggaaatacctttgctttgtccaagtaacctcctcccacacagagtacccgaatcagctcagattttttttccttaatattggcaacacttaatgctacttctttgttcgtaacatttcatttaattatttaaaaatctgcaaatgttgtgtatattttaccgcaatttttaaacaaactccagtgtagaccgtgctctagcatttctaaaaataaaagtaaatatgttaaaataaggtaagagtgagtttttcctacactatgtataatttttaattgaaagtttcccccacaaaagaaatgatacttggaagcatagtttgtgtgtttgacagcaagattctattaggcttcagatttccctcaataaaagttttagtttttatacattctgtcatgaattgaatgaagtaaataatatgctgttgtaagcaaattatctgcagataaatgtcttatgaatcgtatatcttactgtttattaaattctgaagtattgagcagtttccaatgtgaaatcccagctggcttctttgcaatgatggacaagttagttataattcatatggaaattcaaggaacccagaatagccaaaacaatcccgaagagcaaagttggaggactcacatgccccaatttcaaaacttactacaaagctacaataatgaagaaagtgaggtaatagaatttggagtccagaaataaaccctctcacatttatggtcaattgttttttgacaagggtgccaagatcattcaatgggggaaagaatagtcttttcagcaaatagtggtgggacaactggatatccacatgcaaaagaatgacgttggactcctatttcacaccatatacaaaaattaactcaaaatggaacaaagatctaactgtaagaggtagaactataaaactcatagaagaaaacataggggtaaatcttcatgaccttggatttggcagtggtttctcagatatgacaccaaaggcacaagcaaagagaaaaataaattggacttcatcaaatatttaaaattttgtgcttaagaggactctatcgagagggttaaaaagatccacagaatgggagaaaatatttgcaaatcatatccaataagggaattagaatatacaaagaattcttaaactcagtaagttgtaagccgatttaaaatgggcagaggatctgaaaaacctttatccaaagatgtacaaatggccagtaaacacatgaaaagatgctcaacatcattagtcactagggaaatgcaaatcaaaaccacagttgagatgcaacttcacacattatgggtatagtcaaagatggacagtaacaagtgttgctgaggatgtggagaaagtggaagcctcctacattgctggtggaaatgtaaaatgatgcagccacttgggataatagttcctccaaagattaaacaagagtgactgtgtgtcccagcagttttactcctaagtatatacccaagataaatgaaaacacacatccgcacaaaaacttatacacaaatgttcatagcagcattattcataatagctaaagagtggaaacccaaatatccatcaatggatgaatggataaataacaatgtgctcttgacatgatactgaacaatgatgttcagcaataaaaaggagtgacaagtgacatagtgatacacatgttataacgtggatgaactttaaaacactatgctaagtgaaagaagccagtcacgaaataccacatactatatgatttcatttatgtagaacgtccagaaggccaatctacagagacagtcgattcgtggttgcagagggcttggggtggccgatgggttggggagtgttggctgatgggtgcaggatttctctttggggtgataaactttctaaaattgatctagtgataatggttgcacaactctgaatataccaaaagtcatcaaattgtacactttaaatggatacaaattgtatgtgaacttaatctcaataaagccgtgacaaaagtttccaacatgaactcttatttggaaagcctttctccctgcctcactgtttcctcctctcctttttccctgaactgcactctctcgactcctgtgtttgatgtgccttaactcttaggatactgccattttgtctgacagtccatgtcgtgaccaaagttaattcacctttccaaataagggtctctgttcaggcatttctatccaaaatagatttgtcctgtgtcctaaggccagggataagtccccccaccccccccccccacccccaacaccctgtgtgatgtgtttatatttgagagaagattgggcggggaaaagcattttccgaagttcaagcatacagcatagggactagaaagatgctgggttggatataaaataattgagcccccaaagcatcaagaaggatgtttggggcttttagaaggctgcctgttcacagaaaaggtgaatgtgttgtccagcactgtattagcgcgagtctagtcacttgccttggcatttgaaaatgaaaagtaactcggaaatgagctgctagcaaagactaccctgtgtctggggccagaacagtctttagagcagcctcgtcctctgattccaccacctgctctccatatccctctcctgcccctcccccgtgttaacagcctctcccaggaaggggcctggaaactcaggctgcgctctaagtggccaatgaggcctcccaatctaaggcgccgcctccaggaacggaaagccaggcccattccttcccagagagcttttcaggagcaggcgcagtttgcgtattgcaaggcagagggtggagggtgagaagctttcagggaaaaagctacatggtcctttttatgatgtgagtccttcccacttcctgcgaagcatgtagccagctaatgagcctcctctgagtagccagtggtagctcctgggccagctgttctcgaactatgtttggtttgctaggaaatggtagccctaggtaaagggcaattgtactgtgttgtggtcatttggggtccctacatatactgagatgtgcagcctgtcctgtatgatcacctaaatggtgaccacagacacggggaatttgctggaatggattgcataatggagctgtgtgtattgggcgctctggtccctccccaatccctgtgttcatgagggtggaagcccagatccgccttgaaggtaagaactgtgagcagaggaaactcccctaccttgggcttttggtcatttgtcacgtatagcctctcagggcaccgggattctcacccaccgcactcatccctgccacccagtcacccttgagaccctcagctgcctccccagggctctgaagtcctctttggcgatgatttagtggaaacttaactaggaggagctgctcccttctgcattcaaagccaggctttaggaaactgtatgtttctgtcttgaatgtggtaaagcaaatgaattttcaaattatcagggctgctttgtgttcccctgagactgcacctttcacagtatcactgagacaaaaaatgagcagaaaattacccctgctacttaggcttttgtaagaaaattcgtttcggggacattttctttgttctgactttctctggccctgagtggggaataagttcatttttatttcattgaaatcagaaagctatatcttaaaaaaaaaaaaattatctacccagcactgcagttacaattgctttgcgaaatatagccctgtccatctcggtggtgtgtgagggggtcccctacggcccgctctgtgccagtcaccccctggcaggcgccgagctgaggcaggcatcaggcacacttgctgacgcactccagcagctccatccggatggcaatgcggacgtgccagcccagcgggatgaggcggatgaagcgggagatgatggggggccgcagcaggttctgaaccgtggaggtgcggtccgagttgccatagaagacctagagagatagaggaaatcctgtcaccatcacatcggggagggaaaaggaagaagggttcctttctggagctagccccaacttttaactatagaaatgattaggaagtagttaaagcagtttgcgggtgccccccaaaatctgaccttgagtgattgtcatcacacctacatgcttgggacatctggaactgcaccatccaatagggtggccactagccaatatgtctgtttacacttcaattaattaaaattagataaaaattcagttcctcagtcacatgagccacatttcaagtggccgccatattggacagtgcagatgtgaacatttccatcacagaaagttctattggagggtgctgctagaaaatgccacttgactcatcgcttttgagtttttatcctttgcattttgacattttgaaaaggcccacatcacacttacatgttccaaaggtatccaaagtagggctcaagtgaaaacccgtgcttggctcaggagttgtaagccaaaacttaaatgtgtattcctactttgatacaagtgatgagtacctttccaacttggaaaatgtttttttaaaaagacataaaaacttggccaggcgcagtggctcacgcctgtaatcccagcactttgggaggcggaggcgggcggatcgtttgaggtcaggagtttgagaccagcctggccaacacacagtgagaccccgtctctactaaaaatacaaaaaaattagccaggcgcagtggcaggtgcctgtaaatcccagctactctggaggcggaggcaggagaattacttgaacccgggaggcggaggttacagtgagctgagatcacaccgttgcactccagcctgggcaacagagtgagactccatctcaaaacaaaacaaaaagacataaaaactcgaaggaagattctggaaaggggagggtggtgccagagtaaagagaaagggggtttgcttagtgtttttaaggatgtaacataaaaacatgctgtgggtgtttgacgccatttccaaagaaatcattctttgccctcttaccaaagtcatggtgctctgcctgatgccactaggacatttcatctccttctgggattatctcctgaaaatatctggctgttgcatttggccccatccatccacaaaacgggaagggcctggtctgccatgttcttgcctttctccgcagtggcaccgccccacaccaccctctctattgcagtttgtctttgagcctattcaagtcaggagccaggtgaagagaggggagggtggaacaggctccaccagattgcacaagtgcaggggtgaagtgcctctttgcaaagaaccttcaaggccttcagaagcacagggcttgaaaaacttctcatgtcttttgaagaggccagctaataagaataaaaatgaaattaaatgtccaagtatcaagatggtttttcctcttgtgttcaaactccttggaacaacccatgaacgtcttggccgtacaaattgtcatcagagacttacaaagccttctgaatctcagctgtacatgtctacttaacctgattaaatgttgaaattagcctggggaactccttactcttaggcaaaaggatgtttaccatttccaaagagctagggagtttttaattcatttttattcatagcaaatatatatatatatatatagtcaggagtctactgcgtttagtcaatggtgaagaagacttctgtctcaatccacaaagattaataggatgtagagttgcccaaaggtttaagttcgtctgtgtttgtgctggtgaagtccttttaaccatttggctaatgggtaacttgctaggttctcaaaaggctcccctctgtcagtctcaaacaataggagaggccacatctatataaatggatgattctctacccacatcaataacatcagaccatacccgtgaagcaaagtgcattcaatgatccagtgagttgaaatagtccaaatggtcagtcttaagagttcaggcaactgcatgctgatatggaaactcagacaaattttttttttgagcttaagaatagcattcatttgcaaacaaactgtgctgggcaccaaagcaagcccaggaaagagagcacagcacattgtgggggaaagcgcagatgatccactgtgctgtggagtcggtgctctgacagagggcagtgacaggagctcggggacaggaggggaagtcccagagggtgcgagctgaagttggtttgggataagcccaacttacccggttgtttccagtctggtccttgtagtaaatccagttcaggcgctcatcggtcctgtactgcacgctgtacttggtcatccactcatcgatgtcacagcgcccctgggtgaggatccctgaaatcactttgatctccttcagatctatctgtaaccactggctactgtcctggaacttggagagccaggcacacctgccgagaacataccgagtcaccgagagactccccctgtgcatgtctgcaaaaagcccgcaggtgctggctctcgaggggatgccagcatccaaagagccccctgccaagctcgggcagtctgggctgcagtctgagccttgtctcctaggaatggccagcttccgttatacttaacttgcatctcattctccctctccctgcatctccacctcccaagaaaagatttccagattcgactaatttgtcaaagaaatgcctcagagtgtggctgaaattgcctttgggagtggttgaacatgtctgtctgcaaaacacgcaggtgcatggctgttagaccaccagcccctgccctctgcttgagactcccagggtgaacctttctgcgcatttcactctcttcacacctatttgtgtttccctcggttggtgacattcctgcctcgtgcagagcactgacccatgtggatctagaagggctttgacaagtgtcaagccagataaccgttgaagcaactaagttgtttttttagctacattcctcataaatcgtggaaacctatagtagttccccccgccacctccttttttccttttagtgtgtattttaattagctttgtaggacttaagccctgggccaccttctcttccttttccagacttattccttgggtggctcctgacttttcacttctatcccacaccttttctaaaccccaaatccagagagttcagttgccagctagaggacttctgtatgcctctcagcatctcagatgaaacacgtcccaatgtgagcccctaagtgcccccaccccaccctgctttcagaccccacgtctctgagttaaccccatccttgcatgtgtccatgccggccacctgagaaccatcctgggcccctcctctccacctccagtgcccaatctatctattggctccatctccaagtgcctcaaattcttctacttctgtcggtctccaccgccaccactctagcccgtgtccccctctttcttcccacacctcaactactctccctggattgctctggccccacaggaaccagagaacttttcttaaaacacaaatgtgcttgcgatactcttcgacttaaaatatttatccggcagagtctgctaattatcacccgatactcccttcccatcctcatttggtaatagaacccctgagtttcatctgggcaaatggccatctggctaagatggcatttcctagtctcccttgcaactagatggggccccctaaccaaactctggtcaatgggatgtgggcagaagtggccaatagaatatgtttgtgttcttaaaggcaagtcatgcgcactctgctgctcttttgtttctccccactaactagacggtggatgtgatggcagaagacagagacaccattctggaccccaagatagacgcttcatgttaaggacgacagaacaacaaggtagagtctgggccccgcatgccatcaagctgccataacgaccctagactactgaatgaaacttttttttttcctttctgagacagagtcttgctctgtcgcccaggctggtgtgcagtggcacacaatctcggctcactgcaacctccgcctcccaggttcaagtgattctcctgcctcagcctcctaagtagctgggattatagccacctgccaccatgcccggctaatttttgtatttttagtagagatgaggtttcaccatgttggctaagctggtcttgaactcctgacctcaggtaatctgccccccctcggcctcccaaagtgctaggattacaggcgtaagccactgtgcctggctgatgaatggaacttttaagtgagcaagaaacacacttctacattaagtcactgtactttggtgctctttgttacaacagcatgaacatgtatgctaactaatacgcactcagggtcctcccattatccctacagtacggaccacagtcattaacgtggcttctaaggtcctgcaccatctgacctccgcttgcctctccaccttgtctcacttgtgcttcaggcttgctgccctgcttatgttccccatccacaccctggaggtatcatcccgactcagggcttttgcacctgctgtaccccacgcctcttcccctccctcacctggccaacttcaagccacaggtcaaatatgttttccttagaaagccttccctggctgcatggatgaggtctttcttccttcatctctcccccagcactcataagtacattctgtgtcatttgtttattagagaggcctatattttttttcatttttgagacagggtctcactctgtcgcccaggctgtagtgcagtggtgtgatctcggctcactgtaacctccgcttcccaggttcaagcaattctcctgcctcagcctcctgagtagctgggattacaggcacgtgccaccacgccagttaattttttgtatttttagtagagacggggtttcactgtgttggccacgctggtagagaggcctatttttttttaaaagcacatgaaaaaaaatccccgggccctgcttacccaaagccttgactgttgagccgggccttgtttgcagtccacgaagaataccagcccacatactgctccgggttagagcaggtgatctggtccggtgtgacctcccctgactcgaaacccagaggcttgtgatatgggcattctgggaaaggaaaaagaattcacattcacacatatctcaatactcaacaagcaccaggtgactgaaataacaaaacaaacccatctgctttgcgcttcggagacggagaaggctttacctgtctctgtggttcacaatgggtacagctgtgtcttcaacggttcactactcacgcaagaaaggaatgaaggatgaagtaaaggaattgccatagagactcaacagcctttgtaaaagcagagggaagtggctctatggcaacttcacaaggggtgtgtggaattttgagaaatacttcacctcctccaccaacttagagatctaaaaaccaagaggtgcacagtgaaataccatatttaaatgccatacatctttatttcccccattaacacagatttagccatcctgcctcatgacgtcaggtctcttgttgtccttgggcagcagatcatgccaattatagggacaaaaccacagtgagacgcaagaagggcgatgacatattgagatatagagaatgacttcctacttgtaaattgcagttttctcaccagtctaatgaaaaaaaaaatgggtgaaatgtgcttgggggactgttgagtgagaaacagctaaaaggaactgctttttcccagtggtagtacccaaaggtggttcttctgtgttgattgtctcccccttcctctcgtctgtatgtcccctcacagtaaaaacggtgttgaggctgggcacggtgactcatgcctgtaatcccagctactcgggaggctgaggcaggagaatcgcttgaacccgggaggcagaggtttcagtgagccgaggtggtgcctgcagtggcaggcacagtgtcgagttacctggtcagaggctgccaattttcaacccagtattcattcattctccccttcttctccttttttttttcttttgagacagggtctcgccctgtcctaggctgcagtgcggtgctgctatgtcagcccactgcaacctctgcctcctgggctcaagcgatcctgccacctcagccttctgagtagctgggaccacaggtgcacaccaccacacccagctaatttttgtattttttgtagagacaggattttgccatgttccccaggctggtcttgaactcctgggctcaagggatccacctgcctcggcctcccaaggcactagggattacaggtgtgagccatcacacccagcctccccttctttttgactaaagagctctccttttattgggagcagcaatgtagccagctgaataaagggcctttcccagcctcctttgcagttagaagtgcccaggtgacataacttctgaccagtgagacataaagactgcctgctgggatttctggtcaggttttgcttgccccttcttttttcctgttgcctagatcacatctgatagttggtgtgacagtaaccatcttgcaccatgtgggtaaggccgagagaactgcagaggctgagtgcagtggctcatgcctgtaatcccagtgctttgggaggatcacttgagcccaggagttcaagaccagcctggggcaacatagggagaccccatctcgtggctcacgtctatagtcccagctaccggggaggctgagggaggaggattgcttgagcctaggagtctgtggctgcagtgagccatgatcacaccactgcattccagcctgggtgatagacactgtctcaaaaaaaaaaaaaaaaaagaaaactacagagaccttagccttgataaccttaagtattataactccctacccctaattttttttaccatgtgagttaaaactcctaaatcaataagccagtatttagggggtcttgtgcttataaccaaacccagttcctaactgaatttctacagaaaacaaatggcaaatatattttccttttttggttagagacctggtctcgctgtgtcgcacaggctggagtgctgtggcgcagtcatagctctctgcaactctaactcctgggctcaagtgatcctcccacctcattctcctagttttctgatgatgaatgataaactgcaattaaggcaaatcatagtattttctccagaatttttcaaaagccagtaaagttgaatgaaacatgcttgcagagacggccatgccctgtccccagaggctaaaaacaggccagcttcagacctctggccggggaggcttaacttcctttctgccccaatgcacgaaaggaataggcctgatctcactagtatctgcagctctgtgggtctgagggtgagggcacagaatttgtagtttattgagtactcaagtactcaagaatgcagtttccaggactccaccccagagcaattgcatttttaacaagccaacttttgaaagtgcaccttgaaaaccttggcctgccagggaagacattctttctgtgggctggggatcccgaggactgagtgcctgcggactcgagggctcctcccccacccgcgacacccctccagctgggaagacaagcccgagcgatcagggggaggggcacaaggccaggtggcagggatttttcatgggcaaaattctaaccttgggtgtctctgaggcccctccactttgagcatttgatgactgaacctcctttttgttttccacccccacccgccgccgccgccccgctcagggctactagctctgagagagtaggcagaggggaagggaaaaagccagtgccacctctcccagtcaccttattcttggcactttgctcttcttcatctgtttccccttcacatctcttttgccatttcttcccaaatagctcatctaacactccagagcggtctgtagccctgcaggggtacctggccagggccaatggccttgacagcctgggagggcctgtccaggcagcagagaatgtgtggctcactctgcgatctaaagacccgtgtgtccagacgtggatgctgtacttactccccagggaaggtgacgctctcactgtcaccttggcttcagctggtgtctgggagccgatgcctgcctcccgggccccaagcttcattccactgccctctgaatattttccaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccggtaagcagagactctagaccggtggggctcagcctgggctgtacctcggaattgcccgaggagctgtagaaatgcagatgttcaggccacacccccagggattctgacatcattggcctgggcatggggacaaagctgcaggtgattgtaatgggcagtcaaggtcaagcaggcctgcgtccagccaatgacacctggggtaggggcccaccctctcagcgtgtgcgcaggccagttgcttaacctctctgggtctcagtctcctcatctgtgaaatgggggcatgatgtagtacctgtcttcataaaattgctgtaagattgagtgaaactatttggagattgtagagttcgtagagcacagcgtcttgccaaaaagcagcaggtgcatgacattggtggaggtgaatttgtgagactacgttgataaccttcttgaattttgcatgtttttctggcaaagactcaatagggaggaaatccattgcccctctatcctactctgttctgtccccattaccctccccgtccccccaccaccgcaccccccgccacaccctccagagaatgaggccagcttcatgtgactaatgaatggtttcggctgtccttgccccaggcaggagcaagtgtgtgtgtgtgtgtgtgtgtgtgtgtgtgtgtgtgtgtgtgtgagagagagagagagagagagagacagagagacacagagagagacagagagggatgtgagagagaaacttgtcgacagcatcccttaagcttatggacctggaagatctaggcctcaccaggaattagcgcattgcccaagagaaggaggtcacagccccagctaaagtagcagggatgtggtgagggcctgagcgcagcagagagggacctgattcccctgaggggctggactgggatgggcttgggagccctaagctctgggcacgctcagaaaacttgggaaggtccctcggactgagtatggctcagagggagaggagccacccatgagacgtctgccttccaatggggctgtggccagcctgccctcgcaagctcgtggggggttcatgtagtctaaatagggagaaaagaccttcaaaaatcctgtctgcacactcctcacaggccattacaatggggcactccggctggatttcttctaacgtggaaaaatagaaaatgtgacatttcccacactgtgtgtgtcctgaagaagagcacactccagttctcttattgtgatttttcctgacttcttcttcccctttcctcttccttctgtgggcctggttgagctcttttcaggtccacatgtggcctgcagcccttccctgaggccatcccctcccgtccacacccctccgcctggccccccatgcctcagccttcagatctctgcccgccctgagctggctgaggggccccaggtgctacctccccagcacccttcacacctgtcacgcacccctcctcctcaggcatacttcactgccatctcccctcgcctgcctccctccccattctccccctagctgagcagaatgcccacaggtgctgggcactctctaggtattgactggacagatggatggagagatgaatgaacacacaccatcgccccatcttgggtggccactggggacaagcataggaaatggcatttcgaaacaggcagcagaggcctcagggaagaagtagacactgactgcgacctctggcctaatcaaaagaaaccataaattgagtagatgctagaaggcaacataaatagtgttgtgaaagaattaaggggatccaaggctgggtgcagtggctcacgcctgtaatcccagcactttgggaggccgaggcgggaggatcacttgaggtcaggagttcgagaccagcctggccaacacggtgaaaccccatctctactaaaaatacaaaaattagccgagcgcagtggttggcacctgtaatcccagctacttgggaggctgaaacaggagaatcgcttgaacccaggaggcagagcttgcagtgagccaagatcgtgccactgcactccagcttgggcaacagagccagactacatttcaaaaaaaaaaactaaggggatccttatcagacacacacagaatatgaccttcccaagttttccacccagtgtcactttgctgttgcagctattagacctgtttctatactcatttcacccttagggaaaagcctacatcttctgtggctcaaatggctcttctgagccatgatgtgatcatgagatagataaaggcatatttgcaatatgttaccagcccaaggctgtgtatatttcatattctagcctttttactttagtggctactttctgagtttgtaggcaggcttataaagaatgcagatctaaagaaacacagaattcagggactttcttaacacaagattccagacagatgtgaatagtgttatgcatagatattagacttgaatatatgtgacaatatagtagagtacagaagaaaatatgtagaataatatttctggaagaatggatcataagctcaagcatcatatagaatagaaaatctagaatcaaaaggaaccattagcaaaccagtagatttcttatacttttgataatttccctaccctattttttgctctcagagtgccggggtaatcttggctcaacggtggaagagacagagcttttagtatttttaatagcattaaagtgaagattaggaggccagaatgcatgtggccttctgctccgtggggggcccgggcattagccagagtgcacctgctagcgctcctggcagctctgagtgaccccgctgtccttctgtgctttccagggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaacca

SEQ ID NO: 3151 - DNA, 228046 bp, human; identical to SEQ ID NO: 3146

SEQ ID NO: 3152 - DNA, 211437 bp, human; identical to SEQ ID NO: 3150

SEQ ID NO: 3153 - DNA, 8613 bp, human
gcacatggaagtgcctcggacctggagtactggatagggagcaggactggagattggacgatgaagggctcggtttgggacgcacggagtgtgaggcttctttgggtcaccacagcagaagtattctcctggaaaatattcagagggcagtggaatgaagcttggggcccgggaggcaggcatcggctcccagacaccagctgaagccaaggtgacagtgagagcgtcaccttccctggggagtaagtacagcatccacgtctggacacacgggtctttagatcgcagagtgagccacacattctctgctgcctggacaggccctcccaggctgtcaaggccattggccctggccaggtacccctgcagggctacagaccgctctggagtgttagatgagctatttgggaagaaatggcaaaagagatgtgaaggggaaacagatgaagaagagcaaagtgccaagaataaggtgactgggagaggtggcactggctttttcccttcccctctgcctactctctcagagctagtagccctgagcggggcggcggcggcgggtgggggtggaaaacaaaaaggaggttcagtcatcaaatgctcaaagtggaggggcctcagagacacccaaggttagaattttgcccatgaaaaatccctgccacctggccttgtgcccctccccctgatcgctcgggcttgtcttcccagctggaggggtgtcgcgggtgggggaggagccctcgagtccgcaggcactcagtcctcgggatccccagcccacagaaagaatgtcttccctggcaggccaaggttttcaaggtgcactttcaaaagttggcttgttaaaaatgcaattgctctggggtggagtcctggaaactgcattcttgagtacttgagtactcaataaactacaaattctgtgccctcaccctcagacccacagagctgcagatactagtgagatcaggcctattcctttcgtgcattggggcagaaaggaagttaagcctccccggccagaggtctgaagctggcctgtttttagcctctggggacagggcatggccgtctctgcaagcatgtttcattcaactttactggcttttgaaaaattctggagaaaatactatgatttgccttaattgcagtttatcattcatcatcagaaaactaggagaatgaggtgggaggatcacttgagcccaggagttagagttgcagagagctatgactgcgccacagcactccagcctgtgcgacacagcgagaccaggtctctaaccaaaaaaggaaaatatatttgccatttgttttctgtagaaattcagttaggaactgggtttggttataagcacaagaccccctaaatactggcttattgatttaggagttttaactcacatggtaaaaaaaattaggggtagggagttataatacttaaggttatcaaggctaaggtctctgtagttttcttttttttttttttttttgagacagtgtctatcacccaggctggaatgcagtggtgtgatcatggctcactgcagccacagactcctaggctcaagcaatcctcctccctcagcctccccggtagctgggactatagacgtgagccacgagatggggtctccctatgttgccccaggctggtcttgaactcctgggctcaagtgatcctcccaaagcactgggattacaggcatgagccactgcactcagcctctgcagttctctcggccttacccacatggtgcaagatggttactgtcacaccaactatcagatgtgatctaggcaacaggaaaaaagaaggggcaagcaaaacctgaccagaaatcccagcaggcagtctttatgtctcactggtcagaagttatgtcacctgggcacttctaactgcaaaggaggctgggaaaggccctttattcagctggctacattgctgctcccaataaaaggagagctctttagtcaaaaagaaggggaggctgggtgtgatggctcacacctgtaatccctagtgccttgggaggccgaggcaggtggatcccttgagcccaggagttcaagaccagcctggggaacatggcaaaatcctgtctctacaaaaaatacaaaaattagctgggtgtggtggtgtgcacctgtggtcccagctactcagaaggctgaggtggcaggatcgcttgagcccaggaggcagaggttgcagtgggctgacatagcagcaccgcactgcagcctaggacagggcgagaccctgtctcaaaagaaaaaaaaaaggagaagaaggggagaatgaatgaatactgggttgaaaattggcagcctctgaccaggtaactcgacactgtgcctgccactgcaggcaccacctcggctcactgaaacctctgcctcccgggttcaagcgattctcctgcctcagcctcccgagtagctgggattacaggcatgagtcaccgtgcccagcctcaacaccgtttttactgtgaggggacatacagacgagaggaagggggagacaatcaacacagaagaaccacctttgggtactaccactgggaaaaagcagttccttttagctgtttctcactcaacagtcccccaagcacatttcacccattttttttttcattagactggtgagaaaactgcaatttacaagtaggaagtcattctctatatctcaatatgtcatcgcccttcttgcgtctcactgtggttttgtccctataattggcatgatctgctgcccaaggacaacaagagacctgacgtcatgaggcaggatggctaaatctgtgttaatgggggaaataaagatgtatggcatttaaatatggtatttcactgtgcacctcttggtttttagatctctaagttggtggaggaggtgaagtatttctcaaaattccacacaccccttgtgaagttgccatagagccacttccctctgcttttacaaaggctgttgagtctctatggcaattcctttacttcatccttcattcctttcttgcgtgagtagtgaaccgttgaagacacagctgtacccattgtgaaccacagagacaggtaaagccttctccgtctccgaagcgcaaagcagatgggtttgttttgttatttcagtcacctggtgcttgttgagtattgagatatgtgtgaatgtgaattctttttcctttcccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtaagcagggcccggggattttttttcatgtgcttttaaaaaaaaataggcctctctaccagcgtggccaacacagtgaaaccccgtctctactaaaaatacaaaaaattaactggcgtggtggcacgtgcctgtaatcccagctactcaggaggctgaggcaggagaattgcttgaacctgggaagcggaggttacagtgagccgagatcacaccactgcactacagcctgggcgacagagtgagaccctgtctcaaaaatgaaaaaaaatataggcctctctaataaacaaatgacacagaatgtacttatgagtgctgggggagagatgaaggaagaaagacctcatccatgcagccagggaaggctttctaaggaaaacatatttgacctgtggcttgaagttggccaggtgagggaggggaagaggcgtggggtacagcaggtgcaaaagccctgagtcgggatgatacctccagggtgtggatggggaacataagcagggcagcaagcctgaagcacaagtgagacaaggtggagaggcaagcggaggtcagatggtgcaggaccttagaagccacgttaatgactgtggtccgtactgtagggataatgggaggaccctgagtgcgtattagttagcatacatgttcatgctgttgtaacaaagagcaccaaagtacagtgacttaatgtagaagtgtgtttcttgctcacttaaaagttccattcatcagccaggcacagtggcttacgcctgtaatcctagcactttgggaggccgagggggggcagattacctgaggtcaggagttcaagaccagcttagccaacatggtgaaacctcatctctactaaaaatacaaaaattagccgggcatggtggcaggtggctataatcccagctacttaggaggctgaggcaggagaatcacttgaacctgggaggcggaggttgcagtgagccgagattgtgtgccactgcacaccagcctgggcgacagagcaagactctgtctcagaaaggaaaaaaaaaagtttcattcagtagtctagggtcgttatggcagcttgatggcatgcggggcccagactctaccttgttgttctgtcgtccttaacatgaagcgtctatcttggggtccagaatggtgtctctgtcttctgccatcacatccaccgtctagttagtggggagaaacaaaagagcagcagagtgcgcatgacttgcctttaagaacacaaacatattctattggccacttctgcccacatcccattgaccagagtttggttagggggccccatctagttgcaagggagactaggaaatgccatcttagccagatggccatttgcccagatgaaactcaggggttctattaccaaatgaggatgggaagggagtatcgggtgataattagcagactctgccggataaatattttaagtcgaagagtatcgcaagcacatttgtgttttaagaaaagttctctggttcctgtggggccagagcaatccagggagagtagttgaggtgtgggaagaaagagggggacacgggctagagtggtggcggtggagaccgacagaagtagaagaatttgaggcacttggagatggagccaatagatagattgggcactggaggtggagaggaggggcccaggatggttctcaggtggccggcatggacacatgcaaggatggggttaactcagagacgtggggtctgaaagcagggtggggtgggggcacttaggggctcacattgggacgtgtttcatctgagatgctgagaggcatacagaagtcctctagctggcaactgaactctctggatttggggtttagaaaaggtgtgggatagaagtgaaaagtcaggagccacccaaggaataagtctggaaaaggaagagaaggtggcccagggcttaagtcctacaaagctaattaaaatacacactaaaaggaaaaaaggaggtggcggggggaactactataggtttccacgatttatgaggaatgtagctaaaaaaacaacttagttgcttcaacggttatctggcttgacacttgtcaaagcccttctagatccacatgggtcagtgctctgcacgaggcaggaatgtcaccaaccgagggaaacacaaataggtgtgaagagagtgaaatgcgcagaaaggttcaccctgggagtctcaagcagagggcaggggctggtggtctaacagccatgcacctgcgtgttttgcagacagacatgttcaaccactcccaaaggcaatttcagccacactctgaggcatttctttgacaaattagtcgaatctggaaatcttttcttgggaggtggagatgcagggagagggagaatgagatgcaagttaagtataacggaagctggccattcctaggagacaaggctcagactgcagcccagactgcccgagcttggcagggggctctttggatgctggcatcccctcgagagccagcacctgcgggctttttgcagacatgcacagggggagtctctcggtgactcggtatgttctcggcaggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtaagttgggcttatcccaaaccaacttcagctcgcaccctctgggacttcccctcctgtccccgagctcctgtcactgccctctgtcagagcaccgactccacagcacagtggatcatctgcgctttcccccacaatgtgctgtgctctctttcctgggcttgctttggtgcccagcacagtttgtttgcaaatgaatgctattcttaagctcaaaaaaaaaatttgtctgagtttccatatcagcatgcagttgcctgaactcttaagactgaccatttggactatttcaactcactggatcattgaatgcactttgcttcacgggtatggtctgatgttattgatgtgggtagagaatcatccatttatatagatgtggcctctcctattgtttgagactgacagaggggagccttttgagaacctagcaagttacccattagccaaatggttaaaaggacttcaccagcacaaacacagacgaacttaaacctttgggcaactctacatcctattaatctttgtggattgagacagaagtcttcttcaccattgactaaacgcagtagactcctgactatatatatatatatatatttgctatgaataaaaatgaattaaaaactccctagctctttggaaatggtaaacatccttttgcctaagagtaaggagttccccaggctaatttcaacatttaatcaggttaagtagacatgtacagctgagattcagaaggctttgtaagtctctgatgacaatttgtacggccaagacgttcatgggttgttccaaggagtttgaacacaagaggaaaaaccatcttgatacttggacatttaatttcatttttattcttattagctggcctcttcaaaagacatgagaagtttttcaagccctgtgcttctgaaggccttgaaggttctttgcaaagaggcacttcacccctgcacttgtgcaatctggtggagcctgttccaccctcccctctcttcacctggctcctgacttgaataggctcaaagacaaactgcaatagagagggtggtgtggggcggtgccactgcggagaaaggcaagaacatggcagaccaggcccttcccgttttgtggatggatggggccaaatgcaacagccagatattttcaggagataatcccagaaggagatgaaatgtcctagtggcatcaggcagagcaccatgactttggtaagagggcaaagaatgatttctttggaaatggcgtcaaacacccacagcatgtttttatgttacatccttaaaaacactaagcaaaccccctttctctttactctggcaccaccctcccctttccagaatcttccttcgagtttttatgtctttttgttttgttttgagatggagtctcactctgttgcccaggctggagtgcaacggtgtgatctcagctcactgtaacctccgcctcccgggttcaagtaattctcctgcctccgcctccagagtagctgggatttacaggcacctgccactgcgcctggctaatttttttgtatttttagtagagacggggtctcactgtgtgttggccaggctggtctcaaactcctgacctcaaacgatccgcccgcctccgcctcccaaagtgctgggattacaggcgtgagccactgcgcctggccaagtttttatgtctttttaaaaaaacattttccaagttggaaaggtactcatcacttgtatcaaagtaggaatacacatttaagttttggcttacaactcctgagccaagcacgggttttcacttgagccctactttggatacctttggaacatgtaagtgtgatgtgggccttttcaaaatgtcaaaatgcaaaggataaaaactcaaaagcgatgagtcaagtggcattttctagcagcaccctccaatagaactttctgtgatggaaatgttcacatctgcactgtccaatatggcggccacttgaaatgtggctcatgtgactgaggaactgaatttttatctaattttaattaattgaagtgtaaacagacatattggctagtggccaccctattggatggtgcagttccagatgtcccaagcatgtaggtgtgatgacaatcactcaaggtcagattttggggggcacccgcaaactgctttaactacttcctaatcatttctatagttaaaagttggggctagctccagaaaggaacccttcttccttttccctccccgatgtgatggtgacaggatttcctctatctctctaggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgag

SEQ ID NO: 3154 - DNA, 32199 bp, human
cagttcagtaaggtagagctttggccgaggacgaggggaagatgtcacgcaagatagaaggctttttgttattacttctctttggctatgaaggtatgtgctattcaaccattgacattcattgcatacttaatacataatttaattaatatcgttgataaataggaatatagcctgaataatataaatattattaattagcaacacgttaattaactaacatgtgttattaatgaacaacagttgtctttgtgtggatggctttccagttctgtgaggagccttctaaagttcaaaggatgcttaaaatccaacagaaaacaggatgggtctcagaaatctataaaatagccataagttgcaacaattaatgagaaagtatggcatattctggaaaacttttaggagtcaaagtgggagtgattgtagaatttaatattccaaaccggaatgctattgacggtggaggacgatgctattaataattctgttgggacgacaggtgtaacccaggaccatccagggcaaattggggtgtaaggtcaacctagtttaaatatggattaacgtaacatacccagtaccactggaatctaataaaaaacataatccaactgagagtcaggaaacctcggagactcagtacactcactcattttaaaatttctaaatatgaccctagcagaagtgatatgcttcaattaggaaaaaataagggcaaatctgtaaaatgtcatccagttccaattccctctcaatctttgaaataatattctttcatgcctctctcaattctcaagtacccatctgctcagaatttctcctcaggttcatccagatgttagaaattggttgcctgtcttctttgtggacatcgtgtatttgtgtgttatagaaaataaattaaaaagcagggagaaggaggtctctgtgctctgcaaatgacctggtagacagacacagcgaaactcacacaagtagaatcagaattcttggtttcacggctcactgtagcctcaacctcccaggctcaagccatcctcctgcctcagcctccctagtagctgggactacaggcacgcaccaccacatccggctaatttattgtatttcttgtagagaggggttttcaccatgtttcccaggctgatgacttttgttacttagtcacatttctcagtatttggaaagactggtgacaatataattccaaggtcattctgcaaaccccaaggtatatttctaagtagggatcatgtaaaccagttgtctgttaggattttttccccttgcaattaatagtctgcaacttgtcccagtaactctgactactttaagatgctttggggttttgttgtttttccttttactccttgccccctcctctttcctcagcaagaaaatctaagcagactctttcaaggcttagatctaaatactcctggttgtcagacactcccagggctcactctcggatttctcttctttgtgattggcatggagattcattcattcattccttggtcccttcttttaagagctcatccctgactatctgctagggggcaaacattgtgtatgacggcggggcgcggtggctcatgactgtaatcccagcactttgggaggctgaggcgggtctatcacctgaggtcaggagtttgagaccagcctgcccaacctggtgaaaccccgtctctacaaaaatacaaaaagtatctgggcatgatggcaggtgcctctaatcccagctactcgggggaggctgaagcgggagaatcgtctgattgctggagagggaggttgcagtgagctgagatcatgccattgcactccagcctgggtgactgagcgagactcagtctcaaaaaaaaaaaaaaaaaaaaggacttgacatgcagggcatccttgtttcttccacagtgctgagtctaacaaccctgttctgtgacctccccacccccgcgatgcgaagaagtcctagaaatgtttaccaaagcattttaaaattagacctgcccagttagtggatatcagcaataaaagacaggctgtcaggaggcatgaaggatagcactctttcgtgttctaaagtttaccaatctttgtgcatggctggggagctccagaaatgtccacgaagagcagagaacatcgtctctccaggtgccctgcaacgtgggccagtgggaaggtttggggagcttaaattatcttacttgcttaacgcaggcctttaacagcacttgaaaggaaagcagccagccaaaaatagccagtgtggcttggcaacctactgtgtgccctaccctgggccagagggatgctccaggggacagaggacacaatcactgaacttaatcagcatattatccagatggagatgcataaggcccatagacatgggaaagatgcatcccattgtacagctgggaacctgaagacaaaggctgtttgtccaatttaccctccactgcttctgtccttcagtggcagtgtctcctcattacagtgaaataaggtaaagaaattgccttcacttaggcgttggatgaaggttcatttcggagagcacacagcctcacagtaaggcatttcctatgtctttttttttttttttttgagaatttcactcttgttgcccaggctggagtgcagtggcgtgatctcggctcaccacaacctccatctcccgggttcaagcgattctcctgcctcaggctcccgagtggctgggattacagacgtgtgccaccacgcccggatcatttttgtaattttagtagagacggggtttctccatgttggccaggctggtctcgaactcccgacctcaggtgatctgcctgcctcggcctcccaaagtgctgggattacaggcatgagccaccgcacctggcttcctatgtcttataattgagtcaggcttctatttctcttacaccgcacatattggattcaatgccaataaggatttttagaacatccatcgtattaaaatatcttacttcattacttggtcatgtttattatataaaaacaaaaaaagtccttcagcctcaacttataggtgactgtgttaccatcagagattgcaggggtttttttaaagcagttttattgagatgtaatttatatactcttaaattcacccattgaaagtctattgttcgatcgttttaagtatatttacagatttgtggagcacataatctaattttagaacattttcatcacccaaacattaagccctcgctccccattctccctgtctcccccctcccccagcccctgggcaaccacggatcgactttctgtctctaaagatttgccagttctggacagttcatttcaatggagtcacacagcatgtggtcttttgtctttcgcttagcatatgtggttgaggttcatctgtgtttgaagcatgtgcagataacagatttacccatgaatatgcctgtcgcctaaaatagtaacactttcacaccagaagcaatttccttctttctctttcacgagagggacattattgcagcctgctgcgtgcgttcctcctgtttctcaagcagattggaagctggttacagaccatttttaatcattcataattttatgcttttcttctcggcttcatctgtttccatgggaaggaacgctctatggttggtgatacccaatccaagagactaaactaggttttcctgtgtgtatctaaagcgcgcctttcctcatgggttgcaaggtacatttcaagaaatagacacgccttgaaatttcctgctgtgacaacaagggtttcctcacagcagagtggcccttttggaccaaggggcagaatgagcccatattgcataaatctaagcccacattgcataaatctaagattggtgactggcggatgtctcatgtaacatgtggtggaatcacagaagccatctaaacagggagaaaaatatgcaaccacataatcgaaatatttcactatttttcctttagaggctgagatatttctcttgttccccttccaacaatgctattttctggtatgatactattaggttggtgcaagagtaactgcggtttttgccattacaatatgttgtcgccaaaaatgcttttgttctccagtttgttggtgattaaatcattgtgtgggactgcagcagccatgttgcttctcctttggtgacagctttttctgtaaaacgcctgtcgttccttctctctctgctcacttccataaggatatggtacctcagaaccccaggctgtctacagacaaatgctttctgcgggaggggagtctgggaagaaaagaaatgcaagaaatgggtccaaaattggattgcacccaggaattggctctgaaagcaggcctctcttccttggactctaggtttgctcagtgacagctcaacagaccagactctcttcagtgacatacatggcctttgagccaagtggatttggttatgaaagccacactgtcagtgaccaccaacaccccttgcctttggtctcccaaaaagaggatctggcactgtttttttttttttttttgagacagagtctcgctgtgttgctcagggtggagtgcagtggcgtgatcttggctcactgcaaccttccgcccgcctgggttcaatcgattctcctccctcagcctccctagtagctgggatgacaggcacgcaccaccatgcccagctaatttttgtgttttttgtagagacagggtttcaccaccttggccaggctggtctggaactcctgacctcaagtggtttgcccgcctcggtctcccaaagtgctgggattacaggcgtgagccacgggcctggcacaattgatgttgacctaactgacagggcccttcagaaactgcctcacagccagtcccagcttctcttgagggtggggatgggacagagcatctcctggactagcagcccccagccaactagaccctaattgctgatttcctttgcatctcttgatgaacagctacaggcctgaggttaggagttcatgtagtcgttaactccgcagagcacagggcaccatccagcctgtctgggctcccccttgagttccagaagcatctgtctggctgccagctcgatttcaacactggggtgtcccctaggcgtctcaaattcattatgtcccaaacagatcatcctcctccccatcctccccaaatcccttgtcttcgctgaaaccttcttccccttccgcccgccccgcaaatggcagctctatcctcccagttgccccagcctcagacttccgtttctttcacacccccacccctgccacgcgtaatctgcccgcagatcctgtgggcactacttccccagtgtagtcagaatccagccacttaacacttccactgccaccaccctgggccaagccagcatcttctctccctcggatgactgcactcacctcggaaccggaccctgttgccacacttgccgtggccagcccggtccacaacattgtaccagagggagcctttgaaactgtggtcagtaatgtcctcgtctatcctcaagttccacaaagcctcacatggcccacgaggccctgcaggaactggctcccggacacccccaacctcgtcatctcctaagactctctctcctctagctccagcctcaggagctccttgctcttcctggaacacgccaagcacacgctcacctcgagggcttggcacatgctgttccctctgcccagaatgctttgcccacaggtgtctcgcctccttcgaatctttgctccaacatcaccttctcagtgagggcttccctaagcccaaaaggaccagtccctgttccctacttccttgtgttttctccacagcagtcaccgtaattttccatactatctattctctttcttcattagttcattaatgtattctccccacccactcccacccaacacacacactagcctatgagctttatgatggcaagtgcttttcctgttttgtttgctactctatccccagcacctaaagctgggactggaatgtagtagatgctcaatgaatattagttgaatgaatgaatgctttgaggtgagtcattatcagtcattttttgtatgggtttctataatctgtgggcaagaaaaaggtggactgaaaaggccagagcaaatggtgagctgagggacaggaaaaaccctcttttttttttttttttttttttttgagacagggtctcactctgtcacccagactgaggtgcagtgatgcaatcatacctcactgcagcctccaactctcatgatcctcccacctcagtcttccaagtagctcggatcacaggtgtgtgccaccacacctggctaatttttatttatttatttgtttgtttatttatttttagcagagacagggtctcgccatgctgcccaggctggtctcaaacttctgagctcaaggggtcctcccacctcagcctcccaaagtgttagaattacagccatgagccactgcgtccggccaggaaacgtcctctttatagggaatgggctgagcaggcggagaagtaggggtggggggacgcatttgaggcaaagaaattctatggacggaggcaagagacagtctggcacatttgtggcttggcgagcagtacagagtgagaaacataaatcccgagaggtgggcaggaggtagatctatctccatgaccccttgaaggacactttattattatatgcatcataggggtgtggaaatggagagatcataatacatctcagaggtgggactcagcccctggcaacagggacccgccaaagcgttttgcgcaggagagtggcggcatcaggtttgcacctcactgcctcagcagcgtggaggatgaaagagacaagtctctctttagcaggtagagtacctgggagagagggtggggcctcaaagcaggcagtgggatggagaggagagaaagcccctggtggccataggatggtagggatttaggaaaaagaggaggcttggaggagccttctggatggggtggtagatggatggcgaagccactcaggagataagaaatagagaaaagaggccaggtgcaggggctcacgcctgtaatctcagcactttgggagggcgaggtgggaggatcccttgagcccaggaatttgagaccagcctgggtaacatagcatagaccccgtctctacaaaaaaattaacacaattagctgagcgtggcagcgcaggcctgtagtcccagctactcaggaggctgaggtgggaagactgcttgagcccaggaggtcgaggctgcagtgaggtgagatagcaccactgcactccagtgtgggtgacagagcaagaacctgtctcaaaataataataataatactactaataataacaacaataataataaagaactagagaaaggagaacagtctgaggaagcagatgagtttgttgttgttgtttttgagatggagtcttactctgttgcccaggctgggagtacagtggcgtgatcttgactcactgcaacctccgcctccccagctcaagtgattatcccgcctcagcctcctgagtagctgggactacaggtgtgcaccaccatggccggctaatttttgtatctttagtagagccagggtttcaccatgttggccaggctggtcttgaactcctgacctcaggtgatctgcctgcctcggcctcccaaagtgctgggattacaggcgtgagccaccgcgcccggccccttttgtacgttttttaatggatccatgtggtgtatctgcttcagcattggacttctcactcagcatcatgagatgcatccaccctgtggcatgtagttctagactatctatttgcattgcagtatagtgttccattgtgtaaacataccccgatgtagatgctctgcttttgatggacatatgagcatttccagtttgggggtattacaaatactgccgctatggatcatctagcacatgtttttggttttggagtatatatgtatgcatatctggtgggtagctacttaggagtggaattgctgggtcatagggcgcatatatgttcagcctttgtataaattgccaaatagttttccaaagaggttagaccaccttgcacccccaccagcaacatatgacacagttcaggtttctccacagccttgtcaacactaggttggtccactttgagctagcaagagacatctacgggaagatatcctgtaggccattcagtgcttactggatatctgaaccttggatttagcaatgtttactgggtgggtggaggaagcagagctctcaaaggagactgagaaggtgtacctagagtggtggaagctaaaggaagatgggactgacagcacccaacattgcggtgtgaagatggaaggtcagtgttgggaagagtccattggatttgaaaataagaagttggctgggtgcagtggctcacgactgtaatcccagcacttcaggaggccaaggccagaggattgcttgagcccaggagctcaagaccagcctgggcaacatagtgagacctccatctctataaaaataggtttaaaaatattgggtgtggtggcacgggcttgtagtcccagctaccatgggaggctgaggtgagaggatggcttgagccctggagttcaaggctgcagtgagctatgactgccactgtactccagcctgggcgacaagagtaagaccctgtctcaaaaaaaaaaaaaaaaaaaaaaaaagccaggcacagtggctcacgcctgtaatcccagcactttgggaggccaaggcaggtggatcacctgaggtcgagagttccagaccagcctgaccaacatggtgaaaccccatctctactaaaaatacaaaattagccaggcatggtggcgcatgccggtaatcccagttactcaggaagctgaggcaggagaatcgcttgaacccaggaggccgaagttgttgtgagccgagattgcgccattgcactccagcctgggcaacgagtgaaactccgtctcaaaaaaaaaaaaaaaaaaaaaaaaagtcattgttcttggaaccaacccaaacgtccatcagtgatagactggattaagaaaatgtggcacatatacaccatggaatactatgcagctattaaaaaggatgaggtcgggtgcagtggctcacgcctgtaatcctagcactttgggaggccgaggtgggcggatcatgaggtcaggagatcgagaccatcctggctaacacagtgaaaccccgtctctactaaaaatacaaaaaattagccgggtgtggtggcgggcgcctgtagtcccagctacttaagaggctgaggcaggagaatggtgtgaacccgggaggcggagcttgcagtgagccaagatcgcgccactgcactccagcctgggcgacagagcgagactccatctcaaaaaaaaaaaaaaaaggatgagttcatgtagggacatggatgaagctggaaaccatcattctgagcaaactatcgcaaggacagaaaaccaaacaccgcatgttctcactcataggtgggaactgaacaatgaaaacacttggagacagagcgaggaacatcacacactggggcctgtcgtggggtgggggagcggggagggatagcattaggagatatacctaatgtaaatgacgcgttaacaggtgcagcacaccaacatggcacatgtatacatatgcaacaagcctgcacgttgtgcacatgtaccctagaacttaaagtataataataatttttttaaaaagtcgttgttaacttcctcagccagcacagagtctgacattgagggactgtctttgtctgtttgagaagctataataaaataccataaactaggtggcttataaaccacagaaatttatttcgtacaatactggaggctgggaagtccacgatcaaggtgccagcagatttgggtctggtgagagcctgcttcctgcttcatccctggcaccttcttgctgtgccctcccatggcggaaggggcaagctagtgatactggaggggggcagcgcgtggtccctgcctcgggctccacccccaggcctgtgcccacggacctaggtgaggacaggcactcctgccttcgtgcccaaatgctgcatttcccaagaccaccctggcccaccacgcccccatcctgtgcctatcaaaactccaagaccctagcaggcagacacacaagcggctagatgtcgagaggagcacattggcggaagaagacacaagtggctggacgtgcagaaggcgttgagaggagtgcgccggcggaagagcgcacgatagacgccggcagccccaggccatcaaccggcggaacgaggtggagtttggccaggctgtcggagaagagtggggccacctaccaagcccgactccaggagaaaagcatctcccttctggctcccctatctgctgagagctccttccactcaataaaaccttgcactcattctgcaagcccacgtgtgatctgattcttccgataccccaaggcaagaaccctgagatacagaaagctttctgtccctgtgagaaggcagggagacgagtctaatggggctgactaacacaagccgcctacagacggcaaactaaaagagcactctgtaacacacgcctgctggggcctcagctgtaaacattcgcccctagacactgccgtgggtttggagccccacagcctgcccgtctgtatgctcccccagaggtttgagcagcggggcactgaagaagcgaaccacacctcccttgcatgccctgagatggggacaaggggacctttcctgtttcactagctccctggagtctcttttacacagatactaatcccatgtatgagggcaaagcctaatcacctcccaaaggccccacatcttactactaccacattggtgactgggtttcaacatatgaattttggggggacactaacattcacatcatagcagggactctggtggcctgctacaaagatggcgctccctaaccttcattgctacttgagaaggtcaattctgcccatagcgggtgagtaaccagtggaacaagggcccaggagagacagcagtgtggtggctgcaggtgagggtggccctgaatcttcctaggctaagagacatgtgcgcttcactcccactgcagcccctgcatagcccatcgaagtactcaccatgggcatggtccagtggcctgtcttctcctgggtcctcaagccccttgtgagcagagagtgaggcttccatttcagaaggcccagtcctagtatagcgccaagcctacagtggacacaaaaaaagtggttgcagaacagggaaatgtgtattattgaaattcaagcttttataattgtgatgataaaggctttgtgtggtttctaaaagctttttgtgagcatcagattcactttttaaatagcaaagtggttaaaggagggacttttatttccattttttacactcaggtttagtcggaaatttttttatcatcagaaaagaaagaaaggtatttgttttgttcaaaatgtctgggaaggccgggtgtggtggctcacacctgtaatcccagcactttgggaggacaaggcaggtggatcacctaaggtcaggagttcaaaaccagcctgagcaatatggcaaaacccagtctctactaaaaatacaaacattagccaggcatggtggctgtaatcccagctactcgggaggctgaggcaggagaatcgcttgaacccggaaggcagaggttgcagtgagccagtctcaaaagaaaaaaaaaaaaacaagtctgggaaatggagttttggtggtgtaggggagaaaaagtaagcacttttcctcacttatctcaaggttcatggctgagatccctacgacaaaagacagattaatgagggaaaaccatccatacttatttaataagttttacatggcacaggagctttcagagatgaagacccaacgaaacaggaagacctgtgcatttttgtggacagttgtgtggaaatatgattggaggatcaaagggtatgatctaatggtaataaatgagaaaagcataacaaggcctgtttgttcagattcgtgttggtgcccctgtgtgatattccttccctccgggtatagggcaggacacctgtcacatgagggtcttcaggggagaagattagactgaccttcctaggtttgatggcctgcttcagggaagaagaggtgaaaggaattcgatggcccatttcaggagagaaagggtcaagggctgtttttgtttctatggccagcttcaggagggagggggcaggagcaggtcagagagaccttcctgcttctgcagttttctcagtttccttgtgtgtccaggtgccatatttgatggtagcgtttcctgcaccccatcagtgctttaaaccagcagtgtccaatgcaaccttctgcgatgatagaaacgttctgtatcttcttagccagtacggtagccactagtttcatgtggctctgaagcacttgaaatgtggctggcttgactgaagaattgaactttttattttgataattttaattaatttattttattttttgagacagagtctcactctgttgcccagactggagtgcagtggtgcaatatcggctcactgcaacccgggtttcaagtgattctcctgcctcagcctcccaggtggctgggattacaggtgcctgccacaaagcccagctgatttttgtatttttagtagagacagggtttcagcatgctggccaggctggtctcgaactcctgacctcaagtgatcggcctgtctcagcttcccaaagtgctaggattacaggcatgagctaccccgcccggccaattttaattaatttaaattccaataccacatgggactagtcatgactacattggactgtgaagctttaaaccatcagtttctgctaatatatgcaaactctttacctgctaaagtgtgaattcattctctttattcatgcttctataaagagagcttatatgtcagttttatgttaaattttgcacactttcaattttcccacattatgtatatggtacttatactttgattgtggtttgatatttcctgtacattatagacaaacctataaaataatttctaaacaatgtcttaatcttaaatcatctaattgtggcacagtgagggaactgggaatcaactcctgaatagcacattgggcagacacaagggatgatgatgatgatgatgatgatgatgatgatgatgaagatttaataaaagagaaaccttgggccgggcatggtggctcatgcctgtaaccccagcactttgggaggccaaggcaggagtatcacctgaggtcaggagttcgagaccagcctggccaacatagcaaaaccctgtctctactaaaaatacaaaaaattagccaggtgtggtggtatgcacctgtaatcccagctacttgggaggctgaggcaggagaactgcttgaacccaggaggcggaggttgcagtgagccgagatcgcgccattgtactccagcctgggcaacaagagtgaaactccatctcaaaaaagaaagaaagaaagaaaaaaaacacagaaaaacttcacactgctagggttaaatgaaagggaaagcaggatacaacactgtttagatagcaagttctcaaatatatttaaaaatacacatagaaaaatgacaggaaatgacgggaaatatttatactaaaatgttaacagtgttggctttggtggtaaaaaatacaggtgttttcctctccctgccctgtccactttgctacattaatgtagtttccaaaattctataacgaacaaaaataatgattatctttttttggtttgtttttgagacagagtcttactctgtcgcccaggctggagtgcagtggagcgatcttggctcactgcaacctccgcctcccaggttcaaacgattctcctgcctcagcctcctgagtagctgggattacaggcgcgtgccaccatgcccagctaatttttgtattttttgtagaggcggggttttgtcatagtgcccagactggtctcgaactcctggcctaagtgttaggcccgcctcggcctcccaaagtgctgggattacaggtgtgagccgctgcaccggccctataatgatgatcttgttctttctgtttaattttactgtccctagcttcttagcatctgcggatgtttttcctggcagatatttactcaccatgacttcttccagaaggggtgttggtagctttcatgtgactatttctatttcacttttccatgtaacgagtgatgctgttggatttctctttcattaattagattttttctgtctcatccttttgctttagccacattgggattatcgtctaccgaggtatgtaacagtaagaaggctgtaatgtacatgcatagtacttttgaaaattttcctagccaaaaataacatagaggactatcactttgtttttaaatgtattttgaaatatattttggctgggcatggtggctcatgcctgtaatcccaacactttgggaggccgaggcaagcagatcacttgaggtcaggagttcgagaccagcctcgccaacatggtgaaaccctgtctccactttaaaaatacaaaaattagccaggtatagtggtgcatacctgtaatcctagctacttgggaggctgaggcaagagaatcgcttgaacccaggaggcagaggctgcagtgagctgagatcacaccactgcactccagcctgggtgacaaagcgagactctgtctcaaaaaaaaaaaaaaaaaaaaagtattttttttggtgatggtgactgtagcacatttgacctaggcaagctccacgattggtgtttgaatgagagaatgcaagtaaaacaggtcttcaatcagatggcacaatcttgaatctatctccccataggaacttccaggggatgtgaagagtctaaacttggattggggctccccacactcctgaagataactataatggggtgaacggtgccctctagatgggtgtatctgtgagattattagttggtcgcccagggtggcagacattttacttatttagaatggaagatgagtggtagctgtgtgtattgaggctggattaatagctcaatttggccattgtagcaaagctgctatagacgatgcataaggactgagtgtgatcactccgtgggggcaaccacagttgcctttgaccgtgacttttctgccctgcctctctggttggctgcaggatgaaggcgaggacccctggtaccaaaaagcatgcaagtgcgattgccaaggaggacccaatgctctgtggtctgcaggtgccacctccttggactgtataccaggtgagtatcccctgtccttgggatggaacagtcattgggaacaccccatttctcttcctttttcccactcagctgaattaaccccctgaacgctacccccatctttagaatgaaagatgagtggtagctgtgtgtatttattactatttattactattagtaagcctatgttaatgcgggttttctccagttggcctctgagcttcgaatctcacaatggcccctgcttcaacacatggcgtgatgtcagtgttcagaaacagctccctagatctccatgtctccaggctgggatagtacgatgggatctaactttcaatgaaatcgatgaatgagactgattgaaaataaattaatgggaggacgggcacagtggcccacgcctgtaatcccagcactttgggagactgaggcgggtggactgcttgagctcaggagtttgagactctcctgggcaacatggtgaaaccttgtctttactaagaatacaaaaattatccgggtgtggtggcttgcacctgtggtcccagctattcaggaggctgaggtgggaggattgcttgaacccgggaggcggagttgcagcaagcagtgatcgtaccactgcactctggcctgggtgacagagcgagaggctgtctcaaaaaaaaaaaaaaaaaaaaaaaaggaaaagaaaagaaaagaaaagaaattaatgctaggcagcctggaattttgaaaagagcacaggctctagagccaggaagatgagggctggaatcctggctgtgtcacatctgaactctgggactgccacttttttccttgtctgtccaatggaggtgatgatagcaccatgcctggatactgcttgctcaccaaacagccatgtgcttccctcccattgcccagcccccttgtaattaatcaggtggtgccatccaaacagctacagccaaggtgagcaggccactttgaaaatggcactgaagggctggcactcaactcttcagctctccctttcctgctgtgaagccacctgttgagatagtggctttttctgcaacctggtctcaggctgatcacgtggagcagaactccctgcctacccacggtagaccagttgcctgagtgaaaaataaacctgtgttttgtggagcctctgaaatttccaggccaatttgttctgcagctgatttagcctgtgtctaagacaggggccagcaaactttgtaaaggaggagagaggaaatatttgtggctttgtggaccaaataatctgtcacaactagtccattctgctcttgtcttggaaagcagccataaacaatatgtaaatgctcaagcatggctgggttccaataaaactttatttacaaaacaagcagagggccagatgtggcccatgggtcatagtttgttgacctctgctctacggggttgtcaacaaggaataaataagatgaggcattaaagcagcctgtggggtactagcacactgttgaataaaggttggtttctttcctaccagcctcctaagagctcacacactgaggagggagggagcagatccaattttcagaggcttgggcagtcgctgcaaatatttgcaatgcttaaatcctttccatgctcagagcttgttttgcatgaaaccggccttgctgcctctccagggttatgatggtattgtgccacttcatttactttacacaattgcctaataatagcttcacaagagacaggtttgtgtgtctgtgtgtgaggctcttttcattatttcattaaatatgcattaaaaaagcaaattgcaatgtgtgtgtgggagggtagggtacaatggtttctactgcgtgattttcctattttctgaaggggaagtcatttctgaactaagtttgttttccaagggaactatggggtcccaatcgtgaggaaaccggtgggcttttcctatcagacatcccctcaggctccatggcatgagctcacgcagccattaaatgttggtatgattggctcagtcaatactgacgcaccctcattaataatccatttataactcaattcacccatctttcaacatgtgcctatgatgtgtcaggcactgacaaggagacagaaatgaaggcattgtctccaccttagagaaatttaccattcagtggtaacgaatgttcttttcactagagacatgagacctcctggaattccattccaagtaagttctgtctaagaagaaattgaaaagacattgtttatgtggattggcttcatcgacccaatctagtttgatacttcaagaaagggccatgtgcagcctgggcaacatgacgaaaccccatctctagatggggggggcacggtggcatatgcctgcagtcccagctactcgggaggccaaggtgggaagatcgcttgagccctggaggttgaggctgcagtgagccatagtcgtatcactgcactccagcctgggcaacagccagagaccctgtcccccccaccaaaaaaaaaaaaaaaagagagagagaagagtcatgtgtttgagggatgtgatattgaccctggtccccaaagctgtctcccctacacagctgtcatgagcttgaagttctaaaattagaaattcttttagcttaagtgttctcctctctccactattttttgggttttgttctttttttatttttttattttttttttgagacggaatctcactctgtctcccaggctggagtacagtagcgtgatctcggctcactgcaacccccacctcccaggttcaaacaattctcctgcctcagcctcccgagtagctgggactacaggtgcacaccaccacgcccagctaattttttgtattttagtagagacggggtttcaccgtgttgcccaggctggtctcgaactcctgagctcaggcaatgcacctgctcggcctcccaaagtgctgggattacaggcgtgagccactgcacctggccctggtttttgatcttaacaacacagatattttcagaaaggaaaactcaacctcagcgttaatggttgattcattggtgttaattggttcttccatgagagaggtgattcagggcattgggaccagccgcaggcttgcagaagtcacttgcccgtcagtgccgcattctcatggtatgtcaggagcgcagcttggtttacctgggccctgtgaatcagggcttccctcataacgtgtctcacgaagaaagagaaccctggaaagcacagaaggacagcggggtcactcagagctgccaggagcgctagcaggtgcactctggctaatgcccgggccccccacggagcagaaggccacatgcattctggcctcctaatcttcactttaatgctattaaaaatactaaaagctctgtctcttccaccgttgagccaagattaccccggcactctgagagcaaaaaatagggtagggaaattatcaaaagtataagaaatctactggtttgctaatggttccttttgattctagattttctattctatatgatgcttgagcttatgatccattcttccagaaatattattctacatattttcttctgtactctactatattgtcacatatattcaagtctaatatctatgcataacactattcacatctgtctggaatcttgtgttaagaaagtccctgaattctgtgtttctttagatctgcattctttataagcctgcctacaaactcagaaagtagccactaaagtaaaaaggctagaatatgaaatatacacagccttgggctggtaacatattgcaaatatgcctttatctatctcatgatcacatcatggctcagaagagccatttgagccacagaagatgtaggcttttccctaagggtgaaatgagtatagaaacaggtctaatagctgcaacagcaaagtgacactgggtggaaaacttgggaaggtcatattctgtgtgtgtctgataaggatccccttagtttttttttttgaaatgtagtctggctctgttgcccaagctggagtgcagtggcacgatcttggctcactgcaagctctgcctcctgggttcaagcgattctcctgtttcagcctcccaagtagctgggattacaggtgccaaccactgcgctcggctaatttttgtatttttagtagagatggggtttcaccgtgttggccaggctggtctcgaactcctgacctcaagtgatcctcccgcctcggcctcccaaagtgctgggattacaggcgtgagccactgcacccagccttggatccccttaattctttcacaacactatttatgttgccttctagcatctactcaatttatggtttcttttgattaggccagaggtcgcagtcagtgtctacttcttccctgaggcctctgctgcctgtttcgaaatgccatttcctatgcttgtccccagtggccacccaagatggggcgatggtgtgtgttcattcatctctccatccatctgtccagtcaatacctagagagtgcccagcacctgtgggcattctgctcagctagggggagaatggggagggaggcaggcgaggggagatggcagtgaagtatgcctgaggaggaggggtgcgtgacaggtgtgaagggtgctggggaggtagcacctggggcccctcagccagctcagggcgggcagagatctgaaggctgaggcatggggggccaggcggaggggtgtggacgggaggggatggcctcagggaagggctgcaggccacatgtggacctgaaaagagctcaaccaggcccacagaaggaagaggaaaggggaagaagaagtcaggaaaaatcacaataagagaactggagtgtgctcttcttcaggacacacacagtgtgggaaatgtcacattttctatttttccacgttagaagaaatccagccggagtgccccattgtaatggcctgtgaggagtgtgcagacaggatttttgaaggtcttttctccctatttagactacatgaaccccccacgagcttgcgagggcaggctggccacagccccattggaaggcagacgtctcatgggtggctcctctccctctgagccatactcagtccgagggaccttcccaagttttctgagcgtgcccagagcttagggctcccaagcccatcccagtccagcccctcaggggaatcaggtccctctctgctgcgctcaggccctcaccacatccctgctactttagctggggctgtgacctccttctcttgggcaatgcgctaattcctggtgaggcctagatcttccaggtccataagcttaagggatgctgtcgacaagtttctctctcacatccctctctgtctctctctgtgtctctctgtctctctctctctctctctctctcacacacacacacacacacacacacacacacacacacacacacacttgctcctgcctggggcaaggacagccgaaaccattcattagtcacatgaagctggcctcattctctggagggtgtggcggggggtgcggtggtggggggacggggagggtaatggggacagaacagagtaggatagaggggcaatggatttcctccctattgagtctttgccagaaaaacatgcaaaattcaagaaggttatcaacgtagtctcacaaattcacctccaccaatgtcatgcacctgctgctttttggcaagacgctgtgctctacgaactctacaatctccaaatagtttcactcaatcttacagcaattttatgaagacaggtactacatcatgcccccatttcacagatgaggagactgagacccagagaggttaagcaactggcctgcgcacacgctgagagggtgggcccctaccccaggtgtcattggctggacgcaggcctgcttgaccttgactgcccattacaatcacctgcagctttgtccccatgcccaggccaatgatgtcagaatccctgggggtgtggcctgaacatctgcatttctacagctcctcgggcaattccgaggtacagcccaggctgagccccaccggtctagagtctctgcttaccggattgctgggttgggcagctgaaagcatcagtgcctcggacctggagtgtcgggcacatggaagtgcctcggacctggagtactggatagggagcaggactggagattggacgatgaagggctcggtttgggacgcacggagtgtgaggcttctttgggtcaccacagcagaagtattctcctggaaaatattcagagggcagtggaatgaagcttggggcccgggaggcaggcatcggctcccagacaccagctgaagccaaggtgacagtgagagcgtcaccttccctggggagtaagtacagcatccacgtctggacacacgggtctttagatcgcagagtgagccacacattctctgctgcctggacaggccctcccaggctgtcaaggccattggccctggccaggtacccctgcagggctacagaccgctctggagtgttagatgagctatttgggaagaaatggcaaaagagatgtgaaggggaaacagatgaagaagagcaaagtgccaagaataaggtgactgggagaggtggcactggctttttcccttcccctctgcctactctctcagagctagtagccctgagcggggcggcggcggcgggtgggggtggaaaacaaaaaggaggttcagtcatcaaatgctcaaagtggaggggcctcagagacacccaaggttagaattttgcccatgaaaaatccctgccacctggccttgtgcccctccccctgatcgctcgggcttgtcttcccagctggaggggtgtcgcgggtgggggaggagccctcgagtccgcaggcactcagtcctcgggatccccagcccacagaaagaatgtcttccctggcaggccaaggttttcaaggtgcactttcaaaagttggcttgttaaaaatgcaattgctctggggtggagtcctggaaactgcattcttgagtacttgagtactcaataaactacaaattctgtgccctcaccctcagacccacagagctgcagatactagtgagatcaggcctattcctttcgtgcattggggcagaaaggaagttaagcctccccggccagaggtctgaagctggcctgtttttagcctctggggacagggcatggccgtctctgcaagcatgtttcattcaactttactggcttttgaaaaattctggagaaaatactatgatttgccttaattgcagtttatcattcatcatcagaaaactaggagaatgaggtgggaggatcacttgagcccaggagttagagttgcagagagctatgactgcgccacagcactccagcctgtgcgacacagcgagaccaggtctctaaccaaaaaaggaaaatatatttgccatttgttttctgtagaaattcagttaggaactgggtttggttataagcacaagaccccctaaatactggcttattgatttaggagttttaactcacatggtaaaaaaaattaggggtagggagttataatacttaaggttatcaaggctaaggtctctgtagttttcttttttttttttttttttgagacagtgtctatcacccaggctggaatgcagtggtgtgatcatggctcactgcagccacagactcctaggctcaagcaatcctcctccctcagcctccccggtagctgggactatagacgtgagccacgagatggggtctccctatgttgccccaggctggtcttgaactcctgggctcaagtgatcctcccaaagcactgggattacaggcatgagccactgcactcagcctctgcagttctctcggccttacccacatggtgcaagatggttactgtcacaccaactatcagatgtgatctaggcaacaggaaaaaagaaggggcaagcaaaacctgaccagaaatcccagcaggcagtctttatgtctcactggtcagaagttatgtcacctgggcacttctaactgcaaaggaggctgggaaaggccctttattcagctggctacattgctgctcccaataaaaggagagctctttagtcaaaaagaaggggaggctgggtgtgatggctcacacctgtaatccctagtgccttgggaggccgaggcaggtggatcccttgagcccaggagttcaagaccagcctggggaacatggcaaaatcctgtctctacaaaaaatacaaaaattagctgggtgtggtggtgtgcacctgtggtcccagctactcagaaggctgaggtggcaggatcgcttgagcccaggaggcagaggttgcagtgggctgacatagcagcaccgcactgcagcctaggacagggcgagaccctgtctcaaaagaaaaaaaaaaggagaagaaggggagaatgaatgaatactgggttgaaaattggcagcctctgaccaggtaactcgacactgtgcctgccactgcaggcaccacctcggctcactgaaacctctgcctcccgggttcaagcgattctcctgcctcagcctcccgagtagctgggattacaggcatgagtcaccgtgcccagcctcaacaccgtttttactgtgaggggacatacagacgagaggaagggggagacaatcaacacagaagaaccacctttgggtactaccactgggaaaaagcagttccttttagctgtttctcactcaacagtcccccaagcacatttcacccattttttttttcattagactggtgagaaaactgcaatttacaagtaggaagtcattctctatatctcaatatgtcatcgcccttcttgcgtctcactgtggttttgtccctataattggcatgatctgctgcccaaggacaacaagagacctgacgtcatgaggcaggatggctaaatctgtgttaatgggggaaataaagatgtatggcatttaaatatggtatttcactgtgcacctcttggtttttagatctctaagttggtggaggaggtgaagtatttctcaaaattccacacaccccttgtgaagttgccatagagccacttccctctgcttttacaaaggctgttgagtctctatggcaattcctttacttcatccttcattcctttcttgcgtgagtagtgaaccgttgaagacacagctgtacccattgtgaaccacagagacaggtaaagccttctccgtctccgaagcgcaaagcagatgggtttgttttgttatttcagtcacctggtgcttgttgagtattgagatatgtgtgaatgtgaattctttttcctttcccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtaagcagggcccggggattttttttcatgtgcttttaaaaaaaaataggcctctctaccagcgtggccaacacagtgaaaccccgtctctactaaaaatacaaaaaattaactggcgtggtggcacgtgcctgtaatcccagctactcaggaggctgaggcaggagaattgcttgaacctgggaagcggaggttacagtgagccgagatcacaccactgcactacagcctgggcgacagagtgagaccctgtctcaaaaatgaaaaaaaatataggcctctctaataaacaaatgacacagaatgtacttatgagtgctgggggagagatgaaggaagaaagacctcatccatgcagccagggaaggctttctaaggaaaacatatttgacctgtggcttgaagttggccaggtgagggaggggaagaggcgtggggtacagcaggtgcaaaagccctgagtcgggatgatacctccagggtgtggatggggaacataagcagggcagcaagcctgaagcacaagtgagacaaggtggagaggcaagcggaggtcagatggtgcaggaccttagaagccacgttaatgactgtggtccgtactgtagggataatgggaggaccctgagtgcgtattagttagcatacatgttcatgctgttgtaacaaagagcaccaaagtacagtgacttaatgtagaagtgtgtttcttgctcacttaaaagttccattcatcagccaggcacagtggcttacgcctgtaatcctagcactttgggaggccgagggggggcagattacctgaggtcaggagttcaagaccagcttagccaacatggtgaaacctcatctctactaaaaatacaaaaattagccgggcatggtggcaggtggctataatcccagctacttaggaggctgaggcaggagaatcacttgaacctgggaggcggaggttgcagtgagccgagattgtgtgccactgcacaccagcctgggcgacagagcaagactctgtctcagaaaggaaaaaaaaaagtttcattcagtagtctagggtcgttatggcagcttgatggcatgcggggcccagactctaccttgttgttctgtcgtccttaacatgaagcgtctatcttggggtccagaatggtgtctctgtcttctgccatcacatccaccgtctagttagtggggagaaacaaaagagcagcagagtgcgcatgacttgcctttaagaacacaaacatattctattggccacttctgcccacatcccattgaccagagtttggttagggggccccatctagttgcaagggagactaggaaatgccatcttagccagatggccatttgcccagatgaaactcaggggttctattaccaaatgaggatgggaagggagtatcgggtgataattagcagactctgccggataaatattttaagtcgaagagtatcgcaagcacatttgtgttttaagaaaagttctctggttcctgtggggccagagcaatccagggagagtagttgaggtgtgggaagaaagagggggacacgggctagagtggtggcggtggagaccgacagaagtagaagaatttgaggcacttggagatggagccaatagatagattgggcactggaggtggagaggaggggcccaggatggttctcaggtggccggcatggacacatgcaaggatggggttaactcagagacgtggggtctgaaagcagggtggggtgggggcacttaggggctcacattgggacgtgtttcatctgagatgctgagaggcatacagaagtcctctagctggcaactgaactctctggatttggggtttagaaaaggtgtgggatagaagtgaaaagtcaggagccacccaaggaataagtctggaaaaggaagagaaggtggcccagggcttaagtcctacaaagctaattaaaatacacactaaaaggaaaaaaggaggtggcggggggaactactataggtttccacgatttatgaggaatgtagctaaaaaaacaacttagttgcttcaacggttatctggcttgacacttgtcaaagcccttctagatccacatgggtcagtgctctgcacgaggcaggaatgtcaccaaccgagggaaacacaaataggtgtgaagagagtgaaatgcgcagaaaggttcaccctgggagtctcaagcagagggcaggggctggtggtctaacagccatgcacctgcgtgttttgcagacagacatgttcaaccactcccaaaggcaatttcagccacactctgaggcatttctttgacaaattagtcgaatctggaaatcttttcttgggaggtggagatgcagggagagggagaatgagatgcaagttaagtataacggaagctggccattcctaggagacaaggctcagactgcagcccagactgcccgagcttggcagggggctctttggatgctggcatcccctcgagagccagcacctgcgggctttttgcagacatgcacagggggagtctctcggtgactcggtatgttctcggcaggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtaagttgggcttatcccaaaccaacttcagctcgcaccctctgggacttcccctcctgtccccgagctcctgtcactgccctctgtcagagcaccgactccacagcacagtggatcatctgcgctttcccccacaatgtgctgtgctctctttcctgggcttgctttggtgcccagcacagtttgtttgcaaatgaatgctattcttaagctcaaaaaaaaaatttgtctgagtttccatatcagcatgcagttgcctgaactcttaagactgaccatttggactatttcaactcactggatcattgaatgcactttgcttcacgggtatggtctgatgttattgatgtgggtagagaatcatccatttatatagatgtggcctctcctattgtttgagactgacagaggggagccttttgagaacctagcaagttacccattagccaaatggttaaaaggacttcaccagcacaaacacagacgaacttaaacctttgggcaactctacatcctattaatctttgtggattgagacagaagtcttcttcaccattgactaaacgcagtagactcctgactatatatatatatatatatttgctatgaataaaaatgaattaaaaactccctagctctttggaaatggtaaacatccttttgcctaagagtaaggagttccccaggctaatttcaacatttaatcaggttaagtagacatgtacagctgagattcagaaggctttgtaagtctctgatgacaatttgtacggccaagacgttcatgggttgttccaaggagtttgaacacaagaggaaaaaccatcttgatacttggacatttaatttcatttttattcttattagctggcctcttcaaaagacatgagaagtttttcaagccctgtgcttctgaaggccttgaaggttctttgcaaagaggcacttcacccctgcacttgtgcaatctggtggagcctgttccaccctcccctctcttcacctggctcctgacttgaataggctcaaagacaaactgcaatagagagggtggtgtggggcggtgccactgcggagaaaggcaagaacatggcagaccaggcccttcccgttttgtggatggatggggccaaatgcaacagccagatattttcaggagataatcccagaaggagatgaaatgtcctagtggcatcaggcagagcaccatgactttggtaagagggcaaagaatgatttctttggaaatggcgtcaaacacccacagcatgtttttatgttacatccttaaaaacactaagcaaaccccctttctctttactctggcaccaccctcccctttccagaatcttccttcgagtttttatgtctttttgttttgttttgagatggagtctcactctgttgcccaggctggagtgcaacggtgtgatctcagctcactgtaacctccgcctcccgggttcaagtaattctcctgcctccgcctccagagtagctgggatttacaggcacctgccactgcgcctggctaatttttttgtatttttagtagagacggggtctcactgtgtgttggccaggctggtctcaaactcctgacctcaaacgatccgcccgcctccgcctcccaaagtgctgggattacaggcgtgagccactgcgcctggccaagtttttatgtctttttaaaaaaacattttccaagttggaaaggtactcatcacttgtatcaaagtaggaatacacatttaagttttggcttacaactcctgagccaagcacgggttttcacttgagccctactttggatacctttggaacatgtaagtgtgatgtgggccttttcaaaatgtcaaaatgcaaaggataaaaactcaaaagcgatgagtcaagtggcattttctagcagcaccctccaatagaactttctgtgatggaaatgttcacatctgcactgtccaatatggcggccacttgaaatgtggctcatgtgactgaggaactgaatttttatctaattttaattaattgaagtgtaaacagacatattggctagtggccaccctattggatggtgcagttccagatgtcccaagcatgtaggtgtgatgacaatcactcaaggtcagattttggggggcacccgcaaactgctttaactacttcctaatcatttctatagttaaaagttggggctagctccagaaaggaacccttcttccttttccctccccgatgtgatggtgacaggatttcctctatctctctaggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagacagaaacatacagtttcctaaagcctggctttgaatgcagaagggagcagctcctcctagttaagtttccactaaatcatcgccaaagaggacttcagagccctggggaggcagctgagggtctcaagggtgactgggtggcagggatgagtgcggtgggtgagaatcccggtgccctgagaggctatacgtgacaaatgaccaaaagcccaaggtaggggagtttcctctgctcacagttcttaccttcaaggcggatctgggcttccaccctcatgaacacagggattggggagggaccagagcgcccaatacacacagctccattatgcaatccattccagcaaattccccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgccttagattgggaggcctcattggccacttagagcgcagcctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaacccagcatctttctagtccctatgctgtatgcttgaacttcggaaaatgcttttccccgcccaatcttctctcaaatataaacacatcacacagggtgttgggggtggggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtgtacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagtatgtggt

SEQ ID NO: 3155 - DNA, 228046 bp, human; identical to SEQ ID NO: 3146

SEQ ID NO: 3156 - DNA, 211437 bp, human; identical to SEQ ID NO: 3150

SEQ ID NO: 3157 - DNA, 8613 bp, human; identical to SEQ ID NO: 3153

SEQ ID NO: 3158 - DNA, 32199 bp, human; identical to SEQ ID NO: 3154

SEQ ID NO: 3159 - DNA, 228046 bp, human; identical to SEQ ID NO: 3146

SEQ ID NO: 3160 - DNA, 211437 bp, human; identical to SEQ ID NO: 3150

SEQ ID NO: 3161 - DNA, 32199 bp, human; identical to SEQ ID NO: 3154

SEQ ID NO: 3162 - DNA, 21999 bp, human
ttgctcaccattctcaagcttgaaaacccacctgcaatcatttgggcgggggggggggggcatctttaagcgcccaggtgaacttggtctgcaggcagcagctgtccttttctctggatcttctgctgaggtcggtaggttgataagtgatactgattttgtggcaggaactcccttcagccaactcctgtcttcctgggaaggcctctggaagaaaccaggtgggtgcagggaacactaaggtggggatctggatgttcgtcttgatttggccattcatgagctgggtgctcgagctagtcagttcacctctggtctcagtctcctcctttgtaaatacaagggttggactaaacacgtcccctttcacctctgggtctcaatgttatgcccatcttccacgtaggaaaacggaggcagttatctgccatgtaatcccccccacacacacacccccgccccccgcccagaagtagaggcaggccagctagtggcgtgggtttttctagtacccgtttcccgatgtcctcagttagctccctgtcatattcatcatggggcccccttctagtctgcttttttggtgagacgttttcagaggcctctcgagcgcttgatgcctagattgtgggccacgagatgaccagagtggccagccaccggccggaggatacgttcctgagagctccacgtttcccactagtcagtgagcctcaggactcctgggaagcctgataataagtgtatcccacctgtttccaacccctagcggtcgaaaacaagactgccaggaactggccctaaagttacacccactggttgtgttttggatggtgtctctaggaaatgctttgctctccagccccccacatcccgatttttctgtctgcccctgggtataaaggtatgtttgccaagttcccacacttaacctctgtgcagaaaagaagctggtgtccctctgttgcatgcttaacctctgtgcagaaaagaagctggtgtccctctgttgcatgcgacacaggtatctgcctttggtgaaaaactcttgttccttttctccattccaggagggaaactgtgttctgttctccccgccgcccctcgcaaggtgtcatcacaatctttttttttttttttttttttaagacggagtctcgctctgttgcccaggccggagtgcagtggcacgatctcagctcactgcaacctctgcctcccgttcgagcaattctcctgcctcagccacccaagtagctgggattacaggcgcccccccaccatacctggcctactttttgtatttttagtagaaatggggtttcaccatgttggccaggttgatctcaaactcctggcctcaagtgatccgcccacctcggcctcctgaagtgttgggattgcaggcgtaagccaccgcgcccggccccacccagctcaaattctgtggtcatttttatcacttgcttgtttgccctttcatttcttccttgtgcttgttggtaaaaccacaatctcttacatctgactgtctccctaccctgcccctgaacatggcccaagaagaacacatccaagctgactggtttcacactaaattcatgactgcttagctcaagtgaaccctttctgcagtccagaatacgtgtccacttctaaggacggtttcatgtcttatctccgtaaacctcctgtacccccaaccctaatctcggttacagctgatgatctagcttcctattgcggtgaaaaaatggaagcaatcagaagagaacttctggaagtcccctgccagccaccgtctgctctcgtgctcttcctctggatcaggatgggttgggactggctaactctgtcgtaggaggctgtcccgtgtattgtaggatgttttgcagcatccctggcctctattcactggatgcgtgtagcacacatcctcccccaccacccagttgtgatgacccaaaatgtcccctgggggacaaaatcttgggagttctttggcaatatctggagacgcttttgttggttatgactgggagaggggtactataggcacccaggagggagaggccggggcgctgccaaacatcctgtggtgccagctactctgggggagtgaggcgggcagaatcccttgagctcaggaggtcgaggctgtcgtgagccatgattgcaccgctgcactccagcctgggtgacagagtgagaacctggcaaaaaaaaaaaaaaaaaaaaagccgggtgcgatggctcacgcttataatcccagcacttcgggaagctgaggcgggcggattgcttgagctcaggagttcaagaccaggctggccaacatggcaaaaccccatctctataaaaaaatacaaaaaacttagccaggcatggtggcgcacacctgtagtcccagttactctggaggactgaggcagggaggatcccttgagcctggggaggtcgaggctgcaacaagctgagatcgcatcactgcactccagcctgggcgacagagtgagaccccgtctcaaaaacgaaaacaaaagcaaaaaaacaggaaaaaagctcttaattccacttccacctgtgccacttccatgtctctgctctcctttataatacagttcttagattggtctggtgctctctccagttctgtccccccactgggacttgttccagcactccaccaaaattcctctgatccagtgatttccacattgctacacagaatagctcttccttttcatcagatttgatctactagcagcattgaaaacaacccatcactctgttttgaggtaccttcccctcggcttttaggatgcggacctctcgcgatgtttatttcctctcactgcatactcctttttggtcacttttgctggagcctcatctctttgacctttaaacacagccgtacctcagaggtctcggtgcttggacttctctatttgttctcaccaccccagcgacctcattcaatctaatggctttcaatacccttgagaacctagaagattccagtgtgtatctctagtctagacttttctctcaaactccagacctacatgttcaacatctccatttagatgtctgttaggttaggcatctcacatgtctgtgtccacgcttctgatctctgcccctaaatccgcttctctcttgatctgtttttcttttttggagacagttttgctctgtcacccaggctggagtgcagcagcgccatcttagctcactgcaacctccacctcctgggttcaaacaattctcgtgcctcagcctcccgagtacttgggatcacaggcgtgcgccaccacatccggctgatttttttctgtatttttagtagagatgggcttttgctgttttggccaggctgttcttaaactcctggcctcaagtgattcacccacctcggtctctcaaagtgttgggattacaggcgtgagccaccgtgcctggcctctgttttctttatcgcagataatggcagcttcatctttccagctatttaggcctaaaactaagaatcatacttgattcttctttttcttacacccccagtgtaatcttactagcaaagcttattggcaccacctgcaagatctatctatgctagctttctgtcatctccccagctacactctaatcaaagccactatcacattttgcctggatcatagccagtagcctcagatcttggcctttcagcttctgccctttcccccctacagactattctccacacagtagccagagtggtcctttcaagattcagattagctctcatcattctgtgcaaaacccttcaatggctccctacctcaactagaaaagctgaagccttacagtggcctacaaggcttgtgcctctctggttataaatcctcttactggccaagcacagttgatcatgcttgtaatcccagcactttggaggccaaggtgggcagacacttgaggccaggagtttgagaccagtctggccagcatgatgaaatcccgtctttactaaatatacaaaaattagccaggtatggtggcatgcacgtgtaatcccagctacttgggaggctcagatgggaggatcgcttgagcctgggaggcggaggttgcagtgagccgtgactgtgccattacaccccagcctgggtcacagagcaagaccctgtcctcaaaaaaaaaaaaaaaaaaaatcctataactttgcctttgctttgactgcactccagccacaccggcctgcttgctgcccttcagttacactaggcctctcctgcctcggggcctttgctgctgctgctgctgctgctgctgctctcagcctcgaatagtttttccttagatcacgctgttgcttgttctctcaccttgctcgggtcatacccagatatcttctcagtgaggcctttcctgactgtctactgaaaattgctattattcttttccattcatgctagagactcactgcccccctttcctgcttatttttctctgcagcactaaatttcttctctttttttttttttttttgatacggcatctcgctctgtcgcccaggctggagtgcaatggcgtgatctcggttcactgcaacctccgcctcctgggttcaaatgattctcctgcctcagcatcccgagtagctgggactataggcacctgccaccacgcccagctaatttatatatataaatatttttaaattttattattattatactttaagtttcagggtacatgtgcacaacgtgcaggtttgttacatatgtatacgtgtgccatgttggtgtgatgcacccattaactcgtcgtttagcattgggtatatctcctaatgctatccctccccctccccccaccccacaagagttcccggtgtgtgatgttccccttcctgtgtccatgtgttctcattgttcaattcccacttatgagtgaaaacatgcagtgtttggttttttgtccttgcgatagtttgctgagaatgatggtttccagtttcatccatgtccctacaaaggacatgaactcatcattttttatggctgcatagtattctatggtgtatatgtgccacattttcttaatccagtctatcgttgttggacatttgggttggttccaagtctttgctattgtgaatagtgccacaataaacatacgtgtgcatgtgtctttatagcagcatgatttgtaatcctttgggtatatacccagtaatgggatggctgggtcaaatggtaatagagatgggatttcaccatgttggccaggatggtcttgatctcttgacctcgtgatccgcccaccttggcctcccaaagtgctgggattacaggcgtgagtcactgcgcctggcctgcagcactaaatttctacatatttactaatttattttgttgattgtccccaccatcctcgactggaatgaaagatccatgagggcatggatttggcttcattctctgttgtattacgcagagtctaaatagtttccagcatatagtaagtgctcagtgaatatgtcttgaaaacaatgtgtcagtgttgagggtgactcaagccagggcaatgagttccagtaagagctaatcctggatttttgcttgacttcttgagcagagacgtttcctaattcaccctggacttgaacgtgagatgatgtagaggctggcacttctgctgccatcttactattgcgttatattagggctcttggttgcatacaacagaatcctcttgttcaaaatattcacttttcttccccatgtaggattttgacaccatggtcccccgatagacttgcccaggtggctttgctttgcccagttgaatgtgagcagaagtgatgagtatcacttccaagcaaaagtgtaagagccagtgtggtggctgcttctgtccttcccctttgctgcaagaagaacagcaatgccccatagacaggttggcctgagtttcagagggaaggctccatgttacataactgcagcccatctgcactgtccgcggaactggagtgcaaaacaaacctttatcattgtaagccactaacgtttggggttgttacgaaagcataacaccacctaagcggcttcaacactcccacaagtttaagaggaaaaggagtttattaaaggacaccagatggctcacaggatctccaagaaggcctcggtgactccaaagccaggaatgatgtccaaatctcactgagggactgcaccagcgcaggtgcgcactgctgcctcctctgagtacatatttagtaagtcacaccagtgttggagcccagaatcttgaccactgctgtctctggaaactggacacctctgccactaaccttggcagtagatggcctttgggagccctccacgtcttcaggttgccctcttctggattgaagtcgctggcagagctgagtttacctgcctgtgctcttgctatcaaagaggctggaaaagcaaatttcttgtttctactttggcgagttaggagtcaaacaggaggaattaccaagacatagggaggaggttcagaagttagtgaatgaccatgaagcatgaaagacgtccacgacctgctggagacctgaggatggagcggacaccaagggatcccagctgagcaatagagcagctgggtgccatgacttacgccccggccccagtcatgcatataccattgactcttcagttatttgaggaaaccattcctagctttgcttaagccagctggaatgggcttactgacacttgcaatggaaagagtcctaatgatctgtgtctcaaatggatgagcgttggcacagtggctaacggtggtgccctggctcggatgcctgaaagttttggttgttctcagtccccagtaagtggggatgaggctgacagttatgggaatggccgcttctggtagggtaggtgtattaatctgttctcacgctgctaataaagacaaaccccagactgggcaatttataaaggaaagaggtttagtggactcacagttccagtggctgaggaggcctcacaatcatggcggaggatgaaggaggagcaaagggacgtcttacatgctggcaggcaagagagaaatgagagccaggcaaaaggggaagccaaaaccatcagatctcatgagacttattcactctcatgagaacagcatgggaaagacctgccccatgattcgattgcctcccctccgggtccctcccacgacacgtgggaattgtgggagctacaattcaagatgagatttgggttgcagcacagccaaaccgtatcacctgggttgtggtttccctgtctgctggggagccagtagttctcatgtacagcagggcgcttgctcacgtgtggcacagtaaccaggccaggtacaattatacagtgggcaacatgtctgtgtcagatagtgctagttgcttatctactagcagatattgaggaaaagaggaatatccgttcctcttttcctcaataagacaagtaaaaacgcacagttgtacagtgcttgctgtgtattagggactattctaagtgcttcactcgtattaactcattgaatcctcatgagaaccctgtactattatcatagtttgcaggtgaggaaatcgaggcacagagtaagttggtaacttgaccaagtcacacagtgacataaagaagcaaggttctaagcccagaccatctggctccgtgggctgtgcttagcctctgcactatagtgcctgattttgtttgctttggtgatgtgtctggctaaaacagcttcatttccttgaaaggaggtagacccatttggtatccccccttttgcccatagttcatctctttctgcctggaacgtgagtgtggtgctagaaggagggcatcactttctgtcgtgattactattttgcacccatgagttgacaattgggaagaagaaagctgcatggcttggcctaaagaaggaaggtgcctgggtcccagccccagattccctactccagattccttgtgaaatgaataataaaatccctcatttttaatgctactgtttagtagaagtttcagttatatgaggaaaaatacagatcctactgattgaacctttgcacatagctcacccgtagctctctcctgtaccattttgacaatgtctttaatttgtcccccagctaccaagggcttgccctgtgttccagtcccttgatggaagttgttcattatcacatgcctgcaatatgtctgggaacacagtgttgggtagtgcgggagcttttttaaaaaaagtatatgacatggcctcatctcaagaagtctgaagaacatgagttaacccaaaggactcatttgttccagtatgttaatggaagatagtggcttgatgtggttttcctaatgtaggatgttactagatctgaatttgggcccggtctcctttctcttaaagaagaaacttgacaaaagagaaggctgatgagggataggcagggtgataagcaaaaacctgtctaataggaaagaaggcctcacatggtatacctctccagaccagctatctataaccttcacaatcacccacgatcactttcagtgagattacatttcctagagatggccactcgagagagaaacagatgagcttagaatgttttgtctccccctctcttacttaacctatcttgggatgtgtctagtatctttttctctctctcttttttttttttttttaatttgaggcagagtctcactctgtcgcccaggctggagtgcagtggcacaatcttggctcactgcaacctccacctcccgggttcaagcgattctcctgcctcagcttcccaagtagctgggattccaggtatccgccaccacgccttgctgatttttgtattattagtagggatggattttcaccatgctgcccaggctgatcttgaactcctgacatcaggtgatctgcctgccttggcctcccaaagtgctgggattacaggcctgagccaccacacccggcagagatgtgcctagtttctaaagtcactcccctgtgactaggtaactgaacacagaacaatttgactactactgcccactcctctagagtcccatttaaaaggcaacacctgatagcagccagtgctaattggtgatggaaatggaatgggttactccctcgactcccacaacacttactgcctgatttgtttccacatggattcaactgggcacgcaataagacttgcctctaagctttctgcacagtctgagggaaagatttcaagtgtggtgcaggtgttaaactccagtcatattgtgtatttttactaatgatttcaagaattggggatcttttggatacaatttgggtagagtcctaaggccatctacagtaataaaagcaaaaccaattagtaggttgtttaattcatttagaggctatctgcatgctagcagttttcctctgctaaatcctgttaagatgcagtgggttctgccaggcacggtggctcacgcctgtaatcccagcactttgggaggccgaggagggtggatcacgaggtcaggagatcgagaccatcctggctaacacggtgaaaccccatctctactaaaaatacaaaaaattagccggccgcggtggcgggtgcctgtagtcccagctacttgaggggctgaggcaggaggatggcgtgaacccgggaggcggggcttgcagtgagccgagatctcgccactgcactccagcctgggtgaaagagcgagactccatctcaaaaaaaaaaaaaaaaaaagaaaaaaaagcagtgggttctattttgtgcagacggagtaggctgccatgacaactgtctgtgaatattatttcaatattagtcatacatttctagcgtctgcttctgggctcagcgttcttctaaagcctggatacaaatttattcttaatggacctctcctggacgtgtttacaaaaagaacaaaaacaaaacactttcaactggctgactttttttttctttcagaagagaaatttgaatgaattcacacaactgaaaattgattgtgaatcttattgtcattttttcttttaaaaaggtgattgtgatgtgaacttatatggtgctggattatagattttactgaatagaagcactacaccaggatttggaaagttcccctgtaggcatgtagtccttacagtaaaattattatttttttcttctaacagtatcagaaagaatcttgtagttgcctgtggcagaagatccgacccaaactgagcaaaaccagtttcaaacgaatctggtttgaaacttccgaaggtaagatttgatccagagactaaggatggagggctccggctccatttccctgccttttggttggcccttccccatgtatcaatttcaccccctggactggctcttctcatggtgaaaccttgctcagagcaccacactagggggagataagtgagtctgtcccagcactctctccaggtaccccgagattcactcataatatctttctttagctatacgcccaccccaaacactcctttttgccaggagaagaggatatgctgtcttaggcctgaattatgtgcttgttcctgaaaagttgctgttgcttggggagtgggctcggataattggcttaagtcaaccagggcccgcgcttagagttgggggctgcgtcagtcccatgcaaatcacttggctaaaaaacaggaagcgggggtgatttcgaaaaggaaaattgtgattctattacaaggaagttaggggactatttgctagccacctggttagggaacagaatgctggcctaatgataataataatagctaacatttattgaatactatgagccaggcaccaagctgctttatagttgtattggttagagaatgtgtttggctgcctgaaataaggtaaatagaacaccaggggcttaacacagagcgcttggttttcgtcccacatgatacgaagccaggagatatacagtgtcacattgtcatccaggtctcaagctcgtccctccatcctgcatccatcctgcatcatggtttcgctattctcagtgtgaggctttcttcctagtgtgcatgagatggctgctcctcctccaggcattgtgtcctggttccaggcagaatagggggaaggacaaaagagaagaggcttatgccagctgagtcttttcctttttatcaggaaaatagcttttctggaagcctcagcccatagatttctgcttgtatctcaagggctagaactgtgtcacatgactacccatagttgcaagggagcctagcaaatcaagttttgttgcccgaacactgccacctagaacaaaacgggggttttattagtaaggaacagggggagaatggacagtaatgatcagtggctgctacaatgtgtgttaacccattcattcgttacgtcaacccagtgtgattggtgctatctgtagcctcgttttatagttgaagcaataggcacagagaggttatgtaatttgcccaagctcacacagagctgttaagtggttgagcaagaacttgaacccaagcaagctgactctagaatctaattctattatgtccctagacacatcctgacccactggccagaccacatttcttctctaggatgtatatccacttgggaaatgcaggcctctcctggaaatggtagctaatacttgtttagcactttatagtttacaaagagattgccacttaaattattctctttaaatattcttctttttttttttttttttttttgagacagagtctcactctgttgcccaggctggagtgcagtggcacgatctcagctcactgcaacctccacctcccaggttcaagtgattctcgtgcctcagcctccggagtagccgggactataggcgcacaccaccatgcctggctaatttttgtatttttagtagagacggggctttaccatgttgtccaggctggtctcgaacttcagacctcaagtgatccacctgccttggcctcccaaagagctgggattacaggtgtgagctacagcgcccggcctattctcatttttaaaatgaggaaactgaggtttagaggagttatgtaagttgcctaagatccccaggttgaaagtggcagagctgatatttcctcaaaattataaaaacttactccagtttccctttcttaatcttcctgttcttctctgcacagaggagttcatttctagtttttttaaatggcaatatttcactttaggccctatattaacttcataaccttctcacgaaaaccaaaccagagaaatcttggctctctcgcctacttgttttcacataggccaccaggaggaatgtgccacatcagtgggaactgtgacagaagtaagtaatggaggcctggaaagggaggtggtttttctctcacatcatataaaatccagagcttccgtcagaaaatgaaagtgttagttacaaatagctcttattgacctgttaaagagttattaaacatgtagacattgcttctcattagttacatcagattaatttgttacttttctttaaaactatttcataaattgaacttgtcactgagtaagaattgacagcccacttcactgggataaattagagaagtttcactacattactgacacgtcagtttgcttatgattattatttctctcgttctttccaagtctttgaaatctttagcttttggcattgctttatttacatatcacaacattcttttgttttggtcttactactgagtaaaccataaaaattaattgtagaattaatacattttagggagacatgagaattcaatcaaatacatttaagaaatacattggttcagttcagaaaggcaggacaactcgaagcaagggggaggaggggcgtggcttccgggttataggtagattgaaaaatgttctagttgacagttggttgagtttatccaaagacctgggatcagtagaaaggagatgtctgggttaagggactgtggagaccaaagttcttattgtgcagatagatgaagccttcaggtagcaggcttcagagaggacagattgtaaatgtttcttatccgtcctaaggtctgtgtttatattaataccggagaggtataatgaggcatgttggacctctgcttctcgtcatggcctgaagcagtctttcaggttaaattttaaagtgccctggcctaggaagaagtccattccaatggttgggcggggattaaaatttttcttttggtttacactccaaaagctatgaatgaggccaggtgtggtggctcacgcctgtaattccagtgctttgggagcccaagaatttgagaccagcctgggcaagatggtgaaacgccatctctgtaaaaaataaaaaattagccgagtgtggtggcgggcacctgtagtcccagctacttgggaggttgagtgaggaggatgacttgagcccgggaggtggaggctacagtgagctatgatcgcgccactgcactccagcctgggcgcgatcatagctcactctcgacagagtgagaccctgtctcaaacaaataaaaataaataaataaaaagagtactgtgttatagagcagtgcccctcaaagtatgcttcactgtcacctgggagcttattagaaatgcagcttcacagccccaccccagacctactaaatcagattgggattcagcagtgattgggcccgggaatctgtgttttgacaagatccctaggtgacttgtaagtgcattaaagtttgagaagtgctgttttagagttttacgcaaatgagttgtaagactgacagattgtgcaccctttaaattttggtgaaaataagagcttcggctttagtaaattagacctatattgaatcctggattctcctttgaaagtctcccaatcctagtctccagttagctactccgggtcacgagccttagctcaactgtatgcttgactccatcccccatcaacaccttcacctaattaatccacattcaaccttccactgtcaggtcaaagatgacttcctcagagaaggctttgctcgaccccccacctcactctcataaaatgaatacttgtcctttgcaatttcacatttatgattatttgattcatgtttacttctcctactagcctataagctttaggagggaagagaccttaccagttttgctaactggtatatccccagggtgtagaacagtacccggcacataatagatgctcaacaaatatttatttaatgaatatatgaatgaaaccaagccaggaataagtgcacaaaagaaaatgctctgaaaatgttttccaaaggcttctccgtgaacttttaggcatttgaggcagtaatagtgagggttttgaaaagaaagccctggatattttctaggacttgttttttttttttttttttttggcggggggcaggcgtggaacagagtcttactctgtcacccaggctggagtgcagtggcactgtctcagctcactgcaacctccacctcccgagttcaagtgattttcctgcctcagcctcctgagtagctgggattacaggtgcccgccaccatgcccagctaatttttgtttttagtagagacagggtttcaccatgttggccaggctggtcttgaacttctgacctcaggtgatctacccgccttggcctcccaaagtgctgggattacaggcatgagccatcgtgcctggcccaggccttgttttatcaacattcctccaagaaacaaacttttctttgtttaccatgttcatgaacacaaaaatagttgataaggaggcaatggtgacaaaaagaaagctggaatctgcctttcaataagcaagaaatagtcctctcatccaggtcatgtcgtccacattccattggcaggtattgtcatatctgcatcctacattgtgaggtcaccaaggcaacctattaatcattctagaatctacctcttgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggtaagagaagagcacttagtggaccaggtgaatggagtatgatccgggtaggcatgggacaatgatcgaaagttaacctgtggcctctgtctgtttagttgtttagcccaactcttgtggtctttatgttttatgtatgaagtttgttaaaagctttaatatatatgtatagggtgaaactgggtcaccttgatgtgctggtcactgagtcacaggactgtgactttggggaggccacctaacttctctgggcgtggtttcctctcctataaaatgaagatgtctgaggacctttctagacaagtccgaaggatcagagtatcttaccacatttcagcctcacctgttacagagctctgggcagagaacctcatgatggtcttgcaaggtgactccattctctgtctagatcagttttgcccaattcccagtgctttaacatgagagggagttgcatcagtgtgtagtctttgttttacttttgttcttggaatggcagattgtagctcctgtagaaggaaaagaagaagaaataaggaattagcattgctctacattgactcatgctagatgtcaatctgagatacatgtaaaacgtaagcacatacaagataaagaaacagattgtggcaatatttaaaaatatcctagctttctaaattagaagcagttctgataagcctatttggaattcatgcaaaacatccataactctgacagtctgaattgtacatggcaaaggtaaattgcttccaggcagtaattctaggtgcaggtttagatggactatacggtaatcaagtctccattgctttacagatagccctcactccttggcctcttactttccagattgcttctttgttagcctccctgttggctccttcctcttttcattctctttaatgtctctattccccagtgttctgcttttgcctctatagctttactctataagctctccctggctattttatcttctctaatcacttcagctattgtcagcaacctgatgacctatttaatctgactctctggtcctgatttatttcctgagctccaaacccaggcttctcctgcctgtgggatatttcaacagtgaggtctcacaagtactgaaatttagcacactgctgactgaactcacgatttttctccaccataaactcgcttgtcccccttcatgtccgactcttgtaccctttaataccctattgcaatgaatatcatcatctcttagactgtaaattataagaaggcagaaaccatgtctatcttgtccaccccttgtaaccacagcacctagcatagtgcctggcacatggtagacacccagtaaatattgtcaagtgaatgatgaatctatttattcttccaaactaaaaaccctggaatcctcctcgatgtctctgtctccctcactctccatgcccagtctgagacctgtggggtttgttacataaaacccttttacatttggctccttcttccccttcatccccgctgccatgactttaattcagcccttaccatctatctcctggattattgcaggagcctcctcattggtcttcctgttacctgcttttccccattcatcaccatctgatccccagagtgatcttgcagcttgaatctaatcagcttaccctcaggctccccttgacttaaacagagtttgcaatctggcagctttaagcggaatccacgcagtctgtacggcattttgagaaaatgagaatgactgtattttgttgattctaagatgcatttttttttcacattttagcagctctgatattgggatgtgtcttgaaatggacagtgacatagtttgatcagtggtgttctctcttattggtacataaaacagcagtgtaccctgtaatcagtggcttcataaatttgctgaaaaatactcatgctaacatttaaaaataaggagatcgtacataaaactatcttcagcttctcttggaaaattacatcaggcaacactgggctgcgatttctggatagcagccgaagatggagctaccagtaagtagcagctacctcatttagacaaaaactcgctacagtgtctcatggtttccacccaggctgctttagtcatttgtattatctgccccagcccattaagcatttgaaaggacaatccctgactgataagttgaagtccagattctttgttgtgatttataagaacacaggtggcaccaacctacctcccccaggttaatgctcccaacctttgctgtgtactctatgtatcccctaatctcaaatataacagactcccatgttccctggaatgtctttctctatcttttatgccctacgaaacatttcctggtgttcccaggtcgagctcatttctttctggactccagtagtaagtatgtgggcgtatctctgcaaaaaccgcagttacttttgcactaacctaaagtacagttctgtgatttattttttatttttattttttcgagacggagtttttctcttgttgcccaggctggagtgtaatggcgcaaccttggctcaccgcaacctccgcctcccgggttcaagggattctcctgccttagcctcccaagtagctgggattacaggtgcctgccaccacgcctggctaattttttgtgtttttagtagagacacgttttcaccgttttggtcaggctgctcttgaactcctgacctcaggtgatccacccgcttcggcctcccaaagtgctgagatggcaggcgtgagccaccacgcccagccagttctgtgaattttaacacatggatagattagcataaccaccatcatcatcaggatatagaacatgccccccaaaactccctcctgctagccctttgtagtcactcccctccctcacccataaacccctggtaaccactgatcagttccctgtcactatagttttgtctttttgagaatgcgatataactgtctgtatccctttcagcatggcctcttccactcagcataatgcctttgagacccatccaggttgtgtgtatcagcttcatttgtttttattgctaagtagcatttcattgtatggatgtcccacagtttgtgggacactcacggaaggacatttaagctgttttcaatgtttgaccgtatgaacctgcatacacgtttttgcatgaatagaaaattttatttctctaggatagctacccaggagtaggattgctgtcgtatggtaagtgtatgttcaactttataagaaagtaccaaactctttttcagagtgactgtaccactttgcattcctgccagcaaagtgttagagttcgagttgctccacattctagccagcactggatattgtattaaaaaaaaaaattttagctgggcacagtggctcacgcctataatacaaatactttgggaggctgaggcaggcggatacctagagaccagtctgaacaacgtggcaaaacccactccctacaaaaaatacaaaaattagccgggcatggtggcatgtacctgtgatcccaactacttgggaggctgaggtggaaggatagcttgagcccagaaagttgaagttgcagtgagctgtgattgtgtcactgtgctccagcctggtgacagagtgagaccctgtctcaacccccccacccaaatttagccatattcatagacatatagtggtatctcatggttttaattttaatttctgcttccttgaatctggcctggaggaactggagggaacaaaaggtaaactcactgtcagttcagtggtacttcaaactctgatctgtttccttcatctgccgtctgttatttacttttcagagtcctcatgttacttgtttattgctgtgggacagattaccaaaaaatctagtggcttaaaacaacacatgtttatgatcttacagtttctgtggggcagaaacccaggcgtggcttacctgggccctctacgtcagcatctgtcgtgagctgctgcacacaatgtgttgactgggctgctgtcatctgaaggtttgactggggagggatccacttccaagcccgtatggttgttgacaagagtcagttcctcatggtctgtttgactgagggccttagttccttgctggcttttggctagagacttcccccagtcctttgccacttgggcttctcccacatggcagcttacttcattgaaagcacaaaagctgtgaagataatagggtctgctagcaagacagaaaatcacagtcttttataacctagtcatagaagtgacatcccaataccattgccatgctcaattgattagaagcaagtttctgggtccagcctatgctgaagagaagggatgaacacagtggtgtgaattgaccaggaggaagggatcattgggggcagcttagagtctgtctgccacagtcctcaaatagctgtttcatggattctgtccaggttttatagctttgtcccatgagagagaaagagtagagtgggtaaaatgtcccttttccatcttacccagaccagaaccttctgtgaagctttttgatttgatttatgaacattcagggttaatttaaggaatttctttaaactcaagccatcgaggaccaagctagggttagattaagcagtggtccgaattaaaattctgatatctattaatctatttattaaatcacaaccaaggaaagctcaacttttgtatctaagatggagcctttcgaaagctgaatttccccaccttaaaacgtgatggctgttttagcctgtcattgtggctgctcaccaggtgaccccaatagaaacatctggcaagcactgacttttatgaatttcttccatctgatagtgactcataacccacttttaatttcttttaatgacttcctaatgacttgccagatctggcctctcttttctcctagttaatgtgatttttcagtacccagaattcacccttgaaaatatgcttgatcctttctctatttaagtgaaaaattacttggtattcctttcttctcttcacaagggagcaggatctttaaattagagtccttcgattttttttttcttttgagacaaggtcttcctctgttgcctaggctggagtatagtggctctatcatggcttactgcagcctcgatcttgcaggctcaagtgatcctcctgcctcagcctcccaagtagctgtgagaacaggcatgtcccaccacacccagctaattttttttttttttttagtagagaggtcttgctatgttgcccaggctggtctccagctcatcagctcaagcaatcctccttgctcagcctcccaaagtgctgggattacaggtatgagccactgcccccagcctttttgaacttttttcatcatggacccctcacagtaagtttcgtgagaatggaccaagcatatttatttatttacagctaatactgctgaactcatttattgtgtacatgatcaaatatacatggaaatagaaaagttaacaagaataagaaaatagataaaaatatgagttctgatgttttgctttctgctctccagcagatctctgtgcatgtgctgtggggaagctaccccagttttggagactactaggggttaggaagtggtgattgggtgtgattgcttgccagtggccccagcatcaggaggctagctcagagtcagaagagctgggaggccagccctgtctgagcttcccccctttggtgctacggggcttcgaggtatcaggagccacaagcagacaccttaagtacccaccatcaaatagatctgcacatgccgctgttttcttagtctcctctccagtccagctgcttcacctcaattctagcatactcctcagggtatgtcatgatcaataatgggagctgcccattagaactactttgccttggcagaaattggaactgtggccagctccaggaagcttgtgaaataggagaggcttgcctacaaatccctctctcccttgagaggtagccaggcttctccattcccctctgtctttccatagtttgctattgccatggactaactaaatgtcctgggttgggatccctcagaagcagagcctgagataaacatttgagagcaagtttatttggaaggcaggagcaaagaaagtacagcagtggggaagtgagaaaggaagggaaggcaatcaagagagattaagtccagcctgaagaggtggagagggcagccatttttcaatcttaacatccgggcacctttatgtaattgcagcattatcattaggaaagaagttcattttgatttctagttcccctctcccatttcacaccctagttaagtactgtagaatatgcatagctatgagaaccccctcttcccacctcttttcctctggctgatgcctagtcagtcatcaggtctcggcccgtgcatcacttctaggaagccttccgtcatccccctttctgagatagggctctttctctgcgcccctggagtgtctcgtacctgttttattagatattttatcataccatattgctttcatttattcatgtaatagatatttattatgtgcctggcactgttttaagaacctagtatgtatatttcaatatccaatcatgtgtatttttttttctctgccatttgtgtctctgtccctcagtagcacctgctacataggaggtgcttgccacataggaggtttaaaactgttaacatcactctgcccatcattttttcttttttcaggctgggagaacacatccctggtcagctgtaggaaagccagagagcatttgagaagaggctgaagc

SEQ ID NO: 3163 - DNA, 21999 bp, human; identical to SEQ ID NO: 3162

SEQ ID NO: 3164 - DNA, 97496 bp, human
ttctgtgggtctgcagcactgagagctgcgttgatcatccagaactggtaccgaggttacaaagctcgactgaaggccagacaacactatgccctcaccatcttccagtccatcgaatatgctgatgaacaaggccaaatgcaggtctgttttgcaagcttttctcttcttttgataaaatgattctctttaccccttgttattgaaagaatgaaagtttgggtccattttaagctgaggaagcttggtgaaaggctttaatagagcatgtcatgacattgtcttggaactagttattgagagagagtgtgctttgggaaaaggatggtgtttttccgttttgaagttcacatttttaagagggctgcccaacatctggttaactaataaaaatagtcttattctattttggggcagatgccttaataggaaataaagttgtcattttataaaagaaaaaaatacttcaaggggttaaaaaatggcagaatttcctagcaacaaacctctgcaagctctagaagaaaatatacatgggtgaggaaggccttttttttttttttcttcgagacgggatttcactcttgtcacccaggctggagtgcaatggcacggtctcagctcgctgcaatctccgcctcctgggttcaagcgattctcctgcctcagcctcccgagtagctaggattataggcacccaccaccacacccagctaattttgaaatttttagtagagacagggtttcaccatgttggccaggctggtctcgaactcctgacctcaggtaatccatctgccttggcctcccaaagttctggaattacaggcgtgagccaccgcacctggccaaggaaggcctttttaaagaatacataaatctagttttaatgcttattaattttaaaaaagtacttttaacaataaacagatcttagaaagatctccaatatagttgctaatgaaaaaatcaacttttaaaacaatatgtagagtttatctcatttatgtgaaagaacatgaaacatacagcaaaagtctggaaaaagatacacaggaaattgtttacagtagttagttctgaggacaggaatggtattggtgggtgtgggttgggatgttaagagggacttctcatttttatttgaaattatttgtagtttttagcaatcatatatctgtgtatcacattataatatttaaagataattaagaacattccaaaaagaactaagttgctagatttatttttggcagctagaaaaatgatatactgtgattcagtcagatgctccctttgtctagattaggaacctcagcataggctgtctttctaagcactgtagaatatagtgataaatatacaggtagagtgaatcccaaattggtatgctttagacacattccagcaccagtacattattttctattgattctttattgagatgtaattcacatgccatacaattcacccatttaaagtgtgcaattcaatggtttttagtatatgtacagggttgtgcaaacatccccacagtcaattttaggacattttcatttcccgcttcctaaactccgtacccattagcagtcatttccccatttccttcccccagtccctggcaacgactaagctattttctatctctatggatttacctattctggccatttcatataaatggaatcatataatatgtggtctttgatgtctggcttcttttttatttatttatttttttgagacagagtctcgctctgtcgctgggctggagtgcagtggcacgatttcagatcactgcaacctccgcctcccaggttcaaccgattctcctgcctcagcctcctgaatagctgggactacaggcatgtgccaccacgcccagctaatttttgcattttcggtctcccagagtgctgggattacaggcgtgagccactgtgcccggcccagcttcttttacttagcataatgctttcaaggttcacccatgttgtagcacatatcaggacttcattcctttttagttaatattactcattccgaagaatattccattgtatggatggaccacattttggtcatctattcctcaggtgatggatcatttgggttgttccaccttttggctattatgaataatgctgctgtgaacatttgtatgcaagtttttgtgtgaacatatgttttcagttctcttgggtatagacctgtgagtggaatgtcatgtagtaactttgtgcttaactttttgaggagctgctaaactgtgttccaaagcagctccatcgttttaccttcccaccagcagtggatgagggctccaatttcttcacatttttgccaatacttgttattatctctttttgattatagctatcgtagtgggtgtgaagtgatgtctgattgtggtttctattgactgttaatggacaaacccatcatcaacagcattaaaatcatacattttgataactgtatggaaagtcttccttctctcaattcccaactcccagatctactcccagattgataaagtgtttacttttcatgagaggcagggcttgaaaaagaaattatttgtgctgtacaaatgcaggtctttgcagatacctggtggccatagagccagtaccctgattgtggctggaaagctggtgaagttccacctttcccttcctttctttccaaaatatatttgatatttaagaatattccttaactcttaatttcaccaccaaaaagaaaagagatcatgaccgggtgcagtggctcacacctgtaatcctagcactttgggaggccgaggcaggtggatcacctgaggtcaggagtttgagacctgcctggccaacatgttgaaaccctgtctctactaaaaatacaaaaacattagctggacatggtggcgagtgcctgtaatcccagctactcgggacactgaggcaggagaatcgcttgatccggggaggcggaggttacagtgagccaaaattgtgccattgcattccagtctgggtgacaagagtgaaactccatcttaaaaaaaagaaaagaagagatcataatgaacaaaatttggtagctgtcttacgttggatttcctagaagcagaggctgagacagggattctggtacaagtgacttattgagggtgtgttttcagggaaagcctgtaagggagtgaggaatgcgagacaggacaggggagaagctaggccaagatgtactttttgaagtctgacctcagcctgatcccatctggagctgtcaagtgtgaaatgcactacagtttgtccctggcagaggcaagggaggtgggggactgggctgttacacccttgcttcagccagtcgttgtctctgggcagccccacaggaggggcgttcatgtgttaccctgtgttgctctggatgcaggcagtcctctggaggcaggcatagaagtgacccttagcacctgcagcagctgagatacaaatgccccacaagagtaagggcactcgggtggaacaccaacagcatttgtcacagtagctgtttggggttcactaattgattaatttttttttattttgtccagttatccaccttcttttccttcatgttggaaaactacacacatatacataaggaagagctaggtaagtaaaaagcttagtcttttcaaatgtgtcattaaatattgaattgtcttcatcaagagcggtaaattctgaagatgggagaacactatgaaattaaaaagatgcctacctcttttgtttatgtgacacccaacaactggcaacatcagttcaagtggcctttttccctctctggatggtgtcaactaaatcaatcatttaactttttcacttttccaaaagctgaattagaattcattcaatattcatttgttgaatgccttttctgaactacaatctatcggtacacaacagtagcttagtaaagggaaccttatttattattattattattatactttaagttctagggtacatgtgatcaacgtgcaggtttgttacttatgtatacatgtgccatgttggtgtgctgcacccattaactcatcatttacattaggtgtactcctaatgctatccctcccccctcccccaaccccataacaggccccagtgtgtgatgttccccaccctgtgtccaagtgttctcattgttcaattcccacctatgagtgagaacatgcagtgtttggttttctgtccttgcgatagtttgctcagaatgatggtttccagcttcatccatgtccctacaaagggcatgaactcatcctttttaatgactgcatagtattccatggtgtatatgtgccacattttcttaatccagtctatcattgatggacatttgggttggttccaagtctttgctattgtgaatagtgccgcaataaacatacgtgtgcatgtctctttatagcagcatgatttataatcctttgggtatatacccagtaacgggatggctgggtcaaatggtatttctggttctagatccttgaggaatcgccacactgtcttccacaatggttgaactagtttacagtcccaccaacagtgtaaaactgttcctatttctccacatcctctccagcacctgttgtttcccgacttttaatgatcaccattctaactggtgtgagatggtatctcattgtggttttgatttgcatttctctgatggccagtgacgatgagcattttttcatgtgtccgttggctgcataaatgtcttcttttgagaagtatctgttcatatcctttgcccactttttgatgaggttgtttgattttttcttgtaaatttgtttaagttctttgtagattctggatattagccctttgtcagatgggtagattgtaaaaattttctcccattctgtaggttgcctgttcactctcatgatagtttttttgctgtgcggaagctctttagtttaattagatcccatttgtcaattttggcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaaccctttccccatttcttgtgtttgtcaggtttgtcaaataccagatggttgtagatgtgtggtattatttctgaggactctgttctgttccattggtctatgtctctgttttggtaccagtaccatgctgttttggttactgtagccttgtagtatagtttgaagtcaggtagcgtgatgcctccagctttgttcttttggcttaggtttgtcttggcaatgtgggctcttttttggttccataggaactttaaagtagttttttccaattctgtgaagaaagtcattggtagcttgatggggatggcattgaatctataaattaccttgggcagtatggccactttcacgatattgattcttcctattcatgaacacagaatgtccttccatttgtttgtgtcctcttttatttccttgagcagtggtttgtagttctccttgaagaggtccttcacatcccttgtaagttgaattcctacgtattttattctctttgaagcaattgtgaataggagttcactcatgatttggctctctgtttgtctgttattggtgtatgggaatacttgtgatttttgcacattgattttgtatcctgagattttgctgaagttgcttatcagtttaaggagagtttgggctgagacaatggggttttctaaatatacaatcatgtcgtctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgtccattcagtatggtactggctgtgggtttgtcataaatagctgtcattattttgagatacgtcccatcaatacctagtttattaagagtttttagcatgaagggctgttggattttgtcaaaggccttttctgcatctattgagataatcgtgtggtttttgtctttggttctgtttatatgctggattacatttattgatttgcatatattgaaccagccttgtatcccagggataaagctgacttgattgtagtggataagctttttgatgtgctgctggattcggtttgccagtattttattgaggatttttgcatcaatgttcatcagggatattggtctaaaattctctttttttgttgtgtctctgccagcctttggtatcaggatggtgctggcctcataaaatgaattaaggaggattccctctttttctatggattggaatagtttcagaaggaatggtaccagctcctctttgtacctctggtagaattcggctgtgaatctgtctggtcctgtactttttttggttggtaggctattaattattgcctcaatttcagagcctgttattggtctattcagagattcaacttcttcctggtttagtcttgggagggtgtatgtgtccagaaatttatccatttcttctagattttctagtttatttgtgtagaggtgtttatagtattctctgatggtagtttgtatttctgtgggatcggtggtgatatcccctttatcattttttattacgtctgtttgattcttctctcttttcttctttattagtcttgctagcagtctatcaattttgttgatcttttcaaaacagcttctggattcattgattttttgaagggttttttgtgtctctatttccttcagttctgctctgatcttagttatttctcgccttctgctagcttttgaatatgtttgctcttgcttctctagttcttttaattgtgatgttagggtgtcaattttatatctttcctactttctcttgtgggcatttagtgctataagtttccctctacacactgctttaaatgtgtcccagagattctggtatgttgtctttgttctcattggtttcaaagaacatctttatttctgccttcatttcgttatgtaccagtagtcattcaggagcaggttgttcagtttccatgtagttgagcagttttgagtgagtttcttaatcctgagttctagtttgattgcactgtggtctgagagacagtttgttataatttctgttcttttacacttgctgaggagtgctttacttccaactatgtggtcagttttggaataagtgtgatgtggtgctgagaagaatgtttattctgttgattggggtggagagttctgtagatgtctattaggtctgcttggtgcagagctgagttcagttcctgggtatccttgttaactttctgttttgttgatctgtctaatgttgacagtggggtgttaaagtctcccattattattgtgtgggagtctaagtctctttgtaggtcactcaggacttgctttatgaatctgggtgctcctgtattgggtgcacatatatttaggatagttagctcttcttattgaattgatccctttaccattttgtaatggccttctttgtctctttttatctttcttggtttaaagtctgttttatcagagactaggattgcaacccctgctttttttttgttttccatttgcttggtagatcttccttcatccctttattttgagcctatgtgtgtctctgcacgtgagatgggtctcctgaatacagcacactgatgggtcttgactctttatccaatttgccagtctgtgtcttttaattggagcatttagctcatttacacttaaggttaatattgttatgtgtgaatttgatcctgtcattatgatgttagctggttatttttctcgttagttgatgcagtttcttcctagccacgatggtctttacaatttggcatgtttttgcagtggctggtaccagttgttcctttccatgtttagtgcttccttcaggagctcttgtaaggcaggcctggtggtgacaaaatctctcagcatttgcttgtctttaaaggattttgtttctccttcacttacgaagcttagtttggctggatatgaaattctgggttgaaaattcttttctttaagaatgttgaatattggctcccaccctcttctggcttgtagagtttctgccgagagatccgctgttagtctgataggcttccctttgtgggtaacccgacctttctctctggctgcccttaacattttttccttcatttccaactttggtgaatctgacaattatgtgtcttggagttgttcttctcgaggagtatctttgtggcattctctgtatttcctgaatctgaatgttggcctgccttgctagattggggaagttctcctggataatatcctgaagagtgttttccaacttggttccattctcccagtcactttcaggtacaccaatcagatgcagatttagtcttttcacatagtcccatatttcttggaggctttgttcatttcttattactcttttttctctgaacttctcttctcgcttcatttcattcatttgatcttcaatcactgataccctttcttccacttgatcaaatcagctactgaagcttgtgcatgcgtcatgtaattctcgtgccgtggttttcagctccatcaggtcatttaaggtcttctctacgctgtttattctagttagccattcgtctaatcttttttcaaggtttttaacttctttgcgatgggttcgaacatcctcctttagctcggagaagtttgttattaccgatcatccgaggcctacggctgtcaactcatcaaagtccttctctgtccagctttgttccattgctggcgaggagctgcgttcctttggaggagaagaggcactctgagttttagaattttcagcttttctgctctggtttctccgcatctttgtggttttatctgcctttggtctttgatgatggtgacctacaaatggggttttggtgtggatgtcctttctgtttgttagttttccttctaacagtcaggaccctcagctgcaggtctgttggaatttgctggaggtccactccagaccctgtttgcctgagtatcaccagcagaggcttcagaacagcaaatattgcagaacggcaaatgttgctgcctgatcctttctctggaaacttcgtctcagaggggtacctggctgtatgaggtgtcattcggcccctcctgggagttgtctcccagttaggctactcgggggtcagggacccacttgaggaggcagtctgtccgttgtcagatctcatactctgtgctgggagaaccactactctcttcaaagctgtcagacagggatgtttaagtctgcagaagtttctgctgccttttgttcagctatgccctgcccccagaggtggcgtctatagaggcaggcaggcctccttgagctgcaatgggctccacccagttcaagcttcccggctgctttgtttacctactcaagcctcagcaatggtggatgcccctcccccacccttgctgctgccttgcagttcaatcttggactgctgtgctagcagtgagcgaggctccgtgggcgtgggaccctccaagccaggtgtgggatataatctcctagtgtgccatttgctaagaccattggaaaagtgcagtattagagtgggagtgtcctgattttccaggtaccatctgtcacggcttcccttggctaggaaagggaattccccgaccccttgcccttcctgggtgaggcgatgcccagccctgcttctgctcacactccgtgggctgcacccactgtccaataagcccgagtgagatgaacccggtgcctcagttggaaatacagaaatcacctgtcttctgcgtcgctgacgctgggagctgtagactggagctgttcctattcggccatcttggaaccaagatcaagggaacttcatttttcatccacaaaacttttttgctgagagatcaaaatattttgagtatttcatgcagcagatctaggggaaaatggcaaattaaacacagttggccccgttgtgtctgttttctgtcctctctctctctcttttttttttttttgagacagagtctcgctctgtttcccaggctgcagtgcagtggcacggtctcggctcactgcaacctctgcctcccggattcaggtgattctcctgcctcagcctcctgagtgtctgggattacaggtgcttgctaccacacccagctaattttttgtatttttagtagagacagggtttgagaatgttgaccaggttggtcttgaacccctgacctcgtgatctgcctgcctcagtctcccaaagtgctgggattacaggcatgagccactgcacccggcctctcttctctttgatctgtctgtctgtctacctatcatctagtcattctgaagcagaggcaggcaatggaggtgtagttcaaaaatgattttaaaattataattttttacaaccatgtatttctcctgcaaattaagatctgcctgttattatctccaagacagatgccagacttaaacgctcattttgctttaatttgggccaaccattttttttttttttttttttttgctctcattaaaatgtgtatggcatctaggagcatcttttaaataatctggtaaatacccttcaaagtgaagtggtaaaagaatggtgttttaatgggcatgatttaagctaagtgcatatgtatgaaactaattaaagcatttaatgatctgtagaagccttctgaatggtgaaatagccaaacctaaggaatggggagtgggtggaagtgggtactttgccattttttcttttagataactgcaattcgaagacagttgtttatgcttcatattccttggcaaaaatgtttttgagaggaaatatgataatgataaaatgaaacagcactttctgctaatgacctaatacttcaacccaggctcacttcatcagaatcacttacggagtttcagagccacaggtggctgggttccagcccggagatgtctactcagactgtgttgtcattgttgttgttttaatctgcattttaaaaaattccgtaggtgattttaaaatataagaaaaatatttttattaaagaaggggacagtggtttaatcttcttatagaagcttttttggaagtatacattacaggaaggtatacaaattatatgactcagtacattttctcaaagtaaacacacccatgtaactggcacctggaacaagaaataaaacatgatcagggccacataagtttcccatcctgccttcttgtactgctacccaacccccacacaatcacataactactttcttgacttctacaccctagattagtctttgaacttctttatatagatggaagcatgtggtatatacccatttgagtctggctgctgcttcttttttttttttttttttttttttaacgttttgttttgttgtcgttgttgagacagagtcttgctctgtcacccaggctgaattgcagtggcgcaatctcacctcactgcaacctccaccttcctggttcaagcaattctcatgcctcccgagtagctgggattacaggcattcaccagtaaacctggctaatttttgtattcttagtggagatggggtttcgccttgttggccaggctggtctcgaactcctggcctcgggtgatttgcctgcctcggccttccaaagtgctgggattacacacatgagccactgtgcccagtcctgagtctggcttcttttgatcatcattacatttgtaagaatcatccttgtaatttggtcatttttattgctgaataatattccattttactaatataccataattgatccattcgattgtgtatgggcatttgagttgttttcagattggtgatttaaatggtgctgctatgtacattcttgtacatgtcccttttggtaaaatatgtatgcatttatttggctatatattcatttttggttatctattgctacctaataaactacccccacatttagtgacttaaaaacaacagccatgttattgcatgtaattctgtgggtcaggcatttgaacagggcttgctgggaacaacttacctctgttccatgtgttatcagttgagctcactcatctagctggactgggcaggaaagatcaaatggttttaatcacatgtctgggattttggtattaggtattaacttggttacctctcggccaggtgcagtaactcatgcctgtaatctcagcactttgggaggctgaggtggatggatcacttgagatcaggagttcaagaccagcctggccaaccccatctctagtaaaaatacaaaaattagctgggtgtgttggtgcacgcctgtaatcccatctactcaggagactgaggcacaagaatcgcttgaacctgggaggcggaggttgcagtgagccaaaatcgtgctactgcactccagcctgggtgacatagtgagactccatctcagaaaaaaaaaaaaaaatttggttacctctctttttctcacgcagcctttctgtccattaggctattctggacttctttacatgatggctgggtccaagagggcaaaggcagaagctgccaggcctcttaaggcctatgtgctagaactctgggaaatcagttctgccatactctatcggttaaaacaagtcacaaggccagacgtgaattcagagcagttaaagagatatccatctcttcctcagaggagtggcagtattacagtataaagggatgtggacatagggaggcatgattccttggggagccattatcataaaaatgtaccacaagccagggatagaagtttggggttatagcgcttatatctgttcagctttattagatactggcagacatttttacaggatggttgtaacaagctatactctcaccagttcagttgctccatatcctcaccaacacttgcaatagtacattcatttcattttagtcattctggtgaatatctagtggtatcgtatttcaggtttaatttgcatttccctttgagcagtcaagttgctcactttttttcttttcttttttctctttttctttttttttttttttttttttgagacagagtcttactctgttccccaggctggagtgcagtagcgtaatctcggctcactgcaacctctgcctcccgggttcaagccattctcctgcctcagcttcctgagtagctgggactacaggcatgtgccaccacgcctggctaatttttgcatttttagtagaaatgggtttcgccacattggccaggctggtctcaaactcctgacctcaggtgatccgcccacctcggcctcccaaagtgctgggattacaggcatgagccaccgctcccgaccaagttgctcacctttttgtatgtttattggtcatgtggacatctcatgtggtgaagttcctgttcaggtttttttgtccatttttctattgggttatttgtctttttcttatgaatttggaagagttttctaactcttcttattttattttatttttttagatagagtctcactctgtcgcccaggctggagtgcagtggcatgacctcggctccctgcaacctccccgctgcccaggttcaagtgattctcgtgcctcaggctcccgagtagctgggattacaggcatgcaccaccatgcctggctaattttgtatttttagtagatacggggtttcttccatgctggtcaggctggtctcaaactcccgacctcaggtgatccacccgcctcggcctcccaaagtgctgggattacaggcgtgagccattgcgcccggcctaaataggatatttttaggaaccagaaggttatttaacatttccagatatcggggccaccagattaatggtcttaactctggggcatggagtatcttgagacacgttgggtactctgaagataagaggtgaccctggaagcagtcatacttgtccttgtaatcctaccacctcttgatgatcaattataacagttgatctccctgtgctactactttaagagctcaaaaccagtgcataggactccatggggtgtagagactccacagaaacattcccagtccacttttcacacatcagcctcctcccacaggcagaaagccgaagctgccatacatagccataggtttaaacagagactggcggaagcggggagtgggatggagtgtgtggaagtgttgttttcacttttctttctgcttctcagatcagccaaaatgtcctatcggaccaggtattttatattttttgttgctatggtgaatagaacattttccccattatatcttccattggttatcggtagtgtttagtaaagcttttgaattatgtcaatttatcttatattgtgctactattaagtaataataatatttttattgttgatatttgttacatgtttaccatgtgccatgtatttaagtgctttaaatacatcatttcatttagtcttcatgacaaaccagtgagattagtagtattatcatcccctttttgtagatatggaatctgaggcttagaaggcaatctcccaaggttattcatctcattggtggagaagctgtgattcaaaccagtgtgattaatgtctatattttatacatataaaaaatataaaatatatatttattatagtatttatataatatatattccatataattatatatttatatggaatatatattatatattatataattatattatatatattatataattatattatatatattatatattataatataattatatattatattatattccatataattatatagaatatatattatatatatatatatttattttcgagacagggtctcactctgtcacccagactagagcacagtaacatgatcatggctcactgcagcctcgacctcctgggctcagatgatcctcctacctcaggctcccgagtagctgggactagaggcacgcaccaccatgcccagctaatttttttgcattttttgtaggggttttgccatgttgcccaggcttgtctcgaactcctggactcaagcaattctccatgcccagcctctgtattacatttaattctcctatcaattctgggagtttttcaattgattttcttgggtgtaggtatttaatcacattggccacaagtaactttatttttatatctttctatacaataattactgctcttatttcagcttcatgtcttattgcattggccaaagatagtggatcagtgttagaatgaaacagtgaaagtgggcatccttgttttgttgatgatttaatggaaaaaccattattgattatttaaatttataaagcgatgttaaggaagtatcattccattcctagtttctgagtttttaaaaaatcaggaacagatgttaaattttatgaaatgtcattttggcatctattgaatttattatatggacaccaatggttctgatccagattcataactgagaaacaaaaataactataaatgtagttcaattgttgcttttctttttccagcaatatctggagcttgttttcaaagtgacatgtgggtggtagaggcagaaattgttgtataaaaatttatgggctttaaatttttccctgtccagattttgagtctgtactgggtaaaagaaaagattgtgtgtagggggtatttttgaggtattttctttagaacaacttgtaaaggtatcatttgcctataattcttaattagtttagattcatgttgacaaaattgtaaaccaaataggtaaggattaattctgtgttgcacaaatctttatatattgttcattaaattattgttattagttataatagttctagcccacaagaacagtatatacataagaaatgttaaagcctttgattgttttcatacatgacacattagctactggaagagaatttatgttattcttttttatgttgctaaaaaccagcagaaggattatgatttgacgttgactaatacttcatattgagtagttttaactaagaatcggtttagggaactggtcctttttcatatctttgtcactgaacttttaggcaatgatggtcatcagatctatggaagggacggtagaccaagcttctcttttttttaaagaatgaaaacaatattttaattttgttcttaagtaacaagactgagtcttcataactggaagggatggaactgatttgctgtgtcagttagccgatgggaaagggagagatgacagcatgggtggaggcagtgattgggaaaataaaatgatttttgctttattgctcacagagttggggttactaaataaatcggttataagtatataaataatactgtaggtatcgtgtagcatagttacattttaatatgcagtaaaagtgtaatggttaagagtttgagctcaaagccagattctctgggatcaagttccatctctgctacttacatgctgtaccccattttccttgtatataaaatggagataccaacaatatttatctcatagggtggtttcggtcattacatgaatacacatgtgtaaggtgcttagaacagtgcctggcacatcagtaactgggagctcccatccttgtcattatcaccatgatgccttggaaaaggtgtggcctggggttcaactgggcaggggttgctgagttttgaaggatgataaattgtccaaagaagagaaagcaagggtagtccagggagagggaagagtgggaacaataaagacagagtgctgggctgggagaggaaagcatcgccagtgtgggggagatgcaaggtcccggggtgacatcttagatcggaggagtgtctaactatgtttaattgtgttacagagtctgaagagaggatcatgctggagatacaggcaagggaggaagtgactatgaagttgccaggcctctgaggatttggaagggagaaagggtgtggggaacagctccatgggtggttccatatgcctgtctgcatccatagctgcatcctcaacttcatttcctctttccttccagcatctgactttctaaatcaggcatgctttaagctatgctgcctttctttctttctttttgagacagggtcttgctgtgttgcctaggctggagtgcagtggcacaatcacacctcactgcagccttgacctcctgggctcatcctcctgcctcagcctcctgagtagctgggattataggcgcacgccactatgcccagctagtttttttgtattttttgtagagacgaggtttcaccatgttgcccaggctgtttcactgcctttctcatgaacactgcaatcatatcataaattcctcccccatctaaaaaacagaatcccctagtttttaccatgcgttccatattcactttattttttagagtctataacagaaaataacctttataattctgttagatgatatagtgaaagtactgcgggtttttgtgggtttttgtttttgctgttatttgttttttctaagagttgcttggtatttcagtgtgtacagtcaggaaaaggaaagttttcatttgaagcaagatttatatccaagaacgactaccaaattgaaaagggtggcatgggcattgaagacagtgaagtatttaggctttactgcctacgtaatgaatctgagataaagttgtcaagatgctctccctttctagtctctaaatataaattgaaataattaagttattcttaaatctcaaaccaaacccaaatgagaaaaataaccactcccggaccacattaaagacagacattattactcctaaattcagcttcttataaaacatcatcaaccaccaccagaaaacactgtggtacacaagaatttagaaaatatttttttaaattgccaaatagtatgactttagaaaacatttttcacgtttagttcttaactgtaatctctcagcataactggatcatgaaaaaaatgtattctgtctatatcttgaccactctgaatattttaaaagatagaaactgtttgcagagaacttctgaagaatggcctttgtaacaattcggtgttaatgagttgaagagtatgtcattgtcctctgggtcattatccgcaagaatattgtgtattaaacaaccaccatacctcagtggcatgtaatcaatatttctttttgctaacaagtctacagattagctgaacacttctgctgatcttggcaggtttgattaggcagtttttttgggtcttggctggagttcactcatgtgtccagaacaaacactggtggctgctggctgggggctgatcgaggacaaccttggctaggatgactcagctcagctctacatggtcttgggtctttctgaagcctagcctaggctttgtggtagtggcattgttcctaaagagtgcatgaaagcatacaaggcctccagagagacctgagcttggaactggtacatagcacttccatcacattctttaggccagtacaagtcatgagcccagcctggtttgaagggatggggaaacacactcttgacgggagtagctgcaaaagtacattacaaagagcatggatagaaggtgggatagagaattgggatcacttttgcaatccatctaccatgtttcctttcgtctttctctgtctgaattgtcttgatttctgtactggggctgactgtttcatgggcaatctagcaggcagggaccctgggtctcagcacccactaaaatggacaatgcaggcactccgttatgtagaactgtctctccgagactgagaggttctttgggtatttctgcctgtgatttgtcctttaactttatctgctttgttaccaagaaagaatgaaaatcatgtcagaaagtttatttttaagtaaagagaaaaacaaatccgttacagctaaatagaatcctctgaagtgtttaacaggggaaaaattgaatgttgcagttaaattttctgtaggttctgaatagcagcagatgtttgaaccaaatataatgtattgttctgttttcagccctatttgtaaaagtctgagatgtaagagtgggcaaaaaacttagagctagagcttcgatcatccaaataccttgattggctagttttccctgtgcttctccctccccttcccactagccatggacccactgctgtggtaaaacatctgcccaggaagggatggtggtgacccatgtgaatgttctggtctcagggtcagtcattcctcgtggttatatgtgggctgtgttgatatgcagaacatttagcacagtgccttacatgggctaggtattcaagaagatatttattaaatttaagtattgaaatgttgattcccacccccacccccacccccccgttctgtccttccttttccagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacaggtaagtggaagcagatgctgccttgattcttgtacataacagatgcccaataactgttgaaagaatggatgaacataccacagcagagatgcatttctttagaaaacagttcacattaagtgagagctcccctctgttactcatttaatagaagtctcctcaggtgcacagcaagctcctctctgtaggctaacagcatttcatttgccattttctgagatatcattcacataccataaaagtcaccattttacagtgtacgactcagtgactttttcacgcattcacaggattgtgcaaccatcaccaatatctcattccagaacattttcatcactcccaatagaaaggccattcctgttatcattgcctcctccccacccctggcaaccactgttctattttctgtctctatggatttgcctattctagatatttcatgtaaatgaaatcatcaaatatatggccttttgtgtttggcttctttctcttagtgttttaaaggttcgttcatgtcatatcatatatcattacttgatttctttttatggctgataatattccattgtataccacattttgtttatccattcatcagtgaatggacatttggatcatttccaccttttggctattgtgaacagtgctgctatgaatattcattcacagattttcatataaacatgtgttctcagttctcttgggcttatacttaagaatatttcactgggtcatatggtagctctatgctggatcatgtggtaactctatatttaaattttccagtaattactaaactgcttcccacagtagtggcaccattttgcatttctaccagcaatctatcttcccatgtaggttccaatttcttcatgtttttgccaacacttgttattttgtttttttttttatttttattatagccatcctagtgtgtgtgacgtggcatttcattgtggttttgttttgcatttccctaatgactaatgatgttgagcatctttttatgtatttattggccatttgtataccttctttgcagaaatctgtgcagattctttgcccacttaaaatcaggctttttattattgagttataagagttctttctggatataaattccgtatcagatatatgatttgcaaatattttctcccgttctgtaggttgttttttcattttcttgataatgtactttgatgcataaaagcgttacattttgataaagtccagttcatccatgttttttcttggttgcttgtgcttttggtgtcttggttgcttgtgcttttggtgtcatatctaagaatccattgtcaaatctaaggtcatgaagacttgcctttgtgttttcttctaagagttttatagttttagcctttacacttatgtctgtgaatgattttgagttagtttctatatatggtatgaagtcaaaattaattttttgcatatggatatgcattgtcccagcaccatctgttgaagagactgttctttccccattgagtggtctttgcacccttgtcaaaaatcaataggccaggccgggcacagtggctcatgcttgtaatcccaacattttgggaggccgaggcgggtgcatcacctgaggtcaggagttcaagagtagcctggccaacatgatgaaaccctgtctctactaaaaatacaaaaattagccaggcatggtggctcatgcctgtaatcccagctactcaggtggctgaggctgaagaattgcttgaacccaaaaggtggaggttgcagtgagccgagatcgtgccactgcaccctagcctgggcgagaaagcgagactccatctcaaaaaaacaaacaaataaaaatctataggccatagatatctgggtttgttattggactctcagttctattctattggtctatgtgtctgtgccagtaccacactgtcttgattgctgtagctttgtagtaagttttgaaatagggaagtgtgagtccttcaactttgttcttttgcagtgttgaaattgttcttcattattgttttggctatttggggtcccttgcaatgaatttgaagatcaaattttccatttctgcaaaaaagcctattgggattttgatagggattgcgttgaattgctatatcactttgggtaataattgccatcctcacaatacaagtctttcaacccatggtgtctttccatttatttatgtctttaatttctttcagcaatgttttgtagcttttagtggacaagtctttcatcaccttggttaaatttattcttaaacaatttattcttttggttgatattataaaaggaattgttttcttaattccttttttgattgctcattacttgtgtgttgatcttatactctgcagctttgatgaatatacttgttagctctagtagtttgtgtgtgtgtgtgtgtgtatgtgtgcgtgtgtggtgtattcttttgaatattctatataccagatcatggtatctgtgaatatagttttatttccttctttctgatttgggtgccttttgtttctttttcttgctcaattgctctggctagaacttccaccacaatattgaatagcagtgtgaaagtaggcatgtttatcttgttcctcatcgtagggggaaagctttcaatctttcactactgagtttaatgttagttgtaggtttttcataaaagtcttttatcatgttgaggaaatttccttcaattcttagttttctgagtggttttatcaggaaaagttgtcgggttttgtcaaatgcttttttttttttttacatcagttgagatgattgtgcgttttttacccttcgttctattaatgtggtgtgatatattgaataattttcttatgttgaaccaactttgtatttctgggataaatccctcttggccatggtatataatccctttaaaatgctgttgtatttggtttgctggtattatgttgagaatttttgcatctatttcataagggatattggtctgtaattttcttttcttgtagtgtctttgcctggctttggtatcagggtaatactgatctcatagagtgagttaggaattgcttccttttattctgttttttggaagagtttaagaaggattgtgttaattctaatttaaatgtttagtagagttcaccattgaagccatttggccttggacttttctttgttaggaggtttttgatgactgatccaatctcttgttctagatctgttcagattttttatttcttcttgagtctgttttggtaatttgtggagtttctaagaatttgttcatctcatctaagtaatctaatttgttggtgtacaattgttcatagtattctctcataacccttttttatttctttaaggttgatggtaatgtccccactttagtttctgattttagttattttcattttctctttttttcttagtcagtcttgcttaaaggtttgttaattttgttgatcttttcaaagaaccaacttttggttttgttgattctctctattgtttttctattctttatttcatttatctccactctaattcgtattttctttgtcaaaatattaagttagtttattgatttgagatccttcttttttaatgtgtgcatttacagctacaaatttctctctaaacactgcttttgctgtatcccataagttttgatatgttgtgttttcatttttattcttctcaaagtattttctaatttcctttgtgatctttttattacccattggttttttaagagtatgttgtgtaatttctacatatttatgaattttctagttttgcttttgttattgatgtctagtttcattccattgtggtcaaagaagatactttgcatgatttcagtctttttaaattcgatgcggtttattctgtggcctaacatctggtctatcctggagaatgttccatgtgtccttgagaacaatgtatagtctgcttttgttggggaaagtgtttagtagatatctattaggtctagttgtgtgtggtctctgaaatctctgttcctttagcttgtgttaagttagtgttttgacagagacttccttgaacaccaggagcgatttaaaaaaaaaaaaaaaggaagggaaaaaaaccaacaacaaatatttgcagattggctctctgttggagcactccttcaactccttgggccatttacaaatgttagtctttacttcccgcttgtgctgaaccattgttcagtttcctttttcttgattcactgtttggttgctataaactttgagtattttccagagttctgacaaagttgattctgacagggtttgtttgtttgtttgtttttgcttgatttgtcaatgtttttgtggcggaatgggaccttaaagttgcctacatgaccgttttctctgacatcaccccagtaccctcattctcaggttaggaccctaaagggcatacctaggagtaagagtgaactggaagactggcttttcaatgatcagagaacagcttggaatgaatcatgtaattcctgagattgaactgagatcatcttagatagctaaggctcctaaccacctgccaacagcaaatttaagtcttctctggaagacaataggcctgagattgtttgttcagtttttctttcttcctttcttttttaaaggcagggtcacactctgtcacccatgctggagtgtggtggcactatcatagctcactgaagccttgacctcctgggctcaagcaatcctcccccctcagcctctcaagtagctgggactgtaggcacatgccatcatgcccagttaattttttattagcttttggtagagacaagttttcactgtgttgcccaggctggtctcgaactcctggcctcaagtgatcctcccacttcggcttcccaaagtgctgggattataggcatgagccactgcacctggcctcagtttttcatatgcaatttccagaactcaatacaaatataaccaagcacaggaggttataagacacatgaagaaaactgaggcaaacaacaatggaaacagacctgtagggtatttggttagtggcattatcagactctgagtttaaaataaatatgcttaatataagttcaaggagataaatcaatccaaggagccataatagagaagattgataattctgactttataaaaatgaaaagactgttattaagggaagaataaaaggttcaacacagtgtacagagtaaaaaaaaaaggatcatgtatattttgatttttttaattgagaaaaaattcatctaatgtaaaagtgatcatttaaatcattttaaagtgtatgaggccgggtgcagtggctcacgcctgtaatcccagcactttgggaggccgaggcaggcaaatcacttgaggtcaggcgttcaagaccagcctggtcaacatggtgaaaccccgtctctactaaaaatacaaaaatcagctgggcatggtggcacgtgcctgtagtccccgctactcgggaggctgaggcacgataatcacttgaacccaggaggcagaggttacagtgagccgagatcgtgccaccgcactccagcctgggcgacagagtgagactccatcccccccagcccccaaaaaaagagtgtatggttcaacagtttttagtatattaaaaatgttgtgcaaccatcaccactatgtaattccagaacattttcatcacccccaaacaaaaccctttacccattagcagtcactcccagttgctccctcccccagcccctggcaatactaatttaccttctttctctatggatttgtctaatatgaacacttcctgtaagtggaatcgtacaatatatgtggccttttgtgcctggcgtctgttgcttggcatgtttccagagtccatccgtggtagcatggatcagtacttccttcctatttttagctgagtaatgttactttgtatggatatagcacattgtatttaagggattatatgtttatacatgcatttttgtattcatctgtggttatattgatttttgtatgcttgcaaacacatagaatatttctgggaaagatacgatacttttaacagtggctgtttctaggggtagggattaggggaataagatctaggggagacggaaaatgacttttcattattttacccatttctactatttaaaattttatttcaactaaaaaaatgacgtgtttctccattttaatactacttttttttttgagatagagtctcgctctgttgcccaggctggagtgcaatggcgcaatcttggctcactgcaacctccgcctcccgggttcaagtgattctcctgcctcagcctcctgagtagctgggactacaggcgcgccccaccatgcctggctaatttttatatttttaacagagatggggtttcaccatgttagccaggctggtctcgaacttctgacctcaagtgatctgcccacctcggccttccaaagtgctaggattacaggtgtgagccactgtgcccggccctaaaactacttttttaaaaagaaatattctttaaaggtagtattttcctctaacttaaaagaatgtgactattttattcaagtggttatttaacctgaatatatttataaatggagaaactgccatctgagttaatcatcttgagcatttaatattgcagttgtaaatataattctaatgctatggaaagatagccttataggcaaggactagtatgaccaaaatgattttagtcaatccaaagacccagagaaattattttcataataattttctgttgttgcaatatattctcagtgaatatttgttaatttagcttttataaaaaagaaaacttcccctttagacaacagttactctgataagtactaccaatggaccagaaaaactacaatgataagctaaggtaacactgaagccagtgttgggaatcaatagattacatgtggctgggggtggtggctcacacctataatcccaacactttgggaggctgaggcaggaggatcatttgagaccaggagttcgagaccagcctgggcaacctaatgagaccctatctcttccccaccacaaaaaaggaaagagcttgaaaatccagtgtgaatttttcacttacagcacatttcaattcagattagctccatttcacatgctcagtagctccatgtggctagtggctgccatattggacagcataggtccaatatggcaataggtctaaatagttttgacctattaaaatatgttaaatttgtgtggtagtcacatctctgctgtattatattttggagtatgtatttataattttttttcattctccctctcctttttctttttctcttttattattacaattggctttttgtctgcacgtttccctagggcaagggcgtgcctcccttcacttctcttgggctctaaggacctgggatgatgattcattttctcagttacacacgtcgactgagggcttattatatgccagacactgggctagaatgatctatttcagaataattgaaaggttatcctgaaatacagcgacctgaaacgtgcgtgcttgctccacctttacagttttctatacagtcatgtctttcttccttgttcattacatctatttcctctgcttcccgctcacagatacttcatgcccattatgtcttagaggtgctatttgaaaccaagaaagtcctgaagcaaatgccgaatttcactcacatacaaacttctccctccaaagaggtaacaatctgtggtaagtttcagagcagagttgtccaattaatatttaggagcctcttggtcctacatcgtttgcctaacttgaaaactgtgtaaattggactgtgttaagggaaaaatgttaatatagaattatctatcatgataatactgttccccatcttgtctttgttttgcataccagctggcaggaattaattatgtgagaaattaaagagctcatagctttttataaaggcagacagcattttaatatggaaaaaccacccatgggtggaataagcattctttgccctccgtctagctctcattatctttgttccacgttgctttttctaggtgggcctctgcatgccacttgtgctgggaagagaaaagcccgtggcggggtgaagattaaattcttctctgcccttggctgctgttttagatttttccaactggtctgtgcagcttttagaagagtgggaatgtcccagaaatctgtttcttgttcttttaaataacaagatttgagattttgctatcatataggccagcctggcaggatattgcttcaagaaacagtacacattgaaattcctcacagttggtgctcagcatgcttgcaaccgtttgacagtggggtgcgtggaaggaacagcaattcccttaacttctaattaagcctttaggttacaaaacagtgattgttattttccaaatcagtttttagcctgcatttctcttattctggcaggtagaagtgaatttgacaatctaattaaactatttgcatttctagcgtctgatagtggtggcagggacttgatgtagcagtgcctacctcatcacatgccctgactcaggtttttgaagagtctctaatggttcatttccagcctcatcaggcatcacgtctctgactggcagatgattcatctcagcagtgggggtcttttattcaaggcctcacctggccttttcatggaaaatagagacttcgggtcatgaggctcagaaagccatgccaccctgtgaagtctgtgaggccagggctaggtgtgctcttaggatatatagaatagcccaaactgagaatgggatccgctcccctgtgtttcactgggagccactacagactcatccttgctaaaaggatctggaagaagacacacgttaattacagggcagggcagtcctagaatcccacagtgtgagaactgaagggttctctagtctattccttgctcttatgggtgaaattgaagctcagagagaaaagtggcaggatcagaattaaaatcaggtcttctgtatcccaggttagaggcagccccacatctgccatcctgactcgcattaggtacctggtggttcattgtccatcgtgagacaaagattagggcgtgacttaactggacatctccattggttaaagatttccacatcttggcacttatttctagactttttcacgtggcaccattggtagggggaaaagacaaggccagtgggttttcttaacatgggaatattattattttctatttttaacagctcattgaacttcaaaaatttcatgattatttataataaaatttaaaattggggccataacttcaaaaccatcttccgtttaagacggtgttaggaaagggggagagattgtgatgaaaatttgctattattttaattgtgagatgcatttttttacatgtacatctaaatatgccccgtagttttcagcatgcatgaaatataagaggatttttagtctacagttatattataaatgataaccaattctgcactcatgtttttgttggcagtggaaatatctttctgtccttcttcccatggtacgagtttttctttcgctgtccaactagaagttaaaaatattaaactaagtaaagagtcctcccatctttatgtccttagatttagagtgagaccatatgaaagcaatgagatttaagcacacaatgatactaatatgctaataatattatagtagtattttataaataagtgctggtgatatagaatttctattttattatttccagtatatttggagtcttctattgcatgtatttggttaatcttggttgtgggattttaagcaaactgagggaaaagtattcgtaaattaaattgtatagtaattaagttggatacaaagaataaaaatttatgagcagaacttatgaaagatattttacctagaaatagttatccaaatggggcttttggatattcacatagtcactcattattattgctattttttgagacagagtctcgctctgtcacccaggctggagtgcagtggagtgatctcagctcactgcaacctctgcctcccggggctccagcgattctcctgcctcagcctcctgagtagctgggattacaggtgcacgccacgacacctggctaatttttgtatttttagtagagacagggtcttaccatgttggccaggctggccttgaactcctggcctcaagtgatccacctgcctcggcctcccaaagtgctgagattacaggcatgagccaccgtgcctggccttattttttaattaatggcttcagatactcatgatctcccctagttggctttcattttttttctatgtctcatcaaagaatgtcaactacctactcacaaagtttaaatttcagatgctgctactggagtatattaaaaacacggctttaaaaagctatatacttagccaagaaatgtatttactgagtgcctcttatccactgggtcctatggtaggcacttggggattcaatgctgactacaatagatactgttgctgctctcctagggattacagtgtgggtgtacagaataatcgctaagagcctgaggggttttttgtttttcgttttatttttgagacagggtctcactttgtcacccaggctggagtgtggtggcatgatcacagctcactgcagcctcgacttcccagggtcaagcaatcttcccacctcagtcagcctcctgagtagctaggatcacaggtgcgcaccaccaaacctggcaattttttttttttttttttttgagatggagtcttgctctgtcacccaggctggagtgcagtggtgcaatctcagctcactgcaacctccacctcccgggttcaagcgattcttatgcttcagcccccacaagtagctgggattacaggcgtgtgccaccatgcacagctaatttttgtatttttagtagagacggggtttcgccgtgttgaccaggctggtcttgaactcctgggcccaaatgatccatctgccttggcctcccaaagtgctggggtaacaggtgtgagccatcacacccagccaagcttgagttttgaagtgagttaaagttgggtttgaattcttgctctgatacttgatggctgggtatctttgcataacttacttaactactgtgagcctcatttgtaagatgagaatgatgaagataaaacccatctcatagagtggttgtaaggactgaactagataattcatgtaaaacccttagcacagtgcttggcccagagtgatcgaagccctgtgcaaatgactggactgaaaaggtaattgaagcactagatgctgtccccactataggagaggaagagaagagtgctgtggagacaaattgcctgtcaaattaacatcgtcataggataaaaacccaatgccctgagaacacttggagtggatcagcagtatttcacttttaaaaatgggcattgcatcttgttctctactgaatactgatttttcatttgcactgcaggtgatttgcatgggaaactggatgatctttttttgatcttctacaaggtaaatgatgattttgctaaatattaacatttttcttgggggagggcagtcttagggcagataacaatattagttttactagagatatgtactaatacagatataatgttactgtttttaaccaggaggctcaaagatttgtagagccatatcttttttttttttaacacacatctcataaatttttaaaaaattgtactttgggtcttcattctacattattgttgtctgtgtatccattaggatttgtaccggattgtatttattgtctttatcgcatcataaatgtctagatggtacaggatggggagggatgcagtctgttttattttaattttgttcagggatgagcatgtcacataccagtcttctcttccagtgcacactaattatgcatgagtggagttgcttatgataaggaataagttccagcatgctctcttttctcccctgattcgccatccatgggctcagttgttcttccaatgctgtgcctcctcttcatttattgcatttggcttgtgagagccagcacagagggcacaagactgcttggccagcatggattttctctgcatctctttgattggatttttttctgtctctgggccaagagttacagcctgaatgtttgcttcagggatggctgactgcatatggaaaactgatcttgagatccctgccttcacagcggttacccctttacactggtcttctgaatgtctctttttgattaatgcatttattgttcatctactcctgtgacccccacaactagcatgtcaaataattgggcgtagcgtaggtatctcagatgggtggaaagaaaatatattctgattattattgttaccagaaaggggtcccgatccagaccccaagaaaggattcttggatctcgcacaagaaagaattcagggtgagtccatagactaaagtgaaagcaagtttattaagaaagtaaaagaataaaagaatggctactccatagacagagcatccccaagggctgctggttgcccatttttatggttatttcttgatgatatgctaaacaaggggtggactattcatgcctcccctttttagaccacatagggtaacttcctgaggttgccatggcatttgtaagctgtcatgatgctgatgggagtatagccgtgagaatgaccagaggtcactcttgttgccatctcggttttggtgggttttagctggcttctttactgcaactgttttattaggttggtgcaaaagtaattgcggtttctgcgtgctctggttcaaacacctctaacattattgttcctggaccaaactgagggttgggctgctatttctcatggcccaataacgagatacagatgaactgggaaggaagagagtttttatttctgtaagtggctccagggagaaggcctggaaattatcaccagaccaactcaaaattagaaagttttccagagcttatataccttctaagctatatgtctacgtgtaagtgtgcactcatctaaagacgtaagtgattaacttcttttcatctataactaaggtctgagtcctgaagaccttcctctggagcctcagtaaatttacttaatctaaatcggtccaggtgctggggtgattacccttatcttgtctcctgctaaatcatggaggtttgcagagttccttcagacccccaatcaacttgtttgtggaggcctggggagtttcttcacatccccagtaaaacttgtttaatcctaaataggtcctgttaagaattccttcgttatcttgccatgctttaacgcccaggaaaggcctagacaaaactcttggtgggcttttgttacattccagcctttgtatagggcactggctctttgagcttttaatatttaactgaaccactcagtcagtactgagacagttgttatggaggcctgcgttagtgagacctggcctgccacattttgatgaccaatcagttccactctttgaggctgtgagagcttgagtaagccatacaacctccatgaactgcaattttttttttcagctgcaatattatcttgagcttccaccccataagaggttgtattctggataaaataagtatccaaaagcatttttaaaataataaattataatagaaacacaaggttttcacttcatgcattagattagcagcttggaagggaagaggacaggccaaaccaggagtgggtagagccagcacctaggaagaggttccgttgagacttcagcaggcccaagccaggacgtagagtgtgactgtcagagagtgtcaggaggtgtcccaagtagcagattggtgtaggaagtccaggcgaaggtttgctggcagggagccgagggggctggtgaaagagcaattctggacatcagccacagaatctaagctgggtagggaaggaagagaagccaggatgggccagtcaactgggagaagtaggagggtagtaggactggaatgctgaccgactgtgtcagggagcaggctgactgcagtgagggccttaggaggtaggatggtgggaagtgcagggggagcagtcccagggcaagggatgccctggggtggagcctagaacatgggcagcccaagccatcgaaagagagtattggcgatgaggtgggcaaggacctggaaagcaggtgtgttcaacagtggggggcaccacgtggacccagatgaggagcaggggaaggaagtttagtcagaggtcatgggcctgaaaggagggtggtggggtgtttctctgtgagcagccctgggggcaagcagagcctcccctgctcctgggcctgaggtgggtgtcctggggatgggtgggtcctttccttcagaagggctgcaggagtcaggagtgctgctgtgctctggaggaagcccaggcctatggaggagagaagcctttctgaataagttgaaggtggaaggggcttcattgaccatgaaatggagattctactggccccactggagtgccatgggaaaggtggaaggatggacaggggatgggatttatttaatttgggacgtagctccacaccaaatgttcagaagtgcggtccggctattgttgacaattacaatgtgaggaaggaggagggggcagggcatgtggagaacaacaacaaacctggtcattctttatctagagtcttgagaaatatataaaagggcaaatagttgagtaaattaaatcgggaacgtagtcactaaattccaaggcatttagaaaagaaaatttctttatttcgtatgaaagtgcgataagggataggactctggagtagacagatgagaaaagagaattctaacatatttctttaattctgtctgcaaaactatatggaacatataaaactggaaggtgctaatgtaaagattgaacaggaggaggtgggtggtaagaagtactataaaaggaactaaaggtgaaaatatagcattcaaatgcaagcaagatatatttggagagctaaccaatgacagtgctaaggaaatggagattgctagcccagtgatgaaagactagggcactattatatttaggatggatttgggtagagaggtgagagggatgtctggaaaacagaagtgtgcaagagccatggattagaattctggcaggcgtgagtgagaagaaggtaaaatgcatcttggacatggagtgaaccacatacaccagaatctcgaaactgcctggtttaagtggggaaaccgagggaagagccattgatgacagcaagtttccactttaagaaactgaaaagagatctagtgtacaacacgaggactataggtaataaaattgtaccatatatgggattcatgccaaatgagtagattttagctgctattgccacaaaaaaacaaaaattggataactatgtcagatgatggatactttaatttgcttcactatagtaacctttttactatatgtatgtattctgtaacatcatgatatattataccttgaatgtacatggtaaaatttattttttaaaaaagaagaaaatagcaacaatgataaagcaatggggaaaatagctgatcaataatatcattagtattttcaacagcggtacagcagaaaacccggaaactatattattattttaaaggaatttataataagtgaataaatacattactttcatttatctagaaaaaggaaaaaggccgggcacagtggctcatgcctgcaatcctagcacttcaggaggctgaggtggacggatcacttgaggtcaggagttcgagaccagcctggtcaacatgatgaaacccctgtctctaataaaaatacaaaaattagccagatgtggtggtgcgtgcctgtagtcccagctactcaggaggccgaggcaggagaatcgcttgaacccgggaggtggaggttgcaatgagccaagatcgcaccattgcacttcagcctgggggacaagagcaaaactctgtctcaaaaaaaaaaaaaaaaaaagaaaaaagaaaaaagaaaaaaagaagctggaaaggtagtgtacttaatggtgtctcagacgggagaatgacacgtaaagcttgggggtgatggtgcttggtcgcttagcttatagcaaaagaatgtcctaagttaaaagcagggaaatgaaaggctgggacacagagatatctgaggaagccccgaccatctgatgatctctgatttaccaaagtcaggattttgcccttttctgtcttatttatttttgtctgcagtttaactggagaatgatgatagtttgcatggatgtactgtggcctaaaagcatgaatacaggctgttctggaaacagtgtttctatataaatataaatgacagtgataccccacctatcccaatgtcaaacttcagcctactttacttaccttcacttaccactcatatgtcccaaacccagaattaagtaaaaagggtctctgaacgcttgaaattgttgacacaaatccaatgaaccctactcacaggacaggccttaggcctcttactcaaagacccatgaaccagtatcagtaaaaccttctctcacgcaaggttcacatgagtttgcctgtctggctacccaccccacagcagattagggagtgggaggtgaagatggaaaagtcagacataatgacagcaatgaaaattaaaacgttctggctgggcacggtggctcacgcctgtaatcccagcactttgagaggctgaggcgggtggatcacctgaggtcaagagttcgagaccagcccaaccaacatggtggaaccccattctctactaaatacaaaaaaaaattagcttcgcatggtggtgcatgcctgtaatcccagctacctgggaggctgaggcaggagagttacttgaacccgagaggcagaggttgcagtgagccaagattgtgccattgcactgcaccctgggcgacaagagcaaaactctgtctcagaaaaaaaaagaaaagaaaagaaaattaaaagacagaactataaaaatgagataaaaactgaaatactaatactcagcgatctggagctgtggagtgtagggaagagagttcttgccttgtcagaagtgcctgaggggatgtttagactgatgagcctgcaaggccaagagagtttcaagttataaggtgtatactcttaagaagtaaaggggaccaggcgcgtggctcatgcctctaatcccagcactttgggaggccgaggcaggtggatcatgaggtcaggagttcaagagcagcctggccaatatggtgaaaccctgtccctactaaaaatacaaaaattagctgggcgtggtggcacacacccgtagtcccagctactcaggaggctgaggcagaagaattgcttgaacccgggatgcagaggttgcagtgagccgagatcgtgccactgcactccagcctgggcaacagagcgagactccatctgaaaaaaataagaagaagtaaagggagcaaatggcacattttaaaaacttccagccaaaatggttaaagtaatttttaaaggcattttagctttcaaaggaataagcttcagtgatctggaaaatccatttaagcaatgcttatagtatgaatgaggatattgggtcttaggaataggaggatgagagagcatgaagaaagagaaagcttagttaggagaagagcactgggccataaaaatagataaggaagaaaggaagaagcacatctcaaaggaagagagtggtgagggggttggggggtgatggatttctcttggtagcatcacacacgaaggttgcctgctcagattacaggaggtgcataactatgacctaagcaatcacttgattgcttcgggaaatggtagaatttctgtgatggtctttgtttctcactgtaatgctttgtactaatcaatttgtcaacaactgattgaatcccaattatatgtcatacctgactctggttcactgatagaagctacaattgagtcacatcagtgtaaccacaggctcctaatcttttgtttagaagtagttagtggccgtgctttcacttacttttattttattattgtttttaagagcaatagatcttgaattgtggggaatagtttggcaaactacatcctgttggagatttttggagctataagtgaccaaagtttatgttatactatgactaactgattctctccatcactcacaagagtaagtaggaaaacctcaggctttgaattaagacaaaattttaattcatctcaattggtggtttgctagacactttcttcctcatcagttcttttatacagcatagcatgaataggctccaaggctggggctggcccaaagccaactaagggcacagcctgagagactgttctaatgtagggtcactgagaggcctcaccatattactcttttcatccaagtggttggtttggttcaagacttctatcattataactcaccatatgcaaaagtgaatctgtctactaatgcattcattcagtaaacttttatctggtccctgtaatgttcaaggtatcatataaacactaaaggaccatacaaagttgatttaacatatatttatgaaacacctattatgaatgaggcactctactaagggttggcaatacagtatgactaaaacacagttgttggccccaaagacatcacagtttagtggggaaggttggctgataaaaagacaagatagttcagggttggacatgttatgattgggatcagcatggagtcctaaaagaacccactggcagagcacctaaccttatggaagacttcctggaagagaagacatttctgacgatctcttcaaagaattttagtaatttagtaagtgcctaaatcatgaagggaagttttggaggatcatgaaagattttattctcagacactttttgtggtgccctacaataaatgatgggatttgtagcaattattgttcttcattgattgttttgagattttggtttctttaatatttggttgtccttaaaaattgtatcagctagcaccttaatactaagggaaacattttcagctcagaatcgcatctgggtttgaaaaggactcttccccactgggtaccatactcttaacaacagacctttgctaaaagggcatctcaactttacatggcttcaaatataatcttatcatcaagtgaagtaatttacatatcattagttaggtcatatttttagattttattttctgaaaagattaattttaatcagccctgttgcttaattagagtgaccagtttgaaatacttctttcagagcctcagctttagtaaaattacaagacatttttccctcattgaatagaaagctagaaattttagatcaatatcaccaaattagtttgttaaattgatgccatgagtggtgacctcctatcgctgaaaaagagatgcatgtgaacagagagatgctaatgaactcttaaccctgtgggtaccatcctgatgctatccagtggaagccctactgccttgttttccttttttttctctcttccccaccatcctccacccactacacccataattttccagctgtcaaggtagtcaaacattttctttattttctatcactgaaatgcttcacactgccacagtggccaattttattttccttttgaggtgaaggtagtatgttacaatcagaacagacctctgaaatagggtttgcagaagaagaaaattaacgtggagttgaccagagcttattgtttgatgtgccttcaggaaatgtccaaattcactgggataatttccagatgtctgttgtaaaatgcttccataggaaataggcgagactgtgggaaacatctggtttttgtctctgtttaagttaattaattatggtctgctatttttccccctacaggtcatctgagtgcagttcagagttgtagctactctggactttctgtatctgtcaacttaatcaccatgtcatagacggtttgttgcatattagctgcagaatgagccagagggtttcgtttactggaactgggtgaagcatgttttatggcatgaggttttgcttctttgaaggaaacctggagaaatgtcagtagccggaatcctaaatatcctagacactcacaccccagtagactagttcctcatcatcctgtgtgctttttagttcccttattactctaagactaaagtggattcaaacccaaactatataaagtaatacgactaatcctggaacaacagggcagttcttacacatccaaatgagtcttgccctctttgatgcggttgtcttgaggggcttaacactgaaaggagttcagtatacattcaggactccttttagaatcactttcagagatagtgacatactctcttgaatgagctttattatcacaagtcttaatctcttgaagacatgtgagattcttgaagaaaatcttgaagattttctgaaaaggttaaggcttattgagtgtcaagtgtgttgcataaggtggatggattagttgaccattactatttggggcttaaaatgaggtttaactgaagacattcattactctttgctcatagtagaggtgaaataagacatcacagaggtagcaaagaatttacccacaacaaattctggtttaattcgagataagaagttttaatacaagaaaatctgtcatcgcaatagaaagtgtgtttaccattcaaacataataaatataattttagactattggatgctttcctcaaattttgaaattaaggttatactggtttcataaaatgagttggagagattttcatctttttctcttacttataataatttgaatccctgggttgcaaactcaaacttggctatacactgcagtcacccaggtgattctaatgtgcagtcaaggttgggcaccatgggtttaagtcacattaaaactatttgctcatgaaaattaaaatagagttctgctagaaagccacatggggccagtgcactgttcatgttttcctcttcttttgaatcagttttgctaggaaatggatgattttcaaggaaatcataaaattggttcaaagaaagaaccaataaaatttgggtttatataaacccaaattatcctttttatttcttttctatttccttagtttcagctcttctccttatttgatgggttttattgtttttctaatttcctaagatgaatgccatctttcgtgaacatctttaataatgaaggcatttaaggctacacatcttttctgattttagtgttaactaggccttctattgcacttgtaattttgcttttaattttctctttgatataatacttattaagatgataatttttaatttccaagaatcttaattcaaggagccagactttttttctaatcacatttttatgagactgtatcctgtgacatttttcttattttgaatttcttaagagttctttgaagtcaagtacgagactgattctcataaaagttccgtggacatataaaaaattaattacagtgttgagccttgagcaatgctggggttaggggtaccaattccccatacagttgaaaatccacatataattttgactcccccaaaacttaacaactaatagcctactgttgactggaagccttagcaataacataaacagttgatgagcacatattttgtatgttatataattataagctagagaaaaaaatatattattaagaaaatcttaggccaggtgtagtagctcatgcctgtaatcctagcaccttgggaggttgaggtgggtggatcacttgaggccaggagatcgagaccagcctggccaacatggcgaaaccccgtttctactaaaagtacaaaaattagccaggcctggtggcacaggcctgtaatcccagctacactacagaggctgaggcagggattcgcttgagaatctacagataatctacagagaatcgcttgagcctgggaggcagaggttgcagtgagccgagattgcatcactgcactccaatgtaggcgacagggcaagactctctctctcaaatatatatattaaagaagagaaaatatatttactactcaactcattaagtggaagtggatcatcaccaaggtttttatcttcatgttgagtaggctgaggaggaggaagaggcgggattggtcttgctgtctaggggtggcagagggagaagagccacatataagtggacccatgcagttcaaagctgtgttgtttaagggtcagctgtattctcttatttgtaatacacaaagttcttcatatattaaatcaagtttattggttgtatattcaattttcccatattttttctattatatatgttaatcattttttttgttgcgtctctgccagggtttggtatcaggatgatgctggcctcataaaatgagttagggaggattccctctttttctattgattggaatagtttcagaaggaatggtaccagctcctctttgtacctctggtagaatttggctgtgaatgttgctgtgcaacaaattacctcaatacttaatgacttaacactataaacatttagtatctcacagtttctgtgggtcagaaatttgggtcaagcttagctggatggattctggctcaggatctctcatgaggtagcagtcaaactattggccagggctgcagtcatctgaaaagttgattggggctgagggacccatttccaagatggttcattcatgtggctgtagacacagcatttcaattcctcactgactgttggcagaacagccacatgggcttctccacaaggctgcctgattcttcttgtgacagagcagctggctttccccaaagtgagtgatccaagaaagaaagcatgcaggaagctgcagtgtcttttatgacttagtctccaaagttgtacatcatcacttttgcttttttttctcttcatgagaagcaagtcagtaagtcttgcttctgctcaaggggaggcaaattaggcttcaccttgtaaacagagtgccaaagaatttatggacattattttaaagcagtaattcaatctgaataacacactgtgtatttttaaacaatttcttcttgcatttagtagttaaatgtatgaagcaaaaatgtgttcttttattgactataagttcatgagttgtatttttttcataaagtgccttttattatgacataatgttgctttgtgatcctgtttagtactttaatcttaaactctactttgcccggtattaatatttccattcttgctttctttttgttgcatctacctcatattcaaccttctcttaccttctttttaatgtatatttctcatgaacactatatatctgggttttgtattttaacacagcctggtaatcttggtattttaatgagagaatttaatccattcacacttagtataacaacagatatatttgaaattttttcttctactttgctatttcactttgtttcacccttttccttttctttttgctgttttggtaaagttttattttttattgttttatttggaatttttactctgcttttccattcactagtggttaccttcccacttctgacatttctggtaaataatgtatatgtgtgtatttctcaaatagctataactttattcttccactgcagtcctctctctctctctcaataagataactgtttacacactccatgtctcccattcagttaagatttctagagcattttatttttctcttctcacctcccctgtaaatcctagctattgctcataccatagttttagttcctgaccattattaggttttccttcctagcatgtctcttctacttctggaatctttgcttaatacttaaatgcaagtttcatattgtcatattgatttatatataattatatatttcatgattcattgttcacatctgtattctctcctcttgatctttccctgacttgaggacttttattttttatttttatttttttttgagacggagtttcactcttgttgcccaggctggagtgcaatggcatgatcttggcttactgcaacctccacctcccgggttcaagcgattctcctgcctcagcctcctaagtagctgggattacaggcatgcgccaccacacctggctaattttgtatttttagtagaaacagggtttctccatgttggtcaggctggtctcgaactcccaacctcaggtgatccgcccacctcggcctcccaaagtgctgggattataggtgtgggccacggcgcccggccagggacttttaaatgttagtatggttatttagttacagtgttttgttgagtgttttcctcagtggggcatgtggatgctatcttctctgaatgcaggctcctcgaatacagggactttgtattgtttacttctgtgttcctagcacctaaaactgtgcctggtacataacaagcaattgatacatgtttgctgtttttgtgatgttaaatactacacatttgcatgtctgtctttcaccctgagcatttatgtggttggtgatagttgatctctttacacatctgcaagtacttttctatcaccctgagaacttaatgtcttggccactgtagaaatcttggttcaaagtcctttttcctctttaatttgtaaattttattctaccgtctcctacctcccactactatagatgagaagtctgatgctaggctgattcttttccttttgtaacttgttctttctctctggcctcgtctaatctttttaccaggtggtagggattttgtccccatcaattgtgtgtagaagtcgtgtttcaagcttcaaattgaagtcttttttttaaccatagaaaatgttctctcatatttttgtaattattgcctcttcatctgttcctttttcctgattttgaaatgcttattattggcatattaagtctcttggctttgaatgctagtctcttatttattcttcctgattttcatcattttgattttactcaaaatgatgagagtaagagatttttcatctgcttgctctttcaggccaataatgtattttcccaaccattctttcttctagttacctttaacccattgcttttttttttttttttttttttttgagacagagtctcactgtgttgcccaggctggagtgccctggcacaatctcagctcactgcaacctctgcctcccaggttcaagtgattctcctgcctcagcttcaccctcccgagtagctgggattacaggtgcgtgccaccacgcctggctaattttttgtactttcagtagagatggggtttcaccatgttggccaggctggtcttgaactcctgacctcaagtgatccacccacctcagcctcctgaagtgttgggattacaggcatgagccactgtgcccggccaacccattgatattttaagtttgaatagtatattcttaatgccaagaattaataagtttttgttctttcttgtatgttcttcttattactttaaaaacaaactagttctctgtttcctccagcagtcctgttttattggggaccatctgctttagtagatctgattggtctgtctctctctagttgccggatcctcttaggtactagcttatttccattttctattttctgcttaagctaggttaagcctttccatagttggaggcacaacagtttctactcctgcatcgagtgtgaaaaagaagtctctgtgtttctaggtacccctaaatgcaagtgatctgttcttttcgtttcaaggatgtggaagacatcttcctacactttttctagtaggatccaacatttcagctccccctgcctccaaaccaagatcacacacatgctgaggcagagccacccccttaatcaagtgtccaccatcccctcaggcctagttcttccatgttttcaccccagggctccctgccgctgctcctctagcccccttcagacctggacatcccaacagagtctatagccttcaacagtcctcaggttcctctagcttactcaccctagacagctgaaggctggtggaagagtaacagagatcagagatgcagaatccttccccctttctttgtggttggttggttggttggttggttggttggttggtttgttttagacagggtctcactgtgtcacccaggctggaatacagcagtgtgatctcagctccactgagcctcgacctcccaggcctcagacaatcctcccacctcagcctcctgagtagctgggactacaggtgtgcaccatcacacctggctgatttttttgtactttttgtagagaaggggtttcgccatgtttccaaatctgatcttgaactcctgggctcaagcgatccgtccacctcggcttcccaaagtgttaggattactgttgtgagccatcgtgcccagacttctttacgttttgatgaacgatagcctgtatttttgcaactggtttacactaagcccagtgtgaataagcttatatgaattaatacataagaaaatattggggccatgcacagtggctcatgcctgtaatcacaacactttgggaggctgaggtaggcggatcacctgaggttgggagttcaagaccagcctgaccaacatgatgaaaccacatctctacttaaaatacaaaattagccaggcgtggtggcaggtgcctgtaatcccagctactcgggaggctgaagcaggaggatcacttgaacctgggaggcggaggttgcggtgagctgagatcgcgccattgcactccagcctgggcaacaagagcgaaactccatctcaaaaaaagaaaaagaaaatattggaatcttagaattagaaataacatggtcataataaaatgagtctcttaatttgtatgttgctttaccattttaatgcaattttatatacatggtctcatttgagttccaaaatagccgtgtgtggtaagtatggaagatatcatcctcacttgacagatgagaaaactacagctcataaaggttacataacttgcccaaggacacatgggtaatgaatggacctggaccagagaattcaccttcttatcacactatgccattgcttgtttatttgtttgtttgaaattgccttcagaacatgttacattgtataaatgttttctagaatccctaaattatatgctgtaacctgtattaaattttttcaattatttctattatactgatatgagcaatttaaaatgtatatacataataagatactgagtttaataagatttttaaatgtagtcagaaatctaacaaaagaggaatttgaaaatcatttgaaaaagattaatatttctagaatatgtgtattatttcctgaaggtagccattttgtttttcttttcttttcttttttcttttcttttctttttttttcctcttttgagacggagtcttgctgtgtcgcccaggctggagtgcagtggtgcgatctccgctcactgccagctccggctcccggactcactccattctcctgcctcagcctcccgagtagctgggactgcaggcgcctgccatcacgcccggagaatttttttttttgtatatttagtggagacggggtttcaccgtgtgttagccaggatggtcttttctttcttttttttttagacatagtctttctctgttgcccaggctggagtgcagtggtgcaatcctggttcattgcaacctctgcctcccgggttcaagcaattctcctgcctcatcacctgagtagctgggattataggcgcacaccaccacgcctggctaatttttgtatttttagtagagatggggtttcgtcacgttggccaggctagtctcaaactcctgaactcaagtgatctgcccgcctcatcctcccaaggtgctgggattaaaggtatgaaccaccatgcctggcgaaggtaacctttttgaaggaggacatgcatttttatatatgagtagttaaatttgtctctgtgtaatatatttttaaaacatttgaatttgtcttattatgcagtagaagccatgcagtagggaaatagccatctccctatcaaacatgacatcgagaaaatgtaggcatgttacatgtgtttgttttgtcttagagttttatagtatagtactaaatgaattaatagctattttaaagaccaggcctttgttctgatctctgctgcttttcatgctaacactgtgtttaaaagtattttttcatactcaagagtgatattaaaaatacttaaaaactgatatggcccggtcagtgatcactgagaatatacccgggctctgcacacctggtgtagttgctcgctggcagtacatccgagctgctcagtcacatcacatagcactcttcacttgcctgagtactttcatttccattctcccaggtgatctggggagggatgtagtgccatccccattttgcaaattgggggaatcacagccccaaggagctgaccatagggccccttagaataaaggatttctggctcgtagtttggtggtcttccttgggtagaagtttccctcttttcagaagagaaggaagaggtcagaatagccatgtttgataggacaaatatcagctcctttcagaggaaactcatagtaggtggtgggtagaattagcaccgtcccatcctccctggaatcttccattcccaagcagatttgtcactttcagggcctttgcaggagatgcctgccgtggaagagtaaaactggctcaagcgagagagcagatttttcccggtggaagaacctgactcagcctcttttttccatattaacagggatgttatgtacacggcctgactttaaaagtatattcttttaattccttgttttttcccttctcctccttccacagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtaacccaggcctttagattttctcttttaaaagtttcgcactctggaaaatgctgccatatttaattcctaatagagatagaagtgagtgtattggaagagggatgagggggatctcaaggaggacttcaattcttacccctttcaccacccccattattctgctgagtatcagttgccctgaaactcccttcctatcttttcttccagttctgtccgttcttctcccttctattatgttctttctcttgctcccatgcccgaccttcacaggctaaattgtgtgttgggtaggtgtgtgaggccaggtttggaggtgtggcaggttcttcgaacagatttggatgcagtcgttctgttgctactcttggcttgcctcagatgttgtctcagaaactagttccatgtttttcaccgatgcgtgtattgttttatgacatgataattgcttctggcattgttgctcataaacatatttacgaacacagcatttcaactatctaactcaccagaaacttgaggaataaagattggttagatggtttaagaatctttgctggaaggcacagtaggtgacaaatgttcccttttcccttctttttttcttcttcttttaaaaaatctcttgttttatgaaaaacagaaatcagtttgctctaggacagtggaagatatggcatgtctcatgcttttggtcctgggcttttgggtgccttgatcaaagctcagcaactgattagttttgtctttggggcagttttggcgcctggcttgagtacagagtttcaattctaattctcaaggtatggaagcaaatgctaaaactatgaaggaaaaaaatcccaggactattatcagaggcccattatatataatatagcttgatacttttatttaggcatgctgtttatccttattgcctatcgtatttatctagtgtctataatggttaatgaaggagacgtggcccctgccctcatagagcttacatctagcagggaagatgcgtgttgagcaggtttttcaagtgtgatgagtttgtaaagggggaatccaaccttgtctgagggatgatggaaggttcccccatagaaatatggctttagcctgagagctgaagaatgaattaggcaatcaagaaagagccatagagggggatgggaaacagtgttccacagtgaggggacaacttatgcagagctcaggacaagactgtttagatgtgaaagaagttcaggaggacaggagcatagactgagggacagggtggtgcctgatagggctggagacataagaaatgattggatggttcaaaggaatttggacggacttccaagaacaacacaatgtcaccgaataatgtcataaaatttgtgttttaaaatgcagtaggaggagagagttggagaggggcaagagtgaatacacgctcgtcaattaggaagtagttgaaggttaaagggatagataatgggttctcatttagactagggtagtggtgatagagatgcaaagaaatagattcaagaggagtttaggcaatgatgatttaaggctcagtaactggatatgggagagctgaaagaggagggaatcggccgggcatggtagctcgcgcctgtaatcccagcactttgggaggctgaggcgggtggatcatgaggtcaggagattgagaccatcctggctaacacagtgaaaccccgtctctactaaaaaatacaaaaaaattagccgggcatagtggcgggcgcctgtagtcccagctactcgggaggctgaggcaggagaatggcgtgaacccgggaggcagagcttgcagtgagctgagatagcgccactgcactccagcctgggcgacagcgcaagactctgtctcaaaaacaaaaaaaaagggtggggggagggaatcaaggatgacctccagattcccagcttgagtttgggggtacagcggcatcattcacgatattgggaatgtggaaagaggagagaggttgggatgagggggaatgatgaattcagttttgggtaagctgatttgaggtactattgagtaggcagttgagtgtacatacatgtccagagatcagaaatgaagtgtggcctggaacatcatcctgtggtattaacactagataaaaactgaaagcccgggcagggatgagattcccaaaggagaaagtgaggggagaagagagcctaggatgtaatctgaaggaactaccacatttaaggtgaggtagaggagagcttgcaaaagaggctcagaagagccaggaggaaaaccaagagagtttatggtcacagaatccaaggaaagaaaagttttctagaaggatggtagagtcagctgtatttagtgtttcagagagggcgaggaaggtgaggactgcaaggcatctgttggattaaatagtatggacacctttggtgagtacaggatggaattcatctcagaaaacagaacgttacactgtagaagcctgatgtgacatgatttccatggaaagccagagtgagtgtattgcatttcatcttcacagtgtgggatattaagggcatgtactgttatcctaaagcaaggaaaggtaacagaaatattgtcatcattgaatctcccttcactactgctattcaggcattaaggttcctgacactttctattaaaaccctcaataccattatgggacctgtatcagagagagcataacaagccaacttgttacctgctaggtaacaagttgttcagtcttttctttgttcagtcttttcttttttccaatcatttactgtataggatgtctgagaaattctatctaaatgaaaagtcttctctcacacagcttcccccagctaccacagcatgcttctctgcatacttgtagcgtttacaaaacctgtgcctaccacatatttcttaagttgtcttataattgtttcatagaaatctatcttctttccccagctatactataagctccttgagggtagggatgatgtcgttggttgcttttatgctttccaatcatgcctagcaaggactcaggtaagtaacacttccaactgaactctggtttcttgagttcttgtgatagatactgagatgccaagggcttccctttttgcatgactcatggaagtaggcgttatcaacaatcaaatcatttaaatcccatttttttttaggtatggcttcacgaaagaaattttgcataaatataaggtaagacatgcttttttttttttttttagtattcactttgctgtttctatagagaaatttaaaaagagccaagaaagaccagattgatgctttaggaaaggtaataggccaactagtcagaatgcatgccaataaaatacaagcacagcaggaagccctggccacagtagagtcttatattttctttctggattaaaccacactttttcattgtgagttttgtgtaagttttagcatagatacatatttcattgcttcaaaggtaccaaggatttgttttacttaggtgtggtaaaatatgcagacacagaaatgactgtcatgaaggaagagatttttatttacaattctctagaaaatggaggcactgcaagccactctgggagaccgcgtggggaagcaccagagttggtcagaaggcagagggaggctgagcacggtggctcacacctgtaatcccagcactttgggaggctgaggccggtggatcacttgaggtcaggagttcgagaccagcctgaccaacgtggtgaaaccctgtctctactaaaaatataaaaattagctgggcgtggtggcatgctcctgtaatcccagctactcgggaggctgaggcaggagaatacttgaacccaggaggcggaggttgcagtgagccgaggtcgtgccactgcactccagcctgggcaacagagtgagactccatctcaaaaaaaaaaaaaaaaaagaaggcagagggagggtggagggaagcatctgagtgtaatctggtttaggactgaccaatttgagtaatttcagactgctctgggccacagaggttgtccctagttgtctggtaactggccccgggatgaggagtgtgagagctccataaagaaggtagctggggtgtgggctctcggttgcttggtttgcatatgaagggcgagtcattgactatctaggaattagctagccccgggagggacagtctctcctccagagtcagcaaggccccaagatgtcatagtatcaaaaatacagaataaagggccaggcatagtggctcacatctgtaatcctagcactttgggaggccaaggtgggcggatcacctgaggtcaggagttcgagaccagcctggccaacatggagaaaccccgtctctactgaaaatacaaaaattagccagtcgtggtggcacacgcctttagtcccagctacttgggaggctgaggcaggagaatcgcttgaacctgggaggcagaggttgcagtgagccaaggtggcgccactgcactccaatgcgcaacagagcgagactccatctcaaaaaaaaaacaaaaacaaaaacagaataaaaagacatgatgaatacatgctaattggttagtgactccttgctgacttcctttgagtggcctgaaaatcattactttttgtccatacttggggactattcaataaactgaacctgtcagaaaaacaaaacttactcaagctcttacttacagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaaggtaagaagtaatgttggcatgaatcttctctcagggatttagaagggaatacatacctcttcatttattattttgaattgatttgtgttttagtggttgtaactctaaaaagattatagattttattagagtatataaaagtataaattttaagaaaaatctatgactgcatgataaagaactaagtgggtaacttctatatatggaaaaaaattttaaattcatgttgagggtggaaaaatgaggaaatgttggcattttatgtagtttctaaaagtgaaaaatcctgatttttaaaattaaaacctcaattcattcatttatattgtggtaaaatatacataacataaaacttgccactgtaaccatttttaagtgtatagttcagaggtattaagtatattcacattgttgtgcaaccatcaccatcactaccatctatttacagaattttccatcatcccagaccgaaactctggacccattaaacactaactccccattctcccctgtcccagcccctggcaaccaccaaccaccattctaccttctgtctacgaatttcaccactctaggtaccttatataagtggagtcacttatataagtgcagtttatttctgaattgatacgatttcccacataatacacatcaaataacttaggatactttttttggaaatatttttttgaaatgtttaaataatcatgttaaatacaagcagagcaggagctagtatggaacctctgagacaagtggctatgtggtgactgtgaagatctcacgcctagtgaagggttccttggacgggtcttgcagggtcattggagttgtcttcctcctctactcaagccaagaggaagccctcaggctagaggtgtaggggcgccacatgggttgaagaccagtaacagcagtggagccagatgatgctatatggtcctagtgggaaacctgaactgttacccctcaggactgatcatcaacttccaaccaacctggacaggtggggtctagagctggaatttaatctgatagagacagaaatgtgaccccagtggcaccttgacttcttggaccctttatacacatgtgaatgagaatgtcgttgctggtatcctcccatctttttaattaaagtttaataagtctgacctccagaccagatgagatccccttttgtatactgtcaagccctttgtacatatctttcatcacagttaccgaatttaagtaagaaattgtggtactgtttgtttactatcttcctctgtttttctagtccattgataaaaccccagcacctgggatgtagtaagtacttaatagtcactgactatctcttgagggatttaagatcaaagcagggtaaacctaagacaaaactgaatagaaagttttttacagccctctcctgattctgtggtgattttacataccacccttccccacctcaccaactgatgatgatgcttcctggcttacacctgttgtcctattgtaattattaatagcacctccttttactctaaaaaaaaaaaatcccagttgcagccaggcatggtagctcacccctgtaattccagcactttgggaggttgaggtgggcagatcacttgggaccaggagtttgagaccagtctggtcaacatagcaagatgtcatctctacaaaaaagaaaaaattagccaggtgtggtggtgcacacctgtggtcccagctacttgggaggctgaagcatgaggattgctggaacccaggagtttgagattgcagtgagctatgatcgcaccactgcactccagcctgcatgacagagagagaccttgtctcaaacacaacaaaacccagttgcaataaaacttaagcccactctaagtttaaggtacctttctcattatatcagtgagtaatcaagccaataagacattttgatcaagatataatagtcattattaacataatgagtggattagattctaaccaagagcacaagggaacatgatgtctttgtcagtcaaatattggtgaacacagggcatgaatgccacattccatcaccacctgccctatgactacagtgctaatcagtcatggcagcctcttccaattgaccagattgaacacttttgctttcctgaggttagcctgagcagccagctctatcgagggctttttgagatattgagaagatgcctctgggatgtccctcactagctctgtggagatcccaagttgagggccaccttaacatagtaaagactgtgaggctctaagattagacagacagaactaggttaacatcctgcctctgccccttcctgggtgactgggcaacatactgaggttttctaatccttggtttccacacgtataaactgaagataaaaatacctaccatattggatttttgggaggattaaatgtaattacctatatgaagaaaatggtggccaggcgcagtggctcacgcctgtaatcctagcacttttgggaggctgaggtgggcggatcacttgagggtaggaattcaagaccagcctggccaaaaaggtgaaaccctgtccttactaaaatacaaaaaaatagctgggcatggtggtgcacacctgtaatcccagctacttgggaggctgaggcaggaggatcacttgaacccaggaggcagaggctgcagtgagccaagatcaagccactgcactccagcctgggtgacagtgaaacactatctcaaaaaaaaaaaaaaaaaaaagaaaagaaaagaaaatggcatatactactaaacatatagctttctcctccagttctctcttcttttttccttatacttggttctgaggtttgtgtttcagtcaccaatacagaccctggggagagtttgtgggccagccattttctcaggatacctaaagtttcacccccttcagggataactgttctacctgctctttagactggctttaaagatagaaattcaacttgtatattgtttgtgtcttctacccttccttgagtgaggttgaactggtaacacatacttgttgtattaaatatcattgaactgtagtgaaaatgataggttcaaccatttggaactctatcagatgagacataaaagtagattgttccagtccagttttataatccccactttcccatcccataggaccctccaaccctctgtggcaggagggaccatacttcctggtttacacctgcggtcgtaatggtatcattgttaacaggggttgggaagggttgggggaatttgatgacaacctctattctaggttcatttaaggtattttgtaaggtgggcaggttgaggggggtcaatgcagagggattaaagaatgaaggaagattttctaaaactaagattctggtttattatttgtcaaactccccagcaaggcatttgcagaaagatggctactagactccctgggggaaaatggtcgtgtagtgccttagggagagctggggcaaagtatcctgatcccaaatggccttgaaaacttcagagccacacatacttaagagaccatgtggccttgctcaatgagctcatcagaaatgagttgtgtacagctgggcacggtggctcatgcctatagtcccagtacattgggaggccgaagtgagacgatcacttgagaccagaagttcgagaccagcctgggtaacatagcaagaccccatctttacaaaaaaaaaaaaaaagaaagaaagaaaaagggaaaaagaagtgagttgtgtggacccaagtccagagggtcctcccagaatattctgctctgcccctaatgggaacatttgctggcaggagacagggcaggtaggctgtgaactagctagcaatagctgagcttgaatttctacctagctcaatgagacaggacctcagaataagattcaatttcatttttgaaaaataaaggtaagatttcctacacactctagtttgtaaaagaaactaagtgcttggccgggtgcagtggctcacgcctgtaatccgagcactttgggaggccaaggcgggcggatcacgaggtcaggagatcaagaccatcctggctaacacggtgacaccccgtctcttctaaaaaatagaaaaaattagccgggcgtggtggcgggcgcctgtagtcagtgctgaggcaggagaatggcgtgaacccgggaggcggagcttgcagtgagccgagatcgcgccactgcactccagcctgggggacagagcaagactctgtctcaaaaaaaaaaaaaaaaaaaaaaaggaaacttaagtgcctaccacagagaatttgtctatcactgaaccacggccaccagtataacagaagtattgtttaatattgttttgtttaaagacatggtgctacaaagaaacaagtataaaattacagtctctgcttgtgtaagggaacaagagggattctagtaattgatgccctatcagaaagacgttttgttttccaaagaaacgcagcagttttgttgccaagattagagaacatcgtcaatggctggcagagtcaggctgagaaccacaatgcatttaggttggaagggcttctgaagttttcaacctatgtcccctttaagaactttcttggacacagatgtaccttttctcttttcttctggaaagcataacaaaatgcacagcagccactctattaagaggtgtttctgaactcctgaagatcctatggctagataaaggctcaataaggagactcgttgcccctaccttggtatcttccattttctgtgtggatgccacagaatgtgtttaacacctatagagaaactccagtgaaacacagaaactctttctttataggcaatgtctgtaattggaaaatgtaccaacaatgtaacagacccactttacagacatcagtggatgagtgagatataggaggtggacgagatgcaaaaagtgaccgtgtgtttttcattgggttgtggcaccacaacatagaaagaatcccacctgggactgaagtctctgtatgtggcagaataagcagagggttggactaaagcatgaatttgttttatagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtaggtaatcagggtgttcactgcagtggcaacaatgacactagcgtgcatgttgtcccttacaatatatagataaaaagtgactttacctttacgaggagaccacatgattctcttggaattcatcactatatttttaacagctttattgagatataattcacataccatgtaactcacccatttaaagtgtataattcaatggtttttggtatattcacagtgttgtacaactagcaccacaatctaattttagaacgttttcatcatctgaaaaagaaactacatacctattagcatcattccccattcccttctgtagccaccctgtgccacctaacagccttaggcaaccatcaatctactatctgtctttacagatttgcctattctgaacatgttgtagaaatggacacatatgtgatgttttgtgtctggcttctttcactcagcacaatgttctggaggctcatccatgttgtagcatgtatcagtactgaacatctatttgttgctgaataatattccattatatggatatacacattgtatttattcattcataagctgatggacgtttgggttgtttccactttttggctactatgaataatccttctatgagccatcacatacaagtttttctgtgcatgtatgtttttatttctcttaagtgtgtacctaggagtggaactgctgagtcataaactaattctaaaaaagtttaacattttaagaaagtcccaaactgttttcccaagtggctgcaccattttacatttccagtagcaatggatgaacgttccaatttctccacatcctctctaacacttgttattgtctatcattttgattatagccatcccagagggcatgagatggaatctcattgtggttttgatttgcatttccctaatgactaatgatgtcaagcatcttttcatgtgtttattggatatttgtagatcttctttggagaattgtctattcagatcctttgcccatcttaaaaactgagttatttatctttttattattgcattgtaggaggttttttgaatatattctaaatacaaatcctttatcaggtatattatttgcaaataccctctcccattctgtgggttgtcttttcccctttcttgatggtgtcctttgcagtacagcagtttttaattttggtgatgcccagtcaaaatgatatattttttctctttggttgctcgtgtttttggtgttgtatctaagctattgcctaatccaaagtcataaagatctattactttgttttcttctaagagttttatacatttagctcttaaatttaggtgtctgatccattttgagttaatttttgtgtgtggtgggaggtgagattccaaattctttctgttttatgtggatatttagttatcccagcaccaattttttttttcttttttttgagacagagtctcgctctgttacccaggctggagtgcagtgacacgatctcggctcactgcaacctttgcctcctgagtagtagcttggattacaggcatgcattaccacgcctggctaatttttgtatttttagtagagatgagatttcaccatgttgaccaggctggtctcaaactcctgaccttaggtgatctgcccgcctcggcctcccaaactgctgggattacaggtgtgagccactgtgcccggccaccagcaccatttcttaaaaagactatactttccttgttaaattttcttgacacccttatcaaaaaatcagttaaccataataaaagggtttatttctagactcttaattatatttcacaatctctatgtttatccttatgtcagtactgtacaattttgattactgtagctttgtgggaagttttaacattgggaagtgtgagttctccaactttcttcttctttttccagatcgttttggctattctgggccccttgaatttccatatgaattttaggattgatttgtcaatatctaccaaaaagcagctgggatattggtagggttgccttgaatctgtaggtcaatttgggtactatggctgtcttgagatgtctttccatttatttagatctttaatttcaacaatgttttttacctttcagtatacacgtcttgctcttgttttgttaaatttattcctaggtgtttttgatgctattgtaaatagaattgttttcttaattacattttggattgttcattgctagtgtatagaaatacaactgacttttatatactgacattgtgttgtgaactttgataaacgtattagttctaatggtttttagtggatttcttgagattttccacctacaagattatgttatctgtgaataattttacttcttcctttccaatctgtctgccttttcttttccttttttttctttttgcttaattgccttgtctagaacctccagtacactgttgaataaaagtgaagagagtagatgtctttgtcttgttcatgatactggggaaagcattcagtctttcatcaagtatgatattagctgtgtatttgtttgtagtggccttttattacattgaggaagtttctttctatgcttagtttattgagtgtttttattgtgaaagagtgttggattttgtcaaatgctttttctgaatacattgaaatgatgtgttctttccctttattctattaatacagtatattatattgattgatttcagagatgttaaaccaacctgacattcctgggataaatcccacttggtcatgatgtataatccaccttctatgttgctggtttccatttggtaatattttttgaggatttttgcatctatattcataagagctattggtctatggttttcttatgttgtgatatctttgtctggttttggtataagtttggcctcataagaggaattggaaagtattgtctcctcttctgtgttttagaaaagtctgtgaaggattgattttaattcttcaaatgtttgatagaatccatcagtgaagccatcagggcctgggcttttctttgcaggaagttttaaaattactaatttcaatatttttccttgctatagttgtattcaagttttttgtttcttcctgagtagtttgtgtcttggtagttgtgtctttcttggaatttgtttcatttcctgaaacaaatttatttcatgaaattcatttcatctaatatatctaatttgttgacctaaagttgtttgtagtacttctttatttttttttctcctgaaagtttggtagtaatatttccttttttttgttggtcagtctcactaaggtttgtcaatgttattgatctttttgaagaaccaacttttagttttattgatttttctctattgttgtctattctctatttcatttatttctgcactaattgttaacagtggagggtgtccaggttcttggcgtcttgaacaatgaattggacaaaacgcacaaacaaagcaaggaaggaatgaagggttttactgaaatgaaagtacactccacagtgtgggagtggccccgagcatacgggctgaaaggccctgttatagaatttctgggagtttcaatacccccagaggattccattggttacttggggtacaccctatgtaaatgcagagtttgaagtaaagttacaaagtcatttacagcataagcccaatggagaggatatttcctgtcatagctgaagtgtgaactggccttatgttccctgcctccagaccttattttcctgcctcataatctttatcatttccttccttctgcttgttttgggtttagtttgctcttctttttttcagtttccttagaaggtaatatcattgacttgagatcttttttattttttaacaaagatacaaatttccctttaagtactgctttagctccatcccttaagtttgctatgttattaaacaattgctgctgctttaaaaaaaatagttttgctatgttgtgcttttgttttcaatagtattgtctaaatatccttgtgatttctttaacttatctgttatttggtagtgtgttgtttaatttctacatatttatgaattccccatatttctttcgcttattgatttaaaatttaatttgattgtggtcagcgaacacatgctttgcctgatttaaattcctttaaaactttttttctttttttggtaaatccttttaaaatttgttgaggctttttttgtggcctagcatatggtttatcccggagaatgctccatgtgcacttcagaagactatatatttcactcttattgggtggagtgttttatatatgtctctttgaacatatttataatagttgctttgaaatctttgtctgctaagtcgacgtctagtcccttcaaaagcagtttttattgcctgcttcccccctccgctccccccaccccccgcccgtgtatgagtcatacttttttctttgcatgtcctgtaatcttacattgtagtaaccctaggtagttattcccatgcccctctggggcttgttgttatttgcttttttgtttatttgttgagtgacttgtctggactagtttagtgaagtctattccccttcagtgtgcagcctctgatgtcactcttcacagagtgctgccttgggcatgcatacagtttctcccaccaccagggctggtgtggatttaattgggctctctttgactgtctctttccctgatctctcctttaagcttcggacccatctgcctctatttgaagcagtcccagctgttagccttcactaattgctagccgattgctctattgtttttaacaataacaatgccctggcccacagagtgctctacagtctgatccgattaaagttggacccctttgcaggggcagggctttaaccatgtttgaggcttactccaacctccacaaaggctcttttctcatctgtgtctttccccgattcagtctgttaaatttcttctagctggggtactgttactactagtatctcggcactaccatcctcctcgtaaatgcttattcccaacaatctccattgttttcaacagtgcctttaggcatgaacttccttacactctgtgccaaataaggccagtcccttaggaagagtggcagtgctctgttcttgacctgcctcaccccctgggccaaaccactgtgccatcgcactgcagctgggagcagggacagtgacccacttctcctccagtgacagccccattccacaagtggggtagtaggcagggatgatagctcctggtcttcttggcttgcccttcttggcatagcacctcctccttatgattgagcaagcatgggggcagttggggtctagcacctgcaggctgccatgcctaggatagggcttctgcccaatgagcgggagaagtgaccccagtcctctctgctgtgcttgcctggaatccagcttctgtaacgcagagctgaggggaatgagggatgcccatcagcttgctccttctggggcaaaaccatagccctctactgggagctgggggaagaaggagccccgtcttggatgcatccacttgaagtagagcatccttcatgctgatcagtgaagggggttagagtagatcatggctcaaatgccacagactctctctgttggtatcaaaatttagtaagttttcttaaatgtttctccatatgctgtatgccattaggacaatttccagtggctttaactattttaatttttttttaagtgattttccgctgggcgtggtggctcacgcctgtaatcccagcactttgggaggctgaggtgggcggattgcttgagcccaggagttggagaccagccttggcaacttggcgaaaccccatatctataaaaagtacaaaaattagctgggcgtggtggtgcatgcctgtagtaccagctacttgggaggctgaagcaggagcatggcttgaacctgggaggcggaggctgcagtgagctgagatcgtgccactgcactccagcctgggcgacagagtgggaccctgtcttaaagaaaaagatgttcaccagttaaatggttgtttcactggggagagggtctgccaagcccctaacactgccattcctgtcactatgttgtcattttgagaactgtactgagtatgtctataaacatggatgtaaaggcaataagccatgtactcatctttgtgacagcgtgcatatccagagctgcctgtctggagtctctggcagcttctggcatggagtaagatctataaatattcctctcattcattcatccattcaacaagaatgtattgatcactcctgagtactcttgctcatttgtcttggtgaaatttagcgtttttctaaatttccagtcctacattttaactgctttcttgtcagtttttaccctatatggcagggatgagttcttaagaacaacagctatgtgcattatctcattaaatccttaaagcaacctgatgacgtagataatattattcctatttcccgaaagaggacactgaagctcacataagttgaataatttgctaaatgatgggtctggttttgattccaaatttgttggactctacgcttctcatttttgactgctaggtcataccatgtctctcactgtaggaaaagatgttacaggacactgggttttgtttgtttggttggttggtttcctttttttgagatggagtctcactctgtcacccaggctggagtgcagtggcgcaatctcagctcattgcaacctccacctcctgggtttaggcaattctcctgtctcagcctctggagtagctgggattacaggcatgtgccaccacgcccagctaatttttgtgtttttagtagagactgagtttcaccatattggtcaggctggtctcaaactcctgacttcagatgatccacctgccttggcatcccaaagtgctgggattacaggcatgagccactgtgcccggccccagaactctggttttcaacttcttacatgggaatgttatgacctcttagaaaggacttttgaagacttttcttcaggtttcctgttctgaaagaaatgaaataaaattattggatatggactaacgcttaatgataaaagtgttcttcctgtagatagaatcataaccataataagtagctttcgttttcagatataaacacacatacatgcatttgcaatgtcacaagtacacatagacacgtgcccacatgatgttggttacatctgtagctgggaaacataattaaacaattaccaaacagtgttaaatttcttacttcccttcagtaattgttaaagaaacctctttttcttgatttgggacccttataccttgattgctgaaaatgttgactaaaatgtgatttctggtgtaaaatataccctaatcaatgaggagagagagaagtggggagacagactgagggagaaatggaattcatcattggctgtgagtccaaaatatttaaaaatcaagtaagcatgagaggcatctcatagcaagtaggaaaggatgcctccttaaaccttgacatccaaatcccaaagactgaaggttagaacaagctcttctaggattatggtgaataaagaagataatgttaaagaaattggagctgcacacaaagaaaattgtggcctctggaagcctagaagagttagaagagccttaagaagtgggagggaggagactggggctcattattccataacagagcctcccactccccaaacaatagagatacagcatcttgcagaccccacacacatgatcagagctgacattgggtaaaatgggccagaacctcatttctgatgtttaatcattttagttgtgcccctaattttctttcctcagttcctggtacatagtggatacacacacacataagttatgctagagccgaaatttccagataaaaacagagctgacaattactttatttcttaatatctatgagctattttgtataaagatcatatactctttattttgtcttgtagtcatggaaattcataattcttggcagagtgctatagtttaaattttcccttatgttcactgagatgtggggatatatttaatcggagttaagtcactatacagagatgaatatgatactctttaagacagacttacaaagagacagaggccagaaaggtttcaaaaataattttaattatttatagtctgaatgactcccctctctttattcattcatttaacaggtatttattgagcacctactatgtgtcagacactgttctagacttctgggaaatgtcaatgaccaaataaagatccgttaccttgcagagcttacattttagggggaggagttagatgacaaacaatacagtaatgagtaaatgatatgatatcttaagtgatatgttcttttttattattattattatttttagacggagtctcgttctgtcgcccaggctggagtgcagtggcgcaatctcggctcactgcaagctccgcctcccgggctcacaccattctcctgcctcagcctcctaagtagctgggactacaggcacctgccaccacgcccagctaatatttttgtatttttagtagagacggggtttcaccatgttagccaggatgtctcgacctcatgatccgccctgcctcggcctcccaaagtgctgggattacaagcgtgagccactgcgcccagtcttaagtgataagttctatgggaacaataaaaactagagcagagttaaggagaacaggaaaactggacttggggacaaaattgcaattttttttttttgtttgtttgagacagagtctcactcctgtagtccaggtgggaatgcagtagtgcaactacggctcattgcaaacctgaccacctgggctcaagtgattctctcacctcatttttttattttttatagagatgatgtctcactatattgcccagactggtcttgaactcctgggctcaagcgatccttcctcctctgcctcagaaagtgctgggattacaagcatgagccacggcgcctggccaaaattgcaattttaaataacgtagtcagcagcattgaggaggctcccaagagggaaatgacttgattgaggtgtcttggctggtcaggaatgatagagtaggatttgatcctgaggttgacttgaatgtccatgctctttttctgaagggatagatgagagtgacaggcattctcaggaaggacgtgacctactttagtcagcccttattcaatgaggcctgaagggtggacagggagcaggaggaaggcatttaaagaaatctaggtacctggctggaaggtttgggctgagcacggctttttttttgagatggagtcttgctctgtcgcccaggctggagtgcaatggtgcgatctcggctcaatgcagcctctgcctcccagggtgaggcaattctcctgcatcagcctccaaagtagctgggattacaggcatctgccaccacgtccggctaatttttgtagttttagtagaggcagggtttcaccatgttggccatggtagtctcgaactcctgacctcgttcatgatccacccatctcggcctcccaaagtgctggaattacaggggtgagccaccatgtccggcctgagcatagcttttaaaatgacatggtctaggccaggcgtggcggctcacgcctgtgatcccagcactttgggaggccgaggcaggcggatcacaaggtcaggagttccagaccagcctgaccatcgtggtgaaaccccgtctctactaaaaatacaaaaattagccgggcgtggtggcgcatgcctgtaatccctgctactcgggagactgaggcagaattgcttgaacctgggaggcgggggttgcagtgagccgagatcacaccactgcactccagcctgggcgacagagcaagaccccgtctcaaaaaaaaaaaaaaatgacatggtctagctgggcgtggtggcacgtacccgtaatctcagctagtcgggagactgaggcaggagaattgctcgaacccaggaggcggaggttgcagtgagctgagatcacgccattgcactccagcctgggcgacgaaagcaaaactctgtctcaaaaaataaatgaattaatgaattaattaaaaatgacatggtcaaaagctggaagggaggatgtataactaagggaaaatatgaaagaatagtgaatctatagtattaatgttttagaagagaagcatttagatatacctttcagagctattaactctccctcgaagcacacttttggagtctggattacttagagctgcagacatgcgcaaggtccttcttgaaggatttattttagattgaggagatttaaaaggctgacacacaaatagatttttgttgaccaggtcatataaaagctgtaattcagtaaaacgttcccattttttttgtttgaaatttttcaggaaagaatgttgtaaagaattaattagtctttcatgcagtgatcaccccaaggatcctgcatttcagaggataatgtgttgttgagatgaaagagatggtttctactgaggaatttgtttcaccaacaaatgggcttttatgcaatttttttgtgagttctgcaattaatcttacgttaccactacgatctgggtaaacctagtcaagtaaatgatttctagacagaaaaaagaaatgcagaactcagggaatggattctgaaggacaagctcagttcttaaaaactgttaccccttatgacttagaatcaaagaaaaatgagtgtcagatatatcttcctcattcctttgatgatgactaagtcctgaatatgttaagtgatttgcccaaggtgacttaggtaattacttgaagtgctaactccttggccagtgcttattctagttcaacagagtcccatcatatgtgcattgaatttatgtaaatttcaattattgtatatggcaaaaaaggagaaaaatactggaaaattttattttcatatactttatcacatatataaaataatatatccatatttatataatatatataaaacattcacatatccatattattgtatagagttgtatgcatacattcatgtacagtcaaccctccgtatgcacgggttctgcattgtggactcaaccaataacagattgaaaatatttggaaaaaaagaaaacaatataacaatacaatctaatataaattttaaaatatggcataacaactatttacatagcacttacattgtattaggtattataagtaatctggagatgatttatagtacagatactctttgatttatgatgagtttatctggacttaattctatcatgtcaaggagctcattgaatgcttgttgcttttgcaccattgtgaagttgaaaatcgttaagtcagggaccatttgtagacaggaggatgggtgtggattatatgcaaatactacgccattttatacgagggacttgagcatccacagattttagtatcctggatgtaggaggtggtcctggaaccaatccaccttggatactgaggggcaactatatatgttaagggtaacttaagaggtttcccaggggtaattttggctataaatgatttgcatcccatgtagaaattggaagcttaatcccctcctaacaaagcccaactccttgatttccatctttcctccatcattatattacaggtcgaattatgtccctaaacatgacatcatggtgtaagagccagatttgactcagttgaaaatgcaagtgttatttttgtcataaacaccagcaaagtaaaggggttccattatatttattcatagagtagggcggtgctgatgttggaattcagtggggagaaaggagcccccttggctgactcttctttgggtggttttaactgtcacttcaatcatcaaaaactctgcaggtatctgatgtgggcctggtacagggtttctcttttctctagttctgaccaggtacttattccagggtagctctcctgccagttctgctcttttcacctcactgtctttttcctcacttattttctagctcctcttccataccaaacttataaacgggtgtacaatcatgtttagcaattcctggtcctcttctccagacctgatttggagccactagaataactgcataacttcacatgcctgctttttcatgcactcaaaagaaacatgtggaaaatatagactgttagaatcagtctgttagaatctgagatactttacaggtcaactggtccaaatgcctgattctaaagatctcaaaagtgagacccagggaggattttcaaggttatgtagctttaatggcagagagagtttttctcaccgctttaagctgttatagaagtttcaataaagaaacattacaggccgggtgcagtggctcacacctgtaatcccaacaccttgggaggccgaggtgggtcgatcacctgaggtcaggggttcgagatcagcctggccaacacggtaaaaccctgtctctaccaaaaataccaaaaattagccaggtgttgtggcgggcccttgtaatcccagctactcaggaggctgaggcaggagaaccacttgaacccaggaggcggagtttgcagtgagccgagatcatgccactgtactccagcctgggtgacagagcgagactccatcacaaaaaaaaaaaaaagaaaagaaaagaaacattacagatagatgagagccacaaagacggagcctccaatctttatgaaaaatattattttgttttattttgagatggtgtcttgctctgttgccgaggccacagtgcagtggcatgaacatggctcactgcagcctcaacctcctgggctcagggatcttctcacttcagcctcccaagtagctgggaacacattccggcaccaccacacctggctagtttttattttttaagtttttgtagagatggggttttgccatgtttacccaggctgctcttgaattcctggacccaagcattcctcctgactcagcctcccaaagtgctgggattacaggcataagccactgtgcctggcagaaaaatgattttaaaaatttggatctttagtcctggacatcatgtaacctgcatttgcctctcctgcgccccaaaggaaatgttataataatacaacacttgtggatttagaacacattatggaaaccagtcatttactaaatgtattgcggaaactgagaatgtacttaccatcgaggggggaaaagtgaaggagatgctttaggagacaccctcagataaacaggtttccacatttgtgttgggaaacagcaagggcttcctcaggctatgtgctcaacaggacaaaaacctggcccagagccacagcaggagacctactttatgtctttgaacatattaagacacacctaatgtgtgggcattgtggggagctaatttcttccctgaatgtgacaatgaagttcttttaagagaaaagaaccttgtagattcaacaattgtcaaacaattgtgatggaatttttaaagccaaaaaaacaaaaaaaaaatggcaaggcctgattcttggttattgttattgctgtattggttattcatggaggagatgaatatgaaacaatattcttttttctttttcttttttgcggagaccagctcagtaggggagaccctaacccagcagcgctagaggaattaaagacacacacagaaatatagaggtgtgaagtgggaaatcaggggtctcacaaccttcagagctgagagccccaaacacagatttacccacgtatttattaacagcaagccagtcattagcattgtttctatagatattaaattaactaaaagtatcccttatgggaaacgaagggatgggccaaattaaaggaataggttgggcttgttaactgcagcaggagcatgtccctaaggcacagatcgctcatgctgttgtttgtggcttaagaatgcctttcagcggttttccgccctgggcaggccaggtgttccttgccttcattcccgtaaacccacaaccttccagcgtgggcgttatggccatcatgaacatgtcacagtgctgcagagattttgtttatggctagttttggggccagtttatggccagattttaggggggcctgctcccaacaattttgagacagggtctctgtctgtcacccaggctggagtgcagtggagtgatcatggctcactgcagcctcaacctctcaggctcaagtgatcctcccatctcagcctccctagtagctgagactataggcatgcaccaccatgcctggctaatttttgtattttttgcagagttgaggtctcaccatgttgcccaggctgggcttgaactcctggcctcaagcactcctcccacctcagccacccaaagtgctgggatcacaggcatgagccaccacgccaggcctgaaacaattttcaaggaagaatgagaagtggtctttgggataccttgggttaatatttctgacaaataagttggaatctagaaagatatactctcacttgtaagttacagcgaaatctggtttgttgttccaagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtaagctaaaattgttggtgacattcccataaacatccttcccctaagcacagtcttttcttcacagagcatgtctggcctagaagcccatgagaagatgtcttctctagtaccaaacagaaaccagagaaggcgagcttcatctaggttgtttgaaggggcctcactgtcccttatcctaaaagatatttggtttatttccctgatcttccctaatcccagaaacagaaattctttttttttttttgagatggagtctcactctgccacccaggttggagtgcagtggtgtgatctcagctcactgcaacctccgcctcccgggttcaagtgattctcgtgcctcagccacccaagtagctgggattacaggtgtgcgccaccacacccagctaatttttgtatttttagtagagacagggtttcaccatgttagccagactggtctcaaactcctgacctcaggtgatccgcctgcctcggcttcccaaagtgctgggattacagtcgtgagccaccgcgcctggccccagaaacagaaattctgatacatggcactaagtagacacacagaaaggcttggttcttataaggcaactgtcccatacagtggggttgagaatgtccttttcctcacagagcgcataaaaggcagcagtgaatccagtttgctcttgcactttttacatgttccctgtgcagggcccaaaacacaaaacacacttcccttcagctccctgagtaggtgacctccagcaagttgctcactgtagtcagtttagctgcagccactaaaacggagtgtgttgtgttccttcagtggtgtctgatcaaaggctaaaagaggtgaggaccgaggagctggtttcttgtcccaagttgttctgggatgcaccgtttcttttttttttcttttttcttttttttgagacagagtctcgctgtgttgtccaggctggagtgcagtggtgcaatctcggcttactgcaacctccgcctcccgagttcaagtgattctcttgcctcatgctcccgagaagctgggattacaggcgcccgccactacgtccagctaatttttgaacttttagtagagacaaggtttcatgatggccaggctggtctcaaactcctgacctcaggtgatccacctgcctcagcctcccaaagtgctgggattataggcattagccaccgcgcctggcctggaatgcacctttttctatagtgaacagcaataaataaaaatggacaccaagttgtgtggcatttccctctgtgtcagcactttgtttttctgacctttattaattcattttcagctcatactaacattccaagatgagtaaggcaagtattgtttagggtttctttgtagtaagaaaatagatagaaaacatcagtggcttgtctgaagtgacatgctcatcaggacagaacggggcctaaaccaggttccctgtcacccacaaatattgtcctcctggctgggcacggtggctcatgcctgtaatcccagcactttgggaggccaaggcaggtggatcacgaggtcaagagatcgagaccatcctggtcaacatggtaagaccctgtctctactaaaaatacaaaaattagctgggcgtggtggcacacacctgtagtaccagctactcgggaggctgaggcaggagaattcctggaacccaggaggtggaggttgcagtgaggtgagatcgtgccattgcattccatcatggtgagagagcgagactccatcttaaaaaaaaaaaaaaaaaaattgtcctcccatattctaccacagcccaaggctagttccttcacaagacagtggtcgtggtcccttattctagccactgcacctctgcccttaaagcactgactttctggggccctgaaccctctaaatcactcagctccaagcagaagaaaaaaaccgaagtaccagacaaattttgttctgaatgctcaactattacaaggcaagaaaataggggatttatccccttggaaaaagaatttgcaaaatcaaacattaaagaggattctgagatttggcactaaaattgtacccgagaatgcagggccatgcgctgaggacattggctgagtggccaggagttagtgctgctggggacactgggtagtagccttgttttcctccgatgcagtcatagaaatcacatcagactgtgatgatttgcagggtttatgaaccttctttgatttttgctttttaagaattgagctatttctgaccttattgaatgaccttttgagaactaatgttacgtgaacctgaccctctttttctttaaccaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaaggtgtgtatactataccgagagtgctgagcactggtatcacggacccattagaaccagtcccacgtgactaagagcagccacgtgagtgaagagagtcatttatagcttactcattagtatcaacaaaatgtaaatagttccagacaccaagtggtgaatgcacccatatttgaaaccaaaaagagcaattttaaattcatacatctttttagatggataaagcagtcagccctcagaaacgtaactgaatgtaaagaaaagaagatccccacacccactcagtcccccaacctacaaccttctctgacccacaaacagctctatctggtcttgcccctttctcttctctatccagaagtgtatgtgacaaatagttgagtgtctctctccatgtgatggcatttgtagcttatactccttttctccctttaacattatctttctaagtgttttttttggttttttttttgtttgttttttttcatttgttttttgtttttttgagacggagtctcgctctgcagcccaggctggagtgcagtggcgtgatctcagctccctgcaacctctgcctcccaggttcaagctgttctcctgcctcagcctcctgagtagctgagattacaagggcccgccacaacacctggctaacattttatatttttggtagagacggggtttcaccatgttggccaggctggtcttgaactcctgacctcatgtgatctgcctgccttgacctcccaaagtactgggattacaggcatgagccactgcgcccggtctaagattttttacattatagaactaacatgtttgttgttaacaactgaaaaaaagcaaagaagaataaagaaattgttaacaacttctctcctttctcaattatccttttccccagaggtaactaaaactggcagtttagaatggccccttccaccctcttcttgctcttacaaaaatagtcaagcatttattcagtcattgaattaaaaaaaacctttgagtacctgccatgtgtcagatactattctaggcatacataatataagataggctgaagtcccctcatcaaacacatatctcagtgtgaagagaaagacgataaacaatgtacatacttttttttttaaagaaggagtcttgctctgttgcccaggctggagtgcagtggcacgatcttggctcactgcaacctccacctactgggttcaagtgattctcctgtctcagcctcccgagtagctgggactacgggcatgccccaccacgctgggctaatttttgtatttttagtagagacggggtttcaccttgttggccaagctggtattgaactcctgacctcaggtgatttgcccgcctcggcctcccaaagtgctgagattacaggtgtgagctaccacgcccagcctgtacgtacattttttttttttttttgagacggagtcttgctctgttgccaggctggagtgcagtggtgcgatctcagctcactgcaacctctgcctcttgggttcaagcaattctcctgcctcagcctcccaagtagctgggactacaggtgcacgccaccacacccagctaatttttgtttttttagtagagagggggtttcaccatgttggctaggatggtctcgatctcttgaccttgtgatccgcccgcctcagcttcccaaagtgctgggattacagtagtgagccaccacgcccggccgtacgtatattttttaaagaaagaatcacactgcatactgtattctgcaactgaatttttcccctaaaaattttatcatgaacatcaccgcaagttagtaaagatagacctaactcattctttttagtacatacatattattctgtagtatacatgtaccataacagttatggagcaactaaatcttatccaattgatagacatccagattggttccaggattctgcatttaaaaacaatgctataactagcattcctatatataaggaactcatacgactcaacagcaaaaaaaaaaaaaccaagtaatccaatttaaaaaataggcaaaggacctgaatagacattttcccaaagacatacaaatggccaacaggtatacgaaaagatgctcaacgtcactaattatcagggaaatgcaatgcacagccacaatgagatagataccctctctcaccggttagaatggctgttatcaaaaagacaaaacctaagtgttgaccagggagtgtagaaaagggaacgcttgtactctgttgataggaatatggattagtacagccattatagaaaacggtatagaagttcctcaaaacattaaaaatagaagtaccatatgatccagcaatcccactactgggtatatatccaaaggaaatgaaatcagtatcttgaagagatatttgcattcccatgctcagtgtggcattattcacaatagtcaagatatggtaacaaaccaagtgtctatcaagacagaaaaagaaagtgtgactgatatacgtgtgtggatttatatattatatatatatagatatatcacattatatctatctatctatctatctatctatctatctatctatctatctatctagtaattccttgatatttgtagggaattggttccaggagccctctcagataccgaaatccctggatgctcaagtcacttatataaaatagcatggtatttgcataaaacctatgcacatccttccatatactttaagtcatctctaaattacttataataccgaatgcactataaacactatgtcaatagttgttatactgtattgtttagggaataatgacaagaagaagtctgtacatgttaagtacaggcacaaccatctgttttaaaaaaaataaatttggccaagcgcagtggctcacgcttgtagtcccagcactttgggaggccgaggcaggaggatcatttgagcccaggagttcgtgactagctgggcaacatggtgaaaccccatctctacataaaatacaaaaattagctggacgtgatggcgcacacctgtaatcccagctactctggaggctgaggcaggagaatcacttgagcctggaaggtcaaggctgcagtgggccaagactgcaccactgcactccaggttgggcaataaagtgagaccctgtctcaaaaaaaaaaaaaatccactgaagggaaacccatgcatacagagggctgattgtacatgcacaatggaatattattccaacataaaaaagaaatcctgacattatgacaacatggataaacctggagggcattttgctaagtgaaataagtcagacaaatactgtatgacatcacttatatgtggaatctaaaaaagctgaactcatagaaacagagagtagtatggtggttgccaggggctgagaggtggaggatatctggagatacaggtatatcaaatcatcacattgtataccttaaatatgtacaattttatttgccagttataaatatgttatagttttatgtcaataaagctggaaaaaatcctctgtgtgtgtgtgtgtgtgtgtgtgtgtgtgtgtggacatatatccataagttttagtggcttttttaatgtaagattttacaatgtggaatttatggaatttatatgtttaaaattttaatagctacttcagaagggttataacattggacaatctgaaaaacaacataccatatttatttataatttcattataatttttggatctgtacctttgtttagaaaatttctctttctctgtctctgcctctctctgcgcacacacacacacacacacacaaattctcaaatttaacagctacgttgagatgtaatttacataccacaaagtttacccatttacaattcaatgacagtacgtttagagttgtgcaactatcaccattatctaacttttgaacatttttgccatcctaaaaagaaaactcatacccactgagcagtcatttctcagtcacctcctcccatcacagccctaggcaaccactaatctattttctgtctctatggatttgcctattctcggcatttcatataaatgagatcacacaatatgtggtcttttgtggctggcctctttcactcagcacaatgtttttgaggtcattcatgttgtattctatatcagtacttcattccttcttatgggtgaataatattccattgtatggatagaccacattttgtttgtccattcatgagttgatagatatttagggtgtttccactagttggctattataaacaatggtgttatgaacattcatgggcaagtttttgtgtgtacatgtttcatttctcttgagtaaatacttggtaatggaattgctgggttatatggtaactctgtgtttaacattttgagaaacttgcaaacttttttcccaagaagctaaccagtttaccatttccaccatcagtgtgtgaggattccaggttttctacatcattgccaactcttgttatgatctctttttatttatttatttttttgagacagagtttcactcttgttgccccaggctggagtgcagtggcacagtcttggctcactgcaacctccacctcctgggttaaagtgattctcctgcctcagcctcccgagtagctgggactacaggcatgcgccaccatgcccagctaatttgtgtatgtttagtagagatgaggtttctccatgttggccaggctggtctcaaactcctgacctcaggtgatttgcccgcctcggcctcccaaagtgctgggattacaggtgtgagccaccgcgcccagcttgatctctcttttttcttattgttctcttagtggtgtgaggtagaatctcattgtagtgttgcgttgtatttccctaatgattaatgatgttgagcgtctttccatgtgcttattggacatttgtacatcttctttagaaatattatatttcaggtacattttccatttttaattgtcactctttatttttgcattgcaagagttctttattctatatacacatcacttattcagtatatatatatatatatatatatatatattttttttttttttttttttgagacagggtctcactttgttgcccaggcaaaggcgatcatggctcactgcagccttggcctgcggggctcaattgatcctcctgcctcagcctctgaagtagctggggctacaggcacaagccagcacacttggctaatttttgtatttttgatgaaacgggatttcaccatgttgcccaggctgatcttgaactcctgggctcaagagatccacctgcttcagcttcccaaagtgctgggattacaggcgtgagccaccacgactggccacttgttcagtatttgatttgcaaacattctctctcattctgtgggatctcttatccctttctctgtggtattatttgtagtgcaaacatttttcattttgatgaaatccaatttatgtgcttttttggtggtgttgtatctaagaaggcattgcctaactcagagtcataaggattcattcctatgttctcttctaagagttttataggtttagctcctacacttaggtttctgatccattttgagttaatttttgtgtatggtgtgaaggaagggttcagctttattcttttacatgtggatatccagttgtcccagaaccatgactcaaagactgttctttccttcttggcactcttgtcaaaaatcagttgaccataatataagggtttgtttctggcctttaaattgtattctatttgtctatgtctatgtctatcctaatgctaggaccacactgtcctaattattgtaactttacaaacttactacagttttaaaactggtaaatgtgagttgaacgttgcacttctttttaaagattgttttggctattttgggtcccttgcattttcatgtaaatttcagaatcagcttgtcaatttgcaaaaataccagctgagaatttgatagggattatgttgagtctgtagatcaatttgaaggctgttaccatcttaacaatattaagttgtccaatccatgaacatgaaattttgttctatttaaatcttctttaatttcctccaataatattttgaacttttcagtgtacaagtctaggacttattttgctaaatttatttctaaatattttattccttttgctgctatagtaaatggaattgtttttcttttctttccttttctctttttttggagacagggtctcactcagtcacccaggctggagtgcagtgatgtgatcatagctcactgcaccctcaaattcctgggccttacattaaaattagcttgcaccaccacacccggctaattttttcaattttctgtagagacagggtcgcactatgttgcctaggctgggtctcgaactcctgggctcaagtgatcctccagtcttggcttcccaaagtgctgggattacagatgtgagccaccgcacttggcctgttttcttaattatatttttagattcttgatttctagtgtatagaaatacaattgattggccgggcacggtggctcatgcctgtaatcctagcactttgagaggctgaggcgggtggatcacgaggtcaggagatcaagaccagcctggccaatatggtgaaaccctgtctctactaaaaatacaaaaattagctgggtgtgatggcacacgcctgtagtcccagctactcaggaggctgaggcagaagaatggcttgaacccgggaggcggaggttgcagtgagccaacatcacgccactgcactccagcctgggccacggagcaagactccgtctcaaaaaaaaaaaaaaaaaaaacaattgatttttggatattgatcttgtacaatcttgattaacttgttagttttaatctttttctagtagagtcattgagattttttataacctagatcatatctgttaatggagacagttttacttcttttccaatctggatcccttgtatttatttttcttgtataatcatcctggctaaaacctccagtacagtgttgaataaaactggtgagggcagatatacctgtcttatttctgatcttaagggaatgcattcactctttgataattaagtatgatgttagctgtgtatttttatagatgcctctcgtcaagtggaagaagtttctttctatgcctagtttgggtagtgtttttatcatgaaagagtgttgaatttcatcagataaattttttctgcatgcattgagatgatcatgtgatttttgtgattttttaaaatttcaacttttattttcgattcaaggagtacatgtgcagatttgttacatgggtatattgtgtgatgctggggtttgatgtatgagtgatttcatcacccaggtagtgagcataatacccgatacttagttgttcagcccttgccctcctttctgcctccccatctagtagttcccagtgtctatttttcccatctttatgtccatgtgtacccaatggtgagctcccacttaaaagtgagaacatatggcatttggttttctgttcctatgttgattcacttaggataatggcttccagctgcatccatgttgctgcaaaagaaatgattttggtttttttatggttgtatactatttcatggtgtatatgtattgcattttcattatccaatccaccattgatggacacctaggttgattccgtgtttttgctattaggaatagttctatgatgaacatacaactgcatgtgtttttggtacaatgatttattttcctttgggtatatacctagtaatgggattgctgggtccaaatgggagttccatttttagctctttgagaaatctccaaagtgctttctacagtgactgaactagtttgcatttacaccagcggtgtataagcattcccttttctctgcagccttgccaatatttattattttttgacttctgaataatagtcattctgactggtgtgagatggtatctcattgtggttttgatttgcattgctctgaggttcagtgatgttgagcattttttcatgttggttggccgcttataggtcttgttttgagaagtgtttgttcatatcctttgcccgctttttaatggggctatttgttttttgcttgttgaatagtttaagttccttataaattctggatattagacctttgttgcatacatagtttgtgaagatttcctcccaatctttaggttgcctgcttactctgttgatattttcttttgctgtgcagaagttctttagtttaattagttctcatttgtcaatgtttgtttttgttacaattgcttttgaggacttagtcataaattatttgctaaggctgatgtccagaagggtatgtcctaggttttcttctaggatttttacagtttgaggtcttacatttattaataagtctaatccatcttgagttaatttttgcatatggtgataggtagaggtccagtttcattcttctgcgtatgaatagccagttatccccgtgtcatttattgaatagggagtcctttccccattgtttatttgtcctgtgttaatatggtatattacattggttgatttcagctattagacaaagcttgcattcctagaataaatcccacttacccatggtgtataatcctttttatatgtttctggatgccatttgctagtattttgttgaggatattgtatctatattcataagagatactggtctgtagttttcttgtgatctttatctggtttttgtatcaaggtaatactagcttctaagtgggcagtattcccacctcttctttttggaagagtttgtgagtgattggcattaattcttccttaaatgtttcatagaattcaccagtgaagccatctggctctgggcttgtctttgcgaatcatttgattacttagtctttttacttgttacaggcatgttcagttttttaatttcttcctagtcagttttgatcgtttgtgtcattctagcaatttgtccttttcatctatgttatctaatttgttggtctacagttgttcttagtatttctttataatctttcttacttttgtaaggtcagtagtgatgtcccctctcactcttgattttagaaatttgagtcttttttcttttttttcttggacattctaaaagtttgacaatttagtttcaaagaaccaatttttagttttgttgatttttctttattatctttccattctctatttcatttcttactgctctattctttattatttccttttatctgcttatgttgggttcagtttactcttttttccaattttttattttatttatttattttttttttttttgagatggagttttgctcttgttgcccaggctggagtgcaatggcgtgatctcggttcactgcaacctctgcctcccaggttcaagtgattctcctgcctcagcctcccaagtagctgggattacaggcatgagccaccacatccagcctttttccaatcttttaaagtggaagattatgttactgatttgagatcttttttctttttttaatataggcatctatagctataaatttttatctaagcactacttcatatgttttggtatgttgtattttcattttcactcatcttaaaagtattttctgacttctcctgtgatttcttctttgacctattggttaagattttgttgtttaattttctcatatttgtgacttgcccaaatttcttctgttgttaatttttaatttatttattttcccaaattactttattaatttatttctttcaataaatcctaaattttcttcaaagtaaagatactttgatcttaatccttttaaatctattaaggcttatattatggcctagcatcgagtctattgtggagaatgttccacatgtactatagaagaatgtaattctcttgttgttgggtggagtgttttatacatatctgtgaggtctagttggtttgagtgctgttcaagacttctctttccatgttgattttccacctagttgtttcatccattactgaaagtcgactattgaagtctcaatattattgttgaattgtctatgtctcccttcagttctgtccgtttttgcttcatgtagttttgagctctgttgttaggttctcatgtgtttataattgcttcatcttcttgatggactgttttatcattataaaatacccctctttgtctctggtaacaatttttgtcttaaagtccattttgtctgctattggtatgccactctagctctcaggcttgccgtttgcatggaatttcctttttgtctttttccttttaaactctttgtatttttgagactaaagtgtgtctcctattaacaacatatagttagatcttgttttgttgcttttatccagtttcacaatctctgccttttgattatttaatccattctcatatgatgttattattgatatgcctggatttacatctatcattttgccatgtgtgtgtgtgtgtgtgtgtgtgtgtgtgtgtgtgtacatgcacaaaaaatacaaagaggaacaaaacagtaattatatgtatgtgtgtgactgttttgttcctctgttcctcctttatttgaaaatttatttttgtaaatggtctgaggtagaggttgaagtctaggttgttagctaactatcctagcactctttttaaaaattgtcctcttctactgaattgcaatacctctgtattatatatattattcccatacatagtttgatatatttatgaatttttttttttgagacagagtctggctctattgcccaggctggagtgcaatggtgcaatctcagctcactgcaacctccgcctcctgggttcaagcaattctcctgcctcagcctcccaagtagctgggactacaggcacgtgccaccatgcccagctaatttttgtatttttagtagagacggggtttcacaattttggccaggatggtttcgatctcttgactttgtcatccacccgcctcggcctcccaaagtgttgggattacaggtgtgagccaccacacccggcctttgtttatgaaatttctattatgttctactcatgtatcagtcttctcttgtgtcaacatctgttgttttatctcagtgatttaatgataaatttcaatatctggtatagtaagttcctctttattttccttcttttcaaatgattgttcatgtgagttttgacattcaaaagaaaatactatttgtaatccttttaaaacttcatgaaatgcatgtgtgcatgcacacacacatacacatacatatacatatgcatatatttaccatctagtagcgatatgtgagaatctgggcaattcatttaaagtaaaaattcataaatagtaatattgcacattaaaatgaaacacaacaggatgatttatgttacttttacctaattattgttttctttgcagagtggatactatggaaaacagcgccatcaagatattaagagagagagtgatttcacgaaaaagtgaccttactcgtgctttccaacttcaagaccacagaaaatcaggtaacaaatttgcataacatttaccatttcttaacacaccaagttacatacagatcacttttcattttccttgcttccttaggatttcagttctccatttttactaagaaggaagaatagagataaaaataaaatataatccattatttgctcaaaaaaggcatatttctcccttttagcaagctattttcaacttggaaaactaacaacaaccctgaattaaacttttttttttttttttttgagacagagtcttgttctgttgcccaggctggagtgcagtggcgtgacctcagctcactatgacctccacctcctgggtttaagcaattctcctgcctcagcctcctaagtagctaggattataggcatacaccaccacgcccagctaatttttgtatttttagtagagatgggatttcaccatgttgttcaggctggtcttaaactcctgacctcatgatccgtccgccttggccttccaaagtgctgggattacaggcgtgagccacccggccctaaacctctattctgatagtatgctagactagatgttctggagggccttcttattaacaaacagctagattttggaggatgtagaatgttaatgcatttaccagcctcacagtaacgtgaatcttccagctgcatcttcactttccgtgaaagatgatttgaaaccacatgtgagagcatggagcaacaagaaagcacaaaagactagattttcctggggcccaatgctgatattggtatagcaatcaattctgagactaaattataatatagtaggaagatggaaaagctgaatttgagacttccatcatcatgcttggaccctcaaagtggctaaagttgtcctaagtctgtaatgctccctgactcctggcaagcaaatgcaaatttatctttgagggaagcatccctaattttggccactcacgtatccagagattaagatcaactcacatgagatcacaatcaaaaattaccaaacaaacaaggatacaaactaccatgagtgagagtcagcagaaacaacaattatttccccgaggacatcaaatattggaattagcaaataaatatgttcaaaggaaatatggaaccagaaacatgcatttgggaatgatttgaagaaaaaccaaagagatagaaaatatgcttgttaaaaaaagtaaaagcataatgaatgggttaaacggaagattagacgctactcaagaaagaattagtttaggagttataaacaggccaggcgcagtggctcatgcctgtaatcccagcaccttgggagattgaggcgggcagatcacatgaggtcaggagtttgaaaccagcctggccaacatggtgaaaccccacctctactaaaaatacaaaaaaaaacaaaaaattagccagccatggtggcaggcacctgtaatcccagttacttgggaggctgagacaggagaattgcttgaacccaggaggcagaggttgcagtgacccgagaccgcaccattgcactccagcctgggtgacaagagtgaaactctgtctcaaacaaacaaaaaaagagttatgaacaataaaatgagaagttgaacatacacctactcagagtactgggaggagagaatagaatgtaagagaccatatatttgacatggtaatggctaagacatttccagaattgataaaagactcaaattcataaagaggaacagtgattctcaagtagaataaatgaagttaaatccagacctacacacatttgttgtgaaactccagagcaccagtagcaaagaaaaaatctttaaaaagcaggcagagaggaaacacatattgctacaaagagataacgattagactgatagatttctcaacagttgcaaaattagaccatagaatcatatacaccaaacattggaaattaaatttagaaaaacatataccatgaaaacactaacaaaaacaaagctaagacagctttattagtatcaggcaaagtagactctaaggaagtatatattactagaaataaaaaaggacatttcataatgataaaatattaattatgccaattgaatccattctaaatgtgtatgtacttattcatatagcttcaaaactattcaaaacaaaaattgacagaataaaaagtagaagtagaaaaatctaccacgatagagggaggttttaatactcctctctcaggaactaaaagaacaaacagataaaagattagcagactctttttttttttttttgagatggagtcttgctctgtcgcccaggctggagtgcagtagcatgatctcggctcactgcaacctccgcctcccgggttcaagcaattctcctgcctcagcctcccgagtagctgggactacaggcgtgtgccaccacgcccagctaattttttgtatttttagtagaggtggggtttcactgtgttagccagaatggtgttggtctcctgacctcgtgatccacccgccttggcctcccaaagtgctgggattacaagcgtgagccaccgcgcctggccagcaaacttttttcttaaaagactacatagaactctgtacccaaatttcagaatgcatattcttatcaagcacaaatggaccatttacaaaaagtgaccacacactggaacataaagtgaatctcaataggttttgaagaattggaaacattacagaataaagtctctgacatatacaactccgtaacataagatagtaataaaatcaccctttggcttggaaatgagaaatatacttagaaataatccttggctccggccagacgtggtggctcatgcctgtaatcccagcattttgggaggccgaggagggtggatcacgaggtcaggagatggagaccatcctggctaacacagtgaaaccccgtctctactaaaaatacaaaaaattagccaggcgtggtggcgggcgcctgtagtcccagctactcgggaggctgaggcaggagaatggcatgaacccaggaggcgcagcttgcagtgagccgagattgcgccactgcactccagactgggagagagagcgagactctgtctcaaaaaaaaaaaaaaaaaagaaataatccttggctcaaagagaatcacaatggaaattagattgctgaaactgaatgacaatgaaaatacaatgtattagaatttatgggatgcaaattagagaggcattgatgataaccttaaatgtaaaagatatgattaacaaagtaaaaaaaaaaatttgtttttgttttgttttgttttgagatggagtctccctcagtcacccaggctggagtgcagtggcacgatcttggctcattgcaacctccgcctaccaggttaaagcaattcttctgcttcagcctccccaagtagctgggactacaggcatatgccaccacgcccagctaattatttttgtatttttagtggagacaaggtttcatcatgttagccaggctggtctgcaactcttggccttaggtgatccacctgccttggccccccaaagtgctgtgattacaggcatgagccactgtgcccggccaaaaaatggttctttgagggaactgttgaagttgacgaaaccatggcgagagagagagagagagagagagagagagagagagagagagagagaaaacaaataaccagtgcaagtgtagggaggagctgctgtctaaggctgagagagaggacccaaggaaggaaaaacttggaagggaccccctactcccaatcaagagatgagatcaagccctcattggtgaggatgtggctatggtccactggatagggcagaagttcactgaggtgcctcaagttacagttgggtctccggctggtgggccaggactggagaggatggagccacccactgaggtgccagcaagactctctttgggctgtgcaccaccgcgtctcccacacactaatggtgaggaagccatgggctgtggtgtcagtgaaatttactagaaggtgggtgccactacattttccacacatgctaaccgtgcggtgctgtagaaacaagaagcaaggcacaccagaaccagaaagaaaagctttttcttttgctgttctttgcagtgttcttcctgcactgtctactaacagagactaacgttatacgagctgccaaagaggaaatgattacagggtccagctctagtatcacaaaatgtgcaaaaaaaaaaaaaagactagttttggagctaagtaggaataaattgatagctggggtagccagcaattagcttttagataacaaaaatcttaaaagataccattcacaatagataatcaagtactgtgggagaaacctaatgaatgaggtatgagatttctttttttttttttgagacggagtcttgctctgtcgcccaggctggagtgcagtggcacgatcttggttcactgcaagctctgcctcctgggtccatgccattctcctgcctcagcctcccaagtagctgggactacaggcgcccgccaccatgcctggctaattttttgtatttttagtagagacgggggaggtatgagatttctaagatattattaagataaaggggactgaaataaatgggtgggtattactgtgttcaaggactataagggttgaagttgtcaagatacaaattcctcccaaattgagctatagtttcaatgcaatctcagtcaaaatcccaaggtggggatttttcagtagatcttgagaatctgtatctaaaagtcatgtggaattacaaaaggccccaaatagccaagatgttcctgaagaaaaagaacaaggtgggaagactttccctattatatatcaagatctattataaaagtacagtaattagaatggtatgcaattggcacaagaatacccatatagacaatggaagcaagtagagaatcctgaaacagattcatgcatatatagacacttgaaggtcccactgctgagcagtgggcaaaggagtcttttcaataaacgatgctgggccaaatggatatccctataaaaatagaaacagcctatatgtaataaagatatttgtgttttgaaaaattacatatattaggaggaaaagaatattagttgtgaaatgacaggtgaataatacatcttttattctttgtattcttttgtgtttttcaaatcttctataataagcaaacctaggccgcgcatggtggctcacacctgtaatcccagcactttgggaggctgaggtgggcagatgacttgaggtcaggagttcaagaccagcctggccaacatggtgaaactctatctctactaaaagtacaaaaaaattagccgggtatggtggcgtacacctgtaatcccagatacttgggaggctgaggcaggagaatcacttgaacccaggaggcggaggttgcagtgagctcagatggcaccactgcactccagcctgggtgaaaagagccagactccttctcaaaaaaaaaaataaataaataaataagtaagcataccttactttgttaatcaaaaaaaaggaaaaaaaaaatctaacacgtgaagtctgatttcttacaggtgacaggaaggacacgatctgtggaacactgaagatatccttgagttagttctccttcagggctgcagggcctgggaggataaattatgagggagagcagctggccccatgctgccctggctctcccaaggaggttgcattctttaaaatcatattttaacaaatcatttgggctttgttattgttgttgttaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggcaagtgaaacatagccccagctaaaacctagccagggtgaaacataacttagtcctttgaaaagctgggagtggccgggcacagtggctcacgcctgtaatcccagcactttcggaggccaaggcgggcagatcccgaggtcaggagttcgagaccagcctgaccaacatggtgaagccccgtctctaccaaaaatacaaaaatcagccgggtgtggtcgtgcccacctgtaatcccagctactcaagaggctgaggcaggagaattgcttgaacccaggaggcggaggttgcagcgagccaggatcgcaccattgcactccagcctgggtgacagagcgagactccatctcaaaaaaagagaagctgggagtgggataatctaatagatggagtggcagtcttaggaaaagccgaaggggaatctcccaggtacactgtggtctgttcagcaaatttgtgtgttcccaggataagcaaaaagaaaaaagaaaaagcttccacaagcaagtccacatcaaatactggatttttttttgtaagtgctgtctagcagaaggggagatatgacatccatgctttttgtttgttttttgaggtggagtctcgctctgttgcccaggctggagtgcagtggtgcagtctcggctcactgcaacctctgcctgccacgctcaagtgactctcctgtctcagcttcccaagtagctgagattacaggcgcctgccaccatacccagctaatttttatatttttagtggagatggggtttcaccatgttgaccaggctggtcttgaactcttgacctcaagtgatctgcccacctcggcctcccaaagtgctgggattacaggcatgagcccctgtgcctggcctgacatccatgcttttatacaacataccatttctaatacttaatgtattgcttgttaagcctgagtgtacagacttgctgacatgacccagaatatgtctgaaagagttttgaaatgtagaaatcttttcttagaatgtgaatatcagggagatttatcagatccccatacttattagttaacaattcatcagcagttaaatatgacattgagctgaaaaggagctggttggagctaggacttgggtgatcatttgcagtgaagatgagacgttaagagcagagagaagggaagtaaaggtaggttagagactaaagtatccccaggaaggaggcttttgacgtcacttcagaggcagtttaccatggtgactaagatcacaggccttggcttcaggcagccgagatttaaatcccactcaccagctctgtgacccttgggaaagttcctttatctccctgttttcaaatttgtaaaatggacataataatagttctgttcttgttcattcttgttgtagaggaccgaatgaaataatccacataaagttctctgtaaatggtggctgtgttagttactgctgccttattcattttggccctgtcccctgaggatcacagactgaatgaagagggtggggcctccaagggaagtctggccttctcagatttctgtctaaatcacatcatttcaattgttgatgatgttttctgtttgttacatttgctaaaagcgatcagtgtcatgaattcaatatgttctaacacttagaaaatctttattttaggctcattctactctagttgaaactctgtacagatacagatctgacctggaaatcatatttaatgccattgacactgatcactcaggtaaataaatgaacttggatgagtccatttaaaaagtgtatgtgtgtgtgtatgttggggatacaaaatgagtacactttgattgagccctataattaatatggtttgacaccttcattggtaagatggaggccttgcttatgcatactgttaaatgaaaattgtaggagcccattgttttggactaagctccttcaccaggccccaacagactagactaaaagtcaaaatggggtagcagtagtagaaagcaaaggctaatctggttctctgaaatcagaactctgattttatctattttgttcttcatctaacatgatgaaacttgaggggaaaaagaaactcatttaatattattgttatttcagtttggctgcagactctgtattcaagaccatagagtcctacagaagcctaggtagccatcagtcaaactgaaataactttttataaatcaccagcacaaatgaaaagatgatttactatccatttcagtatcttagttactcatggccataaaaatcattcctagaaatctgattctgttttggggagtaagggctatgaaaagtcattttctgcttttttttttttttttttttttttttttgcgacagagttttgctcttgttgcccaggctggagtgcaatggcgggatctcagctcaccacaacctctgcctcccgggttcaagcaattctcctgcctcagcctcctgagtagctgggattacaggcatgcgccaccacaccctgataatttttatttttagtagagatggggttctccatgttggtcaggctggtctcgaactcccgacctcagatgacctgcccacctcagcctcccaaagtgctgggattacaggcgtgagccactgcgcccggccttctgcctttagctttgatgcacaattacttattttcaaatttttaaaaactcatcagataatcccctaatgcagagacctttgaacaccgaaaaaaaaaaaaaatcaatgatcaacacattaaagtaaatgattgcctgtgaaaaaggcagcaccattgtttgtaatcctcttattgactcccaccgtatcttctccctctgctttgatgtcatcctcctctctgccctccttccatgcacctcacctttctattttaggtcttgtaatttctataccacatttagtcccatagtccacaaccccgtccccatttcttcactgtttgctcattctggctttagaataagttcaggatcccttggtagttgaaagtgagatattgtttcttacatttatgatcttactcttccatatccttcagtatcttcatgattaggcagtttagtgagtttctaactggggctatttaatcagtgtgggttccccaacccttgccttaggtgggtcttaaaatgaacactcacaaccttctcctatattcttttaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttatt

SEQ ID NO: 3165 - DNA, 136993 bp, human
aagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggtaagagaagagcacttagtggaccaggtgaatggagtatgatccgggtaggcatgggacaatgatcgaaagttaacctgtggcctctgtctgtttagttgtttagcccaactcttgtggtctttatgttttatgtatgaagtttgttaaaagctttaatatatatgtatagggtgaaactgggtcaccttgatgtgctggtcactgagtcacaggactgtgactttggggaggccacctaacttctctgggcgtggtttcctctcctataaaatgaagatgtctgaggacctttctagacaagtccgaaggatcagagtatcttaccacatttcagcctcacctgttacagagctctgggcagagaacctcatgatggtcttgcaaggtgactccattctctgtctagatcagttttgcccaattcccagtgctttaacatgagagggagttgcatcagtgtgtagtctttgttttacttttgttcttggaatggcagattgtagctcctgtagaaggaaaagaagaagaaataaggaattagcattgctctacattgactcatgctagatgtcaatctgagatacatgtaaaacgtaagcacatacaagataaagaaacagattgtggcaatatttaaaaatatcctagctttctaaattagaagcagttctgataagcctatttggaattcatgcaaaacatccataactctgacagtctgaattgtacatggcaaaggtaaattgcttccaggcagtaattctaggtgcaggtttagatggactatacggtaatcaagtctccattgctttacagatagccctcactccttggcctcttactttccagattgcttctttgttagcctccctgttggctccttcctcttttcattctctttaatgtctctattccccagtgttctgcttttgcctctatagctttactctataagctctccctggctattttatcttctctaatcacttcagctattgtcagcaacctgatgacctatttaatctgactctctggtcctgatttatttcctgagctccaaacccaggcttctcctgcctgtgggatatttcaacagtgaggtctcacaagtactgaaatttagcacactgctgactgaactcacgatttttctccaccataaactcgcttgtcccccttcatgtccgactcttgtaccctttaataccctattgcaatgaatatcatcatctcttagactgtaaattataagaaggcagaaaccatgtctatcttgtccaccccttgtaaccacagcacctagcatagtgcctggcacatggtagacacccagtaaatattgtcaagtgaatgatgaatctatttattcttccaaactaaaaaccctggaatcctcctcgatgtctctgtctccctcactctccatgcccagtctgagacctgtggggtttgttacataaaacccttttacatttggctccttcttccccttcatccccgctgccatgactttaattcagcccttaccatctatctcctggattattgcaggagcctcctcattggtcttcctgttacctgcttttccccattcatcaccatctgatccccagagtgatcttgcagcttgaatctaatcagcttaccctcaggctccccttgacttaaacagagtttgcaatctggcagctttaagcggaatccacgcagtctgtacggcattttgagaaaatgagaatgactgtattttgttgattctaagatgcatttttttttcacattttagcagctctgatattgggatgtgtcttgaaatggacagtgacatagtttgatcagtggtgttctctcttattggtacataaaacagcagtgtaccctgtaatcagtggcttcataaatttgctgaaaaatactcatgctaacatttaaaaataaggagatcgtacataaaactatcttcagcttctcttggaaaattacatcaggcaacactgggctgcgatttctggatagcagccgaagatggagctaccagtaagtagcagctacctcatttagacaaaaactcgctacagtgtctcatggtttccacccaggctgctttagtcatttgtattatctgccccagcccattaagcatttgaaaggacaatccctgactgataagttgaagtccagattctttgttgtgatttataagaacacaggtggcaccaacctacctcccccaggttaatgctcccaacctttgctgtgtactctatgtatcccctaatctcaaatataacagactcccatgttccctggaatgtctttctctatcttttatgccctacgaaacatttcctggtgttcccaggtcgagctcatttctttctggactccagtagtaagtatgtgggcgtatctctgcaaaaaccgcagttacttttgcactaacctaaagtacagttctgtgatttattttttatttttattttttcgagacggagtttttctcttgttgcccaggctggagtgtaatggcgcaaccttggctcaccgcaacctccgcctcccgggttcaagggattctcctgccttagcctcccaagtagctgggattacaggtgcctgccaccacgcctggctaattttttgtgtttttagtagagacacgttttcaccgttttggtcaggctgctcttgaactcctgacctcaggtgatccacccgcttcggcctcccaaagtgctgagatggcaggcgtgagccaccacgcccagccagttctgtgaattttaacacatggatagattagcataaccaccatcatcatcaggatatagaacatgccccccaaaactccctcctgctagccctttgtagtcactcccctccctcacccataaacccctggtaaccactgatcagttccctgtcactatagttttgtctttttgagaatgcgatataactgtctgtatccctttcagcatggcctcttccactcagcataatgcctttgagacccatccaggttgtgtgtatcagcttcatttgtttttattgctaagtagcatttcattgtatggatgtcccacagtttgtgggacactcacggaaggacatttaagctgttttcaatgtttgaccgtatgaacctgcatacacgtttttgcatgaatagaaaattttatttctctaggatagctacccaggagtaggattgctgtcgtatggtaagtgtatgttcaactttataagaaagtaccaaactctttttcagagtgactgtaccactttgcattcctgccagcaaagtgttagagttcgagttgctccacattctagccagcactggatattgtattaaaaaaaaaaattttagctgggcacagtggctcacgcctataatacaaatactttgggaggctgaggcaggcggatacctagagaccagtctgaacaacgtggcaaaacccactccctacaaaaaatacaaaaattagccgggcatggtggcatgtacctgtgatcccaactacttgggaggctgaggtggaaggatagcttgagcccagaaagttgaagttgcagtgagctgtgattgtgtcactgtgctccagcctggtgacagagtgagaccctgtctcaacccccccacccaaatttagccatattcatagacatatagtggtatctcatggttttaattttaatttctgcttccttgaatctggcctggaggaactggagggaacaaaaggtaaactcactgtcagttcagtggtacttcaaactctgatctgtttccttcatctgccgtctgttatttacttttcagagtcctcatgttacttgtttattgctgtgggacagattaccaaaaaatctagtggcttaaaacaacacatgtttatgatcttacagtttctgtggggcagaaacccaggcgtggcttacctgggccctctacgtcagcatctgtcgtgagctgctgcacacaatgtgttgactgggctgctgtcatctgaaggtttgactggggagggatccacttccaagcccgtatggttgttgacaagagtcagttcctcatggtctgtttgactgagggccttagttccttgctggcttttggctagagacttcccccagtcctttgccacttgggcttctcccacatggcagcttacttcattgaaagcacaaaagctgtgaagataatagggtctgctagcaagacagaaaatcacagtcttttataacctagtcatagaagtgacatcccaataccattgccatgctcaattgattagaagcaagtttctgggtccagcctatgctgaagagaagggatgaacacagtggtgtgaattgaccaggaggaagggatcattgggggcagcttagagtctgtctgccacagtcctcaaatagctgtttcatggattctgtccaggttttatagctttgtcccatgagagagaaagagtagagtgggtaaaatgtcccttttccatcttacccagaccagaaccttctgtgaagctttttgatttgatttatgaacattcagggttaatttaaggaatttctttaaactcaagccatcgaggaccaagctagggttagattaagcagtggtccgaattaaaattctgatatctattaatctatttattaaatcacaaccaaggaaagctcaacttttgtatctaagatggagcctttcgaaagctgaatttccccaccttaaaacgtgatggctgttttagcctgtcattgtggctgctcaccaggtgaccccaatagaaacatctggcaagcactgacttttatgaatttcttccatctgatagtgactcataacccacttttaatttcttttaatgacttcctaatgacttgccagatctggcctctcttttctcctagttaatgtgatttttcagtacccagaattcacccttgaaaatatgcttgatcctttctctatttaagtgaaaaattacttggtattcctttcttctcttcacaagggagcaggatctttaaattagagtccttcgattttttttttcttttgagacaaggtcttcctctgttgcctaggctggagtatagtggctctatcatggcttactgcagcctcgatcttgcaggctcaagtgatcctcctgcctcagcctcccaagtagctgtgagaacaggcatgtcccaccacacccagctaattttttttttttttttagtagagaggtcttgctatgttgcccaggctggtctccagctcatcagctcaagcaatcctccttgctcagcctcccaaagtgctgggattacaggtatgagccactgcccccagcctttttgaacttttttcatcatggacccctcacagtaagtttcgtgagaatggaccaagcatatttatttatttacagctaatactgctgaactcatttattgtgtacatgatcaaatatacatggaaatagaaaagttaacaagaataagaaaatagataaaaatatgagttctgatgttttgctttctgctctccagcagatctctgtgcatgtgctgtggggaagctaccccagttttggagactactaggggttaggaagtggtgattgggtgtgattgcttgccagtggccccagcatcaggaggctagctcagagtcagaagagctgggaggccagccctgtctgagcttcccccctttggtgctacggggcttcgaggtatcaggagccacaagcagacaccttaagtacccaccatcaaatagatctgcacatgccgctgttttcttagtctcctctccagtccagctgcttcacctcaattctagcatactcctcagggtatgtcatgatcaataatgggagctgcccattagaactactttgccttggcagaaattggaactgtggccagctccaggaagcttgtgaaataggagaggcttgcctacaaatccctctctcccttgagaggtagccaggcttctccattcccctctgtctttccatagtttgctattgccatggactaactaaatgtcctgggttgggatccctcagaagcagagcctgagataaacatttgagagcaagtttatttggaaggcaggagcaaagaaagtacagcagtggggaagtgagaaaggaagggaaggcaatcaagagagattaagtccagcctgaagaggtggagagggcagccatttttcaatcttaacatccgggcacctttatgtaattgcagcattatcattaggaaagaagttcattttgatttctagttcccctctcccatttcacaccctagttaagtactgtagaatatgcatagctatgagaaccccctcttcccacctcttttcctctggctgatgcctagtcagtcatcaggtctcggcccgtgcatcacttctaggaagccttccgtcatccccctttctgagatagggctctttctctgcgcccctggagtgtctcgtacctgttttattagatattttatcataccatattgctttcatttattcatgtaatagatatttattatgtgcctggcactgttttaagaacctagtatgtatatttcaatatccaatcatgtgtatttttttttctctgccatttgtgtctctgtccctcagtagcacctgctacataggaggtgcttgccacataggaggtttaaaactgttaacatcactctgcccatcattttttcttttttcaggctgggagaacacatccctggtcagctgtaggaaagccagagagcatttgagaagaggctgaagcttgaattttgcaaacacacaaggtgctgactgaggcagtagagtgtaatgattataataagcaggggttctagagccaaagtgcccgggttcaactcccagttccacccctcatttgctgtttgactttaggccacaattcctaatgggtgaagagggatcgtaatagtatatacctcagaggatggtgtgtggattaaataagattaacatatgtaaaatttaaaagtacctagaacatggtcagtgctcaatagatattatcattattgtgatttattcacttacatcagtgttggttcatttaacagttggaggctgaccataagacccctttggtgctcacagtaacatttcagtgttctttctacaatggaaaaatacaatgaagttattcattcaaagcaaattctgagttttcaacaaatcacataaagggcacagccaatccaattcgtggtccaggagctggccattaaaataacaacctaaatcatgagttttttttccctgctttcctttctttctgtggttaaacaaatatttggtgagtacctcttttgcattcagtaatgagtaggtttaaaactgagggtgtggccagtcgcagtggctcacacctgtaatcccagcactttgggaggtcaaggcagatcacctgaggctaggagtttgacactagcatggccaacatggtgaaacctcgtctgtactaaaaatacaaaaattagctgggtgtggtggtgtacacctgtaatcccagctcctcgggaggctgaggcaggagaatcgcttaagcctggcaggcagaggttgcagtgagcccagaatgcaccactacacagcctgggtgacagagtgagactctgtcttaaaaataagaaaacacacacacaactggggatgccaagaggaatgaaacagatcctttccctttaggatttcacatgtaaaagggcaaattacagcacactttgagcagctctataattggacgcacacatggctttgagagccagaagacagagtgactaattcccctttggtgattcaggaaaggcttcacacagaggaggtgacattggaacaactgtatctagacatagccataatttaatggctgaggattgaataggcatttggttgggagagccagctgtatagctacattgtccactattttttttggagcctgagtaattatgctatcatttacaatttgtgtagcagcctcatcaggtcctactcttggcgtccccaccatggaaacctgagtggtcgtattgcctcataatgaggccctctggtgatgttaatatactaataggacagaagcccagagccaccttgccagttatttttcaagtaactccatccgattaaatggcaaactaggtaaccactttactagatctcccgtggctctcaattgcagaaaggaatcgagctaaagagcagcttgggtggggttatgaaatgtttatggctggagtcctgtaaattttagctggcaaagcctaagaccagtaagcttgaaaacacgtatgctgtgtcaccagctaggaagagtttgccagggaaactgctggcagcgcggccgcgatcagtataagactctgtgaacaagaagaccaccactagattgcctcgaacatagcagaactgtggctgctggcatccattactgccatgggcactttgaattttcaagtatgtctttctcctcccctaaactcagcaagattacaggccaactttcctttccctttctgctgatgaagggaggtcattctcccttcacaggtaggttctccaataaggagctactgaacagctggtggagtataaatgtcttatgacccagtggctgctccctcaaacccacacctttctagaaccaaggaaaaatgtttagtttttccacttctcttaattgtaccaggttaatgtaacgttttctaaaaattatcctcagtttacctaaagagtgcttttctgctcttatttactgaaattctcttttctattttgtattgatggcagattatgcacacaatagcgtggtcctgcccatgcggagcctggtccctttggaagcagtcacgtggccgctgactttgcagcccattacttgagtgcatctccaggccaggaacagagcagggctggggcagagagctgtgctcacggccagtgcattgtctcccagattcgtggctctgggcttgccttcccggctgaaaggcaaagcagcctggccctgttctagttatttctttgtgtatatatgtttgtttatttatttaagcaagagctctctctgcagagtggggtgtgtgtgtgtgtgtgtgtgtgtgtgtgtgtgtgtgtgtgtttgtgtggggtgcttcagagagggctgaaattgtacctcttttctttcagccctctgcatttccccagagagaaggtttttttctcgtcttcatttcctttgaaacacctggggtgaggaaaaacctctacattggccaagcagaagaaacaggtaatatgtttgtttattcttaggcatttggggcaagcagaagtctacatcataaacatatatcgtgtggcaatggaacagggaatgtgtactccttggagtatatcttactgctttgcaatttctcggaatgattgttctcaaaaatgctggttgtaaatcagttgccatcagttgaagaagacgtacagatgacttggcaatctgaaggattgtggcctatttcaaatgaacttgatatttggaaaatctccacagtcacttggattgagagccagaaaatgagggaaggggtcctttgagaaacccttctaggtcccctcagggagtattctccaaactccactgcacaccttcatatttagaaatcttcctttagttcccttggcgtcttgtcgtcttagaggtttctagctatctgtaagaatggaaccagaattccttacagtgttcaaaattctctttagtgatttagttcgtatgcgaactgatcagattggatcctgaaaccaaggcatagccttttagtgggcagacatttttgttctttaatgattaaacagagcgagtcttcagttctgccactaatcagctacgccagggagtgtgttatttgagtctcagttttgttcatctgtaacatggtgatgacgatactaccttgaaagtttgctgtgacagtgaactgaaataatagaaatataaagcacccactatgctgggtaaatagtagtcccttaataaatagtagtgattttagctactattatgattactggtatagcattctttccgatcttagacctctcaagggaaaagagcccattgctttgcgactcttaaattataccagaacctgtaggtacccaaagggtttagtctttgggaagccccagacaaagcattctgaagaaagagacttgaacaaacacagtgggttcccacccatgcatggcccctcctaactcatcagctaaaaacagttggtctttgttcaagctagttttttcccaccactcagtcctcagtacaagtcagtaagatatgcattattatcactgttttcttatgaggaaactgaggtacaggggaattaatgactaagagttcaaactcctgttgtctgacttctaaacccaaggctccactgggccagcattaggcagttaggaacaatagttcttgagatgctttacttcaaaagggccccttgctaggctctttgggaaatagtggtcagctctttctgagagattcacaatgtatgttcatatattaaaggctctgagaagtcctgcagtaaagaaacctgtccagctctacatcccctgaacttattatgtaatagtgggacctttattttggccttagtcctagaataataaaccacatagaactattcttccacaaacacactttggaaaacctggcaccaggccacgctgtttcctgattacaatcatgtctgatataccagcagacactttcaaacaccttctggtggtcagtatagtttcctcccttttcttatcctctcatgtggcgagacccaggaagaatcaccagcttggtcttacagacctccccttactcatttaagaccccagacataagtaattgctccactgttctactggaaaggtagtgatggaagggaactctctggcacgggctgccagggactcctctgcctcaccctatgcctctgcattatatttaggccacagacatcaggctataaaacctctgtggcaatgaataccaagcagaatgcaatagggtgagcctgatgaggcatctgttcctcatgctagcacaatctacgggggaagaattacacctgcctgcttcactcccactgtggtggtcgggggtgggggtagagggtgttggtatcagttgaatgactatgggttccaggttttcaggactagagctaaagccaatttcttgctaaagccaacatctctaggaaaagctgaattctagcataggaaactacgaaactgacatctagaatgccagagagggtcgtgtcagggtggctgagccaaggtgtggaagttggatagagatgagcttagaaatcagaccaccttaagaatgaacaagaacaactcggggaggctgggctagtggttggagggtgcttggtggcgaacgttagtttgtccccacggcctgtcttttgtactttccttgtattttcagcattggaagtgaaagattagcatgaaaaaaatggaaaattatcagttccacccagtcacccccaacacacacacagtaaaaaccttttagcggaaggctttccttttgcaaattataagtgagtgccaatgatgagtcattatttcatgtttactctttaaaaccatccttggtatatattagaagggacagcagcaatgggcaagtttcaagctgtttttttgccaagatccacccagcggctcatgttacccactaggacattcttgggcgtttgtgaaccctgtggaagccccccacctctttgagcctgagaacccttttcaggcctcagggaatcacttcttcagagacttcttcaatgcacttaaacgctaacagagggtgggaaatggaagcagcttagattttaccaagtcatggaaaatccccaatcatttttatcagctttacgtcagagatgtcctcaaaggctcacgcactgcttacaaactcacttccctctctcctggaagtctaggtggggcagtacatgggaggggtaagtggcatcttgctttaaccagctcatattttggtgagaatgaaaaagaactgactttttttgtaacctattacctgagagaaaaacagttaaaaataaactgataataattatttaataatgtaaaaattattatagccaattttttctaatggataatcaaaaaattctagaacatcatgtctttccatcatgattttaaaactttctttaaaaattatgtataagtactacccctttctgatttaataaaatgcttttgtataattgaatagcacctacctgtgcacaaaatgatggattaataatgacttttagcaactaaatttttaaagaactctggcctaggaatattgattcctttgttcattcattcattcatttagcattatccaacatctgcaatgtgaaaggcaccatgtaggtgccagagattcaagggctactttggaagttgcccgtggggctaatagtctaacagaaatatactcaagtttgatgctttttagttcttactgaatcttttatatgcagttgtgtttgttgtggattaactgaggggtgactgaaaaccaaatgcctctggagagatattgagacagtgcttttttttttctggaaaaagaaaatcgaaattgaaatatgtcaatcagtccaatcagtgtttatggcctactaaatgctcaattctttttttcccctgttttcttttttaaattaaaaaacatacctttttttttttttttttttaaagtcaggatttcactctgtcacccaggctggagtgcagtggtgtgatcacggctcgctgcatccttgacctcccaggctcaggtgatcctcccacctcagcctcctgaggagctgggactacagatgtgcaccaccatgcctggctaattttttgtattttttggtagagatggggtctccctatgttgcccaggctggtctcgaactcctgggctcaaaggatccatctgcctcagcctcccaaagtgctaggattacgaatgagagccactgtgcccagccccaattcttatgtcttcataaaaaggggtggaaaaaatagcatgaggatggagcgaagcccaagcgagatttggatactgttggaaaatagtgtttcttcaactgagatatggggattccttgcatcaaagttctcggcatggtgcactttaaatgtgtattccaaggcactggacttttgaatctgagtattgttagtaaagcctgggaatctgcatccccccacccccaataagtcttgtgagcactcgagttggagagcactgatctaggcacctggagaatgtcaccaggactagatgaattcctagatgaacagtgccccaatttcaaaaatgagaaaagaatatatgctagaagccacagacttgatatgacctctggaaaaattcagcttgaaatagatggagccaaagcatttctaggaaaatgtgatcatcactatgcagcaccgtgggttttctaaaataccgtctctattacagattgtcaaactttgttgtgtattagaatctggaaaactgaaaaaaatcttgatgcctcatcctccacccagtaccaattatgtcaaattatctgggggtgggacttgggcatcagtattttttaaaccccaagagattctgacttaatgaggtgcaggctgagtactgggagtttgaaaagctccccaggtgacactcatatgcaacgaagtatgacaagcacaggtctatatgacatgggacaagttgcttaacttccttgcactttgtgtaaatactaggtaattttaaaggtctctctcacctttaaacttctatgattttgtattaaaaatgttgccaaattgatttccttcctttcttcctcccctgcccttccttccttttctcctcctccttccctctctcttcttttgctggaataagctggaatgtcaaagtatcaaaatatatacatatcatcattttattaaaatatttagtaaaattctccaggatgtctcacagataaatgagagttatgataggtgagtttaccagctaactgaacaaatgtgctcagcgagtatgaaggtaacggatctgtggtgaacctggaggatggtttggagtgggatgccacagggctcatcctgcccttggatctgatcttgttaatgttctttagccatgatgtagataaggaagacacgaaagaaatgcctatcgaatttggaaataaagccaagcacggtggctgatgcctgtcatcccagcactttgggaggctgaggtgggcacgttgcttgaggccaggagtttgagaccaacttgggcaacatggtgagaccccatgtctacaaaaaagtacaaaaattagctgggcatggtggcgcatgcctgtagttccagctgctcaggaggctgaggtaggagaatcacttgagcccgggaggtggaggctgcagtgagtcatggttgcgccactgcactccagcctgggtgacagagcgagaccttgtctcaaaaaataaataaaaatttggaagtaacccaaagtttaggaaggctaattcattcaatacataaaataatcaggttcacctctggtcagaaaatctgtttactaagcttattgttattttcaaaacatggccatagttcaaatattttgcttattttagttttccctttcttcagtcgagttgaaattttgaagcttttggtgtagtaccaatggaaagatagatatgtcagttgtttgctgactttgtgcctgtcaagaaatgcaaatagggctgggcaagatggctcacacctgtgatcccagcactttgggaggacaaggtcggaggatcacttgagcccaggagtttgagaccagcctcggcaacatagggagaccctgtctctacaaaaaaataaaattagccgggtgtcacggcacatgcttgggaggttaaggctgcagcgagccgtgattgtgccactacactccatcctgggtgacagagtgagaccctgtctgaaaaaaaaaaaaaaaaaaaaggaatgcaaatatattagatcaggttggtttggagcatcacaaaataaaggaaacatcaccctaaaaagtgacgtgacagtatactatggaaaggaattttgttgaaaactcccgtgaagtgattatgggagtcagggagctcatgagaaggactatagaacacaaagttagactccagaggggcctcagcagtgcccagagagcttgtttaaaagggcactcttggccaggcacggtggctcacgcctgtcatcccagcactttgggaggccgaggcaggtggatcacctgaggtcaggagttcgagaccatcctggccaacacagcaaaaccccgtctctactaaaaatacaaaaaattagccaggtgtggtggcgcatgcctgtagtcccagctactagggaggctgaggcgggaggatcacctgagcctgggaggttgaggctgcagtgagctgtgatcacaccactgcactccagcctgggtaatagagcgagactccgtctcaaaaaataaaataaataaaaggacactctcacagattacaattcctaaatttggggggaggtttcaaacctccttttttttttttttttttttttttttttgagatggagtctcgctttgtcgcccaggctagagtacagtggtgcgatctcagctcactgcaacctccgcctcctgggttcaagcgattctgctgcctcagcctcctgagtagctgggattacagacatgtgccaccatgcttggctaatttttgtacttttagtagagacggggtttcaccatgttggccaggctggtctcgaactcctgacctcgtaatccgcccgcctcggcctcccaaagtgctgggattgcaggcgtgagccactgcgaccggctgcctccttttttttaaaacaaatgttcccaacttattccgcgaaatactgtcaaagaactcactttgaatttcagcatagctgttaaatatgttgtttttgtctcatagtcaacttccaatttgtgtttttaaaagcctagataggttgaattactttgagctgaaaaccaaaacagttaattatgtcagctcctccacatcccattccccatatttaaattagaaaatcgtacactctcatatttcgatttttcttttcattttgaatgctctattttatacagagctggatgtgacctagacatggagaaactcatttatgtctagcagagaagcagcctatagctgctctgtagctgctgctgtgttttggaaaataagccaggattagattatgtctgatcactttccacatcacatgatgaacagcgattcagaagaagcgtaaaatgaatcctgctgagcagcccctcagctaccatgtggttaactggcggtttccttccctccctcctgtgtattcctcattagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatgtgagtactgggaatgtgcctgtggttatgaatgaaaaggggaaaatgagctgccctcaccctcttctcctttctcatttactcccacgatgctcaagctgccctgtgtgatttgcacaaggcatcgttagagtagcataggaaactacatttaggaagatgtagctttgaatttatgaagtaccataaagtattgtcttagagatattttgtgtttgatttaatttcattcgataatgtaccaatataaaatctcaatttaaaactcagtggcagggaacaagaaaggcagtgtaatttatatgtgtttcttcaatacttttataaatagctatatccctacttttgtgacatttagtagcatcattgaatttttattggattttataactcaatgatcacattatttctatatctattcaacacagaacttcatgagatttgcatcacgttttaaaaataatctaggagaattgggagaatgctagatcatctgtttccaaaaaaaaggtgtattgtttctaaatagatggcatgcctttctgtacccccatataattagaagcttaaatattcactttgtttattttgtactgaggttctttctcatggctattggcatctagttgaaacaaacttgagcatttaagggatagagtttccaacaagcaaattaaaataaaaacaagtaaataagctgggacaattaatatgagtaatttgctcttaaactccacttctttgatgtctaggttataggtaattcccccaacttctattccacgtcttgcctttggaagtttattcaggcttaaggtggagggtttaggatgcagagtgtgctatactaattagcgtgggatgttttactttgggaatcaaatgttattctcctacccagctgacttgtgctgatgatgtaggaaactcatctctgaaagtaggaagggacataggaggtgtactgactctttcaaatctttaagcatgtcatgaaataaatctttcaaaagctccatctgaactctactgctgtagtagacgtttattagcagagagtaaagagaaattatctttttatatctaggattactcacagttctttaaatttagccaaatttcctaggttaaaaaaaaaaaagccaagtccaacttgtaaaaacaaatcctctctctttttgaaatacttttcaacttttaaaacattgcatgtaagtggaaatattagcttagatttttggattgctttttctttcaaatacctgtgatttattgaggtgaaattcacgtaacataaaattagccattgtcaagtgaacaactcagcagcagttggtatgttcacagtgtcgtgcaaccacaacccctatgtacttctgagacatttccaacactccaaagtaaaaccccttatccattaagcactttctcctctcagcccctggcaaccacaaatctatattcagtctctatggatttatctattctggacatttcatgtaaatggagtcatatattatgtgaccttttgtgtctggctttgtccatgttgtagcatgtatcagtactatattcctttttattgtggaataatatttcattgtatgaatatgccacattgtatttatccattcatcaattgatagacatttggattgtttcagctttgttttttgttttttgttttttttgagacagtcttgctctgtcacccaggctggagtgcagtggggcgatctcggctcgctgcaacctccgcctcccaggttcaagcgattctcctgcctcagcctctggagtagctgggattacaggcacacaccaccacacctagctaatttttgtatttttggtagagacagggtttcaccatgttggccaggctggtctcgaactcctgacctcaggtgatctgcccgcctcggcctcccaaagcgctaggattacaggcgtgagccactgtgcccgacctgtttcagctttttgactgttatgaacaatgctgctgtgaacatatgttttccgttctcttgggtatatacctagaagtggaattgctgggtcatacggtagctttatgtttaacattttgagaaatttccaagctgttttcccaagtgactgcaccattctacattcctaccagcagtgtataaaggtttcaatttctccacattttcagcgatagttgttattgtctgtccttttgattttagtcatcctagtgggtatgaagtggtatcacaccatggttttcatttgtatttcagtagtgactaatgacattgagcatcttttcatgtgtttattggctatttgtatatctgctttggagaaatgtctattcagatcatttacccatttttaattgaattatttatttttatattgttgtaagataaatttatatattctagatacaagtttcctatcaaatatgtgacttgcaaatattttctctcatttgttgaattctcttcatcctttcttaatggtgttctttgaagcacaaaagtttttacttttgatgaagttcactttattttttctttggttgcttgtgattttggtgtcatatctaagaatccattcccgagtccaaaaagatttttgctcacgtcttactttaagagttttgtaacaactcaacaagaaaaaaaagataactccattaaaaagtgggcaaaggtcatgaacagacattttttcaaaagaaggcatacaaatggctaacaaacacacgaaaaaaatgctcaacatcactaatcatcaggtaaatgcaaattgaaaccataatgagataccaccttacataccggtcagaatggctattactaaaaagtcaaaaaataagagatgtaggcaaggatgtagggaaaagggaatgtttatcactgctggtgggaatgtaaattagtacaacctctgtggaaaacattatggagatttctcaaagaactaaaaatagagctaccaaactaccatttcatccagcaatcccaccacggagtctacccaaaggaagtcattatatcaaatagatatctacactcttatgtttaccgcagcactatttacaatagcaaagatatggaatcaccgtaagtgtttttcaatggatgattgggtaaagaaaatgtgtggtgtatgtatatgtaagtgtgtgtgtgtgtatatatgtgtgtgtgtgtatgtgtgtgtatatatacgtatatatgtatgtatgtgtgtgcatatatatatgtatatatatgtgtgtgtgtgtgtatatatatatatatgcatgccatggaatactactcagccataaaaaagaatgaaatcatgtcttttgcagcaacatggatggaacaagaagccattatcctaagtgaaattactcaaaaaacagaaagtcaaataccccatgttctcacttaaaagtgggagctaaataatgtatacatatgggcatccagaatacaataatagacactggagactcagaaagctgggagggtgggaggggggtgaggtatgagaaattacctaatgagtacaatgtatgctacttgggtaatggttacgctaaaagcccagacttcattatacatgtaacaaaattacacttataccccctaaatatatatgtttttaaaggccaaaaaaagttttgtacttttagctcttacttttaggcatttgaaccattttgagttgctgattttcacgtatggtgtgaggtaggagtacaaattcattttttgcatgtggatatccagttgtctcagcactgtttgttgaaaagattgttctttccccattgaatcctcttagcaccattgtcaaaaatcaattgaccataaatgtttatttctgggctctcaattctattccagtgatctgtatgtctttcttatgccagtaccagtgtctggattactatagctttttttttttttttttgagacggagtcttactcttgtagcccaggctggagtgcaatggcacaatctcagctcactgcaacctccgcctcccaggttcaagtgactctcctgcctcagcctccggagtagctgggattacaggcacaaaccaccacatctggctaatttttgtatttttggtagagacggggtttcaccatgttggccaggctggtctgaactcctgaccttgtgatccgcccgccttggcctcccaaagtgctgggattacaggcataagccaccacgccaggcctactatagctttttttaataaagttttgaaattgggaagtatgaattcttcaactttgtttctctttttcaagattattttggctattctgggtcccttacatttccatatgaattttagaatcaatgtgtcagtgtctcaaaagaagccaagtggaatgttgagaggggttgtgttgaatctgtagatcaatttggggagtattgctatattaacaattaaataatctgatccatgaacatgggatgtctttccatctatttagatctttaatttctttcaccagtgtcttgtagtgttcagagtataagttttacacttctttccttaaatttaacctaggttttttattctttttgatgatattatacatggatttttgttaatttcatttttggattgtttattgcaaatgtttaaaaattgatttttgtatattggtcttatatcccaaaactttactgaactcattagctctaataggtttttagtggatattttaggaatttttatttacaaaccaggtcatctgcaaatatagttttacttgtttctttccaatgccttttgtttcattttcttgcctccactacaatgtcaaatagaaatgcaagagtagccatccttgtcttgttcctgatcttaagggagaaacattcagtgtttcaccagtaagtcttatatcagctgtgtctttttcatagatgctctttctcaggttgagaaaacacactcctattcctagtttattgatttttttattattacaaagtggtgtttaattttgtcaaatgctttctctgcatgtattgagatgatcttgtggtttttgtcctttattttatgatatggcatataatgttaattaaatggcacattatgttaattgatgttaagccaacttcgcattcctaggataaatccccttgatcatggtgtataatgctttttatatgctgctgaattcagtttgctggtattttgtagaggaatcttgcaactatattcataagagatactgatctatagttttcttgtgatatctttgtctgatttaactgtcagggtaatattggcctcatagaatgagttggaaagtgttcccttctcctccattttttggaagagttcatgaagaattggtattaattctttaaatatttggtagaattcatcagtgaagctatctgggcatgaggttttctttgtgcgtagtttttttgattacttattctgtctcttgttatatgactatttagattttctattccttcttgagtcatttgtggtagttctaggaatttgcccatttcatctacattatctaatttgttgacatatacttgttcagagtattcccttaaaattcttttttttttttttttttctttactgctccattgctccttatggagcagggcaaacccatatggagtgcgtccagaagagccatttaaaattctttttcttcttttatctcttgttggatatgccaatcaaggtttattatgagttcataataataaatctgctgaaagctgatgcagtgatgtttacttatatttattcatagacaaacattgtgtgcataaaattttctctcattcagatatttggaaaaaatatagaaaagcagttgaaaataatgaatactccctcatcattccactacccagagataatgacaacattctgataatttccttcaatgtattttttgtatattatagatttctgatcatcctaaatgttagttttttgtagcctcactttcagcactaaaatgttatgtaaacatttctcaagttgttataaatgctttgcaaacatcattttagtcattgctaagtattttatttggtgaataggccataatatgcttaattattcttcaaatattggaccttttaatactaatataaataacactttgaagaatttctttgtgcaaagccttttccttattttggattatttctatattcaggtgattagatatgaaattatcgtgtcaagggctataaatattttgaaagctcttgatagaaaatgatagatattatttcctgattactaaccatattccaaagagtgttcaacataatctacatatgttttatctaatccttgtaataaacctgaataaagggttattattcctgtttgtatagtggaagcagctcatgctcagtgtggtacttggtaagtttgtttttcgtttttttgttttttttttttgagatggaatctcactctgtcgcctgggctggagcgcagtggcgtgatctcggctcactgcacccttcacctcccgggttcaagtgattctcctgcctcagcctcctgagtagctgggattacaggcgcccaccactatgcccagctaattttttgtatttttagtagaggcggggcttcaccatgttggccaggctggtcttgaactcctgaccttatggttcgcccgcctcggcctcccaaagtgctgggattataggcgtgagccaccgtgcccagcctacttggtaagtttatgcagcttacagctggcagagttgggatttgaattcaaggagttttgatgacaaagtattttttgctgtcacccattacaccattttatgccacctctgaatgttgctgcttcagaagctagctttaattaaatttacttatatacagtaccttgtatttgcatagtgcttttcaagttggccaggccctgtaacatacgtttgatcctcacagccttttgaagggttgttctcagtttgcagaaaaggaaatgaggctttgaaaggcaaagtgattgcctcaagggaacacagcaagtcacagagccaaggctcgtgcttgattcctgtttccactggtctgactagtgttaagggttttttgtcctgctaggtcgttccacctgaccacagtactctgcctctggagtatcacggcagtttgagaaagcgtaacctacatataaaatcgaggctattccctttcttgtgctctacccagcttccatgtagagaagtagcatcgggccaggcgcggtgactcacgcctgtaatcccaacactttgagaggcgggtgaatcacttgagcccaggagtttgaggttgcagtgagctatgattatgccactgcactccagccaggaccaccactgagtgagaccctgactcttaaaagaagaaaaagaccaggcacagtggctcacacctgtaatcccagcactttgagaggctgaggtgggtggatcacttgaggtcaggagttcaagaccagcctggtcaacatggtgagacactgtctctactaaaaatagaaaaattagctgggcgtgacggcacatgcctgtaatcccagttacttgggaggctgaggcaggagaattgcctgaacctgggaggcagacaggttgcagtgagccaagatcatgccactgcactccagcctgggcaacagagtgagactccatctcaaaaaaaaaagtaacatcaattttatattgtcattgttattttatttcttttgtgatatgtagcaggtaagagaggactaataatagctatcatttattgagtgcctgctactctcattatttcttaccaaaactcttaaagctttgattagtctccctcgttttataaatgaggaaagtgagacttaactgccccaagttacacactcatgggtggcagagcctgaattggaaccagatctggcagattccaaagttcatggcccttctgatatgctaccctgacttggagaattggaatttatccacataacagaaattaaacattgcaatttcattctcctgaatttcacttgacacttaaaattttatgttaatggtatttcaattaataatctattgcctttttgttcccatggagcactttggaaacactgatatattttatttcttcccttgagaccacttagaaatgtatttattcaatttctgtaagtgctaagaggccgacaaagacaatccgtgcttttttggctttgtggtttgatgcgtaagctgtgacaaatagaagtttctctaaaggaaattgttcctttcaaaagtactcattctttattttatatgaaaaaaacttaaaaatactgaatagcaaactaaatatttctttaattcttggtaaaacatctagttaatttagctgtttaaaaatcaaacaatcgccaggcgcggtggctcacgcctgtaatcccagcactttgggaggccgaggcgggtgaatcacgaggtcaggagattgagaccatcctggctaacacggtgcaaccccatctttactaaaaatacaaaaaattagcagggcgtggtggcgggcgcctgtagtcccagctcctcgggaggctgaggaaggtgaatggcgtgaacccaggaggcggagcttgcagtgagccaagatcacaccactgcactacagcctgggcgagagagcgagacaccatctcaaaaaaaaaaaaaaaaaaaaaaatcgaacaatcaagccattcacagctgcttgagagcccccctcccggctctccatccccatctccttactcccaatttgaagtcctttactgtgatgtatatttcagtttgagaccttcatggaaaaataacaaatgaaaatctttcatctttggtgttccctaaagaattttctccaagtttagagggcctcttgccattctccttgctattgtttgtcagagggttctaggttatcatagccatcaagcagtctttactgccaccgtagggtatattgaaaatccctgtgaactcggaccgtcctcattttcctcctcaatgaactgcagacagagaagatgctctttcaagtccattgtccctctaagactatccgtatgctctgtagctgtgggaggggtaggtaggggagggcattgattttccttctgcctctcctgctcattccgctagctattgctcatcagcatcttgacatgctcggtgactttcctctttttttcctttttccttttttttttttttggtttgtatatatatatatatttttttctcaagccattttgttttgcttttgttttcctccccaaatatttttgaaaattgcaaacctacagagaagatgaaagaatagtacataaacacccgtttgaaataatttgaaaataagctgtagacattatggaattaacctctacgtacttcagcatgcatctactaaaagagggatattctcttatataactacaatactagatcaccctgaagaaatttaacattgatagtgtaacattatctaacatgtagtccatattcagaatttcccagttgtccaaaattgccctttgtaactgttctttccttccctttaaaataagtcttctctggccctctcatcccctccagttcctctcgtctctctcctccccttcaagctcgctccttaggggtgcatttgtacccgctgtctcctacctcctctttgatcccagcccagggaagatgatctgacaggttcttgaatgacctcgaagtccaatggagcattttcagtgctgattttgctcacttcctggcagtctttggcactcctgcccactcccttcttactactcattgcccttggcttcaggggcaacacattctcctggtttttcttttaggtctctgcatgaactatttatgtggactctactttctcctggcttttaaatgttggggctcctctgggttccccttggctctctggttttgtcactctaacactctccttggatgctttttctagtccatggctttgacatcagtgtgtcaagactccaaatctttattttcagcccacatcatatgctctaatccctgttttattgggaatcattttaaataagtacttttctttgtaaaaggagaccattttcttcatctgaaatcatgattcctctcactaccaattcttaggtaatagtcaccgtttgatatgataatgtgttggcctggaggtttgtataggattggtactacaaacacatttaatgcctgtatgaaacagacaaaacaaaacaaacccatcccaacaacctttttattctttacaccaattaaatacatcttcatctttttatttgctgtgtgattaatttacctttgctttaaaaatttcaagtattttgagactctgataggggctatttagatatccattttagaatcgtgaacctttagaaggcagaaaggccaggtgtagtagccatgtctgtaatcccagcactttgggaggctgaggcgggaggatcacttgaggctaggagtttgaaaccagcctgggcaacatagcaatacctcgtctctaccaaaggaaaaaaaaaatagctggacatggtggctcgcacctgtagtcccagctacataggaggctgaggcagaggatcacttgagcccaggaggatcacttgagcccaggaggtggaggctgcagtgaaccatgatcgtaccactgcactccagcccgggcaacagagcaagacattgtctcaaaaaagaaaaaacaaaaacacacacacaacacaacacaaaacccaaagagagcagaaccacctctttgtttaaatgatttttactggcttccagctttactaggaaattcacaaagaagccagctttccagttgggtcatgttaattgttaggaaatcttgttacagagagacctattgcaactaagtgcaagaaaggacaatccctcagccccaattgccagttatttcccatattcagaacgcttttcttatatgattatggctttatatttcattagcttttagcagctgcaaaagacaaaaatttaatgcggatcgtatttgaccttggatgaacgaacatggcaatataacacagattagtaattaataacgagggagacataaaacagaatttgcagtcaagatattatttcctgagtgaagattaaaggttattattgaattattgaatagaacacatttcctatgagagactattttaataatttaaaatgataggaattcttttatatagcaaaatttcttttacatacttaagaatacaatagtttttaaaaattaatgtattcataataattcttttggaaaattggcaaaacataatatggtaggaaggttaacagttacttgtaaactattctcttggtctgagtgttttattgagttggcctattattttggtatggtataaatgaagcatcacattttcctgaactagtgatatagccaaggattacaactcatctttttttttttttttttcttttttgacacagggtctcactctgtcacccaggctggagtgcagtggcgccatcaaggctcactgcagcctcaacctcctgggctcaagtgatcctcccacctcaacctcccaagtagctgggactacaggtgtgtgccaccatgcccggttaattgttatagtttttgtagagatggggtttcatcacattgcccaggctggtcgtgaactcctaggctcaagagatctgcccgcctcggcctcccaaagtactaggattacagtcatgagccactgcacccagtccaaggatgacaactcttaaggaacctttcatgagatggctttatgtcatcttcatgttgttccattgccctgttgaatcaaatagggctttaaatgggccatttaaaaatcctaatcctaataaatgtagaagaaatgagttcaaaaatcactgttttgcaaccaccatagaaataattgatttaagcaaaaatcatcaatggatattttggagaacagaatgtatacacagtctcaaagcgtgttcctgcaaactgtttattaattgtaaagaggcaaacacttctacagtagagaagttcacatggacaccaccttacccaagtgatccaagttcgctcagtgataatgagacagatgagcaccacatgccttctgatgtcctaatgcactgagaaagacataccacttatcctgccaaaatacacaacctgaatctcatcacgaggaaaagagcagacagatccagattgagggatgttttacaatcaactggcctgtactgtttgaaaatttcagtgtcattgaagagaaaggcagaggagttgttccagaataaaggagactgaagaaatgacgatggtatatggagagagagagagagagagactagttattaacaattatactatctttactttttcatacatttgaaaatatttcagccgggcgcagtggctcatgcctgtgatcccagcactttgggaagctgaggcgggcagatcacctgagggcaggagttcaagaccagcctggccaacgtgatgaaaccccgtctctactaaaaatacaaaaattagctgggcatggtggcgtgtgcctgtagtctcagctactcgggaagctgaaacaggagaattgcttgaacctgggaggcggaggttgcagtgagccaagatcgcgccactgcactccatcctgggtgacagagtgagactccgtctcaaaaaaaaaacaaaaatttctttcaaaagaaaaaaccctaatcctgtacatcctgagataagtttaccaagtttgtagtggtggcaacctaggcttatgtcctttggtagtaccattttttagccctttcttgtttttgccatctaccaacttcattcattgaagactctccacccactctgagcctcatactgggtatcttcactgtacatgtgaataagccccaaatgctttggtgtctgagttccttgatctcctgagccccagaaaccccctcatctcctcaacttcagctgctcactcccatttactggcccccatggtcacctggaaaagccccacctctggaatcttcatgattatcatcctattctctgattgcttggtcttctttgaaacctctgagccttagatacttcacatgtgtctctatctcccagcctccagttttatatagattttgggaatacaggtgcatttttattacatggatatactgcgtggtggtgaagtctgagccagccctctcttgtcttccctttcttccccatccatcttccctccatcttttgttggctgtcacttgaaccagttaacagatcatacaccttagtcatattttaggcagttaaaaaaactaatgtgtgaaatgtttagtgttcccaaaccaattgctagcaaactttggctacaattccttgatggaaaagccagagatattagtaacttgtatttttctacagggatgattccgattgattgatttattttcaaatagcctttagaatttgtctcctttgtccagaagtttctggtttgagtgttcagttttgcacatcatatcgtgcccttggatggttattttcagcttttctatgtacagtgataggtgggctgcagcaatggcactaaaaacaagtagatggatgagttagagtatttggtaactggaaagaatcttagagatcacacagtccaaagttctcattgtttacatgagaaactgaggacctcggagtttcgttgatttgcctgaggttacttagctggcaactgggtaagtcagggcccaaatggaagtatctcaatgacaaagtcagaacttatttttattaccccatgtggatggggttggtgggtacgagagtaagtacatagaatgttgtagaaatgacctgttattctcgctcttgtctcactggaaggccagaggttcctgagaatgacacaattatgatctcttttgtcccttagggaaagtgatagttgtgtttcaaatgcctgacattgtttggagactggacttcacactttactctcttctttcagaaaagtgtctcccagggacaaggcctctgtgttgtggccttgctctgcagggctgccagagtttgtggctgagcgagcctcataaggtgtctgccttgcttgctgcccaacaagcaggctttgtgtctgtctcatgttcactgggcatgtgctttgagctgtttttccagtgaagtcagaagtctcactgggacagccgcacattctggcagatggcagatatagaaaatctgtaaacaaaaataacagtaatgaagactgtggtcctaggccagagttcagccatatcctcttctcatcatgctttgaacagctgaggttatagatgcttctcctcttcgcttaaagccttttgctattagaggattcattttctttccagttcattcgaattcattttaatcagctgtgtcgcacttgtgcctgggtctcttcttgcctggaggccaggccccttaaaggtacattaaatattcgctaatcctgctgcttcctcaggattcctctgccagaagaatttcaaaagcagagagcctttaaataccttatcattctgaatatgaaatgtcttgtttgaagaactatctgtcaaataaactcctatttaaaaaccaaaaccaaaccaaacataaagactctaccagccagcacaaagagaaatgtaagacacaaagtcttaactaaacagtcatttcatttgttcaacaaatatttattcctgctatgttccagagactattccaggctcaggaaatacagcagctaactcaacagatcaaaatcccagctcttatggagattacattctagtggaaagacacagacaatgacaaagaagtaaatatcacatggtgataagtgctatggagaaaaaataaggaaggagataggcgatgaggggagaggagaccatgtaagaaggggtggtcaggaaaggcctcccgcaaaggtgatgtctgagcaaaagctgcaggctctaactgcatgcacctcagttggccgggctcttcttgctctaggctgttgtgttcggagatggtagcctgtttgtccacagtaatttgtgaattttttttttttttgtgacggagtctcgctctgtcgcccaggctagagtgcagtggtgtgatctcggctcacggcaacctccgtctcccaggttcaagcaattgtcctgcctcagcctcccaagtagctgggattacaggtgcccaccaccatgcccggctaatttttctatttttagtagagacgaggttttgccttgttggccaggctgctctcaaactcctgatctcaggtaatccacctgcttcggcctcccaaagtgctggggttacaggcgtgagccaccatgtgcagtcataatttgtgaaatttctaatgaaatattatgtataattaggaagtctttgggacttaactggaatttgttagcctggagagagacaatttttaaaaaagtatctcccatttatcgagtgcttcctatatgacaggcaatatgctaagcattttatatgaatcaattaatatattactaatacctatgtcaacagattactaatacagtattatgtattattacaacacccctagaaggtgttcattcattcattcaatcattcattcaacaaatatataatacatttccaggccttgccccaggtgctgcggatgcagcaatgaaaaaaatgaagttcctagctaataggggaaaatggacaataaacccatacacatataactgtagacaatgtcagatgctcaagagtgctacagagaacagtagaacaggtaaagagatagggaatgtgagcgggagaaggtgtgggaggagatgctattctatataccatctgattttttttttttttgagacagagtcttgctctgttgcccaggctggagtgcagtggcatgatcttggctcactgcaacctctgcctcccgggttcaagtgattctcatgccttgtgcctcagcctcccaagtagctgggattacaggcatgcaccaccacgcctggctaattttttgtatttttagtagagacagggtttcgccatgttgcccaggctggtctcaaactcctgagctcaggcaatccacttgccttggcctcccaaagtgctaggattaaagacttgagccattgcgcctggccccgtctcattttttatggctgattccaaatgccatgtatatagcaaaatgaggatgagcccaggttctgaaattacagataactggatttgactctgcattgtccctctgacaagtgacatgaccccagacatgttgtttctgagccccagtttccttatctgtaaaatagggacagtcacacttgagaggattgttagggggaggatgaaatcaaatcacgttgaagtagatgatccacataaagcacgaggcacaatgcctggcacaaagcaatcactctgaattcattatttgtcttgctcactaaccccgtacatgactatttaatttcttgcaagataccatgatagtgattgccaccagagaaaagaatctattaaaacaaaacaaaaaaccagcttggcaatagagaaaccacctactggccacagaaagttggccaggtaacttattgaatctatgctgttgcttctgtctagaaacaaaaatagaagacccttgctacacatgctcctcaatagcatgcatttatttattcattcgttcgttcatttattctgcatggaatcaatgtgaccgggaagagaagccctgttatcagatgaagcagcaggaccagaagtagatctaagctgtccaataagtttagaactggatgacgcagatcttcaactctctgggcagggtggggggttatgggggccagcaacccctcgggtagggtctatcatgcctgcattctaccctttgctattttggaggtttcttctccaggggagggtcctcagctggctagtgctgtcctgtggtggatggggcttaggaattaggtgaggttttggaggtctgatattggtatgcccaaccttgctgggctccttccctctcctggagaggtttccttgggaaatgtatgcccaagggacaacagcaggatgtggatcaaagtccactttattagctgctgcacaagtaccccaaatctcaacgtagagctctaatgacggcgtgcgttggagcctgcaggaagttggaggcttgaggtcttagcaggacctatttttcccacccctctgagatgagctcatcgggcagggtctagtcaggaggcagaaaccacagagtgatttgaacagagagaattgaatgtaaagaactatagcaactgcagggaagttaccaccctagagttgagagaacaaagggaaaagggtggaattattccggttgagaaacttgcaaggagggtcccacagaactgaagcccagacctctgagaagtggtgcactcagctggtgctggtatctccggggctgccatgagactggctttgcaagtgctggatgagctgcaaactggatccgacgactgttacctggggtgaagagcagttgctaggttacactgtcaggaacaggaagcagacaggaaggagtgtgtccctagtccctccctccagccttgcagtctgcctttcccacccctattggcagagcctcacagggggcaactgacaaagctgaaatggggtctgcaaagtcccagcctcagcaccactgtgctgactagggaagggtggggttagagttgagacctgatagcttaataagtggcatgtgtgctcgggtacaggcgtatgagcataggcagagatggctgcttcccaagctggggtggggtggggcagttccgtttcctgactttggagtagaagaggaagtagaagacagaggggaccataggtgtttataaacttcctatgccacagtttacacccctcccagtggaacccagtgaacgtattgtgtgctatatacaaaacagcagctcctcccttggagagtggggtggggatggaagctaggcagagatgggagggggcctagcttgcctctttctccgcatcagggaggagaagtggcagtagatgtcaggtgtccagctagtgccagccacttagtaggcattcaagaaatggtgaatggccaggcgcagtggctcacacctgtaatcccagcattttgggaggctgaggcgggtggatcatgaggtcaggagttcaagaccagcctggccaatatggtgaaaccttgtctctacagaaaatacaaaaattagctgggcgtggtggtgggcgcctgtagtcccagctactggggaggctgaggcagagaattgcttgaatccaggaggcggaggttgcagtgagccgagatcgtggctctgcactccagcctgggctacagacgagactctgactcaaataaataaataaataaataaataaataaataaataaataaatggcggccattattattcaaaggaaggaaaggtacacataggttagggaatgaagtaactgactggagtggaaagagccagaggacctgagttcatactaaataagtgacttggagcaagagactcgcctttctgaactcaaaatttccttatgtgtaacatggagatgatgatgcttgtggggaccaaatgtcttgtaatagacccttaacatatgatagttattttgttctattattacagaaatagtaataagctcagttatttcttttttttttttaatcgaaatggagtcttgctctgtctcccaggctggagtgcagtggcggtgatcttggctcactgcaacctccgtctcctaggttcaagtgatcctcccacctcagcctcccaagtagctgggattacaagcgtgtaccaccgtgcccagctaatttttgtatttttagtaaaggtggggtttcaccatgttagccagtctggtctcaaactcctgacctcaagtgttctgcccacctcggcctcccaaagtgttgggattacaggcgtgagccatcgcacttggccaagcttgtttatttgttattgatgttgctaataccaaatagaagagacttcagtgatcatttattctacaacatcattgtgcagatgaagaagcagaggcacagaaaagatcaatagctctatggaggttaagagcttgggctatggagtcagtcagaccagggttcgaatcctcactgtctatttccacttaccagctaagtgagctttagtgagttcctcagtctctgtcagcttcgcagtgttgtgaggactgcaggactaatcaatgcatggtcctttgtaagtgcctaggaagtggcactggaaaggtaccattgtgcttgtgagtatgagaacccctgaggccagagggtgattcatcatgatagcgactgtcccacagaacaggcctttcaggtgaccctagagcctccatcatggtattgtgagaacacttcagatttcagccatgccactgccaattatttgctttgcaaggttgaagatgtgtgtagggaaaatctttttcccctaaccattttttttctccactctcacaccacagcaatcatcaacacagaagacttctgtgaccaaatgtgtggggacttttctgcacacaccaagcagcagataccagctgggtgtcctctaattcagattctgacattatctacccagagatagtgtcagatcccacaggttgagggctcagtccccaagactgcctacccaccccaccccaacaccagttgcaagttaagacctccagaacttctgactgaccagcttcaagttgggggttcccatgaccccctctttgggttccattattttactagagcagctcacaaaactcagggaaacacttccttacatttactggtttgttataaagggtattacaaaggaaacagataaagagatgcatagggcgaggcaagggggaaggggcaggccaccctcccagaacctccactgtttcgctatccggaagctcactgaacccggttctcttgggtttttatgaaggcttcaagacaacagcatttcttcccctagggcatagagccttaagcccataatgagaaagtcaggggaagattagagccttggggcaggtgaaaggaggacaggaggtcagaggctgcccctgaggcctaacatacccgacatcacaacaaaagactgtatcagggccatggatgaaaacctctctctctctctgtctctctctctctctcgctctctctctctctctatatatatatcttgtattagtttgttttcacactgctgataaagacataaccgagactgggtaatttataaagaaaaagaagtttaatggacttatggttccacatggctggggaggcctcacaatcatggtggaagggaaaaggtacgtcttacatggtggcagacaagaaagaatgagcgccaagtgaaaggggaaaccccttataaaactatcagatctcatgagacttattcactaccaccagaacagtatgggggaaaccgcccccatgatcagttacctcccaccaggtccctcccacaacacgtgggaattttgggggctacaattcaagatgagatttgggtggggacacagccaaatcatttgtatattataacaccacaacatgtcactctatttcttcttcctgtggtttttccctataaagctcatgatacgtgatgttgggtctatttcctggggttttctgaaacctgaataatggaaagagtccctggaacccaagagccttggggaagctaataaattaaccttgcgagacgaccaggtcctgggatattctgtgtactgcagcagtactaaaccagaggatgctgagactgggggctggacccctgctttcagaactcacatcgttcctgttatagtcaactcttattttttatgcaccaactgggaaaaacgatagcatgaataaaaggagccagctggtgttgattgctcttcactctaaaactcgaggaggcataagagactgtattttaaatctcattacctcttacctgatttctttcttcaatatgatgaaactacaaggtggctcaaaggctaccttccccagaagagagacagtctgcctagatagtccacaaacaagacaatacttccagttgccatttacttagcatgtgctttttaccaggcattgggctaaactcttccccttgtaacatctcatttcatcctcatagaaactctgtgagggagggggtgtgtttctttatccacctgcattttatcaatcgaatctcaggtgcagaaggtggtgtgaatcatacgtttccatcagctcattgaacattatcatcattggtctgtgcaagaccccttcttatgttaattagtttattcccttctcttcatgtaccccacgctcattcactcccctataaataaccggtccattatgtgttgtgtgcatctttccctttgtatatgttcttatgaaatgtggttttgtatctatatagttctattgattaaagtagtatttcattctgtctctgactttttaataaccattccaatggaagtactatgtttttaagacctactggttaggttgctatgggtttatttaatctattgcttccagttgtgttgtgctactccgtggtgtgcacccaccaaagatacagattctctttcctagtgataggcagccaggcctatttgtatcaaacttcctattgccacaaagaagcaattgcatccccatatgtctccttgatggactgtgtgagaattgcctttggggtacgtagtgaagaatggaattgctacttcatagggtatacatagattcatagatttactatgcttaagccatgccaaaggtaggtgctgttattattcctattttacagatgaggaaactgaggttttgagagttttaataacttacccaaagtaacatagacggtaattagcagagctaggattcaagttcaggcagtcttactccaaaacttctgttcctaatggctgtgccatcattattctctgagtgtttgagacatgaggacattttataaaaaacataaaagtcaatctcattgtttggtgttttaatattcttagaacctaggaatccaggtggactgctttttttttccactgaagcacctacttctcctaacaggtgcatagtaactgtttttctttgactttcatattctgtgggtctgcagcactgagagctgcgttgatcatccagaactggtaccgaggttacaaagctcgactgaaggccagacaacactatgccctcaccatcttccagtccatcgaatatgctgatgaacaaggccaaatgcaggtctgttttgcaagcttttctcttcttttgataaaatgattctctttaccccttgttattgaaagaatgaaagtttgggtccattttaagctgaggaagcttggtgaaaggctttaatagagcatgtcatgacattgtcttggaactagttattgagagagagtgtgctttgggaaaaggatggtgtttttccgttttgaagttcacatttttaagagggctgcccaacatctggttaactaataaaaatagtcttattctattttggggcagatgccttaataggaaataaagttgtcattttataaaagaaaaaaatacttcaaggggttaaaaaatggcagaatttcctagcaacaaacctctgcaagctctagaagaaaatatacatgggtgaggaaggccttttttttttttttcttcgagacgggatttcactcttgtcacccaggctggagtgcaatggcacggtctcagctcgctgcaatctccgcctcctgggttcaagcgattctcctgcctcagcctcccgagtagctaggattataggcacccaccaccacacccagctaattttgaaatttttagtagagacagggtttcaccatgttggccaggctggtctcgaactcctgacctcaggtaatccatctgccttggcctcccaaagttctggaattacaggcgtgagccaccgcacctggccaaggaaggcctttttaaagaatacataaatctagttttaatgcttattaattttaaaaaagtacttttaacaataaacagatcttagaaagatctccaatatagttgctaatgaaaaaatcaacttttaaaacaatatgtagagtttatctcatttatgtgaaagaacatgaaacatacagcaaaagtctggaaaaagatacacaggaaattgtttacagtagttagttctgaggacaggaatggtattggtgggtgtgggttgggatgttaagagggacttctcatttttatttgaaattatttgtagtttttagcaatcatatatctgtgtatcacattataatatttaaagataattaagaacattccaaaaagaactaagttgctagatttatttttggcagctagaaaaatgatatactgtgattcagtcagatgctccctttgtctagattaggaacctcagcataggctgtctttctaagcactgtagaatatagtgataaatatacaggtagagtgaatcccaaattggtatgctttagacacattccagcaccagtacattattttctattgattctttattgagatgtaattcacatgccatacaattcacccatttaaagtgtgcaattcaatggtttttagtatatgtacagggttgtgcaaacatccccacagtcaattttaggacattttcatttcccgcttcctaaactccgtacccattagcagtcatttccccatttccttcccccagtccctggcaacgactaagctattttctatctctatggatttacctattctggccatttcatataaatggaatcatataatatgtggtctttgatgtctggcttcttttttatttatttatttttttgagacagagtctcgctctgtcgctgggctggagtgcagtggcacgatttcagatcactgcaacctccgcctcccaggttcaaccgattctcctgcctcagcctcctgaatagctgggactacaggcatgtgccaccacgcccagctaatttttgcattttcggtctcccagagtgctgggattacaggcgtgagccactgtgcccggcccagcttcttttacttagcataatgctttcaaggttcacccatgttgtagcacatatcaggacttcattcctttttagttaatattactcattccgaagaatattccattgtatggatggaccacattttggtcatctattcctcaggtgatggatcatttgggttgttccaccttttggctattatgaataatgctgctgtgaacatttgtatgcaagtttttgtgtgaacatatgttttcagttctcttgggtatagacctgtgagtggaatgtcatgtagtaactttgtgcttaactttttgaggagctgctaaactgtgttccaaagcagctccatcgttttaccttcccaccagcagtggatgagggctccaatttcttcacatttttgccaatacttgttattatctctttttgattatagctatcgtagtgggtgtgaagtgatgtctgattgtggtttctattgactgttaatggacaaacccatcatcaacagcattaaaatcatacattttgataactgtatggaaagtcttccttctctcaattcccaactcccagatctactcccagattgataaagtgtttacttttcatgagaggcagggcttgaaaaagaaattatttgtgctgtacaaatgcaggtctttgcagatacctggtggccatagagccagtaccctgattgtggctggaaagctggtgaagttccacctttcccttcctttctttccaaaatatatttgatatttaagaatattccttaactcttaatttcaccaccaaaaagaaaagagatcatgaccgggtgcagtggctcacacctgtaatcctagcactttgggaggccgaggcaggtggatcacctgaggtcaggagtttgagacctgcctggccaacatgttgaaaccctgtctctactaaaaatacaaaaacattagctggacatggtggcgagtgcctgtaatcccagctactcgggacactgaggcaggagaatcgcttgatccggggaggcggaggttacagtgagccaaaattgtgccattgcattccagtctgggtgacaagagtgaaactccatcttaaaaaaaagaaaagaagagatcataatgaacaaaatttggtagctgtcttacgttggatttcctagaagcagaggctgagacagggattctggtacaagtgacttattgagggtgtgttttcagggaaagcctgtaagggagtgaggaatgcgagacaggacaggggagaagctaggccaagatgtactttttgaagtctgacctcagcctgatcccatctggagctgtcaagtgtgaaatgcactacagtttgtccctggcagaggcaagggaggtgggggactgggctgttacacccttgcttcagccagtcgttgtctctgggcagccccacaggaggggcgttcatgtgttaccctgtgttgctctggatgcaggcagtcctctggaggcaggcatagaagtgacccttagcacctgcagcagctgagatacaaatgccccacaagagtaagggcactcgggtggaacaccaacagcatttgtcacagtagctgtttggggttcactaattgattaatttttttttattttgtccagttatccaccttcttttccttcatgttggaaaactacacacatatacataaggaagagctaggtaagtaaaaagcttagtcttttcaaatgtgtcattaaatattgaattgtcttcatcaagagcggtaaattctgaagatgggagaacactatgaaattaaaaagatgcctacctcttttgtttatgtgacacccaacaactggcaacatcagttcaagtggcctttttccctctctggatggtgtcaactaaatcaatcatttaactttttcacttttccaaaagctgaattagaattcattcaatattcatttgttgaatgccttttctgaactacaatctatcggtacacaacagtagcttagtaaagggaaccttatttattattattattattatactttaagttctagggtacatgtgatcaacgtgcaggtttgttacttatgtatacatgtgccatgttggtgtgctgcacccattaactcatcatttacattaggtgtactcctaatgctatccctcccccctcccccaaccccataacaggccccagtgtgtgatgttccccaccctgtgtccaagtgttctcattgttcaattcccacctatgagtgagaacatgcagtgtttggttttctgtccttgcgatagtttgctcagaatgatggtttccagcttcatccatgtccctacaaagggcatgaactcatcctttttaatgactgcatagtattccatggtgtatatgtgccacattttcttaatccagtctatcattgatggacatttgggttggttccaagtctttgctattgtgaatagtgccgcaataaacatacgtgtgcatgtctctttatagcagcatgatttataatcctttgggtatatacccagtaacgggatggctgggtcaaatggtatttctggttctagatccttgaggaatcgccacactgtcttccacaatggttgaactagtttacagtcccaccaacagtgtaaaactgttcctatttctccacatcctctccagcacctgttgtttcccgacttttaatgatcaccattctaactggtgtgagatggtatctcattgtggttttgatttgcatttctctgatggccagtgacgatgagcattttttcatgtgtccgttggctgcataaatgtcttcttttgagaagtatctgttcatatcctttgcccactttttgatgaggttgtttgattttttcttgtaaatttgtttaagttctttgtagattctggatattagccctttgtcagatgggtagattgtaaaaattttctcccattctgtaggttgcctgttcactctcatgatagtttttttgctgtgcggaagctctttagtttaattagatcccatttgtcaattttggcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaaccctttccccatttcttgtgtttgtcaggtttgtcaaataccagatggttgtagatgtgtggtattatttctgaggactctgttctgttccattggtctatgtctctgttttggtaccagtaccatgctgttttggttactgtagccttgtagtatagtttgaagtcaggtagcgtgatgcctccagctttgttcttttggcttaggtttgtcttggcaatgtgggctcttttttggttccataggaactttaaagtagttttttccaattctgtgaagaaagtcattggtagcttgatggggatggcattgaatctataaattaccttgggcagtatggccactttcacgatattgattcttcctattcatgaacacagaatgtccttccatttgtttgtgtcctcttttatttccttgagcagtggtttgtagttctccttgaagaggtccttcacatcccttgtaagttgaattcctacgtattttattctctttgaagcaattgtgaataggagttcactcatgatttggctctctgtttgtctgttattggtgtatgggaatacttgtgatttttgcacattgattttgtatcctgagattttgctgaagttgcttatcagtttaaggagagtttgggctgagacaatggggttttctaaatatacaatcatgtcgtctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgtccattcagtatggtactggctgtgggtttgtcataaatagctgtcattattttgagatacgtcccatcaatacctagtttattaagagtttttagcatgaagggctgttggattttgtcaaaggccttttctgcatctattgagataatcgtgtggtttttgtctttggttctgtttatatgctggattacatttattgatttgcatatattgaaccagccttgtatcccagggataaagctgacttgattgtagtggataagctttttgatgtgctgctggattcggtttgccagtattttattgaggatttttgcatcaatgttcatcagggatattggtctaaaattctctttttttgttgtgtctctgccagcctttggtatcaggatggtgctggcctcataaaatgaattaaggaggattccctctttttctatggattggaatagtttcagaaggaatggtaccagctcctctttgtacctctggtagaattcggctgtgaatctgtctggtcctgtactttttttggttggtaggctattaattattgcctcaatttcagagcctgttattggtctattcagagattcaacttcttcctggtttagtcttgggagggtgtatgtgtccagaaatttatccatttcttctagattttctagtttatttgtgtagaggtgtttatagtattctctgatggtagtttgtatttctgtgggatcggtggtgatatcccctttatcattttttattacgtctgtttgattcttctctcttttcttctttattagtcttgctagcagtctatcaattttgttgatcttttcaaaacagcttctggattcattgattttttgaagggttttttgtgtctctatttccttcagttctgctctgatcttagttatttctcgccttctgctagcttttgaatatgtttgctcttgcttctctagttcttttaattgtgatgttagggtgtcaattttatatctttcctactttctcttgtgggcatttagtgctataagtttccctctacacactgctttaaatgtgtcccagagattctggtatgttgtctttgttctcattggtttcaaagaacatctttatttctgccttcatttcgttatgtaccagtagtcattcaggagcaggttgttcagtttccatgtagttgagcagttttgagtgagtttcttaatcctgagttctagtttgattgcactgtggtctgagagacagtttgttataatttctgttcttttacacttgctgaggagtgctttacttccaactatgtggtcagttttggaataagtgtgatgtggtgctgagaagaatgtttattctgttgattggggtggagagttctgtagatgtctattaggtctgcttggtgcagagctgagttcagttcctgggtatccttgttaactttctgttttgttgatctgtctaatgttgacagtggggtgttaaagtctcccattattattgtgtgggagtctaagtctctttgtaggtcactcaggacttgctttatgaatctgggtgctcctgtattgggtgcacatatatttaggatagttagctcttcttattgaattgatccctttaccattttgtaatggccttctttgtctctttttatctttcttggtttaaagtctgttttatcagagactaggattgcaacccctgctttttttttgttttccatttgcttggtagatcttccttcatccctttattttgagcctatgtgtgtctctgcacgtgagatgggtctcctgaatacagcacactgatgggtcttgactctttatccaatttgccagtctgtgtcttttaattggagcatttagctcatttacacttaaggttaatattgttatgtgtgaatttgatcctgtcattatgatgttagctggttatttttctcgttagttgatgcagtttcttcctagccacgatggtctttacaatttggcatgtttttgcagtggctggtaccagttgttcctttccatgtttagtgcttccttcaggagctcttgtaaggcaggcctggtggtgacaaaatctctcagcatttgcttgtctttaaaggattttgtttctccttcacttacgaagcttagtttggctggatatgaaattctgggttgaaaattcttttctttaagaatgttgaatattggctcccaccctcttctggcttgtagagtttctgccgagagatccgctgttagtctgataggcttccctttgtgggtaacccgacctttctctctggctgcccttaacattttttccttcatttccaactttggtgaatctgacaattatgtgtcttggagttgttcttctcgaggagtatctttgtggcattctctgtatttcctgaatctgaatgttggcctgccttgctagattggggaagttctcctggataatatcctgaagagtgttttccaacttggttccattctcccagtcactttcaggtacaccaatcagatgcagatttagtcttttcacatagtcccatatttcttggaggctttgttcatttcttattactcttttttctctgaacttctcttctcgcttcatttcattcatttgatcttcaatcactgataccctttcttccacttgatcaaatcagctactgaagcttgtgcatgcgtcatgtaattctcgtgccgtggttttcagctccatcaggtcatttaaggtcttctctacgctgtttattctagttagccattcgtctaatcttttttcaaggtttttaacttctttgcgatgggttcgaacatcctcctttagctcggagaagtttgttattaccgatcatccgaggcctacggctgtcaactcatcaaagtccttctctgtccagctttgttccattgctggcgaggagctgcgttcctttggaggagaagaggcactctgagttttagaattttcagcttttctgctctggtttctccgcatctttgtggttttatctgcctttggtctttgatgatggtgacctacaaatggggttttggtgtggatgtcctttctgtttgttagttttccttctaacagtcaggaccctcagctgcaggtctgttggaatttgctggaggtccactccagaccctgtttgcctgagtatcaccagcagaggcttcagaacagcaaatattgcagaacggcaaatgttgctgcctgatcctttctctggaaacttcgtctcagaggggtacctggctgtatgaggtgtcattcggcccctcctgggagttgtctcccagttaggctactcgggggtcagggacccacttgaggaggcagtctgtccgttgtcagatctcatactctgtgctgggagaaccactactctcttcaaagctgtcagacagggatgtttaagtctgcagaagtttctgctgccttttgttcagctatgccctgcccccagaggtggcgtctatagaggcaggcaggcctccttgagctgcaatgggctccacccagttcaagcttcccggctgctttgtttacctactcaagcctcagcaatggtggatgcccctcccccacccttgctgctgccttgcagttcaatcttggactgctgtgctagcagtgagcgaggctccgtgggcgtgggaccctccaagccaggtgtgggatataatctcctagtgtgccatttgctaagaccattggaaaagtgcagtattagagtgggagtgtcctgattttccaggtaccatctgtcacggcttcccttggctaggaaagggaattccccgaccccttgcccttcctgggtgaggcgatgcccagccctgcttctgctcacactccgtgggctgcacccactgtccaataagcccgagtgagatgaacccggtgcctcagttggaaatacagaaatcacctgtcttctgcgtcgctgacgctgggagctgtagactggagctgttcctattcggccatcttggaaccaagatcaagggaacttcatttttcatccacaaaacttttttgctgagagatcaaaatattttgagtatttcatgcagcagatctaggggaaaatggcaaattaaacacagttggccccgttgtgtctgttttctgtcctctctctctctcttttttttttttttgagacagagtctcgctctgtttcccaggctgcagtgcagtggcacggtctcggctcactgcaacctctgcctcccggattcaggtgattctcctgcctcagcctcctgagtgtctgggattacaggtgcttgctaccacacccagctaattttttgtatttttagtagagacagggtttgagaatgttgaccaggttggtcttgaacccctgacctcgtgatctgcctgcctcagtctcccaaagtgctgggattacaggcatgagccactgcacccggcctctcttctctttgatctgtctgtctgtctacctatcatctagtcattctgaagcagaggcaggcaatggaggtgtagttcaaaaatgattttaaaattataattttttacaaccatgtatttctcctgcaaattaagatctgcctgttattatctccaagacagatgccagacttaaacgctcattttgctttaatttgggccaaccattttttttttttttttttttttgctctcattaaaatgtgtatggcatctaggagcatcttttaaataatctggtaaatacccttcaaagtgaagtggtaaaagaatggtgttttaatgggcatgatttaagctaagtgcatatgtatgaaactaattaaagcatttaatgatctgtagaagccttctgaatggtgaaatagccaaacctaaggaatggggagtgggtggaagtgggtactttgccattttttcttttagataactgcaattcgaagacagttgtttatgcttcatattccttggcaaaaatgtttttgagaggaaatatgataatgataaaatgaaacagcactttctgctaatgacctaatacttcaacccaggctcacttcatcagaatcacttacggagtttcagagccacaggtggctgggttccagcccggagatgtctactcagactgtgttgtcattgttgttgttttaatctgcattttaaaaaattccgtaggtgattttaaaatataagaaaaatatttttattaaagaaggggacagtggtttaatcttcttatagaagcttttttggaagtatacattacaggaaggtatacaaattatatgactcagtacattttctcaaagtaaacacacccatgtaactggcacctggaacaagaaataaaacatgatcagggccacataagtttcccatcctgccttcttgtactgctacccaacccccacacaatcacataactactttcttgacttctacaccctagattagtctttgaacttctttatatagatggaagcatgtggtatatacccatttgagtctggctgctgcttcttttttttttttttttttttttttaacgttttgttttgttgtcgttgttgagacagagtcttgctctgtcacccaggctgaattgcagtggcgcaatctcacctcactgcaacctccaccttcctggttcaagcaattctcatgcctcccgagtagctgggattacaggcattcaccagtaaacctggctaatttttgtattcttagtggagatggggtttcgccttgttggccaggctggtctcgaactcctggcctcgggtgatttgcctgcctcggccttccaaagtgctgggattacacacatgagccactgtgcccagtcctgagtctggcttcttttgatcatcattacatttgtaagaatcatccttgtaatttggtcatttttattgctgaataatattccattttactaatataccataattgatccattcgattgtgtatgggcatttgagttgttttcagattggtgatttaaatggtgctgctatgtacattcttgtacatgtcccttttggtaaaatatgtatgcatttatttggctatatattcatttttggttatctattgctacctaataaactacccccacatttagtgacttaaaaacaacagccatgttattgcatgtaattctgtgggtcaggcatttgaacagggcttgctgggaacaacttacctctgttccatgtgttatcagttgagctcactcatctagctggactgggcaggaaagatcaaatggttttaatcacatgtctgggattttggtattaggtattaacttggttacctctcggccaggtgcagtaactcatgcctgtaatctcagcactttgggaggctgaggtggatggatcacttgagatcaggagttcaagaccagcctggccaaccccatctctagtaaaaatacaaaaattagctgggtgtgttggtgcacgcctgtaatcccatctactcaggagactgaggcacaagaatcgcttgaacctgggaggcggaggttgcagtgagccaaaatcgtgctactgcactccagcctgggtgacatagtgagactccatctcagaaaaaaaaaaaaaaatttggttacctctctttttctcacgcagcctttctgtccattaggctattctggacttctttacatgatggctgggtccaagagggcaaaggcagaagctgccaggcctcttaaggcctatgtgctagaactctgggaaatcagttctgccatactctatcggttaaaacaagtcacaaggccagacgtgaattcagagcagttaaagagatatccatctcttcctcagaggagtggcagtattacagtataaagggatgtggacatagggaggcatgattccttggggagccattatcataaaaatgtaccacaagccagggatagaagtttggggttatagcgcttatatctgttcagctttattagatactggcagacatttttacaggatggttgtaacaagctatactctcaccagttcagttgctccatatcctcaccaacacttgcaatagtacattcatttcattttagtcattctggtgaatatctagtggtatcgtatttcaggtttaatttgcatttccctttgagcagtcaagttgctcactttttttcttttcttttttctctttttctttttttttttttttttttttgagacagagtcttactctgttccccaggctggagtgcagtagcgtaatctcggctcactgcaacctctgcctcccgggttcaagccattctcctgcctcagcttcctgagtagctgggactacaggcatgtgccaccacgcctggctaatttttgcatttttagtagaaatgggtttcgccacattggccaggctggtctcaaactcctgacctcaggtgatccgcccacctcggcctcccaaagtgctgggattacaggcatgagccaccgctcccgaccaagttgctcacctttttgtatgtttattggtcatgtggacatctcatgtggtgaagttcctgttcaggtttttttgtccatttttctattgggttatttgtctttttcttatgaatttggaagagttttctaactcttcttattttattttatttttttagatagagtctcactctgtcgcccaggctggagtgcagtggcatgacctcggctccctgcaacctccccgctgcccaggttcaagtgattctcgtgcctcaggctcccgagtagctgggattacaggcatgcaccaccatgcctggctaattttgtatttttagtagatacggggtttcttccatgctggtcaggctggtctcaaactcccgacctcaggtgatccacccgcctcggcctcccaaagtgctgggattacaggcgtgagccattgcgcccggcctaaataggatatttttaggaaccagaaggttatttaacatttccagatatcggggccaccagattaatggtcttaactctggggcatggagtatcttgagacacgttgggtactctgaagataagaggtgaccctggaagcagtcatacttgtccttgtaatcctaccacctcttgatgatcaattataacagttgatctccctgtgctactactttaagagctcaaaaccagtgcataggactccatggggtgtagagactccacagaaacattcccagtccacttttcacacatcagcctcctcccacaggcagaaagccgaagctgccatacatagccataggtttaaacagagactggcggaagcggggagtgggatggagtgtgtggaagtgttgttttcacttttctttctgcttctcagatcagccaaaatgtcctatcggaccaggtattttatattttttgttgctatggtgaatagaacattttccccattatatcttccattggttatcggtagtgtttagtaaagcttttgaattatgtcaatttatcttatattgtgctactattaagtaataataatatttttattgttgatatttgttacatgtttaccatgtgccatgtatttaagtgctttaaatacatcatttcatttagtcttcatgacaaaccagtgagattagtagtattatcatcccctttttgtagatatggaatctgaggcttagaaggcaatctcccaaggttattcatctcattggtggagaagctgtgattcaaaccagtgtgattaatgtctatattttatacatataaaaaatataaaatatatatttattatagtatttatataatatatattccatataattatatatttatatggaatatatattatatattatataattatattatatatattatataattatattatatatattatatattataatataattatatattatattatattccatataattatatagaatatatattatatatatatatatttattttcgagacagggtctcactctgtcacccagactagagcacagtaacatgatcatggctcactgcagcctcgacctcctgggctcagatgatcctcctacctcaggctcccgagtagctgggactagaggcacgcaccaccatgcccagctaatttttttgcattttttgtaggggttttgccatgttgcccaggcttgtctcgaactcctggactcaagcaattctccatgcccagcctctgtattacatttaattctcctatcaattctgggagtttttcaattgattttcttgggtgtaggtatttaatcacattggccacaagtaactttatttttatatctttctatacaataattactgctcttatttcagcttcatgtcttattgcattggccaaagatagtggatcagtgttagaatgaaacagtgaaagtgggcatccttgttttgttgatgatttaatggaaaaaccattattgattatttaaatttataaagcgatgttaaggaagtatcattccattcctagtttctgagtttttaaaaaatcaggaacagatgttaaattttatgaaatgtcattttggcatctattgaatttattatatggacaccaatggttctgatccagattcataactgagaaacaaaaataactataaatgtagttcaattgttgcttttctttttccagcaatatctggagcttgttttcaaagtgacatgtgggtggtagaggcagaaattgttgtataaaaatttatgggctttaaatttttccctgtccagattttgagtctgtactgggtaaaagaaaagattgtgtgtagggggtatttttgaggtattttctttagaacaacttgtaaaggtatcatttgcctataattcttaattagtttagattcatgttgacaaaattgtaaaccaaataggtaaggattaattctgtgttgcacaaatctttatatattgttcattaaattattgttattagttataatagttctagcccacaagaacagtatatacataagaaatgttaaagcctttgattgttttcatacatgacacattagctactggaagagaatttatgttattcttttttatgttgctaaaaaccagcagaaggattatgatttgacgttgactaatacttcatattgagtagttttaactaagaatcggtttagggaactggtcctttttcatatctttgtcactgaacttttaggcaatgatggtcatcagatctatggaagggacggtagaccaagcttctcttttttttaaagaatgaaaacaatattttaattttgttcttaagtaacaagactgagtcttcataactggaagggatggaactgatttgctgtgtcagttagccgatgggaaagggagagatgacagcatgggtggaggcagtgattgggaaaataaaatgatttttgctttattgctcacagagttggggttactaaataaatcggttataagtatataaataatactgtaggtatcgtgtagcatagttacattttaatatgcagtaaaagtgtaatggttaagagtttgagctcaaagccagattctctgggatcaagttccatctctgctacttacatgctgtaccccattttccttgtatataaaatggagataccaacaatatttatctcatagggtggtttcggtcattacatgaatacacatgtgtaaggtgcttagaacagtgcctggcacatcagtaactgggagctcccatccttgtcattatcaccatgatgccttggaaaaggtgtggcctggggttcaactgggcaggggttgctgagttttgaaggatgataaattgtccaaagaagagaaagcaagggtagtccagggagagggaagagtgggaacaataaagacagagtgctgggctgggagaggaaagcatcgccagtgtgggggagatgcaaggtcccggggtgacatcttagatcggaggagtgtctaactatgtttaattgtgttacagagtctgaagagaggatcatgctggagatacaggcaagggaggaagtgactatgaagttgccaggcctctgaggatttggaagggagaaagggtgtggggaacagctccatgggtggttccatatgcctgtctgcatccatagctgcatcctcaacttcatttcctctttccttccagcatctgactttctaaatcaggcatgctttaagctatgctgcctttctttctttctttttgagacagggtcttgctgtgttgcctaggctggagtgcagtggcacaatcacacctcactgcagccttgacctcctgggctcatcctcctgcctcagcctcctgagtagctgggattataggcgcacgccactatgcccagctagtttttttgtattttttgtagagacgaggtttcaccatgttgcccaggctgtttcactgcctttctcatgaacactgcaatcatatcataaattcctcccccatctaaaaaacagaatcccctagtttttaccatgcgttccatattcactttattttttagagtctataacagaaaataacctttataattctgttagatgatatagtgaaagtactgcgggtttttgtgggtttttgtttttgctgttatttgttttttctaagagttgcttggtatttcagtgtgtacagtcaggaaaaggaaagttttcatttgaagcaagatttatatccaagaacgactaccaaattgaaaagggtggcatgggcattgaagacagtgaagtatttaggctttactgcctacgtaatgaatctgagataaagttgtcaagatgctctccctttctagtctctaaatataaattgaaataattaagttattcttaaatctcaaaccaaacccaaatgagaaaaataaccactcccggaccacattaaagacagacattattactcctaaattcagcttcttataaaacatcatcaaccaccaccagaaaacactgtggtacacaagaatttagaaaatatttttttaaattgccaaatagtatgactttagaaaacatttttcacgtttagttcttaactgtaatctctcagcataactggatcatgaaaaaaatgtattctgtctatatcttgaccactctgaatattttaaaagatagaaactgtttgcagagaacttctgaagaatggcctttgtaacaattcggtgttaatgagttgaagagtatgtcattgtcctctgggtcattatccgcaagaatattgtgtattaaacaaccaccatacctcagtggcatgtaatcaatatttctttttgctaacaagtctacagattagctgaacacttctgctgatcttggcaggtttgattaggcagtttttttgggtcttggctggagttcactcatgtgtccagaacaaacactggtggctgctggctgggggctgatcgaggacaaccttggctaggatgactcagctcagctctacatggtcttgggtctttctgaagcctagcctaggctttgtggtagtggcattgttcctaaagagtgcatgaaagcatacaaggcctccagagagacctgagcttggaactggtacatagcacttccatcacattctttaggccagtacaagtcatgagcccagcctggtttgaagggatggggaaacacactcttgacgggagtagctgcaaaagtacattacaaagagcatggatagaaggtgggatagagaattgggatcacttttgcaatccatctaccatgtttcctttcgtctttctctgtctgaattgtcttgatttctgtactggggctgactgtttcatgggcaatctagcaggcagggaccctgggtctcagcacccactaaaatggacaatgcaggcactccgttatgtagaactgtctctccgagactgagaggttctttgggtatttctgcctgtgatttgtcctttaactttatctgctttgttaccaagaaagaatgaaaatcatgtcagaaagtttatttttaagtaaagagaaaaacaaatccgttacagctaaatagaatcctctgaagtgtttaacaggggaaaaattgaatgttgcagttaaattttctgtaggttctgaatagcagcagatgtttgaaccaaatataatgtattgttctgttttcagccctatttgtaaaagtctgagatgtaagagtgggcaaaaaacttagagctagagcttcgatcatccaaataccttgattggctagttttccctgtgcttctccctccccttcccactagccatggacccactgctgtggtaaaacatctgcccaggaagggatggtggtgacccatgtgaatgttctggtctcagggtcagtcattcctcgtggttatatgtgggctgtgttgatatgcagaacatttagcacagtgccttacatgggctaggtattcaagaagatatttattaaatttaagtattgaaatgttgattcccacccccacccccacccccccgttctgtccttccttttccagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacaggtaagtggaagcagatgctgccttgattcttgtacataacagatgcccaataactgttgaaagaatggatgaacataccacagcagagatgcatttctttagaaaacagttcacattaagtgagagctcccctctgttactcatttaatagaagtctcctcaggtgcacagcaagctcctctctgtaggctaacagcatttcatttgccattttctgagatatcattcacataccataaaagtcaccattttacagtgtacgactcagtgactttttcacgcattcacaggattgtgcaaccatcaccaatatctcattccagaacattttcatcactcccaatagaaaggccattcctgttatcattgcctcctccccacccctggcaaccactgttctattttctgtctctatggatttgcctattctagatatttcatgtaaatgaaatcatcaaatatatggccttttgtgtttggcttctttctcttagtgttttaaaggttcgttcatgtcatatcatatatcattacttgatttctttttatggctgataatattccattgtataccacattttgtttatccattcatcagtgaatggacatttggatcatttccaccttttggctattgtgaacagtgctgctatgaatattcattcacagattttcatataaacatgtgttctcagttctcttgggcttatacttaagaatatttcactgggtcatatggtagctctatgctggatcatgtggtaactctatatttaaattttccagtaattactaaactgcttcccacagtagtggcaccattttgcatttctaccagcaatctatcttcccatgtaggttccaatttcttcatgtttttgccaacacttgttattttgtttttttttttatttttattatagccatcctagtgtgtgtgacgtggcatttcattgtggttttgttttgcatttccctaatgactaatgatgttgagcatctttttatgtatttattggccatttgtataccttctttgcagaaatctgtgcagattctttgcccacttaaaatcaggctttttattattgagttataagagttctttctggatataaattccgtatcagatatatgatttgcaaatattttctcccgttctgtaggttgttttttcattttcttgataatgtactttgatgcataaaagcgttacattttgataaagtccagttcatccatgttttttcttggttgcttgtgcttttggtgtcttggttgcttgtgcttttggtgtcatatctaagaatccattgtcaaatctaaggtcatgaagacttgcctttgtgttttcttctaagagttttatagttttagcctttacacttatgtctgtgaatgattttgagttagtttctatatatggtatgaagtcaaaattaattttttgcatatggatatgcattgtcccagcaccatctgttgaagagactgttctttccccattgagtggtctttgcacccttgtcaaaaatcaataggccaggccgggcacagtggctcatgcttgtaatcccaacattttgggaggccgaggcgggtgcatcacctgaggtcaggagttcaagagtagcctggccaacatgatgaaaccctgtctctactaaaaatacaaaaattagccaggcatggtggctcatgcctgtaatcccagctactcaggtggctgaggctgaagaattgcttgaacccaaaaggtggaggttgcagtgagccgagatcgtgccactgcaccctagcctgggcgagaaagcgagactccatctcaaaaaaacaaacaaataaaaatctataggccatagatatctgggtttgttattggactctcagttctattctattggtctatgtgtctgtgccagtaccacactgtcttgattgctgtagctttgtagtaagttttgaaatagggaagtgtgagtccttcaactttgttcttttgcagtgttgaaattgttcttcattattgttttggctatttggggtcccttgcaatgaatttgaagatcaaattttccatttctgcaaaaaagcctattgggattttgatagggattgcgttgaattgctatatcactttgggtaataattgccatcctcacaatacaagtctttcaacccatggtgtctttccatttatttatgtctttaatttctttcagcaatgttttgtagcttttagtggacaagtctttcatcaccttggttaaatttattcttaaacaatttattcttttggttgatattataaaaggaattgttttcttaattccttttttgattgctcattacttgtgtgttgatcttatactctgcagctttgatgaatatacttgttagctctagtagtttgtgtgtgtgtgtgtgtgtatgtgtgcgtgtgtggtgtattcttttgaatattctatataccagatcatggtatctgtgaatatagttttatttccttctttctgatttgggtgccttttgtttctttttcttgctcaattgctctggctagaacttccaccacaatattgaatagcagtgtgaaagtaggcatgtttatcttgttcctcatcgtagggggaaagctttcaatctttcactactgagtttaatgttagttgtaggtttttcataaaagtcttttatcatgttgaggaaatttccttcaattcttagttttctgagtggttttatcaggaaaagttgtcgggttttgtcaaatgcttttttttttttttacatcagttgagatgattgtgcgttttttacccttcgttctattaatgtggtgtgatatattgaataattttcttatgttgaaccaactttgtatttctgggataaatccctcttggccatggtatataatccctttaaaatgctgttgtatttggtttgctggtattatgttgagaatttttgcatctatttcataagggatattggtctgtaattttcttttcttgtagtgtctttgcctggctttggtatcagggtaatactgatctcatagagtgagttaggaattgcttccttttattctgttttttggaagagtttaagaaggattgtgttaattctaatttaaatgtttagtagagttcaccattgaagccatttggccttggacttttctttgttaggaggtttttgatgactgatccaatctcttgttctagatctgttcagattttttatttcttcttgagtctgttttggtaatttgtggagtttctaagaatttgttcatctcatctaagtaatctaatttgttggtgtacaattgttcatagtattctctcataacccttttttatttctttaaggttgatggtaatgtccccactttagtttctgattttagttattttcattttctctttttttcttagtcagtcttgcttaaaggtttgttaattttgttgatcttttcaaagaaccaacttttggttttgttgattctctctattgtttttctattctttatttcatttatctccactctaattcgtattttctttgtcaaaatattaagttagtttattgatttgagatccttcttttttaatgtgtgcatttacagctacaaatttctctctaaacactgcttttgctgtatcccataagttttgatatgttgtgttttcatttttattcttctcaaagtattttctaatttcctttgtgatctttttattacccattggttttttaagagtatgttgtgtaatttctacatatttatgaattttctagttttgcttttgttattgatgtctagtttcattccattgtggtcaaagaagatactttgcatgatttcagtctttttaaattcgatgcggtttattctgtggcctaacatctggtctatcctggagaatgttccatgtgtccttgagaacaatgtatagtctgcttttgttggggaaagtgtttagtagatatctattaggtctagttgtgtgtggtctctgaaatctctgttcctttagcttgtgttaagttagtgttttgacagagacttccttgaacaccaggagcgatttaaaaaaaaaaaaaaaggaagggaaaaaaaccaacaacaaatatttgcagattggctctctgttggagcactccttcaactccttgggccatttacaaatgttagtctttacttcccgcttgtgctgaaccattgttcagtttcctttttcttgattcactgtttggttgctataaactttgagtattttccagagttctgacaaagttgattctgacagggtttgtttgtttgtttgtttttgcttgatttgtcaatgtttttgtggcggaatgggaccttaaagttgcctacatgaccgttttctctgacatcaccccagtaccctcattctcaggttaggaccctaaagggcatacctaggagtaagagtgaactggaagactggcttttcaatgatcagagaacagcttggaatgaatcatgtaattcctgagattgaactgagatcatcttagatagctaaggctcctaaccacctgccaacagcaaatttaagtcttctctggaagacaataggcctgagattgtttgttcagtttttctttcttcctttcttttttaaaggcagggtcacactctgtcacccatgctggagtgtggtggcactatcatagctcactgaagccttgacctcctgggctcaagcaatcctcccccctcagcctctcaagtagctgggactgtaggcacatgccatcatgcccagttaattttttattagcttttggtagagacaagttttcactgtgttgcccaggctggtctcgaactcctggcctcaagtgatcctcccacttcggcttcccaaagtgctgggattataggcatgagccactgcacctggcctcagtttttcatatgcaatttccagaactcaatacaaatataaccaagcacaggaggttataagacacatgaagaaaactgaggcaaacaacaatggaaacagacctgtagggtatttggttagtggcattatcagactctgagtttaaaataaatatgcttaatataagttcaaggagataaatcaatccaaggagccataatagagaagattgataattctgactttataaaaatgaaaagactgttattaagggaagaataaaaggttcaacacagtgtacagagtaaaaaaaaaaggatcatgtatattttgatttttttaattgagaaaaaattcatctaatgtaaaagtgatcatttaaatcattttaaagtgtatgaggccgggtgcagtggctcacgcctgtaatcccagcactttgggaggccgaggcaggcaaatcacttgaggtcaggcgttcaagaccagcctggtcaacatggtgaaaccccgtctctactaaaaatacaaaaatcagctgggcatggtggcacgtgcctgtagtccccgctactcgggaggctgaggcacgataatcacttgaacccaggaggcagaggttacagtgagccgagatcgtgccaccgcactccagcctgggcgacagagtgagactccatcccccccagcccccaaaaaaagagtgtatggttcaacagtttttagtatattaaaaatgttgtgcaaccatcaccactatgtaattccagaacattttcatcacccccaaacaaaaccctttacccattagcagtcactcccagttgctccctcccccagcccctggcaatactaatttaccttctttctctatggatttgtctaatatgaacacttcctgtaagtggaatcgtacaatatatgtggccttttgtgcctggcgtctgttgcttggcatgtttccagagtccatccgtggtagcatggatcagtacttccttcctatttttagctgagtaatgttactttgtatggatatagcacattgtatttaagggattatatgtttatacatgcatttttgtattcatctgtggttatattgatttttgtatgcttgcaaacacatagaatatttctgggaaagatacgatacttttaacagtggctgtttctaggggtagggattaggggaataagatctaggggagacggaaaatgacttttcattattttacccatttctactatttaaaattttatttcaactaaaaaaatgacgtgtttctccattttaatactacttttttttttgagatagagtctcgctctgttgcccaggctggagtgcaatggcgcaatcttggctcactgcaacctccgcctcccgggttcaagtgattctcctgcctcagcctcctgagtagctgggactacaggcgcgccccaccatgcctggctaatttttatatttttaacagagatggggtttcaccatgttagccaggctggtctcgaacttctgacctcaagtgatctgcccacctcggccttccaaagtgctaggattacaggtgtgagccactgtgcccggccctaaaactacttttttaaaaagaaatattctttaaaggtagtattttcctctaacttaaaagaatgtgactattttattcaagtggttatttaacctgaatatatttataaatggagaaactgccatctgagttaatcatcttgagcatttaatattgcagttgtaaatataattctaatgctatggaaagatagccttataggcaaggactagtatgaccaaaatgattttagtcaatccaaagacccagagaaattattttcataataattttctgttgttgcaatatattctcagtgaatatttgttaatttagcttttataaaaaagaaaacttcccctttagacaacagttactctgataagtactaccaatggaccagaaaaactacaatgataagctaaggtaacactgaagccagtgttgggaatcaatagattacatgtggctgggggtggtggctcacacctataatcccaacactttgggaggctgaggcaggaggatcatttgagaccaggagttcgagaccagcctgggcaacctaatgagaccctatctcttccccaccacaaaaaaggaaagagcttgaaaatccagtgtgaatttttcacttacagcacatttcaattcagattagctccatttcacatgctcagtagctccatgtggctagtggctgccatattggacagcataggtccaatatggcaataggtctaaatagttttgacctattaaaatatgttaaatttgtgtggtagtcacatctctgctgtattatattttggagtatgtatttataattttttttcattctccctctcctttttctttttctcttttattattacaattggctttttgtctgcacgtttccctagggcaagggcgtgcctcccttcacttctcttgggctctaaggacctgggatgatgattcattttctcagttacacacgtcgactgagggcttattatatgccagacactgggctagaatgatctatttcagaataattgaaaggttatcctgaaatacagcgacctgaaacgtgcgtgcttgctccacctttacagttttctatacagtcatgtctttcttccttgttcattacatctatttcctctgcttcccgctcacagatacttcatgcccattatgtcttagaggtgctatttgaaaccaagaaagtcctgaagcaaatgccgaatttcactcacatacaaacttctccctccaaagaggtaacaatctgtggtaagtttcagagcagagttgtccaattaatatttaggagcctcttggtcctacatcgtttgcctaacttgaaaactgtgtaaattggactgtgttaagggaaaaatgttaatatagaattatctatcatgataatactgttccccatcttgtctttgttttgcataccagctggcaggaattaattatgtgagaaattaaagagctcatagctttttataaaggcagacagcattttaatatggaaaaaccacccatgggtggaataagcattctttgccctccgtctagctctcattatctttgttccacgttgctttttctaggtgggcctctgcatgccacttgtgctgggaagagaaaagcccgtggcggggtgaagattaaattcttctctgcccttggctgctgttttagatttttccaactggtctgtgcagcttttagaagagtgggaatgtcccagaaatctgtttcttgttcttttaaataacaagatttgagattttgctatcatataggccagcctggcaggatattgcttcaagaaacagtacacattgaaattcctcacagttggtgctcagcatgcttgcaaccgtttgacagtggggtgcgtggaaggaacagcaattcccttaacttctaattaagcctttaggttacaaaacagtgattgttattttccaaatcagtttttagcctgcatttctcttattctggcaggtagaagtgaatttgacaatctaattaaactatttgcatttctagcgtctgatagtggtggcagggacttgatgtagcagtgcctacctcatcacatgccctgactcaggtttttgaagagtctctaatggttcatttccagcctcatcaggcatcacgtctctgactggcagatgattcatctcagcagtgggggtcttttattcaaggcctcacctggccttttcatggaaaatagagacttcgggtcatgaggctcagaaagccatgccaccctgtgaagtctgtgaggccagggctaggtgtgctcttaggatatatagaatagcccaaactgagaatgggatccgctcccctgtgtttcactgggagccactacagactcatccttgctaaaaggatctggaagaagacacacgttaattacagggcagggcagtcctagaatcccacagtgtgagaactgaagggttctctagtctattccttgctcttatgggtgaaattgaagctcagagagaaaagtggcaggatcagaattaaaatcaggtcttctgtatcccaggttagaggcagccccacatctgccatcctgactcgcattaggtacctggtggttcattgtccatcgtgagacaaagattagggcgtgacttaactggacatctccattggttaaagatttccacatcttggcacttatttctagactttttcacgtggcaccattggtagggggaaaagacaaggccagtgggttttcttaacatgggaatattattattttctatttttaacagctcattgaacttcaaaaatttcatgattatttataataaaatttaaaattggggccataacttcaaaaccatcttccgtttaagacggtgttaggaaagggggagagattgtgatgaaaatttgctattattttaattgtgagatgcatttttttacatgtacatctaaatatgccccgtagttttcagcatgcatgaaatataagaggatttttagtctacagttatattataaatgataaccaattctgcactcatgtttttgttggcagtggaaatatctttctgtccttcttcccatggtacgagtttttctttcgctgtccaactagaagttaaaaatattaaactaagtaaagagtcctcccatctttatgtccttagatttagagtgagaccatatgaaagcaatgagatttaagcacacaatgatactaatatgctaataatattatagtagtattttataaataagtgctggtgatatagaatttctattttattatttccagtatatttggagtcttctattgcatgtatttggttaatcttggttgtgggattttaagcaaactgagggaaaagtattcgtaaattaaattgtatagtaattaagttggatacaaagaataaaaatttatgagcagaacttatgaaagatattttacctagaaatagttatccaaatggggcttttggatattcacatagtcactcattattattgctattttttgagacagagtctcgctctgtcacccaggctggagtgcagtggagtgatctcagctcactgcaacctctgcctcccggggctccagcgattctcctgcctcagcctcctgagtagctgggattacaggtgcacgccacgacacctggctaatttttgtatttttagtagagacagggtcttaccatgttggccaggctggccttgaactcctggcctcaagtgatccacctgcctcggcctcccaaagtgctgagattacaggcatgagccaccgtgcctggccttattttttaattaatggcttcagatactcatgatctcccctagttggctttcattttttttctatgtctcatcaaagaatgtcaactacctactcacaaagtttaaatttcagatgctgctactggagtatattaaaaacacggctttaaaaagctatatacttagccaagaaatgtatttactgagtgcctcttatccactgggtcctatggtaggcacttggggattcaatgctgactacaatagatactgttgctgctctcctagggattacagtgtgggtgtacagaataatcgctaagagcctgaggggttttttgtttttcgttttatttttgagacagggtctcactttgtcacccaggctggagtgtggtggcatgatcacagctcactgcagcctcgacttcccagggtcaagcaatcttcccacctcagtcagcctcctgagtagctaggatcacaggtgcgcaccaccaaacctggcaattttttttttttttttttttgagatggagtcttgctctgtcacccaggctggagtgcagtggtgcaatctcagctcactgcaacctccacctcccgggttcaagcgattcttatgcttcagcccccacaagtagctgggattacaggcgtgtgccaccatgcacagctaatttttgtatttttagtagagacggggtttcgccgtgttgaccaggctggtcttgaactcctgggcccaaatgatccatctgccttggcctcccaaagtgctggggtaacaggtgtgagccatcacacccagccaagcttgagttttgaagtgagttaaagttgggtttgaattcttgctctgatacttgatggctgggtatctttgcataacttacttaactactgtgagcctcatttgtaagatgagaatgatgaagataaaacccatctcatagagtggttgtaaggactgaactagataattcatgtaaaacccttagcacagtgcttggcccagagtgatcgaagccctgtgcaaatgactggactgaaaaggtaattgaagcactagatgctgtccccactataggagaggaagagaagagtgctgtggagacaaattgcctgtcaaattaacatcgtcataggataaaaacccaatgccctgagaacacttggagtggatcagcagtatttcacttttaaaaatgggcattgcatcttgttctctactgaatactgatttttcatttgcactgcaggtgatttgcatgggaaactggatgatctttttttgatcttctacaaggtaaatgatgattttgctaaatattaacatttttcttgggggagggcagtcttagggcagataacaatattagttttactagagatatgtactaatacagatataatgttactgtttttaaccaggaggctcaaagatttgtagagccatatcttttttttttttaacacacatctcataaatttttaaaaaattgtactttgggtcttcattctacattattgttgtctgtgtatccattaggatttgtaccggattgtatttattgtctttatcgcatcataaatgtctagatggtacaggatggggagggatgcagtctgttttattttaattttgttcagggatgagcatgtcacataccagtcttctcttccagtgcacactaattatgcatgagtggagttgcttatgataaggaataagttccagcatgctctcttttctcccctgattcgccatccatgggctcagttgttcttccaatgctgtgcctcctcttcatttattgcatttggcttgtgagagccagcacagagggcacaagactgcttggccagcatggattttctctgcatctctttgattggatttttttctgtctctgggccaagagttacagcctgaatgtttgcttcagggatggctgactgcatatggaaaactgatcttgagatccctgccttcacagcggttacccctttacactggtcttctgaatgtctctttttgattaatgcatttattgttcatctactcctgtgacccccacaactagcatgtcaaataattgggcgtagcgtaggtatctcagatgggtggaaagaaaatatattctgattattattgttaccagaaaggggtcccgatccagaccccaagaaaggattcttggatctcgcacaagaaagaattcagggtgagtccatagactaaagtgaaagcaagtttattaagaaagtaaaagaataaaagaatggctactccatagacagagcatccccaagggctgctggttgcccatttttatggttatttcttgatgatatgctaaacaaggggtggactattcatgcctcccctttttagaccacatagggtaacttcctgaggttgccatggcatttgtaagctgtcatgatgctgatgggagtatagccgtgagaatgaccagaggtcactcttgttgccatctcggttttggtgggttttagctggcttctttactgcaactgttttattaggttggtgcaaaagtaattgcggtttctgcgtgctctggttcaaacacctctaacattattgttcctggaccaaactgagggttgggctgctatttctcatggcccaataacgagatacagatgaactgggaaggaagagagtttttatttctgtaagtggctccagggagaaggcctggaaattatcaccagaccaactcaaaattagaaagttttccagagcttatataccttctaagctatatgtctacgtgtaagtgtgcactcatctaaagacgtaagtgattaacttcttttcatctataactaaggtctgagtcctgaagaccttcctctggagcctcagtaaatttacttaatctaaatcggtccaggtgctggggtgattacccttatcttgtctcctgctaaatcatggaggtttgcagagttccttcagacccccaatcaacttgtttgtggaggcctggggagtttcttcacatccccagtaaaacttgtttaatcctaaataggtcctgttaagaattccttcgttatcttgccatgctttaacgcccaggaaaggcctagacaaaactcttggtgggcttttgttacattccagcctttgtatagggcactggctctttgagcttttaatatttaactgaaccactcagtcagtactgagacagttgttatggaggcctgcgttagtgagacctggcctgccacattttgatgaccaatcagttccactctttgaggctgtgagagcttgagtaagccatacaacctccatgaactgcaattttttttttcagctgcaatattatcttgagcttccaccccataagaggttgtattctggataaaataagtatccaaaagcatttttaaaataataaattataatagaaacacaaggttttcacttcatgcattagattagcagcttggaagggaagaggacaggccaaaccaggagtgggtagagccagcacctaggaagaggttccgttgagacttcagcaggcccaagccaggacgtagagtgtgactgtcagagagtgtcaggaggtgtcccaagtagcagattggtgtaggaagtccaggcgaaggtttgctggcagggagccgagggggctggtgaaagagcaattctggacatcagccacagaatctaagctgggtagggaaggaagagaagccaggatgggccagtcaactgggagaagtaggagggtagtaggactggaatgctgaccgactgtgtcagggagcaggctgactgcagtgagggccttaggaggtaggatggtgggaagtgcagggggagcagtcccagggcaagggatgccctggggtggagcctagaacatgggcagcccaagccatcgaaagagagtattggcgatgaggtgggcaaggacctggaaagcaggtgtgttcaacagtggggggcaccacgtggacccagatgaggagcaggggaaggaagtttagtcagaggtcatgggcctgaaaggagggtggtggggtgtttctctgtgagcagccctgggggcaagcagagcctcccctgctcctgggcctgaggtgggtgtcctggggatgggtgggtcctttccttcagaagggctgcaggagtcaggagtgctgctgtgctctggaggaagcccaggcctatggaggagagaagcctttctgaataagttgaaggtggaaggggcttcattgaccatgaaatggagattctactggccccactggagtgccatgggaaaggtggaaggatggacaggggatgggatttatttaatttgggacgtagctccacaccaaatgttcagaagtgcggtccggctattgttgacaattacaatgtgaggaaggaggagggggcagggcatgtggagaacaacaacaaacctggtcattctttatctagagtcttgagaaatatataaaagggcaaatagttgagtaaattaaatcgggaacgtagtcactaaattccaaggcatttagaaaagaaaatttctttatttcgtatgaaagtgcgataagggataggactctggagtagacagatgagaaaagagaattctaacatatttctttaattctgtctgcaaaactatatggaacatataaaactggaaggtgctaatgtaaagattgaacaggaggaggtgggtggtaagaagtactataaaaggaactaaaggtgaaaatatagcattcaaatgcaagcaagatatatttggagagctaaccaatgacagtgctaaggaaatggagattgctagcccagtgatgaaagactagggcactattatatttaggatggatttgggtagagaggtgagagggatgtctggaaaacagaagtgtgcaagagccatggattagaattctggcaggcgtgagtgagaagaaggtaaaatgcatcttggacatggagtgaaccacatacaccagaatctcgaaactgcctggtttaagtggggaaaccgagggaagagccattgatgacagcaagtttccactttaagaaactgaaaagagatctagtgtacaacacgaggactataggtaataaaattgtaccatatatgggattcatgccaaatgagtagattttagctgctattgccacaaaaaaacaaaaattggataactatgtcagatgatggatactttaatttgcttcactatagtaacctttttactatatgtatgtattctgtaacatcatgatatattataccttgaatgtacatggtaaaatttattttttaaaaaagaagaaaatagcaacaatgataaagcaatggggaaaatagctgatcaataatatcattagtattttcaacagcggtacagcagaaaacccggaaactatattattattttaaaggaatttataataagtgaataaatacattactttcatttatctagaaaaaggaaaaaggccgggcacagtggctcatgcctgcaatcctagcacttcaggaggctgaggtggacggatcacttgaggtcaggagttcgagaccagcctggtcaacatgatgaaacccctgtctctaataaaaatacaaaaattagccagatgtggtggtgcgtgcctgtagtcccagctactcaggaggccgaggcaggagaatcgcttgaacccgggaggtggaggttgcaatgagccaagatcgcaccattgcacttcagcctgggggacaagagcaaaactctgtctcaaaaaaaaaaaaaaaaaaagaaaaaagaaaaaagaaaaaaagaagctggaaaggtagtgtacttaatggtgtctcagacgggagaatgacacgtaaagcttgggggtgatggtgcttggtcgcttagcttatagcaaaagaatgtcctaagttaaaagcagggaaatgaaaggctgggacacagagatatctgaggaagccccgaccatctgatgatctctgatttaccaaagtcaggattttgcccttttctgtcttatttatttttgtctgcagtttaactggagaatgatgatagtttgcatggatgtactgtggcctaaaagcatgaatacaggctgttctggaaacagtgtttctatataaatataaatgacagtgataccccacctatcccaatgtcaaacttcagcctactttacttaccttcacttaccactcatatgtcccaaacccagaattaagtaaaaagggtctctgaacgcttgaaattgttgacacaaatccaatgaaccctactcacaggacaggccttaggcctcttactcaaagacccatgaaccagtatcagtaaaaccttctctcacgcaaggttcacatgagtttgcctgtctggctacccaccccacagcagattagggagtgggaggtgaagatggaaaagtcagacataatgacagcaatgaaaattaaaacgttctggctgggcacggtggctcacgcctgtaatcccagcactttgagaggctgaggcgggtggatcacctgaggtcaagagttcgagaccagcccaaccaacatggtggaaccccattctctactaaatacaaaaaaaaattagcttcgcatggtggtgcatgcctgtaatcccagctacctgggaggctgaggcaggagagttacttgaacccgagaggcagaggttgcagtgagccaagattgtgccattgcactgcaccctgggcgacaagagcaaaactctgtctcagaaaaaaaaagaaaagaaaagaaaattaaaagacagaactataaaaatgagataaaaactgaaatactaatactcagcgatctggagctgtggagtgtagggaagagagttcttgccttgtcagaagtgcctgaggggatgtttagactgatgagcctgcaaggccaagagagtttcaagttataaggtgtatactcttaagaagtaaaggggaccaggcgcgtggctcatgcctctaatcccagcactttgggaggccgaggcaggtggatcatgaggtcaggagttcaagagcagcctggccaatatggtgaaaccctgtccctactaaaaatacaaaaattagctgggcgtggtggcacacacccgtagtcccagctactcaggaggctgaggcagaagaattgcttgaacccgggatgcagaggttgcagtgagccgagatcgtgccactgcactccagcctgggcaacagagcgagactccatctgaaaaaaataagaagaagtaaagggagcaaatggcacattttaaaaacttccagccaaaatggttaaagtaatttttaaaggcattttagctttcaaaggaataagcttcagtgatctggaaaatccatttaagcaatgcttatagtatgaatgaggatattgggtcttaggaataggaggatgagagagcatgaagaaagagaaagcttagttaggagaagagcactgggccataaaaatagataaggaagaaaggaagaagcacatctcaaaggaagagagtggtgagggggttggggggtgatggatttctcttggtagcatcacacacgaaggttgcctgctcagattacaggaggtgcataactatgacctaagcaatcacttgattgcttcgggaaatggtagaatttctgtgatggtctttgtttctcactgtaatgctttgtactaatcaatttgtcaacaactgattgaatcccaattatatgtcatacctgactctggttcactgatagaagctacaattgagtcacatcagtgtaaccacaggctcctaatcttttgtttagaagtagttagtggccgtgctttcacttacttttattttattattgtttttaagagcaatagatcttgaattgtggggaatagtttggcaaactacatcctgttggagatttttggagctataagtgaccaaagtttatgttatactatgactaactgattctctccatcactcacaagagtaagtaggaaaacctcaggctttgaattaagacaaaattttaattcatctcaattggtggtttgctagacactttcttcctcatcagttcttttatacagcatagcatgaataggctccaaggctggggctggcccaaagccaactaagggcacagcctgagagactgttctaatgtagggtcactgagaggcctcaccatattactcttttcatccaagtggttggtttggttcaagacttctatcattataactcaccatatgcaaaagtgaatctgtctactaatgcattcattcagtaaacttttatctggtccctgtaatgttcaaggtatcatataaacactaaaggaccatacaaagttgatttaacatatatttatgaaacacctattatgaatgaggcactctactaagggttggcaatacagtatgactaaaacacagttgttggccccaaagacatcacagtttagtggggaaggttggctgataaaaagacaagatagttcagggttggacatgttatgattgggatcagcatggagtcctaaaagaacccactggcagagcacctaaccttatggaagacttcctggaagagaagacatttctgacgatctcttcaaagaattttagtaatttagtaagtgcctaaatcatgaagggaagttttggaggatcatgaaagattttattctcagacactttttgtggtgccctacaataaatgatgggatttgtagcaattattgttcttcattgattgttttgagattttggtttctttaatatttggttgtccttaaaaattgtatcagctagcaccttaatactaagggaaacattttcagctcagaatcgcatctgggtttgaaaaggactcttccccactgggtaccatactcttaacaacagacctttgctaaaagggcatctcaactttacatggcttcaaatataatcttatcatcaagtgaagtaatttacatatcattagttaggtcatatttttagattttattttctgaaaagattaattttaatcagccctgttgcttaattagagtgaccagtttgaaatacttctttcagagcctcagctttagtaaaattacaagacatttttccctcattgaatagaaagctagaaattttagatcaatatcaccaaattagtttgttaaattgatgccatgagtggtgacctcctatcgctgaaaaagagatgcatgtgaacagagagatgctaatgaactcttaaccctgtgggtaccatcctgatgctatccagtggaagccctactgccttgttttccttttttttctctcttccccaccatcctccacccactacacccataattttccagctgtcaaggtagtcaaacattttctttattttctatcactgaaatgcttcacactgccacagtggccaattttattttccttttgaggtgaaggtagtatgttacaatcagaacagacctctgaaatagggtttgcagaagaagaaaattaacgtggagttgaccagagcttattgtttgatgtgccttcaggaaatgtccaaattcactgggataatttccagatgtctgttgtaaaatgcttccataggaaataggcgagactgtgggaaacatctggtttttgtctctgtttaagttaattaattatggtctgctatttttccccctacaggtcatctgagtgcagttcagagttgtagctactctggactttctgtatctgtcaacttaatcaccatgtcatagacggtttgttgcatattagctgcagaatgagccagagggtttcgtttactggaactgggtgaagcatgttttatggcatgaggttttgcttctttgaaggaaacctggagaaatgtcagtagccggaatcctaaatatcctagacactcacaccccagtagactagttcctcatcatcctgtgtgctttttagttcccttattactctaagactaaagtggattcaaacccaaactatataaagtaatacgactaatcctggaacaacagggcagttcttacacatccaaatgagtcttgccctctttgatgcggttgtcttgaggggcttaacactgaaaggagttcagtatacattcaggactccttttagaatcactttcagagatagtgacatactctcttgaatgagctttattatcacaagtcttaatctcttgaagacatgtgagattcttgaagaaaatcttgaagattttctgaaaaggttaaggcttattgagtgtcaagtgtgttgcataaggtggatggattagttgaccattactatttggggcttaaaatgaggtttaactgaagacattcattactctttgctcatagtagaggtgaaataagacatcacagaggtagcaaagaatttacccacaacaaattctggtttaattcgagataagaagttttaatacaagaaaatctgtcatcgcaatagaaagtgtgtttaccattcaaacataataaatataattttagactattggatgctttcctcaaattttgaaattaaggttatactggtttcataaaatgagttggagagattttcatctttttctcttacttataataatttgaatccctgggttgcaaactcaaacttggctatacactgcagtcacccaggtgattctaatgtgcagtcaaggttgggcaccatgggtttaagtcacattaaaactatttgctcatgaaaattaaaatagagttctgctagaaagccacatggggccagtgcactgttcatgttttcctcttcttttgaatcagttttgctaggaaatggatgattttcaaggaaatcataaaattggttcaaagaaagaaccaataaaatttgggtttatataaacccaaattatcctttttatttcttttctatttccttagtttcagctcttctccttatttgatgggttttattgtttttctaatttcctaagatgaatgccatctttcgtgaacatctttaataatgaaggcatttaaggctacacatcttttctgattttagtgttaactaggccttctattgcacttgtaattttgcttttaattttctctttgatataatacttattaagatgataatttttaatttccaagaatcttaattcaaggagccagactttttttctaatcacatttttatgagactgtatcctgtgacatttttcttattttgaatttcttaagagttctttgaagtcaagtacgagactgattctcataaaagttccgtggacatataaaaaattaattacagtgttgagccttgagcaatgctggggttaggggtaccaattccccatacagttgaaaatccacatataattttgactcccccaaaacttaacaactaatagcctactgttgactggaagccttagcaataacataaacagttgatgagcacatattttgtatgttatataattataagctagagaaaaaaatatattattaagaaaatcttaggccaggtgtagtagctcatgcctgtaatcctagcaccttgggaggttgaggtgggtggatcacttgaggccaggagatcgagaccagcctggccaacatggcgaaaccccgtttctactaaaagtacaaaaattagccaggcctggtggcacaggcctgtaatcccagctacactacagaggctgaggcagggattcgcttgagaatctacagataatctacagagaatcgcttgagcctgggaggcagaggttgcagtgagccgagattgcatcactgcactccaatgtaggcgacagggcaagactctctctctcaaatatatatattaaagaagagaaaatatatttactactcaactcattaagtggaagtggatcatcaccaaggtttttatcttcatgttgagtaggctgaggaggaggaagaggcgggattggtcttgctgtctaggggtggcagagggagaagagccacatataagtggacccatgcagttcaaagctgtgttgtttaagggtcagctgtattctcttatttgtaatacacaaagttcttcatatattaaatcaagtttattggttgtatattcaattttcccatattttttctattatatatgttaatcattttttttgttgcgtctctgccagggtttggtatcaggatgatgctggcctcataaaatgagttagggaggattccctctttttctattgattggaatagtttcagaaggaatggtaccagctcctctttgtacctctggtagaatttggctgtgaatgttgctgtgcaacaaattacctcaatacttaatgacttaacactataaacatttagtatctcacagtttctgtgggtcagaaatttgggtcaagcttagctggatggattctggctcaggatctctcatgaggtagcagtcaaactattggccagggctgcagtcatctgaaaagttgattggggctgagggacccatttccaagatggttcattcatgtggctgtagacacagcatttcaattcctcactgactgttggcagaacagccacatgggcttctccacaaggctgcctgattcttcttgtgacagagcagctggctttccccaaagtgagtgatccaagaaagaaagcatgcaggaagctgcagtgtcttttatgacttagtctccaaagttgtacatcatcacttttgcttttttttctcttcatgagaagcaagtcagtaagtcttgcttctgctcaaggggaggcaaattaggcttcaccttgtaaacagagtgccaaagaatttatggacattattttaaagcagtaattcaatctgaataacacactgtgtatttttaaacaatttcttcttgcatttagtagttaaatgtatgaagcaaaaatgtgttcttttattgactataagttcatgagttgtatttttttcataaagtgccttttattatgacataatgttgctttgtgatcctgtttagtactttaatcttaaactctactttgcccggtattaatatttccattcttgctttctttttgttgcatctacctcatattcaaccttctcttaccttctttttaatgtatatttctcatgaacactatatatctgggttttgtattttaacacagcctggtaatcttggtattttaatgagagaatttaatccattcacacttagtataacaacagatatatttgaaattttttcttctactttgctatttcactttgtttcacccttttccttttctttttgctgttttggtaaagttttattttttattgttttatttggaatttttactctgcttttccattcactagtggttaccttcccacttctgacatttctggtaaataatgtatatgtgtgtatttctcaaatagctataactttattcttccactgcagtcctctctctctctctcaataagataactgtttacacactccatgtctcccattcagttaagatttctagagcattttatttttctcttctcacctcccctgtaaatcctagctattgctcataccatagttttagttcctgaccattattaggttttccttcctagcatgtctcttctacttctggaatctttgcttaatacttaaatgcaagtttcatattgtcatattgatttatatataattatatatttcatgattcattgttcacatctgtattctctcctcttgatctttccctgacttgaggacttttattttttatttttatttttttttgagacggagtttcactcttgttgcccaggctggagtgcaatggcatgatcttggcttactgcaacctccacctcccgggttcaagcgattctcctgcctcagcctcctaagtagctgggattacaggcatgcgccaccacacctggctaattttgtatttttagtagaaacagggtttctccatgttggtcaggctggtctcgaactcccaacctcaggtgatccgcccacctcggcctcccaaagtgctgggattataggtgtgggccacggcgcccggccagggacttttaaatgttagtatggttatttagttacagtgttttgttgagtgttttcctcagtggggcatgtggatgctatcttctctgaatgcaggctcctcgaatacagggactttgtattgtttacttctgtgttcctagcacctaaaactgtgcctggtacataacaagcaattgatacatgtttgctgtttttgtgatgttaaatactacacatttgcatgtctgtctttcaccctgagcatttatgtggttggtgatagttgatctctttacacatctgcaagtacttttctatcaccctgagaacttaatgtcttggccactgtagaaatcttggttcaaagtcctttttcctctttaatttgtaaattttattctaccgtctcctacctcccactactatagatgagaagtctgatgctaggctgattcttttccttttgtaacttgttctttctctctggcctcgtctaatctttttaccaggtggtagggattttgtccccatcaattgtgtgtagaagtcgtgtttcaagcttcaaattgaagtcttttttttaaccatagaaaatgttctctcatatttttgtaattattgcctcttcatctgttcctttttcctgattttgaaatgcttattattggcatattaagtctcttggctttgaatgctagtctcttatttattcttcctgattttcatcattttgattttactcaaaatgatgagagtaagagatttttcatctgcttgctctttcaggccaataatgtattttcccaaccattctttcttctagttacctttaacccattgcttttttttttttttttttttttttgagacagagtctcactgtgttgcccaggctggagtgccctggcacaatctcagctcactgcaacctctgcctcccaggttcaagtgattctcctgcctcagcttcaccctcccgagtagctgggattacaggtgcgtgccaccacgcctggctaattttttgtactttcagtagagatggggtttcaccatgttggccaggctggtcttgaactcctgacctcaagtgatccacccacctcagcctcctgaagtgttgggattacaggcatgagccactgtgcccggccaacccattgatattttaagtttgaatagtatattcttaatgccaagaattaataagtttttgttctttcttgtatgttcttcttattactttaaaaacaaactagttctctgtttcctccagcagtcctgttttattggggaccatctgctttagtagatctgattggtctgtctctctctagttgccggatcctcttaggtactagcttatttccattttctattttctgcttaagctaggttaagcctttccatagttggaggcacaacagtttctactcctgcatcgagtgtgaaaaagaagtctctgtgtttctaggtacccctaaatgcaagtgatctgttcttttcgtttcaaggatgtggaagacatcttcctacactttttctagtaggatccaacatttcagctccccctgcctccaaaccaagatcacacacatgctgaggcagagccacccccttaatcaagtgtccaccatcccctcaggcctagttcttccatgttttcaccccagggctccctgccgctgctcctctagcccccttcagacctggacatcccaacagagtctatagccttcaacagtcctcaggttcctctagcttactcaccctagacagctgaaggctggtggaagagtaacagagatcagagatgcagaatccttccccctttctttgtggttggttggttggttggttggttggttggttggtttgttttagacagggtctcactgtgtcacccaggctggaatacagcagtgtgatctcagctccactgagcctcgacctcccaggcctcagacaatcctcccacctcagcctcctgagtagctgggactacaggtgtgcaccatcacacctggctgatttttttgtactttttgtagagaaggggtttcgccatgtttccaaatctgatcttgaactcctgggctcaagcgatccgtccacctcggcttcccaaagtgttaggattactgttgtgagccatcgtgcccagacttctttacgttttgatgaacgatagcctgtatttttgcaactggtttacactaagcccagtgtgaataagcttatatgaattaatacataagaaaatattggggccatgcacagtggctcatgcctgtaatcacaacactttgggaggctgaggtaggcggatcacctgaggttgggagttcaagaccagcctgaccaacatgatgaaaccacatctctacttaaaatacaaaattagccaggcgtggtggcaggtgcctgtaatcccagctactcgggaggctgaagcaggaggatcacttgaacctgggaggcggaggttgcggtgagctgagatcgcgccattgcactccagcctgggcaacaagagcgaaactccatctcaaaaaaagaaaaagaaaatattggaatcttagaattagaaataacatggtcataataaaatgagtctcttaatttgtatgttgctttaccattttaatgcaattttatatacatggtctcatttgagttccaaaatagccgtgtgtggtaagtatggaagatatcatcctcacttgacagatgagaaaactacagctcataaaggttacataacttgcccaaggacacatgggtaatgaatggacctggaccagagaattcaccttcttatcacactatgccattgcttgtttatttgtttgtttgaaattgccttcagaacatgttacattgtataaatgttttctagaatccctaaattatatgctgtaacctgtattaaattttttcaattatttctattatactgatatgagcaatttaaaatgtatatacataataagatactgagtttaataagatttttaaatgtagtcagaaatctaacaaaagaggaatttgaaaatcatttgaaaaagattaatatttctagaatatgtgtattatttcctgaaggtagccattttgtttttcttttcttttcttttttcttttcttttctttttttttcctcttttgagacggagtcttgctgtgtcgcccaggctggagtgcagtggtgcgatctccgctcactgccagctccggctcccggactcactccattctcctgcctcagcctcccgagtagctgggactgcaggcgcctgccatcacgcccggagaatttttttttttgtatatttagtggagacggggtttcaccgtgtgttagccaggatggtcttttctttcttttttttttagacatagtctttctctgttgcccaggctggagtgcagtggtgcaatcctggttcattgcaacctctgcctcccgggttcaagcaattctcctgcctcatcacctgagtagctgggattataggcgcacaccaccacgcctggctaatttttgtatttttagtagagatggggtttcgtcacgttggccaggctagtctcaaactcctgaactcaagtgatctgcccgcctcatcctcccaaggtgctgggattaaaggtatgaaccaccatgcctggcgaaggtaacctttttgaaggaggacatgcatttttatatatgagtagttaaatttgtctctgtgtaatatatttttaaaacatttgaatttgtcttattatgcagtagaagccatgcagtagggaaatagccatctccctatcaaacatgacatcgagaaaatgtaggcatgttacatgtgtttgttttgtcttagagttttatagtatagtactaaatgaattaatagctattttaaagaccaggcctttgttctgatctctgctgcttttcatgctaacactgtgtttaaaagtattttttcatactcaagagtgatattaaaaatacttaaaaactgatatggcccggtcagtgatcactgagaatatacccgggctctgcacacctggtgtagttgctcgctggcagtacatccgagctgctcagtcacatcacatagcactcttcacttgcctgagtactttcatttccattctcccaggtgatctggggagggatgtagtgccatccccattttgcaaattgggggaatcacagccccaaggagctgaccatagggccccttagaataaaggatttctggctcgtagtttggtggtcttccttgggtagaagtttccctcttttcagaagagaaggaagaggtcagaatagccatgtttgataggacaaatatcagctcctttcagaggaaactcatagtaggtggtgggtagaattagcaccgtcccatcctccctggaatcttccattcccaagcagatttgtcactttcagggcctttgcaggagatgcctgccgtggaagagtaaaactggctcaagcgagagagcagatttttcccggtggaagaacctgactcagcctcttttttccatattaacagggatgttatgtacacggcctgactttaaaagtatattcttttaattccttgttttttcccttctcctccttccacagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtaacccaggcctttagattttctcttttaaaagtttcgcactctggaaaatgctgccatatttaattcctaatagagatagaagtgagtgtattggaagagggatgagggggatctcaaggaggacttcaattcttacccctttcaccacccccattattctgctgagtatcagttgccctgaaactcccttcctatcttttcttccagttctgtccgttcttctcccttctattatgttctttctcttgctcccatgcccgaccttcacaggctaaattgtgtgttgggtaggtgtgtgaggccaggtttggaggtgtggcaggttcttcgaacagatttggatgcagtcgttctgttgctactcttggcttgcctcagatgttgtctcagaaactagttccatgtttttcaccgatgcgtgtattgttttatgacatgataattgcttctggcattgttgctcataaacatatttacgaacacagcatttcaactatctaactcaccagaaacttgaggaataaagattggttagatggtttaagaatctttgctggaaggcacagtaggtgacaaatgttcccttttcccttctttttttcttcttcttttaaaaaatctcttgttttatgaaaaacagaaatcagtttgctctaggacagtggaagatatggcatgtctcatgcttttggtcctgggcttttgggtgccttgatcaaagctcagcaactgattagttttgtctttggggcagttttggcgcctggcttgagtacagagtttcaattctaattctcaaggtatggaagcaaatgctaaaactatgaaggaaaaaaatcccaggactattatcagaggcccattatatataatatagcttgatacttttatttaggcatgctgtttatccttattgcctatcgtatttatctagtgtctataatggttaatgaaggagacgtggcccctgccctcatagagcttacatctagcagggaagatgcgtgttgagcaggtttttcaagtgtgatgagtttgtaaagggggaatccaaccttgtctgagggatgatggaaggttcccccatagaaatatggctttagcctgagagctgaagaatgaattaggcaatcaagaaagagccatagagggggatgggaaacagtgttccacagtgaggggacaacttatgcagagctcaggacaagactgtttagatgtgaaagaagttcaggaggacaggagcatagactgagggacagggtggtgcctgatagggctggagacataagaaatgattggatggttcaaaggaatttggacggacttccaagaacaacacaatgtcaccgaataatgtcataaaatttgtgttttaaaatgcagtaggaggagagagttggagaggggcaagagtgaatacacgctcgtcaattaggaagtagttgaaggttaaagggatagataatgggttctcatttagactagggtagtggtgatagagatgcaaagaaatagattcaagaggagtttaggcaatgatgatttaaggctcagtaactggatatgggagagctgaaagaggagggaatcggccgggcatggtagctcgcgcctgtaatcccagcactttgggaggctgaggcgggtggatcatgaggtcaggagattgagaccatcctggctaacacagtgaaaccccgtctctactaaaaaatacaaaaaaattagccgggcatagtggcgggcgcctgtagtcccagctactcgggaggctgaggcaggagaatggcgtgaacccgggaggcagagcttgcagtgagctgagatagcgccactgcactccagcctgggcgacagcgcaagactctgtctcaaaaacaaaaaaaaagggtggggggagggaatcaaggatgacctccagattcccagcttgagtttgggggtacagcggcatcattcacgatattgggaatgtggaaagaggagagaggttgggatgagggggaatgatgaattcagttttgggtaagctgatttgaggtactattgagtaggcagttgagtgtacatacatgtccagagatcagaaatgaagtgtggcctggaacatcatcctgtggtattaacactagataaaaactgaaagcccgggcagggatgagattcccaaaggagaaagtgaggggagaagagagcctaggatgtaatctgaaggaactaccacatttaaggtgaggtagaggagagcttgcaaaagaggctcagaagagccaggaggaaaaccaagagagtttatggtcacagaatccaaggaaagaaaagttttctagaaggatggtagagtcagctgtatttagtgtttcagagagggcgaggaaggtgaggactgcaaggcatctgttggattaaatagtatggacacctttggtgagtacaggatggaattcatctcagaaaacagaacgttacactgtagaagcctgatgtgacatgatttccatggaaagccagagtgagtgtattgcatttcatcttcacagtgtgggatattaagggcatgtactgttatcctaaagcaaggaaaggtaacagaaatattgtcatcattgaatctcccttcactactgctattcaggcattaaggttcctgacactttctattaaaaccctcaataccattatgggacctgtatcagagagagcataacaagccaacttgttacctgctaggtaacaagttgttcagtcttttctttgttcagtcttttcttttttccaatcatttactgtataggatgtctgagaaattctatctaaatgaaaagtcttctctcacacagcttcccccagctaccacagcatgcttctctgcatacttgtagcgtttacaaaacctgtgcctaccacatatttcttaagttgtcttataattgtttcatagaaatctatcttctttccccagctatactataagctccttgagggtagggatgatgtcgttggttgcttttatgctttccaatcatgcctagcaaggactcaggtaagtaacacttccaactgaactctggtttcttgagttcttgtgatagatactgagatgccaagggcttccctttttgcatgactcatggaagtaggcgttatcaacaatcaaatcatttaaatcccatttttttttaggtatggcttcacgaaagaaattttgcataaatataaggtaagacatgcttttttttttttttttagtattcactttgctgtttctatagagaaatttaaaaagagccaagaaagaccagattgatgctttaggaaaggtaataggccaactagtcagaatgcatgccaataaaatacaagcacagcaggaagccctggccacagtagagtcttatattttctttctggattaaaccacactttttcattgtgagttttgtgtaagttttagcatagatacatatttcattgcttcaaaggtaccaaggatttgttttacttaggtgtggtaaaatatgcagacacagaaatgactgtcatgaaggaagagatttttatttacaattctctagaaaatggaggcactgcaagccactctgggagaccgcgtggggaagcaccagagttggtcagaaggcagagggaggctgagcacggtggctcacacctgtaatcccagcactttgggaggctgaggccggtggatcacttgaggtcaggagttcgagaccagcctgaccaacgtggtgaaaccctgtctctactaaaaatataaaaattagctgggcgtggtggcatgctcctgtaatcccagctactcgggaggctgaggcaggagaatacttgaacccaggaggcggaggttgcagtgagccgaggtcgtgccactgcactccagcctgggcaacagagtgagactccatctcaaaaaaaaaaaaaaaaaagaaggcagagggagggtggagggaagcatctgagtgtaatctggtttaggactgaccaatttgagtaatttcagactgctctgggccacagaggttgtccctagttgtctggtaactggccccgggatgaggagtgtgagagctccataaagaaggtagctggggtgtgggctctcggttgcttggtttgcatatgaagggcgagtcattgactatctaggaattagctagccccgggagggacagtctctcctccagagtcagcaaggccccaagatgtcatagtatcaaaaatacagaataaagggccaggcatagtggctcacatctgtaatcctagcactttgggaggccaaggtgggcggatcacctgaggtcaggagttcgagaccagcctggccaacatggagaaaccccgtctctactgaaaatacaaaaattagccagtcgtggtggcacacgcctttagtcccagctacttgggaggctgaggcaggagaatcgcttgaacctgggaggcagaggttgcagtgagccaaggtggcgccactgcactccaatgcgcaacagagcgagactccatctcaaaaaaaaaacaaaaacaaaaacagaataaaaagacatgatgaatacatgctaattggttagtgactccttgctgacttcctttgagtggcctgaaaatcattactttttgtccatacttggggactattcaataaactgaacctgtcagaaaaacaaaacttactcaagctcttacttacagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaaggtaagaagtaatgttggcatgaatcttctctcagggatttagaagggaatacatacctcttcatttattattttgaattgatttgtgttttagtggttgtaactctaaaaagattatagattttattagagtatataaaagtataaattttaagaaaaatctatgactgcatgataaagaactaagtgggtaacttctatatatggaaaaaaattttaaattcatgttgagggtggaaaaatgaggaaatgttggcattttatgtagtttctaaaagtgaaaaatcctgatttttaaaattaaaacctcaattcattcatttatattgtggtaaaatatacataacataaaacttgccactgtaaccatttttaagtgtatagttcagaggtattaagtatattcacattgttgtgcaaccatcaccatcactaccatctatttacagaattttccatcatcccagaccgaaactctggacccattaaacactaactccccattctcccctgtcccagcccctggcaaccaccaaccaccattctaccttctgtctacgaatttcaccactctaggtaccttatataagtggagtcacttatataagtgcagtttatttctgaattgatacgatttcccacataatacacatcaaataacttaggatactttttttggaaatatttttttgaaatgtttaaataatcatgttaaatacaagcagagcaggagctagtatggaacctctgagacaagtggctatgtggtgactgtgaagatctcacgcctagtgaagggttccttggacgggtcttgcagggtcattggagttgtcttcctcctctactcaagccaagaggaagccctcaggctagaggtgtaggggcgccacatgggttgaagaccagtaacagcagtggagccagatgatgctatatggtcctagtgggaaacctgaactgttacccctcaggactgatcatcaacttccaaccaacctggacaggtggggtctagagctggaatttaatctgatagagacagaaatgtgaccccagtggcaccttgacttcttggaccctttatacacatgtgaatgagaatgtcgttgctggtatcctcccatctttttaattaaagtttaataagtctgacctccagaccagatgagatccccttttgtatactgtcaagccctttgtacatatctttcatcacagttaccgaatttaagtaagaaattgtggtactgtttgtttactatcttcctctgtttttctagtccattgataaaaccccagcacctgggatgtagtaagtacttaatagtcactgactatctcttgagggatttaagatcaaagcagggtaaacctaagacaaaactgaatagaaagttttttacagccctctcctgattctgtggtgattttacataccacccttccccacctcaccaactgatgatgatgcttcctggcttacacctgttgtcctattgtaattattaatagcacctccttttactctaaaaaaaaaaaatcccagttgcagccaggcatggtagctcacccctgtaattccagcactttgggaggttgaggtgggcagatcacttgggaccaggagtttgagaccagtctggtcaacatagcaagatgtcatctctacaaaaaagaaaaaattagccaggtgtggtggtgcacacctgtggtcccagctacttgggaggctgaagcatgaggattgctggaacccaggagtttgagattgcagtgagctatgatcgcaccactgcactccagcctgcatgacagagagagaccttgtctcaaacacaacaaaacccagttgcaataaaacttaagcccactctaagtttaaggtacctttctcattatatcagtgagtaatcaagccaataagacattttgatcaagatataatagtcattattaacataatgagtggattagattctaaccaagagcacaagggaacatgatgtctttgtcagtcaaatattggtgaacacagggcatgaatgccacattccatcaccacctgccctatgactacagtgctaatcagtcatggcagcctcttccaattgaccagattgaacacttttgctttcctgaggttagcctgagcagccagctctatcgagggctttttgagatattgagaagatgcctctgggatgtccctcactagctctgtggagatcccaagttgagggccaccttaacatagtaaagactgtgaggctctaagattagacagacagaactaggttaacatcctgcctctgccccttcctgggtgactgggcaacatactgaggttttctaatccttggtttccacacgtataaactgaagataaaaatacctaccatattggatttttgggaggattaaatgtaattacctatatgaagaaaatggtggccaggcgcagtggctcacgcctgtaatcctagcacttttgggaggctgaggtgggcggatcacttgagggtaggaattcaagaccagcctggccaaaaaggtgaaaccctgtccttactaaaatacaaaaaaatagctgggcatggtggtgcacacctgtaatcccagctacttgggaggctgaggcaggaggatcacttgaacccaggaggcagaggctgcagtgagccaagatcaagccactgcactccagcctgggtgacagtgaaacactatctcaaaaaaaaaaaaaaaaaaaagaaaagaaaagaaaatggcatatactactaaacatatagctttctcctccagttctctcttcttttttccttatacttggttctgaggtttgtgtttcagtcaccaatacagaccctggggagagtttgtgggccagccattttctcaggatacctaaagtttcacccccttcagggataactgttctacctgctctttagactggctttaaagatagaaattcaacttgtatattgtttgtgtcttctacccttccttgagtgaggttgaactggtaacacatacttgttgtattaaatatcattgaactgtagtgaaaatgataggttcaaccatttggaactctatcagatgagacataaaagtagattgttccagtccagttttataatccccactttcccatcccataggaccctccaaccctctgtggcaggagggaccatacttcctggtttacacctgcggtcgtaatggtatcattgttaacaggggttgggaagggttgggggaatttgatgacaacctctattctaggttcatttaaggtattttgtaaggtgggcaggttgaggggggtcaatgcagagggattaaagaatgaaggaagattttctaaaactaagattctggtttattatttgtcaaactccccagcaaggcatttgcagaaagatggctactagactccctgggggaaaatggtcgtgtagtgccttagggagagctggggcaaagtatcctgatcccaaatggccttgaaaacttcagagccacacatacttaagagaccatgtggccttgctcaatgagctcatcagaaatgagttgtgtacagctgggcacggtggctcatgcctatagtcccagtacattgggaggccgaagtgagacgatcacttgagaccagaagttcgagaccagcctgggtaacatagcaagaccccatctttacaaaaaaaaaaaaaaagaaagaaagaaaaagggaaaaagaagtgagttgtgtggacccaagtccagagggtcctcccagaatattctgctctgcccctaatgggaacatttgctggcaggagacagggcaggtaggctgtgaactagctagcaatagctgagcttgaatttctacctagctcaatgagacaggacctcagaataagattcaatttcatttttgaaaaataaaggtaagatttcctacacactctagtttgtaaaagaaactaagtgcttggccgggtgcagtggctcacgcctgtaatccgagcactttgggaggccaaggcgggcggatcacgaggtcaggagatcaagaccatcctggctaacacggtgacaccccgtctcttctaaaaaatagaaaaaattagccgggcgtggtggcgggcgcctgtagtcagtgctgaggcaggagaatggcgtgaacccgggaggcggagcttgcagtgagccgagatcgcgccactgcactccagcctgggggacagagcaagactctgtctcaaaaaaaaaaaaaaaaaaaaaaaggaaacttaagtgcctaccacagagaatttgtctatcactgaaccacggccaccagtataacagaagtattgtttaatattgttttgtttaaagacatggtgctacaaagaaacaagtataaaattacagtctctgcttgtgtaagggaacaagagggattctagtaattgatgccctatcagaaagacgttttgttttccaaagaaacgcagcagttttgttgccaagattagagaacatcgtcaatggctggcagagtcaggctgagaaccacaatgcatttaggttggaagggcttctgaagttttcaacctatgtcccctttaagaactttcttggacacagatgtaccttttctcttttcttctggaaagcataacaaaatgcacagcagccactctattaagaggtgtttctgaactcctgaagatcctatggctagataaaggctcaataaggagactcgttgcccctaccttggtatcttccattttctgtgtggatgccacagaatgtgtttaacacctatagagaaactccagtgaaacacagaaactctttctttataggcaatgtctgtaattggaaaatgtaccaacaatgtaacagacccactttacagacatcagtggatgagtgagatataggaggtggacgagatgcaaaaagtgaccgtgtgtttttcattgggttgtggcaccacaacatagaaagaatcccacctgggactgaagtctctgtatgtggcagaataagcagagggttggactaaagcatgaatttgttttatagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtaggtaatcagggtgttcactgcagtggcaacaatgacactagcgtgcatgttgtcccttacaatatatagataaaaagtgactttacctttacgaggagaccacatgattctcttggaattcatcactatatttttaacagctttattgagatataattcacataccatgtaactcacccatttaaagtgtataattcaatggtttttggtatattcacagtgttgtacaactagcaccacaatctaattttagaacgttttcatcatctgaaaaagaaactacatacctattagcatcattccccattcccttctgtagccaccctgtgccacctaacagccttaggcaaccatcaatctactatctgtctttacagatttgcctattctgaacatgttgtagaaatggacacatatgtgatgttttgtgtctggcttctttcactcagcacaatgttctggaggctcatccatgttgtagcatgtatcagtactgaacatctatttgttgctgaataatattccattatatggatatacacattgtatttattcattcataagctgatggacgtttgggttgtttccactttttggctactatgaataatccttctatgagccatcacatacaagtttttctgtgcatgtatgtttttatttctcttaagtgtgtacctaggagtggaactgctgagtcataaactaattctaaaaaagtttaacattttaagaaagtcccaaactgttttcccaagtggctgcaccattttacatttccagtagcaatggatgaacgttccaatttctccacatcctctctaacacttgttattgtctatcattttgattatagccatcccagagggcatgagatggaatctcattgtggttttgatttgcatttccctaatgactaatgatgtcaagcatcttttcatgtgtttattggatatttgtagatcttctttggagaattgtctattcagatcctttgcccatcttaaaaactgagttatttatctttttattattgcattgtaggaggttttttgaatatattctaaatacaaatcctttatcaggtatattatttgcaaataccctctcccattctgtgggttgtcttttcccctttcttgatggtgtcctttgcagtacagcagtttttaattttggtgatgcccagtcaaaatgatatattttttctctttggttgctcgtgtttttggtgttgtatctaagctattgcctaatccaaagtcataaagatctattactttgttttcttctaagagttttatacatttagctcttaaatttaggtgtctgatccattttgagttaatttttgtgtgtggtgggaggtgagattccaaattctttctgttttatgtggatatttagttatcccagcaccaattttttttttcttttttttgagacagagtctcgctctgttacccaggctggagtgcagtgacacgatctcggctcactgcaacctttgcctcctgagtagtagcttggattacaggcatgcattaccacgcctggctaatttttgtatttttagtagagatgagatttcaccatgttgaccaggctggtctcaaactcctgaccttaggtgatctgcccgcctcggcctcccaaactgctgggattacaggtgtgagccactgtgcccggccaccagcaccatttcttaaaaagactatactttccttgttaaattttcttgacacccttatcaaaaaatcagttaaccataataaaagggtttatttctagactcttaattatatttcacaatctctatgtttatccttatgtcagtactgtacaattttgattactgtagctttgtgggaagttttaacattgggaagtgtgagttctccaactttcttcttctttttccagatcgttttggctattctgggccccttgaatttccatatgaattttaggattgatttgtcaatatctaccaaaaagcagctgggatattggtagggttgccttgaatctgtaggtcaatttgggtactatggctgtcttgagatgtctttccatttatttagatctttaatttcaacaatgttttttacctttcagtatacacgtcttgctcttgttttgttaaatttattcctaggtgtttttgatgctattgtaaatagaattgttttcttaattacattttggattgttcattgctagtgtatagaaatacaactgacttttatatactgacattgtgttgtgaactttgataaacgtattagttctaatggtttttagtggatttcttgagattttccacctacaagattatgttatctgtgaataattttacttcttcctttccaatctgtctgccttttcttttccttttttttctttttgcttaattgccttgtctagaacctccagtacactgttgaataaaagtgaagagagtagatgtctttgtcttgttcatgatactggggaaagcattcagtctttcatcaagtatgatattagctgtgtatttgtttgtagtggccttttattacattgaggaagtttctttctatgcttagtttattgagtgtttttattgtgaaagagtgttggattttgtcaaatgctttttctgaatacattgaaatgatgtgttctttccctttattctattaatacagtatattatattgattgatttcagagatgttaaaccaacctgacattcctgggataaatcccacttggtcatgatgtataatccaccttctatgttgctggtttccatttggtaatattttttgaggatttttgcatctatattcataagagctattggtctatggttttcttatgttgtgatatctttgtctggttttggtataagtttggcctcataagaggaattggaaagtattgtctcctcttctgtgttttagaaaagtctgtgaaggattgattttaattcttcaaatgtttgatagaatccatcagtgaagccatcagggcctgggcttttctttgcaggaagttttaaaattactaatttcaatatttttccttgctatagttgtattcaagttttttgtttcttcctgagtagtttgtgtcttggtagttgtgtctttcttggaatttgtttcatttcctgaaacaaatttatttcatgaaattcatttcatctaatatatctaatttgttgacctaaagttgtttgtagtacttctttatttttttttctcctgaaagtttggtagtaatatttccttttttttgttggtcagtctcactaaggtttgtcaatgttattgatctttttgaagaaccaacttttagttttattgatttttctctattgttgtctattctctatttcatttatttctgcactaattgttaacagtggagggtgtccaggttcttggcgtcttgaacaatgaattggacaaaacgcacaaacaaagcaaggaaggaatgaagggttttactgaaatgaaagtacactccacagtgtgggagtggccccgagcatacgggctgaaaggccctgttatagaatttctgggagtttcaatacccccagaggattccattggttacttggggtacaccctatgtaaatgcagagtttgaagtaaagttacaaagtcatttacagcataagcccaatggagaggatatttcctgtcatagctgaagtgtgaactggccttatgttccctgcctccagaccttattttcctgcctcataatctttatcatttccttccttctgcttgttttgggtttagtttgctcttctttttttcagtttccttagaaggtaatatcattgacttgagatcttttttattttttaacaaagatacaaatttccctttaagtactgctttagctccatcccttaagtttgctatgttattaaacaattgctgctgctttaaaaaaaatagttttgctatgttgtgcttttgttttcaatagtattgtctaaatatccttgtgatttctttaacttatctgttatttggtagtgtgttgtttaatttctacatatttatgaattccccatatttctttcgcttattgatttaaaatttaatttgattgtggtcagcgaacacatgctttgcctgatttaaattcctttaaaactttttttctttttttggtaaatccttttaaaatttgttgaggctttttttgtggcctagcatatggtttatcccggagaatgctccatgtgcacttcagaagactatatatttcactcttattgggtggagtgttttatatatgtctctttgaacatatttataatagttgctttgaaatctttgtctgctaagtcgacgtctagtcccttcaaaagcagtttttattgcctgcttcccccctccgctccccccaccccccgcccgtgtatgagtcatacttttttctttgcatgtcctgtaatcttacattgtagtaaccctaggtagttattcccatgcccctctggggcttgttgttatttgcttttttgtttatttgttgagtgacttgtctggactagtttagtgaagtctattccccttcagtgtgcagcctctgatgtcactcttcacagagtgctgccttgggcatgcatacagtttctcccaccaccagggctggtgtggatttaattgggctctctttgactgtctctttccctgatctctcctttaagcttcggacccatctgcctctatttgaagcagtcccagctgttagccttcactaattgctagccgattgctctattgtttttaacaataacaatgccctggcccacagagtgctctacagtctgatccgattaaagttggacccctttgcaggggcagggctttaaccatgtttgaggcttactccaacctccacaaaggctcttttctcatctgtgtctttccccgattcagtctgttaaatttcttctagctggggtactgttactactagtatctcggcactaccatcctcctcgtaaatgcttattcccaacaatctccattgttttcaacagtgcctttaggcatgaacttccttacactctgtgccaaataaggccagtcccttaggaagagtggcagtgctctgttcttgacctgcctcaccccctgggccaaaccactgtgccatcgcactgcagctgggagcagggacagtgacccacttctcctccagtgacagccccattccacaagtggggtagtaggcagggatgatagctcctggtcttcttggcttgcccttcttggcatagcacctcctccttatgattgagcaagcatgggggcagttggggtctagcacctgcaggctgccatgcctaggatagggcttctgcccaatgagcgggagaagtgaccccagtcctctctgctgtgcttgcctggaatccagcttctgtaacgcagagctgaggggaatgagggatgcccatcagcttgctccttctggggcaaaaccatagccctctactgggagctgggggaagaaggagccccgtcttggatgcatccacttgaagtagagcatccttcatgctgatcagtgaagggggttagagtagatcatggctcaaatgccacagactctctctgttggtatcaaaatttagtaagttttcttaaatgtttctccatatgctgtatgccattaggacaatttccagtggctttaactattttaatttttttttaagtgattttccgctgggcgtggtggctcacgcctgtaatcccagcactttgggaggctgaggtgggcggattgcttgagcccaggagttggagaccagccttggcaacttggcgaaaccccatatctataaaaagtacaaaaattagctgggcgtggtggtgcatgcctgtagtaccagctacttgggaggctgaagcaggagcatggcttgaacctgggaggcggaggctgcagtgagctgagatcgtgccactgcactccagcctgggcgacagagtgggaccctgtcttaaagaaaaagatgttcaccagttaaatggttgtttcactggggagagggtctgccaagcccctaacactgccattcctgtcactatgttgtcattttgagaactgtactgagtatgtctataaacatggatgtaaaggcaataagccatgtactcatctttgtgacagcgtgcatatccagagctgcctgtctggagtctctggcagcttctggcatggagtaagatctataaatattcctctcattcattcatccattcaacaagaatgtattgatcactcctgagtactcttgctcatttgtcttggtgaaatttagcgtttttctaaatttccagtcctacattttaactgctttcttgtcagtttttaccctatatggcagggatgagttcttaagaacaacagctatgtgcattatctcattaaatccttaaagcaacctgatgacgtagataatattattcctatttcccgaaagaggacactgaagctcacataagttgaataatttgctaaatgatgggtctggttttgattccaaatttgttggactctacgcttctcatttttgactgctaggtcataccatgtctctcactgtaggaaaagatgttacaggacactgggttttgtttgtttggttggttggtttcctttttttgagatggagtctcactctgtcacccaggctggagtgcagtggcgcaatctcagctcattgcaacctccacctcctgggtttaggcaattctcctgtctcagcctctggagtagctgggattacaggcatgtgccaccacgcccagctaatttttgtgtttttagtagagactgagtttcaccatattggtcaggctggtctcaaactcctgacttcagatgatccacctgccttggcatcccaaagtgctgggattacaggcatgagccactgtgcccggccccagaactctggttttcaacttcttacatgggaatgttatgacctcttagaaaggacttttgaagacttttcttcaggtttcctgttctgaaagaaatgaaataaaattattggatatggactaacgcttaatgataaaagtgttcttcctgtagatagaatcataaccataataagtagctttcgttttcagatataaacacacatacatgcatttgcaatgtcacaagtacacatagacacgtgcccacatgatgttggttacatctgtagctgggaaacataattaaacaattaccaaacagtgttaaatttcttacttcccttcagtaattgttaaagaaacctctttttcttgatttgggacccttataccttgattgctgaaaatgttgactaaaatgtgatttctggtgtaaaatataccctaatcaatgaggagagagagaagtggggagacagactgagggagaaatggaattcatcattggctgtgagtccaaaatatttaaaaatcaagtaagcatgagaggcatctcatagcaagtaggaaaggatgcctccttaaaccttgacatccaaatcccaaagactgaaggttagaacaagctcttctaggattatggtgaataaagaagataatgttaaagaaattggagctgcacacaaagaaaattgtggcctctggaagcctagaagagttagaagagccttaagaagtgggagggaggagactggggctcattattccataacagagcctcccactccccaaacaatagagatacagcatcttgcagaccccacacacatgatcagagctgacattgggtaaaatgggccagaacctcatttctgatgtttaatcattttagttgtgcccctaattttctttcctcagttcctggtacatagtggatacacacacacataagttatgctagagccgaaatttccagataaaaacagagctgacaattactttatttcttaatatctatgagctattttgtataaagatcatatactctttattttgtcttgtagtcatggaaattcataattcttggcagagtgctatagtttaaattttcccttatgttcactgagatgtggggatatatttaatcggagttaagtcactatacagagatgaatatgatactctttaagacagacttacaaagagacagaggccagaaaggtttcaaaaataattttaattatttatagtctgaatgactcccctctctttattcattcatttaacaggtatttattgagcacctactatgtgtcagacactgttctagacttctgggaaatgtcaatgaccaaataaagatccgttaccttgcagagcttacattttagggggaggagttagatgacaaacaatacagtaatgagtaaatgatatgatatcttaagtgatatgttcttttttattattattattatttttagacggagtctcgttctgtcgcccaggctggagtgcagtggcgcaatctcggctcactgcaagctccgcctcccgggctcacaccattctcctgcctcagcctcctaagtagctgggactacaggcacctgccaccacgcccagctaatatttttgtatttttagtagagacggggtttcaccatgttagccaggatgtctcgacctcatgatccgccctgcctcggcctcccaaagtgctgggattacaagcgtgagccactgcgcccagtcttaagtgataagttctatgggaacaataaaaactagagcagagttaaggagaacaggaaaactggacttggggacaaaattgcaattttttttttttgtttgtttgagacagagtctcactcctgtagtccaggtgggaatgcagtagtgcaactacggctcattgcaaacctgaccacctgggctcaagtgattctctcacctcatttttttattttttatagagatgatgtctcactatattgcccagactggtcttgaactcctgggctcaagcgatccttcctcctctgcctcagaaagtgctgggattacaagcatgagccacggcgcctggccaaaattgcaattttaaataacgtagtcagcagcattgaggaggctcccaagagggaaatgacttgattgaggtgtcttggctggtcaggaatgatagagtaggatttgatcctgaggttgacttgaatgtccatgctctttttctgaagggatagatgagagtgacaggcattctcaggaaggacgtgacctactttagtcagcccttattcaatgaggcctgaagggtggacagggagcaggaggaaggcatttaaagaaatctaggtacctggctggaaggtttgggctgagcacggctttttttttgagatggagtcttgctctgtcgcccaggctggagtgcaatggtgcgatctcggctcaatgcagcctctgcctcccagggtgaggcaattctcctgcatcagcctccaaagtagctgggattacaggcatctgccaccacgtccggctaatttttgtagttttagtagaggcagggtttcaccatgttggccatggtagtctcgaactcctgacctcgttcatgatccacccatctcggcctcccaaagtgctggaattacaggggtgagccaccatgtccggcctgagcatagcttttaaaatgacatggtctaggccaggcgtggcggctcacgcctgtgatcccagcactttgggaggccgaggcaggcggatcacaaggtcaggagttccagaccagcctgaccatcgtggtgaaaccccgtctctactaaaaatacaaaaattagccgggcgtggtggcgcatgcctgtaatccctgctactcgggagactgaggcagaattgcttgaacctgggaggcgggggttgcagtgagccgagatcacaccactgcactccagcctgggcgacagagcaagaccccgtctcaaaaaaaaaaaaaaatgacatggtctagctgggcgtggtggcacgtacccgtaatctcagctagtcgggagactgaggcaggagaattgctcgaacccaggaggcggaggttgcagtgagctgagatcacgccattgcactccagcctgggcgacgaaagcaaaactctgtctcaaaaaataaatgaattaatgaattaattaaaaatgacatggtcaaaagctggaagggaggatgtataactaagggaaaatatgaaagaatagtgaatctatagtattaatgttttagaagagaagcatttagatatacctttcagagctattaactctccctcgaagcacacttttggagtctggattacttagagctgcagacatgcgcaaggtccttcttgaaggatttattttagattgaggagatttaaaaggctgacacacaaatagatttttgttgaccaggtcatataaaagctgtaattcagtaaaacgttcccattttttttgtttgaaatttttcaggaaagaatgttgtaaagaattaattagtctttcatgcagtgatcaccccaaggatcctgcatttcagaggataatgtgttgttgagatgaaagagatggtttctactgaggaatttgtttcaccaacaaatgggcttttatgcaatttttttgtgagttctgcaattaatcttacgttaccactacgatctgggtaaacctagtcaagtaaatgatttctagacagaaaaaagaaatgcagaactcagggaatggattctgaaggacaagctcagttcttaaaaactgttaccccttatgacttagaatcaaagaaaaatgagtgtcagatatatcttcctcattcctttgatgatgactaagtcctgaatatgttaagtgatttgcccaaggtgacttaggtaattacttgaagtgctaactccttggccagtgcttattctagttcaacagagtcccatcatatgtgcattgaatttatgtaaatttcaattattgtatatggcaaaaaaggagaaaaatactggaaaattttattttcatatactttatcacatatataaaataatatatccatatttatataatatatataaaacattcacatatccatattattgtatagagttgtatgcatacattcatgtacagtcaaccctccgtatgcacgggttctgcattgtggactcaaccaataacagattgaaaatatttggaaaaaaagaaaacaatataacaatacaatctaatataaattttaaaatatggcataacaactatttacatagcacttacattgtattaggtattataagtaatctggagatgatttatagtacagatactctttgatttatgatgagtttatctggacttaattctatcatgtcaaggagctcattgaatgcttgttgcttttgcaccattgtgaagttgaaaatcgttaagtcagggaccatttgtagacaggaggatgggtgtggattatatgcaaatactacgccattttatacgagggacttgagcatccacagattttagtatcctggatgtaggaggtggtcctggaaccaatccaccttggatactgaggggcaactatatatgttaagggtaacttaagaggtttcccaggggtaattttggctataaatgatttgcatcccatgtagaaattggaagcttaatcccctcctaacaaagcccaactccttgatttccatctttcctccatcattatattacaggtcgaattatgtccctaaacatgacatcatggtgtaagagccagatttgactcagttgaaaatgcaagtgttatttttgtcataaacaccagcaaagtaaaggggttccattatatttattcatagagtagggcggtgctgatgttggaattcagtggggagaaaggagcccccttggctgactcttctttgggtggttttaactgtcacttcaatcatcaaaaactctgcaggtatctgatgtgggcctggtacagggtttctcttttctctagttctgaccaggtacttattccagggtagctctcctgccagttctgctcttttcacctcactgtctttttcctcacttattttctagctcctcttccataccaaacttataaacgggtgtacaatcatgtttagcaattcctggtcctcttctccagacctgatttggagccactagaataactgcataacttcacatgcctgctttttcatgcactcaaaagaaacatgtggaaaatatagactgttagaatcagtctgttagaatctgagatactttacaggtcaactggtccaaatgcctgattctaaagatctcaaaagtgagacccagggaggattttcaaggttatgtagctttaatggcagagagagtttttctcaccgctttaagctgttatagaagtttcaataaagaaacattacaggccgggtgcagtggctcacacctgtaatcccaacaccttgggaggccgaggtgggtcgatcacctgaggtcaggggttcgagatcagcctggccaacacggtaaaaccctgtctctaccaaaaataccaaaaattagccaggtgttgtggcgggcccttgtaatcccagctactcaggaggctgaggcaggagaaccacttgaacccaggaggcggagtttgcagtgagccgagatcatgccactgtactccagcctgggtgacagagcgagactccatcacaaaaaaaaaaaaaagaaaagaaaagaaacattacagatagatgagagccacaaagacggagcctccaatctttatgaaaaatattattttgttttattttgagatggtgtcttgctctgttgccgaggccacagtgcagtggcatgaacatggctcactgcagcctcaacctcctgggctcagggatcttctcacttcagcctcccaagtagctgggaacacattccggcaccaccacacctggctagtttttattttttaagtttttgtagagatggggttttgccatgtttacccaggctgctcttgaattcctggacccaagcattcctcctgactcagcctcccaaagtgctgggattacaggcataagccactgtgcctggcagaaaaatgattttaaaaatttggatctttagtcctggacatcatgtaacctgcatttgcctctcctgcgccccaaaggaaatgttataataatacaacacttgtggatttagaacacattatggaaaccagtcatttactaaatgtattgcggaaactgagaatgtacttaccatcgaggggggaaaagtgaaggagatgctttaggagacaccctcagataaacaggtttccacatttgtgttgggaaacagcaagggcttcctcaggctatgtgctcaacaggacaaaaacctggcccagagccacagcaggagacctactttatgtctttgaacatattaagacacacctaatgtgtgggcattgtggggagctaatttcttccctgaatgtgacaatgaagttcttttaagagaaaagaaccttgtagattcaacaattgtcaaacaattgtgatggaatttttaaagccaaaaaaacaaaaaaaaaatggcaaggcctgattcttggttattgttattgctgtattggttattcatggaggagatgaatatgaaacaatattcttttttctttttcttttttgcggagaccagctcagtaggggagaccctaacccagcagcgctagaggaattaaagacacacacagaaatatagaggtgtgaagtgggaaatcaggggtctcacaaccttcagagctgagagccccaaacacagatttacccacgtatttattaacagcaagccagtcattagcattgtttctatagatattaaattaactaaaagtatcccttatgggaaacgaagggatgggccaaattaaaggaataggttgggcttgttaactgcagcaggagcatgtccctaaggcacagatcgctcatgctgttgtttgtggcttaagaatgcctttcagcggttttccgccctgggcaggccaggtgttccttgccttcattcccgtaaacccacaaccttccagcgtgggcgttatggccatcatgaacatgtcacagtgctgcagagattttgtttatggctagttttggggccagtttatggccagattttaggggggcctgctcccaacaattttgagacagggtctctgtctgtcacccaggctggagtgcagtggagtgatcatggctcactgcagcctcaacctctcaggctcaagtgatcctcccatctcagcctccctagtagctgagactataggcatgcaccaccatgcctggctaatttttgtattttttgcagagttgaggtctcaccatgttgcccaggctgggcttgaactcctggcctcaagcactcctcccacctcagccacccaaagtgctgggatcacaggcatgagccaccacgccaggcctgaaacaattttcaaggaagaatgagaagtggtctttgggataccttgggttaatatttctgacaaataagttggaatctagaaagatatactctcacttgtaagttacagcgaaatctggtttgttgttccaagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtaagctaaaattgttggtgacattcccataaacatccttcccctaagcacagtcttttcttcacagagcatgtctggcctagaagcccatgagaagatgtcttctctagtaccaaacagaaaccagagaaggcgagcttcatctaggttgtttgaaggggcctcactgtcccttatcctaaaagatatttggtttatttccctgatcttccctaatcccagaaacagaaattctttttttttttttgagatggagtctcactctgccacccaggttggagtgcagtggtgtgatctcagctcactgcaacctccgcctcccgggttcaagtgattctcgtgcctcagccacccaagtagctgggattacaggtgtgcgccaccacacccagctaatttttgtatttttagtagagacagggtttcaccatgttagccagactggtctcaaactcctgacctcaggtgatccgcctgcctcggcttcccaaagtgctgggattacagtcgtgagccaccgcgcctggccccagaaacagaaattctgatacatggcactaagtagacacacagaaaggcttggttcttataaggcaactgtcccatacagtggggttgagaatgtccttttcctcacagagcgcataaaaggcagcagtgaatccagtttgctcttgcactttttacatgttccctgtgcagggcccaaaacacaaaacacacttcccttcagctccctgagtaggtgacctccagcaagttgctcactgtagtcagtttagctgcagccactaaaacggagtgtgttgtgttccttcagtggtgtctgatcaaaggctaaaagaggtgaggaccgaggagctggtttcttgtcccaagttgttctgggatgcaccgtttcttttttttttcttttttcttttttttgagacagagtctcgctgtgttgtccaggctggagtgcagtggtgcaatctcggcttactgcaacctccgcctcccgagttcaagtgattctcttgcctcatgctcccgagaagctgggattacaggcgcccgccactacgtccagctaatttttgaacttttagtagagacaaggtttcatgatggccaggctggtctcaaactcctgacctcaggtgatccacctgcctcagcctcccaaagtgctgggattataggcattagccaccgcgcctggcctggaatgcacctttttctatagtgaacagcaataaataaaaatggacaccaagttgtgtggcatttccctctgtgtcagcactttgtttttctgacctttattaattcattttcagctcatactaacattccaagatgagtaaggcaagtattgtttagggtttctttgtagtaagaaaatagatagaaaacatcagtggcttgtctgaagtgacatgctcatcaggacagaacggggcctaaaccaggttccctgtcacccacaaatattgtcctcctggctgggcacggtggctcatgcctgtaatcccagcactttgggaggccaaggcaggtggatcacgaggtcaagagatcgagaccatcctggtcaacatggtaagaccctgtctctactaaaaatacaaaaattagctgggcgtggtggcacacacctgtagtaccagctactcgggaggctgaggcaggagaattcctggaacccaggaggtggaggttgcagtgaggtgagatcgtgccattgcattccatcatggtgagagagcgagactccatcttaaaaaaaaaaaaaaaaaaattgtcctcccatattctaccacagcccaaggctagttccttcacaagacagtggtcgtggtcccttattctagccactgcacctctgcccttaaagcactgactttctggggccctgaaccctctaaatcactcagctccaagcagaagaaaaaaaccgaagtaccagacaaattttgttctgaatgctcaactattacaaggcaagaaaataggggatttatccccttggaaaaagaatttgcaaaatcaaacattaaagaggattctgagatttggcactaaaattgtacccgagaatgcagggccatgcgctgaggacattggctgagtggccaggagttagtgctgctggggacactgggtagtagccttgttttcctccgatgcagtcatagaaatcacatcagactgtgatgatttgcagggtttatgaaccttctttgatttttgctttttaagaattgagctatttctgaccttattgaatgaccttttgagaactaatgttacgtgaacctgaccctctttttctttaaccaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaaggtgtgtatactataccgagagtgctgagcactggtatcacggacccattagaaccagtcccacgtgactaagagcagccacgtgagtgaagagagtcatttatagcttactcattagtatcaacaaaatgtaaatagttccagacaccaagtggtgaatgcacccatatttgaaaccaaaaagagcaattttaaattcatacatctttttagatggataaagcagtcagccctcagaaacgtaactgaatgtaaagaaaagaagatccccacacccactcagtcccccaacctacaaccttctctgacccacaaacagctctatctggtcttgcccctttctcttctctatccagaagtgtatgtgacaaatagttgagtgtctctctccatgtgatggcatttgtagcttatactccttttctccctttaacattatctttctaagtgttttttttggttttttttttgtttgttttttttcatttgttttttgtttttttgagacggagtctcgctctgcagcccaggctggagtgcagtggcgtgatctcagctccctgcaacctctgcctcccaggttcaagctgttctcctgcctcagcctcctgagtagctgagattacaagggcccgccacaacacctggctaacattttatatttttggtagagacggggtttcaccatgttggccaggctggtcttgaactcctgacctcatgtgatctgcctgccttgacctcccaaagtactgggattacaggcatgagccactgcgcccggtctaagattttttacattatagaactaacatgtttgttgttaacaactgaaaaaaagcaaagaagaataaagaaattgttaacaacttctctcctttctcaattatccttttccccagaggtaactaaaactggcagtttagaatggccccttccaccctcttcttgctcttacaaaaatagtcaagcatttattcagtcattgaattaaaaaaaacctttgagtacctgccatgtgtcagatactattctaggcatacataatataagataggctgaagtcccctcatcaaacacatatctcagtgtgaagagaaagacgataaacaatgtacatacttttttttttaaagaaggagtcttgctctgttgcccaggctggagtgcagtggcacgatcttggctcactgcaacctccacctactgggttcaagtgattctcctgtctcagcctcccgagtagctgggactacgggcatgccccaccacgctgggctaatttttgtatttttagtagagacggggtttcaccttgttggccaagctggtattgaactcctgacctcaggtgatttgcccgcctcggcctcccaaagtgctgagattacaggtgtgagctaccacgcccagcctgtacgtacattttttttttttttttgagacggagtcttgctctgttgccaggctggagtgcagtggtgcgatctcagctcactgcaacctctgcctcttgggttcaagcaattctcctgcctcagcctcccaagtagctgggactacaggtgcacgccaccacacccagctaatttttgtttttttagtagagagggggtttcaccatgttggctaggatggtctcgatctcttgaccttgtgatccgcccgcctcagcttcccaaagtgctgggattacagtagtgagccaccacgcccggccgtacgtatattttttaaagaaagaatcacactgcatactgtattctgcaactgaatttttcccctaaaaattttatcatgaacatcaccgcaagttagtaaagatagacctaactcattctttttagtacatacatattattctgtagtatacatgtaccataacagttatggagcaactaaatcttatccaattgatagacatccagattggttccaggattctgcatttaaaaacaatgctataactagcattcctatatataaggaactcatacgactcaacagcaaaaaaaaaaaaaccaagtaatccaatttaaaaaataggcaaaggacctgaatagacattttcccaaagacatacaaatggccaacaggtatacgaaaagatgctcaacgtcactaattatcagggaaatgcaatgcacagccacaatgagatagataccctctctcaccggttagaatggctgttatcaaaaagacaaaacctaagtgttgaccagggagtgtagaaaagggaacgcttgtactctgttgataggaatatggattagtacagccattatagaaaacggtatagaagttcctcaaaacattaaaaatagaagtaccatatgatccagcaatcccactactgggtatatatccaaaggaaatgaaatcagtatcttgaagagatatttgcattcccatgctcagtgtggcattattcacaatagtcaagatatggtaacaaaccaagtgtctatcaagacagaaaaagaaagtgtgactgatatacgtgtgtggatttatatattatatatatatagatatatcacattatatctatctatctatctatctatctatctatctatctatctatctatctagtaattccttgatatttgtagggaattggttccaggagccctctcagataccgaaatccctggatgctcaagtcacttatataaaatagcatggtatttgcataaaacctatgcacatccttccatatactttaagtcatctctaaattacttataataccgaatgcactataaacactatgtcaatagttgttatactgtattgtttagggaataatgacaagaagaagtctgtacatgttaagtacaggcacaaccatctgttttaaaaaaaataaatttggccaagcgcagtggctcacgcttgtagtcccagcactttgggaggccgaggcaggaggatcatttgagcccaggagttcgtgactagctgggcaacatggtgaaaccccatctctacataaaatacaaaaattagctggacgtgatggcgcacacctgtaatcccagctactctggaggctgaggcaggagaatcacttgagcctggaaggtcaaggctgcagtgggccaagactgcaccactgcactccaggttgggcaataaagtgagaccctgtctcaaaaaaaaaaaaaatccactgaagggaaacccatgcatacagagggctgattgtacatgcacaatggaatattattccaacataaaaaagaaatcctgacattatgacaacatggataaacctggagggcattttgctaagtgaaataagtcagacaaatactgtatgacatcacttatatgtggaatctaaaaaagctgaactcatagaaacagagagtagtatggtggttgccaggggctgagaggtggaggatatctggagatacaggtatatcaaatcatcacattgtataccttaaatatgtacaattttatttgccagttataaatatgttatagttttatgtcaataaagctggaaaaaatcctctgtgtgtgtgtgtgtgtgtgtgtgtgtgtgtgtggacatatatccataagttttagtggcttttttaatgtaagattttacaatgtggaatttatggaatttatatgtttaaaattttaatagctacttcagaagggttataacattggacaatctgaaaaacaacataccatatttatttataatttcattataatttttggatctgtacctttgtttagaaaatttctctttctctgtctctgcctctctctgcgcacacacacacacacacacacaaattctcaaatttaacagctacgttgagatgtaatttacataccacaaagtttacccatttacaattcaatgacagtacgtttagagttgtgcaactatcaccattatctaacttttgaacatttttgccatcctaaaaagaaaactcatacccactgagcagtcatttctcagtcacctcctcccatcacagccctaggcaaccactaatctattttctgtctctatggatttgcctattctcggcatttcatataaatgagatcacacaatatgtggtcttttgtggctggcctctttcactcagcacaatgtttttgaggtcattcatgttgtattctatatcagtacttcattccttcttatgggtgaataatattccattgtatggatagaccacattttgtttgtccattcatgagttgatagatatttagggtgtttccactagttggctattataaacaatggtgttatgaacattcatgggcaagtttttgtgtgtacatgtttcatttctcttgagtaaatacttggtaatggaattgctgggttatatggtaactctgtgtttaacattttgagaaacttgcaaacttttttcccaagaagctaaccagtttaccatttccaccatcagtgtgtgaggattccaggttttctacatcattgccaactcttgttatgatctctttttatttatttatttttttgagacagagtttcactcttgttgccccaggctggagtgcagtggcacagtcttggctcactgcaacctccacctcctgggttaaagtgattctcctgcctcagcctcccgagtagctgggactacaggcatgcgccaccatgcccagctaatttgtgtatgtttagtagagatgaggtttctccatgttggccaggctggtctcaaactcctgacctcaggtgatttgcccgcctcggcctcccaaagtgctgggattacaggtgtgagccaccgcgcccagcttgatctctcttttttcttattgttctcttagtggtgtgaggtagaatctcattgtagtgttgcgttgtatttccctaatgattaatgatgttgagcgtctttccatgtgcttattggacatttgtacatcttctttagaaatattatatttcaggtacattttccatttttaattgtcactctttatttttgcattgcaagagttctttattctatatacacatcacttattcagtatatatatatatatatatatatatatattttttttttttttttttttgagacagggtctcactttgttgcccaggcaaaggcgatcatggctcactgcagccttggcctgcggggctcaattgatcctcctgcctcagcctctgaagtagctggggctacaggcacaagccagcacacttggctaatttttgtatttttgatgaaacgggatttcaccatgttgcccaggctgatcttgaactcctgggctcaagagatccacctgcttcagcttcccaaagtgctgggattacaggcgtgagccaccacgactggccacttgttcagtatttgatttgcaaacattctctctcattctgtgggatctcttatccctttctctgtggtattatttgtagtgcaaacatttttcattttgatgaaatccaatttatgtgcttttttggtggtgttgtatctaagaaggcattgcctaactcagagtcataaggattcattcctatgttctcttctaagagttttataggtttagctcctacacttaggtttctgatccattttgagttaatttttgtgtatggtgtgaaggaagggttcagctttattcttttacatgtggatatccagttgtcccagaaccatgactcaaagactgttctttccttcttggcactcttgtcaaaaatcagttgaccataatataagggtttgtttctggcctttaaattgtattctatttgtctatgtctatgtctatcctaatgctaggaccacactgtcctaattattgtaactttacaaacttactacagttttaaaactggtaaatgtgagttgaacgttgcacttctttttaaagattgttttggctattttgggtcccttgcattttcatgtaaatttcagaatcagcttgtcaatttgcaaaaataccagctgagaatttgatagggattatgttgagtctgtagatcaatttgaaggctgttaccatcttaacaatattaagttgtccaatccatgaacatgaaattttgttctatttaaatcttctttaatttcctccaataatattttgaacttttcagtgtacaagtctaggacttattttgctaaatttatttctaaatattttattccttttgctgctatagtaaatggaattgtttttcttttctttccttttctctttttttggagacagggtctcactcagtcacccaggctggagtgcagtgatgtgatcatagctcactgcaccctcaaattcctgggccttacattaaaattagcttgcaccaccacacccggctaattttttcaattttctgtagagacagggtcgcactatgttgcctaggctgggtctcgaactcctgggctcaagtgatcctccagtcttggcttcccaaagtgctgggattacagatgtgagccaccgcacttggcctgttttcttaattatatttttagattcttgatttctagtgtatagaaatacaattgattggccgggcacggtggctcatgcctgtaatcctagcactttgagaggctgaggcgggtggatcacgaggtcaggagatcaagaccagcctggccaatatggtgaaaccctgtctctactaaaaatacaaaaattagctgggtgtgatggcacacgcctgtagtcccagctactcaggaggctgaggcagaagaatggcttgaacccgggaggcggaggttgcagtgagccaacatcacgccactgcactccagcctgggccacggagcaagactccgtctcaaaaaaaaaaaaaaaaaaaacaattgatttttggatattgatcttgtacaatcttgattaacttgttagttttaatctttttctagtagagtcattgagattttttataacctagatcatatctgttaatggagacagttttacttcttttccaatctggatcccttgtatttatttttcttgtataatcatcctggctaaaacctccagtacagtgttgaataaaactggtgagggcagatatacctgtcttatttctgatcttaagggaatgcattcactctttgataattaagtatgatgttagctgtgtatttttatagatgcctctcgtcaagtggaagaagtttctttctatgcctagtttgggtagtgtttttatcatgaaagagtgttgaatttcatcagataaattttttctgcatgcattgagatgatcatgtgatttttgtgattttttaaaatttcaacttttattttcgattcaaggagtacatgtgcagatttgttacatgggtatattgtgtgatgctggggtttgatgtatgagtgatttcatcacccaggtagtgagcataatacccgatacttagttgttcagcccttgccctcctttctgcctccccatctagtagttcccagtgtctatttttcccatctttatgtccatgtgtacccaatggtgagctcccacttaaaagtgagaacatatggcatttggttttctgttcctatgttgattcacttaggataatggcttccagctgcatccatgttgctgcaaaagaaatgattttggtttttttatggttgtatactatttcatggtgtatatgtattgcattttcattatccaatccaccattgatggacacctaggttgattccgtgtttttgctattaggaatagttctatgatgaacatacaactgcatgtgtttttggtacaatgatttattttcctttgggtatatacctagtaatgggattgctgggtccaaatgggagttccatttttagctctttgagaaatctccaaagtgctttctacagtgactgaactagtttgcatttacaccagcggtgtataagcattcccttttctctgcagccttgccaatatttattattttttgacttctgaataatagtcattctgactggtgtgagatggtatctcattgtggttttgatttgcattgctctgaggttcagtgatgttgagcattttttcatgttggttggccgcttataggtcttgttttgagaagtgtttgttcatatcctttgcccgctttttaatggggctatttgttttttgcttgttgaatagtttaagttccttataaattctggatattagacctttgttgcatacatagtttgtgaagatttcctcccaatctttaggttgcctgcttactctgttgatattttcttttgctgtgcagaagttctttagtttaattagttctcatttgtcaatgtttgtttttgttacaattgcttttgaggacttagtcataaattatttgctaaggctgatgtccagaagggtatgtcctaggttttcttctaggatttttacagtttgaggtcttacatttattaataagtctaatccatcttgagttaatttttgcatatggtgataggtagaggtccagtttcattcttctgcgtatgaatagccagttatccccgtgtcatttattgaatagggagtcctttccccattgtttatttgtcctgtgttaatatggtatattacattggttgatttcagctattagacaaagcttgcattcctagaataaatcccacttacccatggtgtataatcctttttatatgtttctggatgccatttgctagtattttgttgaggatattgtatctatattcataagagatactggtctgtagttttcttgtgatctttatctggtttttgtatcaaggtaatactagcttctaagtgggcagtattcccacctcttctttttggaagagtttgtgagtgattggcattaattcttccttaaatgtttcatagaattcaccagtgaagccatctggctctgggcttgtctttgcgaatcatttgattacttagtctttttacttgttacaggcatgttcagttttttaatttcttcctagtcagttttgatcgtttgtgtcattctagcaatttgtccttttcatctatgttatctaatttgttggtctacagttgttcttagtatttctttataatctttcttacttttgtaaggtcagtagtgatgtcccctctcactcttgattttagaaatttgagtcttttttcttttttttcttggacattctaaaagtttgacaatttagtttcaaagaaccaatttttagttttgttgatttttctttattatctttccattctctatttcatttcttactgctctattctttattatttccttttatctgcttatgttgggttcagtttactcttttttccaattttttattttatttatttattttttttttttttgagatggagttttgctcttgttgcccaggctggagtgcaatggcgtgatctcggttcactgcaacctctgcctcccaggttcaagtgattctcctgcctcagcctcccaagtagctgggattacaggcatgagccaccacatccagcctttttccaatcttttaaagtggaagattatgttactgatttgagatcttttttctttttttaatataggcatctatagctataaatttttatctaagcactacttcatatgttttggtatgttgtattttcattttcactcatcttaaaagtattttctgacttctcctgtgatttcttctttgacctattggttaagattttgttgtttaattttctcatatttgtgacttgcccaaatttcttctgttgttaatttttaatttatttattttcccaaattactttattaatttatttctttcaataaatcctaaattttcttcaaagtaaagatactttgatcttaatccttttaaatctattaaggcttatattatggcctagcatcgagtctattgtggagaatgttccacatgtactatagaagaatgtaattctcttgttgttgggtggagtgttttatacatatctgtgaggtctagttggtttgagtgctgttcaagacttctctttccatgttgattttccacctagttgtttcatccattactgaaagtcgactattgaagtctcaatattattgttgaattgtctatgtctcccttcagttctgtccgtttttgcttcatgtagttttgagctctgttgttaggttctcatgtgtttataattgcttcatcttcttgatggactgttttatcattataaaatacccctctttgtctctggtaacaatttttgtcttaaagtccattttgtctgctattggtatgccactctagctctcaggcttgccgtttgcatggaatttcctttttgtctttttccttttaaactctttgtatttttgagactaaagtgtgtctcctattaacaacatatagttagatcttgttttgttgcttttatccagtttcacaatctctgccttttgattatttaatccattctcatatgatgttattattgatatgcctggatttacatctatcattttgccatgtgtgtgtgtgtgtgtgtgtgtgtgtgtgtgtgtgtacatgcacaaaaaatacaaagaggaacaaaacagtaattatatgtatgtgtgtgactgttttgttcctctgttcctcctttatttgaaaatttatttttgtaaatggtctgaggtagaggttgaagtctaggttgttagctaactatcctagcactctttttaaaaattgtcctcttctactgaattgcaatacctctgtattatatatattattcccatacatagtttgatatatttatgaatttttttttttgagacagagtctggctctattgcccaggctggagtgcaatggtgcaatctcagctcactgcaacctccgcctcctgggttcaagcaattctcctgcctcagcctcccaagtagctgggactacaggcacgtgccaccatgcccagctaatttttgtatttttagtagagacggggtttcacaattttggccaggatggtttcgatctcttgactttgtcatccacccgcctcggcctcccaaagtgttgggattacaggtgtgagccaccacacccggcctttgtttatgaaatttctattatgttctactcatgtatcagtcttctcttgtgtcaacatctgttgttttatctcagtgatttaatgataaatttcaatatctggtatagtaagttcctctttattttccttcttttcaaatgattgttcatgtgagttttgacattcaaaagaaaatactatttgtaatccttttaaaacttcatgaaatgcatgtgtgcatgcacacacacatacacatacatatacatatgcatatatttaccatctagtagcgatatgtgagaatctgggcaattcatttaaagtaaaaattcataaatagtaatattgcacattaaaatgaaacacaacaggatgatttatgttacttttacctaattattgttttctttgcagagtggatactatggaaaacagcgccatcaagatattaagagagagagtgatttcacgaaaaagtgaccttactcgtgctttccaacttcaagaccacagaaaatcaggtaacaaatttgcataacatttaccatttcttaacacaccaagttacatacagatcacttttcattttccttgcttccttaggatttcagttctccatttttactaagaaggaagaatagagataaaaataaaatataatccattatttgctcaaaaaaggcatatttctcccttttagcaagctattttcaacttggaaaactaacaacaaccctgaattaaacttttttttttttttttttgagacagagtcttgttctgttgcccaggctggagtgcagtggcgtgacctcagctcactatgacctccacctcctgggtttaagcaattctcctgcctcagcctcctaagtagctaggattataggcatacaccaccacgcccagctaatttttgtatttttagtagagatgggatttcaccatgttgttcaggctggtcttaaactcctgacctcatgatccgtccgccttggccttccaaagtgctgggattacaggcgtgagccacccggccctaaacctctattctgatagtatgctagactagatgttctggagggccttcttattaacaaacagctagattttggaggatgtagaatgttaatgcatttaccagcctcacagtaacgtgaatcttccagctgcatcttcactttccgtgaaagatgatttgaaaccacatgtgagagcatggagcaacaagaaagcacaaaagactagattttcctggggcccaatgctgatattggtatagcaatcaattctgagactaaattataatatagtaggaagatggaaaagctgaatttgagacttccatcatcatgcttggaccctcaaagtggctaaagttgtcctaagtctgtaatgctccctgactcctggcaagcaaatgcaaatttatctttgagggaagcatccctaattttggccactcacgtatccagagattaagatcaactcacatgagatcacaatcaaaaattaccaaacaaacaaggatacaaactaccatgagtgagagtcagcagaaacaacaattatttccccgaggacatcaaatattggaattagcaaataaatatgttcaaaggaaatatggaaccagaaacatgcatttgggaatgatttgaagaaaaaccaaagagatagaaaatatgcttgttaaaaaaagtaaaagcataatgaatgggttaaacggaagattagacgctactcaagaaagaattagtttaggagttataaacaggccaggcgcagtggctcatgcctgtaatcccagcaccttgggagattgaggcgggcagatcacatgaggtcaggagtttgaaaccagcctggccaacatggtgaaaccccacctctactaaaaatacaaaaaaaaacaaaaaattagccagccatggtggcaggcacctgtaatcccagttacttgggaggctgagacaggagaattgcttgaacccaggaggcagaggttgcagtgacccgagaccgcaccattgcactccagcctgggtgacaagagtgaaactctgtctcaaacaaacaaaaaaagagttatgaacaataaaatgagaagttgaacatacacctactcagagtactgggaggagagaatagaatgtaagagaccatatatttgacatggtaatggctaagacatttccagaattgataaaagactcaaattcataaagaggaacagtgattctcaagtagaataaatgaagttaaatccagacctacacacatttgttgtgaaactccagagcaccagtagcaaagaaaaaatctttaaaaagcaggcagagaggaaacacatattgctacaaagagataacgattagactgatagatttctcaacagttgcaaaattagaccatagaatcatatacaccaaacattggaaattaaatttagaaaaacatataccatgaaaacactaacaaaaacaaagctaagacagctttattagtatcaggcaaagtagactctaaggaagtatatattactagaaataaaaaaggacatttcataatgataaaatattaattatgccaattgaatccattctaaatgtgtatgtacttattcatatagcttcaaaactattcaaaacaaaaattgacagaataaaaagtagaagtagaaaaatctaccacgatagagggaggttttaatactcctctctcaggaactaaaagaacaaacagataaaagattagcagactctttttttttttttttgagatggagtcttgctctgtcgcccaggctggagtgcagtagcatgatctcggctcactgcaacctccgcctcccgggttcaagcaattctcctgcctcagcctcccgagtagctgggactacaggcgtgtgccaccacgcccagctaattttttgtatttttagtagaggtggggtttcactgtgttagccagaatggtgttggtctcctgacctcgtgatccacccgccttggcctcccaaagtgctgggattacaagcgtgagccaccgcgcctggccagcaaacttttttcttaaaagactacatagaactctgtacccaaatttcagaatgcatattcttatcaagcacaaatggaccatttacaaaaagtgaccacacactggaacataaagtgaatctcaataggttttgaagaattggaaacattacagaataaagtctctgacatatacaactccgtaacataagatagtaataaaatcaccctttggcttggaaatgagaaatatacttagaaataatccttggctccggccagacgtggtggctcatgcctgtaatcccagcattttgggaggccgaggagggtggatcacgaggtcaggagatggagaccatcctggctaacacagtgaaaccccgtctctactaaaaatacaaaaaattagccaggcgtggtggcgggcgcctgtagtcccagctactcgggaggctgaggcaggagaatggcatgaacccaggaggcgcagcttgcagtgagccgagattgcgccactgcactccagactgggagagagagcgagactctgtctcaaaaaaaaaaaaaaaaaagaaataatccttggctcaaagagaatcacaatggaaattagattgctgaaactgaatgacaatgaaaatacaatgtattagaatttatgggatgcaaattagagaggcattgatgataaccttaaatgtaaaagatatgattaacaaagtaaaaaaaaaaatttgtttttgttttgttttgttttgagatggagtctccctcagtcacccaggctggagtgcagtggcacgatcttggctcattgcaacctccgcctaccaggttaaagcaattcttctgcttcagcctccccaagtagctgggactacaggcatatgccaccacgcccagctaattatttttgtatttttagtggagacaaggtttcatcatgttagccaggctggtctgcaactcttggccttaggtgatccacctgccttggccccccaaagtgctgtgattacaggcatgagccactgtgcccggccaaaaaatggttctttgagggaactgttgaagttgacgaaaccatggcgagagagagagagagagagagagagagagagagagagagagagagaaaacaaataaccagtgcaagtgtagggaggagctgctgtctaaggctgagagagaggacccaaggaaggaaaaacttggaagggaccccctactcccaatcaagagatgagatcaagccctcattggtgaggatgtggctatggtccactggatagggcagaagttcactgaggtgcctcaagttacagttgggtctccggctggtgggccaggactggagaggatggagccacccactgaggtgccagcaagactctctttgggctgtgcaccaccgcgtctcccacacactaatggtgaggaagccatgggctgtggtgtcagtgaaatttactagaaggtgggtgccactacattttccacacatgctaaccgtgcggtgctgtagaaacaagaagcaaggcacaccagaaccagaaagaaaagctttttcttttgctgttctttgcagtgttcttcctgcactgtctactaacagagactaacgttatacgagctgccaaagaggaaatgattacagggtccagctctagtatcacaaaatgtgcaaaaaaaaaaaaaagactagttttggagctaagtaggaataaattgatagctggggtagccagcaattagcttttagataacaaaaatcttaaaagataccattcacaatagataatcaagtactgtgggagaaacctaatgaatgaggtatgagatttctttttttttttttgagacggagtcttgctctgtcgcccaggctggagtgcagtggcacgatcttggttcactgcaagctctgcctcctgggtccatgccattctcctgcctcagcctcccaagtagctgggactacaggcgcccgccaccatgcctggctaattttttgtatttttagtagagacgggggaggtatgagatttctaagatattattaagataaaggggactgaaataaatgggtgggtattactgtgttcaaggactataagggttgaagttgtcaagatacaaattcctcccaaattgagctatagtttcaatgcaatctcagtcaaaatcccaaggtggggatttttcagtagatcttgagaatctgtatctaaaagtcatgtggaattacaaaaggccccaaatagccaagatgttcctgaagaaaaagaacaaggtgggaagactttccctattatatatcaagatctattataaaagtacagtaattagaatggtatgcaattggcacaagaatacccatatagacaatggaagcaagtagagaatcctgaaacagattcatgcatatatagacacttgaaggtcccactgctgagcagtgggcaaaggagtcttttcaataaacgatgctgggccaaatggatatccctataaaaatagaaacagcctatatgtaataaagatatttgtgttttgaaaaattacatatattaggaggaaaagaatattagttgtgaaatgacaggtgaataatacatcttttattctttgtattcttttgtgtttttcaaatcttctataataagcaaacctaggccgcgcatggtggctcacacctgtaatcccagcactttgggaggctgaggtgggcagatgacttgaggtcaggagttcaagaccagcctggccaacatggtgaaactctatctctactaaaagtacaaaaaaattagccgggtatggtggcgtacacctgtaatcccagatacttgggaggctgaggcaggagaatcacttgaacccaggaggcggaggttgcagtgagctcagatggcaccactgcactccagcctgggtgaaaagagccagactccttctcaaaaaaaaaaataaataaataaataagtaagcataccttactttgttaatcaaaaaaaaggaaaaaaaaaatctaacacgtgaagtctgatttcttacaggtgacaggaaggacacgatctgtggaacactgaagatatccttgagttagttctccttcagggctgcagggcctgggaggataaattatgagggagagcagctggccccatgctgccctggctctcccaaggaggttgcattctttaaaatcatattttaacaaatcatttgggctttgttattgttgttgttaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggcaagtgaaacatagccccagctaaaacctagccagggtgaaacataacttagtcctttgaaaagctgggagtggccgggcacagtggctcacgcctgtaatcccagcactttcggaggccaaggcgggcagatcccgaggtcaggagttcgagaccagcctgaccaacatggtgaagccccgtctctaccaaaaatacaaaaatcagccgggtgtggtcgtgcccacctgtaatcccagctactcaagaggctgaggcaggagaattgcttgaacccaggaggcggaggttgcagcgagccaggatcgcaccattgcactccagcctgggtgacagagcgagactccatctcaaaaaaagagaagctgggagtgggataatctaatagatggagtggcagtcttaggaaaagccgaaggggaatctcccaggtacactgtggtctgttcagcaaatttgtgtgttcccaggataagcaaaaagaaaaaagaaaaagcttccacaagcaagtccacatcaaatactggatttttttttgtaagtgctgtctagcagaaggggagatatgacatccatgctttttgtttgttttttgaggtggagtctcgctctgttgcccaggctggagtgcagtggtgcagtctcggctcactgcaacctctgcctgccacgctcaagtgactctcctgtctcagcttcccaagtagctgagattacaggcgcctgccaccatacccagctaatttttatatttttagtggagatggggtttcaccatgttgaccaggctggtcttgaactcttgacctcaagtgatctgcccacctcggcctcccaaagtgctgggattacaggcatgagcccctgtgcctggcctgacatccatgcttttatacaacataccatttctaatacttaatgtattgcttgttaagcctgagtgtacagacttgctgacatgacccagaatatgtctgaaagagttttgaaatgtagaaatcttttcttagaatgtgaatatcagggagatttatcagatccccatacttattagttaacaattcatcagcagttaaatatgacattgagctgaaaaggagctggttggagctaggacttgggtgatcatttgcagtgaagatgagacgttaagagcagagagaagggaagtaaaggtaggttagagactaaagtatccccaggaaggaggcttttgacgtcacttcagaggcagtttaccatggtgactaagatcacaggccttggcttcaggcagccgagatttaaatcccactcaccagctctgtgacccttgggaaagttcctttatctccctgttttcaaatttgtaaaatggacataataatagttctgttcttgttcattcttgttgtagaggaccgaatgaaataatccacataaagttctctgtaaatggtggctgtgttagttactgctgccttattcattttggccctgtcccctgaggatcacagactgaatgaagagggtggggcctccaagggaagtctggccttctcagatttctgtctaaatcacatcatttcaattgttgatgatgttttctgtttgttacatttgctaaaagcgatcagtgtcatgaattcaatatgttctaacacttagaaaatctttattttaggctcattctactctagttgaaactctgtacagatacagatctgacctggaaatcatatttaatgccattgacactgatcactcaggtaaataaatgaacttggatgagtccatttaaaaagtgtatgtgtgtgtgtatgttggggatacaaaatgagtacactttgattgagccctataattaatatggtttgacaccttcattggtaagatggaggccttgcttatgcatactgttaaatgaaaattgtaggagcccattgttttggactaagctccttcaccaggccccaacagactagactaaaagtcaaaatggggtagcagtagtagaaagcaaaggctaatctggttctctgaaatcagaactctgattttatctattttgttcttcatctaacatgatgaaacttgaggggaaaaagaaactcatttaatattattgttatttcagtttggctgcagactctgtattcaagaccatagagtcctacagaagcctaggtagccatcagtcaaactgaaataactttttataaatcaccagcacaaatgaaaagatgatttactatccatttcagtatcttagttactcatggccataaaaatcattcctagaaatctgattctgttttggggagtaagggctatgaaaagtcattttctgcttttttttttttttttttttttttttttgcgacagagttttgctcttgttgcccaggctggagtgcaatggcgggatctcagctcaccacaacctctgcctcccgggttcaagcaattctcctgcctcagcctcctgagtagctgggattacaggcatgcgccaccacaccctgataatttttatttttagtagagatggggttctccatgttggtcaggctggtctcgaactcccgacctcagatgacctgcccacctcagcctcccaaagtgctgggattacaggcgtgagccactgcgcccggccttctgcctttagctttgatgcacaattacttattttcaaatttttaaaaactcatcagataatcccctaatgcagagacctttgaacaccgaaaaaaaaaaaaaatcaatgatcaacacattaaagtaaatgattgcctgtgaaaaaggcagcaccattgtttgtaatcctcttattgactcccaccgtatcttctccctctgctttgatgtcatcctcctctctgccctccttccatgcacctcacctttctattttaggtcttgtaatttctataccacatttagtcccatagtccacaaccccgtccccatttcttcactgtttgctcattctggctttagaataagttcaggatcccttggtagttgaaagtgagatattgtttcttacatttatgatcttactcttccatatccttcagtatcttcatgattaggcagtttagtgagtttctaactggggctatttaatcagtgtgggttccccaacccttgccttaggtgggtcttaaaatgaacactcacaaccttctcctatattcttttaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaactgt

SEQ ID NO: 3166 - DNA, 136993 bp, human; identical to SEQ ID NO: 3165

SEQ ID NO: 3167 - DNA, 136993 bp, human; identical to SEQ ID NO: 3165

SEQ ID NO: 3168 - DNA, 120033 bp, human
ttagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatgtgagtactgggaatgtgcctgtggttatgaatgaaaaggggaaaatgagctgccctcaccctcttctcctttctcatttactcccacgatgctcaagctgccctgtgtgatttgcacaaggcatcgttagagtagcataggaaactacatttaggaagatgtagctttgaatttatgaagtaccataaagtattgtcttagagatattttgtgtttgatttaatttcattcgataatgtaccaatataaaatctcaatttaaaactcagtggcagggaacaagaaaggcagtgtaatttatatgtgtttcttcaatacttttataaatagctatatccctacttttgtgacatttagtagcatcattgaatttttattggattttataactcaatgatcacattatttctatatctattcaacacagaacttcatgagatttgcatcacgttttaaaaataatctaggagaattgggagaatgctagatcatctgtttccaaaaaaaaggtgtattgtttctaaatagatggcatgcctttctgtacccccatataattagaagcttaaatattcactttgtttattttgtactgaggttctttctcatggctattggcatctagttgaaacaaacttgagcatttaagggatagagtttccaacaagcaaattaaaataaaaacaagtaaataagctgggacaattaatatgagtaatttgctcttaaactccacttctttgatgtctaggttataggtaattcccccaacttctattccacgtcttgcctttggaagtttattcaggcttaaggtggagggtttaggatgcagagtgtgctatactaattagcgtgggatgttttactttgggaatcaaatgttattctcctacccagctgacttgtgctgatgatgtaggaaactcatctctgaaagtaggaagggacataggaggtgtactgactctttcaaatctttaagcatgtcatgaaataaatctttcaaaagctccatctgaactctactgctgtagtagacgtttattagcagagagtaaagagaaattatctttttatatctaggattactcacagttctttaaatttagccaaatttcctaggttaaaaaaaaaaaagccaagtccaacttgtaaaaacaaatcctctctctttttgaaatacttttcaacttttaaaacattgcatgtaagtggaaatattagcttagatttttggattgctttttctttcaaatacctgtgatttattgaggtgaaattcacgtaacataaaattagccattgtcaagtgaacaactcagcagcagttggtatgttcacagtgtcgtgcaaccacaacccctatgtacttctgagacatttccaacactccaaagtaaaaccccttatccattaagcactttctcctctcagcccctggcaaccacaaatctatattcagtctctatggatttatctattctggacatttcatgtaaatggagtcatatattatgtgaccttttgtgtctggctttgtccatgttgtagcatgtatcagtactatattcctttttattgtggaataatatttcattgtatgaatatgccacattgtatttatccattcatcaattgatagacatttggattgtttcagctttgttttttgttttttgttttttttgagacagtcttgctctgtcacccaggctggagtgcagtggggcgatctcggctcgctgcaacctccgcctcccaggttcaagcgattctcctgcctcagcctctggagtagctgggattacaggcacacaccaccacacctagctaatttttgtatttttggtagagacagggtttcaccatgttggccaggctggtctcgaactcctgacctcaggtgatctgcccgcctcggcctcccaaagcgctaggattacaggcgtgagccactgtgcccgacctgtttcagctttttgactgttatgaacaatgctgctgtgaacatatgttttccgttctcttgggtatatacctagaagtggaattgctgggtcatacggtagctttatgtttaacattttgagaaatttccaagctgttttcccaagtgactgcaccattctacattcctaccagcagtgtataaaggtttcaatttctccacattttcagcgatagttgttattgtctgtccttttgattttagtcatcctagtgggtatgaagtggtatcacaccatggttttcatttgtatttcagtagtgactaatgacattgagcatcttttcatgtgtttattggctatttgtatatctgctttggagaaatgtctattcagatcatttacccatttttaattgaattatttatttttatattgttgtaagataaatttatatattctagatacaagtttcctatcaaatatgtgacttgcaaatattttctctcatttgttgaattctcttcatcctttcttaatggtgttctttgaagcacaaaagtttttacttttgatgaagttcactttattttttctttggttgcttgtgattttggtgtcatatctaagaatccattcccgagtccaaaaagatttttgctcacgtcttactttaagagttttgtaacaactcaacaagaaaaaaaagataactccattaaaaagtgggcaaaggtcatgaacagacattttttcaaaagaaggcatacaaatggctaacaaacacacgaaaaaaatgctcaacatcactaatcatcaggtaaatgcaaattgaaaccataatgagataccaccttacataccggtcagaatggctattactaaaaagtcaaaaaataagagatgtaggcaaggatgtagggaaaagggaatgtttatcactgctggtgggaatgtaaattagtacaacctctgtggaaaacattatggagatttctcaaagaactaaaaatagagctaccaaactaccatttcatccagcaatcccaccacggagtctacccaaaggaagtcattatatcaaatagatatctacactcttatgtttaccgcagcactatttacaatagcaaagatatggaatcaccgtaagtgtttttcaatggatgattgggtaaagaaaatgtgtggtgtatgtatatgtaagtgtgtgtgtgtgtatatatgtgtgtgtgtgtatgtgtgtgtatatatacgtatatatgtatgtatgtgtgtgcatatatatatgtatatatatgtgtgtgtgtgtgtatatatatatatatgcatgccatggaatactactcagccataaaaaagaatgaaatcatgtcttttgcagcaacatggatggaacaagaagccattatcctaagtgaaattactcaaaaaacagaaagtcaaataccccatgttctcacttaaaagtgggagctaaataatgtatacatatgggcatccagaatacaataatagacactggagactcagaaagctgggagggtgggaggggggtgaggtatgagaaattacctaatgagtacaatgtatgctacttgggtaatggttacgctaaaagcccagacttcattatacatgtaacaaaattacacttataccccctaaatatatatgtttttaaaggccaaaaaaagttttgtacttttagctcttacttttaggcatttgaaccattttgagttgctgattttcacgtatggtgtgaggtaggagtacaaattcattttttgcatgtggatatccagttgtctcagcactgtttgttgaaaagattgttctttccccattgaatcctcttagcaccattgtcaaaaatcaattgaccataaatgtttatttctgggctctcaattctattccagtgatctgtatgtctttcttatgccagtaccagtgtctggattactatagctttttttttttttttttgagacggagtcttactcttgtagcccaggctggagtgcaatggcacaatctcagctcactgcaacctccgcctcccaggttcaagtgactctcctgcctcagcctccggagtagctgggattacaggcacaaaccaccacatctggctaatttttgtatttttggtagagacggggtttcaccatgttggccaggctggtctgaactcctgaccttgtgatccgcccgccttggcctcccaaagtgctgggattacaggcataagccaccacgccaggcctactatagctttttttaataaagttttgaaattgggaagtatgaattcttcaactttgtttctctttttcaagattattttggctattctgggtcccttacatttccatatgaattttagaatcaatgtgtcagtgtctcaaaagaagccaagtggaatgttgagaggggttgtgttgaatctgtagatcaatttggggagtattgctatattaacaattaaataatctgatccatgaacatgggatgtctttccatctatttagatctttaatttctttcaccagtgtcttgtagtgttcagagtataagttttacacttctttccttaaatttaacctaggttttttattctttttgatgatattatacatggatttttgttaatttcatttttggattgtttattgcaaatgtttaaaaattgatttttgtatattggtcttatatcccaaaactttactgaactcattagctctaataggtttttagtggatattttaggaatttttatttacaaaccaggtcatctgcaaatatagttttacttgtttctttccaatgccttttgtttcattttcttgcctccactacaatgtcaaatagaaatgcaagagtagccatccttgtcttgttcctgatcttaagggagaaacattcagtgtttcaccagtaagtcttatatcagctgtgtctttttcatagatgctctttctcaggttgagaaaacacactcctattcctagtttattgatttttttattattacaaagtggtgtttaattttgtcaaatgctttctctgcatgtattgagatgatcttgtggtttttgtcctttattttatgatatggcatataatgttaattaaatggcacattatgttaattgatgttaagccaacttcgcattcctaggataaatccccttgatcatggtgtataatgctttttatatgctgctgaattcagtttgctggtattttgtagaggaatcttgcaactatattcataagagatactgatctatagttttcttgtgatatctttgtctgatttaactgtcagggtaatattggcctcatagaatgagttggaaagtgttcccttctcctccattttttggaagagttcatgaagaattggtattaattctttaaatatttggtagaattcatcagtgaagctatctgggcatgaggttttctttgtgcgtagtttttttgattacttattctgtctcttgttatatgactatttagattttctattccttcttgagtcatttgtggtagttctaggaatttgcccatttcatctacattatctaatttgttgacatatacttgttcagagtattcccttaaaattcttttttttttttttttttctttactgctccattgctccttatggagcagggcaaacccatatggagtgcgtccagaagagccatttaaaattctttttcttcttttatctcttgttggatatgccaatcaaggtttattatgagttcataataataaatctgctgaaagctgatgcagtgatgtttacttatatttattcatagacaaacattgtgtgcataaaattttctctcattcagatatttggaaaaaatatagaaaagcagttgaaaataatgaatactccctcatcattccactacccagagataatgacaacattctgataatttccttcaatgtattttttgtatattatagatttctgatcatcctaaatgttagttttttgtagcctcactttcagcactaaaatgttatgtaaacatttctcaagttgttataaatgctttgcaaacatcattttagtcattgctaagtattttatttggtgaataggccataatatgcttaattattcttcaaatattggaccttttaatactaatataaataacactttgaagaatttctttgtgcaaagccttttccttattttggattatttctatattcaggtgattagatatgaaattatcgtgtcaagggctataaatattttgaaagctcttgatagaaaatgatagatattatttcctgattactaaccatattccaaagagtgttcaacataatctacatatgttttatctaatccttgtaataaacctgaataaagggttattattcctgtttgtatagtggaagcagctcatgctcagtgtggtacttggtaagtttgtttttcgtttttttgttttttttttttgagatggaatctcactctgtcgcctgggctggagcgcagtggcgtgatctcggctcactgcacccttcacctcccgggttcaagtgattctcctgcctcagcctcctgagtagctgggattacaggcgcccaccactatgcccagctaattttttgtatttttagtagaggcggggcttcaccatgttggccaggctggtcttgaactcctgaccttatggttcgcccgcctcggcctcccaaagtgctgggattataggcgtgagccaccgtgcccagcctacttggtaagtttatgcagcttacagctggcagagttgggatttgaattcaaggagttttgatgacaaagtattttttgctgtcacccattacaccattttatgccacctctgaatgttgctgcttcagaagctagctttaattaaatttacttatatacagtaccttgtatttgcatagtgcttttcaagttggccaggccctgtaacatacgtttgatcctcacagccttttgaagggttgttctcagtttgcagaaaaggaaatgaggctttgaaaggcaaagtgattgcctcaagggaacacagcaagtcacagagccaaggctcgtgcttgattcctgtttccactggtctgactagtgttaagggttttttgtcctgctaggtcgttccacctgaccacagtactctgcctctggagtatcacggcagtttgagaaagcgtaacctacatataaaatcgaggctattccctttcttgtgctctacccagcttccatgtagagaagtagcatcgggccaggcgcggtgactcacgcctgtaatcccaacactttgagaggcgggtgaatcacttgagcccaggagtttgaggttgcagtgagctatgattatgccactgcactccagccaggaccaccactgagtgagaccctgactcttaaaagaagaaaaagaccaggcacagtggctcacacctgtaatcccagcactttgagaggctgaggtgggtggatcacttgaggtcaggagttcaagaccagcctggtcaacatggtgagacactgtctctactaaaaatagaaaaattagctgggcgtgacggcacatgcctgtaatcccagttacttgggaggctgaggcaggagaattgcctgaacctgggaggcagacaggttgcagtgagccaagatcatgccactgcactccagcctgggcaacagagtgagactccatctcaaaaaaaaaagtaacatcaattttatattgtcattgttattttatttcttttgtgatatgtagcaggtaagagaggactaataatagctatcatttattgagtgcctgctactctcattatttcttaccaaaactcttaaagctttgattagtctccctcgttttataaatgaggaaagtgagacttaactgccccaagttacacactcatgggtggcagagcctgaattggaaccagatctggcagattccaaagttcatggcccttctgatatgctaccctgacttggagaattggaatttatccacataacagaaattaaacattgcaatttcattctcctgaatttcacttgacacttaaaattttatgttaatggtatttcaattaataatctattgcctttttgttcccatggagcactttggaaacactgatatattttatttcttcccttgagaccacttagaaatgtatttattcaatttctgtaagtgctaagaggccgacaaagacaatccgtgcttttttggctttgtggtttgatgcgtaagctgtgacaaatagaagtttctctaaaggaaattgttcctttcaaaagtactcattctttattttatatgaaaaaaacttaaaaatactgaatagcaaactaaatatttctttaattcttggtaaaacatctagttaatttagctgtttaaaaatcaaacaatcgccaggcgcggtggctcacgcctgtaatcccagcactttgggaggccgaggcgggtgaatcacgaggtcaggagattgagaccatcctggctaacacggtgcaaccccatctttactaaaaatacaaaaaattagcagggcgtggtggcgggcgcctgtagtcccagctcctcgggaggctgaggaaggtgaatggcgtgaacccaggaggcggagcttgcagtgagccaagatcacaccactgcactacagcctgggcgagagagcgagacaccatctcaaaaaaaaaaaaaaaaaaaaaaatcgaacaatcaagccattcacagctgcttgagagcccccctcccggctctccatccccatctccttactcccaatttgaagtcctttactgtgatgtatatttcagtttgagaccttcatggaaaaataacaaatgaaaatctttcatctttggtgttccctaaagaattttctccaagtttagagggcctcttgccattctccttgctattgtttgtcagagggttctaggttatcatagccatcaagcagtctttactgccaccgtagggtatattgaaaatccctgtgaactcggaccgtcctcattttcctcctcaatgaactgcagacagagaagatgctctttcaagtccattgtccctctaagactatccgtatgctctgtagctgtgggaggggtaggtaggggagggcattgattttccttctgcctctcctgctcattccgctagctattgctcatcagcatcttgacatgctcggtgactttcctctttttttcctttttccttttttttttttttggtttgtatatatatatatatttttttctcaagccattttgttttgcttttgttttcctccccaaatatttttgaaaattgcaaacctacagagaagatgaaagaatagtacataaacacccgtttgaaataatttgaaaataagctgtagacattatggaattaacctctacgtacttcagcatgcatctactaaaagagggatattctcttatataactacaatactagatcaccctgaagaaatttaacattgatagtgtaacattatctaacatgtagtccatattcagaatttcccagttgtccaaaattgccctttgtaactgttctttccttccctttaaaataagtcttctctggccctctcatcccctccagttcctctcgtctctctcctccccttcaagctcgctccttaggggtgcatttgtacccgctgtctcctacctcctctttgatcccagcccagggaagatgatctgacaggttcttgaatgacctcgaagtccaatggagcattttcagtgctgattttgctcacttcctggcagtctttggcactcctgcccactcccttcttactactcattgcccttggcttcaggggcaacacattctcctggtttttcttttaggtctctgcatgaactatttatgtggactctactttctcctggcttttaaatgttggggctcctctgggttccccttggctctctggttttgtcactctaacactctccttggatgctttttctagtccatggctttgacatcagtgtgtcaagactccaaatctttattttcagcccacatcatatgctctaatccctgttttattgggaatcattttaaataagtacttttctttgtaaaaggagaccattttcttcatctgaaatcatgattcctctcactaccaattcttaggtaatagtcaccgtttgatatgataatgtgttggcctggaggtttgtataggattggtactacaaacacatttaatgcctgtatgaaacagacaaaacaaaacaaacccatcccaacaacctttttattctttacaccaattaaatacatcttcatctttttatttgctgtgtgattaatttacctttgctttaaaaatttcaagtattttgagactctgataggggctatttagatatccattttagaatcgtgaacctttagaaggcagaaaggccaggtgtagtagccatgtctgtaatcccagcactttgggaggctgaggcgggaggatcacttgaggctaggagtttgaaaccagcctgggcaacatagcaatacctcgtctctaccaaaggaaaaaaaaaatagctggacatggtggctcgcacctgtagtcccagctacataggaggctgaggcagaggatcacttgagcccaggaggatcacttgagcccaggaggtggaggctgcagtgaaccatgatcgtaccactgcactccagcccgggcaacagagcaagacattgtctcaaaaaagaaaaaacaaaaacacacacacaacacaacacaaaacccaaagagagcagaaccacctctttgtttaaatgatttttactggcttccagctttactaggaaattcacaaagaagccagctttccagttgggtcatgttaattgttaggaaatcttgttacagagagacctattgcaactaagtgcaagaaaggacaatccctcagccccaattgccagttatttcccatattcagaacgcttttcttatatgattatggctttatatttcattagcttttagcagctgcaaaagacaaaaatttaatgcggatcgtatttgaccttggatgaacgaacatggcaatataacacagattagtaattaataacgagggagacataaaacagaatttgcagtcaagatattatttcctgagtgaagattaaaggttattattgaattattgaatagaacacatttcctatgagagactattttaataatttaaaatgataggaattcttttatatagcaaaatttcttttacatacttaagaatacaatagtttttaaaaattaatgtattcataataattcttttggaaaattggcaaaacataatatggtaggaaggttaacagttacttgtaaactattctcttggtctgagtgttttattgagttggcctattattttggtatggtataaatgaagcatcacattttcctgaactagtgatatagccaaggattacaactcatctttttttttttttttttcttttttgacacagggtctcactctgtcacccaggctggagtgcagtggcgccatcaaggctcactgcagcctcaacctcctgggctcaagtgatcctcccacctcaacctcccaagtagctgggactacaggtgtgtgccaccatgcccggttaattgttatagtttttgtagagatggggtttcatcacattgcccaggctggtcgtgaactcctaggctcaagagatctgcccgcctcggcctcccaaagtactaggattacagtcatgagccactgcacccagtccaaggatgacaactcttaaggaacctttcatgagatggctttatgtcatcttcatgttgttccattgccctgttgaatcaaatagggctttaaatgggccatttaaaaatcctaatcctaataaatgtagaagaaatgagttcaaaaatcactgttttgcaaccaccatagaaataattgatttaagcaaaaatcatcaatggatattttggagaacagaatgtatacacagtctcaaagcgtgttcctgcaaactgtttattaattgtaaagaggcaaacacttctacagtagagaagttcacatggacaccaccttacccaagtgatccaagttcgctcagtgataatgagacagatgagcaccacatgccttctgatgtcctaatgcactgagaaagacataccacttatcctgccaaaatacacaacctgaatctcatcacgaggaaaagagcagacagatccagattgagggatgttttacaatcaactggcctgtactgtttgaaaatttcagtgtcattgaagagaaaggcagaggagttgttccagaataaaggagactgaagaaatgacgatggtatatggagagagagagagagagagactagttattaacaattatactatctttactttttcatacatttgaaaatatttcagccgggcgcagtggctcatgcctgtgatcccagcactttgggaagctgaggcgggcagatcacctgagggcaggagttcaagaccagcctggccaacgtgatgaaaccccgtctctactaaaaatacaaaaattagctgggcatggtggcgtgtgcctgtagtctcagctactcgggaagctgaaacaggagaattgcttgaacctgggaggcggaggttgcagtgagccaagatcgcgccactgcactccatcctgggtgacagagtgagactccgtctcaaaaaaaaaacaaaaatttctttcaaaagaaaaaaccctaatcctgtacatcctgagataagtttaccaagtttgtagtggtggcaacctaggcttatgtcctttggtagtaccattttttagccctttcttgtttttgccatctaccaacttcattcattgaagactctccacccactctgagcctcatactgggtatcttcactgtacatgtgaataagccccaaatgctttggtgtctgagttccttgatctcctgagccccagaaaccccctcatctcctcaacttcagctgctcactcccatttactggcccccatggtcacctggaaaagccccacctctggaatcttcatgattatcatcctattctctgattgcttggtcttctttgaaacctctgagccttagatacttcacatgtgtctctatctcccagcctccagttttatatagattttgggaatacaggtgcatttttattacatggatatactgcgtggtggtgaagtctgagccagccctctcttgtcttccctttcttccccatccatcttccctccatcttttgttggctgtcacttgaaccagttaacagatcatacaccttagtcatattttaggcagttaaaaaaactaatgtgtgaaatgtttagtgttcccaaaccaattgctagcaaactttggctacaattccttgatggaaaagccagagatattagtaacttgtatttttctacagggatgattccgattgattgatttattttcaaatagcctttagaatttgtctcctttgtccagaagtttctggtttgagtgttcagttttgcacatcatatcgtgcccttggatggttattttcagcttttctatgtacagtgataggtgggctgcagcaatggcactaaaaacaagtagatggatgagttagagtatttggtaactggaaagaatcttagagatcacacagtccaaagttctcattgtttacatgagaaactgaggacctcggagtttcgttgatttgcctgaggttacttagctggcaactgggtaagtcagggcccaaatggaagtatctcaatgacaaagtcagaacttatttttattaccccatgtggatggggttggtgggtacgagagtaagtacatagaatgttgtagaaatgacctgttattctcgctcttgtctcactggaaggccagaggttcctgagaatgacacaattatgatctcttttgtcccttagggaaagtgatagttgtgtttcaaatgcctgacattgtttggagactggacttcacactttactctcttctttcagaaaagtgtctcccagggacaaggcctctgtgttgtggccttgctctgcagggctgccagagtttgtggctgagcgagcctcataaggtgtctgccttgcttgctgcccaacaagcaggctttgtgtctgtctcatgttcactgggcatgtgctttgagctgtttttccagtgaagtcagaagtctcactgggacagccgcacattctggcagatggcagatatagaaaatctgtaaacaaaaataacagtaatgaagactgtggtcctaggccagagttcagccatatcctcttctcatcatgctttgaacagctgaggttatagatgcttctcctcttcgcttaaagccttttgctattagaggattcattttctttccagttcattcgaattcattttaatcagctgtgtcgcacttgtgcctgggtctcttcttgcctggaggccaggccccttaaaggtacattaaatattcgctaatcctgctgcttcctcaggattcctctgccagaagaatttcaaaagcagagagcctttaaataccttatcattctgaatatgaaatgtcttgtttgaagaactatctgtcaaataaactcctatttaaaaaccaaaaccaaaccaaacataaagactctaccagccagcacaaagagaaatgtaagacacaaagtcttaactaaacagtcatttcatttgttcaacaaatatttattcctgctatgttccagagactattccaggctcaggaaatacagcagctaactcaacagatcaaaatcccagctcttatggagattacattctagtggaaagacacagacaatgacaaagaagtaaatatcacatggtgataagtgctatggagaaaaaataaggaaggagataggcgatgaggggagaggagaccatgtaagaaggggtggtcaggaaaggcctcccgcaaaggtgatgtctgagcaaaagctgcaggctctaactgcatgcacctcagttggccgggctcttcttgctctaggctgttgtgttcggagatggtagcctgtttgtccacagtaatttgtgaattttttttttttttgtgacggagtctcgctctgtcgcccaggctagagtgcagtggtgtgatctcggctcacggcaacctccgtctcccaggttcaagcaattgtcctgcctcagcctcccaagtagctgggattacaggtgcccaccaccatgcccggctaatttttctatttttagtagagacgaggttttgccttgttggccaggctgctctcaaactcctgatctcaggtaatccacctgcttcggcctcccaaagtgctggggttacaggcgtgagccaccatgtgcagtcataatttgtgaaatttctaatgaaatattatgtataattaggaagtctttgggacttaactggaatttgttagcctggagagagacaatttttaaaaaagtatctcccatttatcgagtgcttcctatatgacaggcaatatgctaagcattttatatgaatcaattaatatattactaatacctatgtcaacagattactaatacagtattatgtattattacaacacccctagaaggtgttcattcattcattcaatcattcattcaacaaatatataatacatttccaggccttgccccaggtgctgcggatgcagcaatgaaaaaaatgaagttcctagctaataggggaaaatggacaataaacccatacacatataactgtagacaatgtcagatgctcaagagtgctacagagaacagtagaacaggtaaagagatagggaatgtgagcgggagaaggtgtgggaggagatgctattctatataccatctgattttttttttttttgagacagagtcttgctctgttgcccaggctggagtgcagtggcatgatcttggctcactgcaacctctgcctcccgggttcaagtgattctcatgccttgtgcctcagcctcccaagtagctgggattacaggcatgcaccaccacgcctggctaattttttgtatttttagtagagacagggtttcgccatgttgcccaggctggtctcaaactcctgagctcaggcaatccacttgccttggcctcccaaagtgctaggattaaagacttgagccattgcgcctggccccgtctcattttttatggctgattccaaatgccatgtatatagcaaaatgaggatgagcccaggttctgaaattacagataactggatttgactctgcattgtccctctgacaagtgacatgaccccagacatgttgtttctgagccccagtttccttatctgtaaaatagggacagtcacacttgagaggattgttagggggaggatgaaatcaaatcacgttgaagtagatgatccacataaagcacgaggcacaatgcctggcacaaagcaatcactctgaattcattatttgtcttgctcactaaccccgtacatgactatttaatttcttgcaagataccatgatagtgattgccaccagagaaaagaatctattaaaacaaaacaaaaaaccagcttggcaatagagaaaccacctactggccacagaaagttggccaggtaacttattgaatctatgctgttgcttctgtctagaaacaaaaatagaagacccttgctacacatgctcctcaatagcatgcatttatttattcattcgttcgttcatttattctgcatggaatcaatgtgaccgggaagagaagccctgttatcagatgaagcagcaggaccagaagtagatctaagctgtccaataagtttagaactggatgacgcagatcttcaactctctgggcagggtggggggttatgggggccagcaacccctcgggtagggtctatcatgcctgcattctaccctttgctattttggaggtttcttctccaggggagggtcctcagctggctagtgctgtcctgtggtggatggggcttaggaattaggtgaggttttggaggtctgatattggtatgcccaaccttgctgggctccttccctctcctggagaggtttccttgggaaatgtatgcccaagggacaacagcaggatgtggatcaaagtccactttattagctgctgcacaagtaccccaaatctcaacgtagagctctaatgacggcgtgcgttggagcctgcaggaagttggaggcttgaggtcttagcaggacctatttttcccacccctctgagatgagctcatcgggcagggtctagtcaggaggcagaaaccacagagtgatttgaacagagagaattgaatgtaaagaactatagcaactgcagggaagttaccaccctagagttgagagaacaaagggaaaagggtggaattattccggttgagaaacttgcaaggagggtcccacagaactgaagcccagacctctgagaagtggtgcactcagctggtgctggtatctccggggctgccatgagactggctttgcaagtgctggatgagctgcaaactggatccgacgactgttacctggggtgaagagcagttgctaggttacactgtcaggaacaggaagcagacaggaaggagtgtgtccctagtccctccctccagccttgcagtctgcctttcccacccctattggcagagcctcacagggggcaactgacaaagctgaaatggggtctgcaaagtcccagcctcagcaccactgtgctgactagggaagggtggggttagagttgagacctgatagcttaataagtggcatgtgtgctcgggtacaggcgtatgagcataggcagagatggctgcttcccaagctggggtggggtggggcagttccgtttcctgactttggagtagaagaggaagtagaagacagaggggaccataggtgtttataaacttcctatgccacagtttacacccctcccagtggaacccagtgaacgtattgtgtgctatatacaaaacagcagctcctcccttggagagtggggtggggatggaagctaggcagagatgggagggggcctagcttgcctctttctccgcatcagggaggagaagtggcagtagatgtcaggtgtccagctagtgccagccacttagtaggcattcaagaaatggtgaatggccaggcgcagtggctcacacctgtaatcccagcattttgggaggctgaggcgggtggatcatgaggtcaggagttcaagaccagcctggccaatatggtgaaaccttgtctctacagaaaatacaaaaattagctgggcgtggtggtgggcgcctgtagtcccagctactggggaggctgaggcagagaattgcttgaatccaggaggcggaggttgcagtgagccgagatcgtggctctgcactccagcctgggctacagacgagactctgactcaaataaataaataaataaataaataaataaataaataaataaatggcggccattattattcaaaggaaggaaaggtacacataggttagggaatgaagtaactgactggagtggaaagagccagaggacctgagttcatactaaataagtgacttggagcaagagactcgcctttctgaactcaaaatttccttatgtgtaacatggagatgatgatgcttgtggggaccaaatgtcttgtaatagacccttaacatatgatagttattttgttctattattacagaaatagtaataagctcagttatttcttttttttttttaatcgaaatggagtcttgctctgtctcccaggctggagtgcagtggcggtgatcttggctcactgcaacctccgtctcctaggttcaagtgatcctcccacctcagcctcccaagtagctgggattacaagcgtgtaccaccgtgcccagctaatttttgtatttttagtaaaggtggggtttcaccatgttagccagtctggtctcaaactcctgacctcaagtgttctgcccacctcggcctcccaaagtgttgggattacaggcgtgagccatcgcacttggccaagcttgtttatttgttattgatgttgctaataccaaatagaagagacttcagtgatcatttattctacaacatcattgtgcagatgaagaagcagaggcacagaaaagatcaatagctctatggaggttaagagcttgggctatggagtcagtcagaccagggttcgaatcctcactgtctatttccacttaccagctaagtgagctttagtgagttcctcagtctctgtcagcttcgcagtgttgtgaggactgcaggactaatcaatgcatggtcctttgtaagtgcctaggaagtggcactggaaaggtaccattgtgcttgtgagtatgagaacccctgaggccagagggtgattcatcatgatagcgactgtcccacagaacaggcctttcaggtgaccctagagcctccatcatggtattgtgagaacacttcagatttcagccatgccactgccaattatttgctttgcaaggttgaagatgtgtgtagggaaaatctttttcccctaaccattttttttctccactctcacaccacagcaatcatcaacacagaagacttctgtgaccaaatgtgtggggacttttctgcacacaccaagcagcagataccagctgggtgtcctctaattcagattctgacattatctacccagagatagtgtcagatcccacaggttgagggctcagtccccaagactgcctacccaccccaccccaacaccagttgcaagttaagacctccagaacttctgactgaccagcttcaagttgggggttcccatgaccccctctttgggttccattattttactagagcagctcacaaaactcagggaaacacttccttacatttactggtttgttataaagggtattacaaaggaaacagataaagagatgcatagggcgaggcaagggggaaggggcaggccaccctcccagaacctccactgtttcgctatccggaagctcactgaacccggttctcttgggtttttatgaaggcttcaagacaacagcatttcttcccctagggcatagagccttaagcccataatgagaaagtcaggggaagattagagccttggggcaggtgaaaggaggacaggaggtcagaggctgcccctgaggcctaacatacccgacatcacaacaaaagactgtatcagggccatggatgaaaacctctctctctctctgtctctctctctctctcgctctctctctctctctatatatatatcttgtattagtttgttttcacactgctgataaagacataaccgagactgggtaatttataaagaaaaagaagtttaatggacttatggttccacatggctggggaggcctcacaatcatggtggaagggaaaaggtacgtcttacatggtggcagacaagaaagaatgagcgccaagtgaaaggggaaaccccttataaaactatcagatctcatgagacttattcactaccaccagaacagtatgggggaaaccgcccccatgatcagttacctcccaccaggtccctcccacaacacgtgggaattttgggggctacaattcaagatgagatttgggtggggacacagccaaatcatttgtatattataacaccacaacatgtcactctatttcttcttcctgtggtttttccctataaagctcatgatacgtgatgttgggtctatttcctggggttttctgaaacctgaataatggaaagagtccctggaacccaagagccttggggaagctaataaattaaccttgcgagacgaccaggtcctgggatattctgtgtactgcagcagtactaaaccagaggatgctgagactgggggctggacccctgctttcagaactcacatcgttcctgttatagtcaactcttattttttatgcaccaactgggaaaaacgatagcatgaataaaaggagccagctggtgttgattgctcttcactctaaaactcgaggaggcataagagactgtattttaaatctcattacctcttacctgatttctttcttcaatatgatgaaactacaaggtggctcaaaggctaccttccccagaagagagacagtctgcctagatagtccacaaacaagacaatacttccagttgccatttacttagcatgtgctttttaccaggcattgggctaaactcttccccttgtaacatctcatttcatcctcatagaaactctgtgagggagggggtgtgtttctttatccacctgcattttatcaatcgaatctcaggtgcagaaggtggtgtgaatcatacgtttccatcagctcattgaacattatcatcattggtctgtgcaagaccccttcttatgttaattagtttattcccttctcttcatgtaccccacgctcattcactcccctataaataaccggtccattatgtgttgtgtgcatctttccctttgtatatgttcttatgaaatgtggttttgtatctatatagttctattgattaaagtagtatttcattctgtctctgactttttaataaccattccaatggaagtactatgtttttaagacctactggttaggttgctatgggtttatttaatctattgcttccagttgtgttgtgctactccgtggtgtgcacccaccaaagatacagattctctttcctagtgataggcagccaggcctatttgtatcaaacttcctattgccacaaagaagcaattgcatccccatatgtctccttgatggactgtgtgagaattgcctttggggtacgtagtgaagaatggaattgctacttcatagggtatacatagattcatagatttactatgcttaagccatgccaaaggtaggtgctgttattattcctattttacagatgaggaaactgaggttttgagagttttaataacttacccaaagtaacatagacggtaattagcagagctaggattcaagttcaggcagtcttactccaaaacttctgttcctaatggctgtgccatcattattctctgagtgtttgagacatgaggacattttataaaaaacataaaagtcaatctcattgtttggtgttttaatattcttagaacctaggaatccaggtggactgctttttttttccactgaagcacctacttctcctaacaggtgcatagtaactgtttttctttgactttcatattctgtgggtctgcagcactgagagctgcgttgatcatccagaactggtaccgaggttacaaagctcgactgaaggccagacaacactatgccctcaccatcttccagtccatcgaatatgctgatgaacaaggccaaatgcaggtctgttttgcaagcttttctcttcttttgataaaatgattctctttaccccttgttattgaaagaatgaaagtttgggtccattttaagctgaggaagcttggtgaaaggctttaatagagcatgtcatgacattgtcttggaactagttattgagagagagtgtgctttgggaaaaggatggtgtttttccgttttgaagttcacatttttaagagggctgcccaacatctggttaactaataaaaatagtcttattctattttggggcagatgccttaataggaaataaagttgtcattttataaaagaaaaaaatacttcaaggggttaaaaaatggcagaatttcctagcaacaaacctctgcaagctctagaagaaaatatacatgggtgaggaaggccttttttttttttttcttcgagacgggatttcactcttgtcacccaggctggagtgcaatggcacggtctcagctcgctgcaatctccgcctcctgggttcaagcgattctcctgcctcagcctcccgagtagctaggattataggcacccaccaccacacccagctaattttgaaatttttagtagagacagggtttcaccatgttggccaggctggtctcgaactcctgacctcaggtaatccatctgccttggcctcccaaagttctggaattacaggcgtgagccaccgcacctggccaaggaaggcctttttaaagaatacataaatctagttttaatgcttattaattttaaaaaagtacttttaacaataaacagatcttagaaagatctccaatatagttgctaatgaaaaaatcaacttttaaaacaatatgtagagtttatctcatttatgtgaaagaacatgaaacatacagcaaaagtctggaaaaagatacacaggaaattgtttacagtagttagttctgaggacaggaatggtattggtgggtgtgggttgggatgttaagagggacttctcatttttatttgaaattatttgtagtttttagcaatcatatatctgtgtatcacattataatatttaaagataattaagaacattccaaaaagaactaagttgctagatttatttttggcagctagaaaaatgatatactgtgattcagtcagatgctccctttgtctagattaggaacctcagcataggctgtctttctaagcactgtagaatatagtgataaatatacaggtagagtgaatcccaaattggtatgctttagacacattccagcaccagtacattattttctattgattctttattgagatgtaattcacatgccatacaattcacccatttaaagtgtgcaattcaatggtttttagtatatgtacagggttgtgcaaacatccccacagtcaattttaggacattttcatttcccgcttcctaaactccgtacccattagcagtcatttccccatttccttcccccagtccctggcaacgactaagctattttctatctctatggatttacctattctggccatttcatataaatggaatcatataatatgtggtctttgatgtctggcttcttttttatttatttatttttttgagacagagtctcgctctgtcgctgggctggagtgcagtggcacgatttcagatcactgcaacctccgcctcccaggttcaaccgattctcctgcctcagcctcctgaatagctgggactacaggcatgtgccaccacgcccagctaatttttgcattttcggtctcccagagtgctgggattacaggcgtgagccactgtgcccggcccagcttcttttacttagcataatgctttcaaggttcacccatgttgtagcacatatcaggacttcattcctttttagttaatattactcattccgaagaatattccattgtatggatggaccacattttggtcatctattcctcaggtgatggatcatttgggttgttccaccttttggctattatgaataatgctgctgtgaacatttgtatgcaagtttttgtgtgaacatatgttttcagttctcttgggtatagacctgtgagtggaatgtcatgtagtaactttgtgcttaactttttgaggagctgctaaactgtgttccaaagcagctccatcgttttaccttcccaccagcagtggatgagggctccaatttcttcacatttttgccaatacttgttattatctctttttgattatagctatcgtagtgggtgtgaagtgatgtctgattgtggtttctattgactgttaatggacaaacccatcatcaacagcattaaaatcatacattttgataactgtatggaaagtcttccttctctcaattcccaactcccagatctactcccagattgataaagtgtttacttttcatgagaggcagggcttgaaaaagaaattatttgtgctgtacaaatgcaggtctttgcagatacctggtggccatagagccagtaccctgattgtggctggaaagctggtgaagttccacctttcccttcctttctttccaaaatatatttgatatttaagaatattccttaactcttaatttcaccaccaaaaagaaaagagatcatgaccgggtgcagtggctcacacctgtaatcctagcactttgggaggccgaggcaggtggatcacctgaggtcaggagtttgagacctgcctggccaacatgttgaaaccctgtctctactaaaaatacaaaaacattagctggacatggtggcgagtgcctgtaatcccagctactcgggacactgaggcaggagaatcgcttgatccggggaggcggaggttacagtgagccaaaattgtgccattgcattccagtctgggtgacaagagtgaaactccatcttaaaaaaaagaaaagaagagatcataatgaacaaaatttggtagctgtcttacgttggatttcctagaagcagaggctgagacagggattctggtacaagtgacttattgagggtgtgttttcagggaaagcctgtaagggagtgaggaatgcgagacaggacaggggagaagctaggccaagatgtactttttgaagtctgacctcagcctgatcccatctggagctgtcaagtgtgaaatgcactacagtttgtccctggcagaggcaagggaggtgggggactgggctgttacacccttgcttcagccagtcgttgtctctgggcagccccacaggaggggcgttcatgtgttaccctgtgttgctctggatgcaggcagtcctctggaggcaggcatagaagtgacccttagcacctgcagcagctgagatacaaatgccccacaagagtaagggcactcgggtggaacaccaacagcatttgtcacagtagctgtttggggttcactaattgattaatttttttttattttgtccagttatccaccttcttttccttcatgttggaaaactacacacatatacataaggaagagctaggtaagtaaaaagcttagtcttttcaaatgtgtcattaaatattgaattgtcttcatcaagagcggtaaattctgaagatgggagaacactatgaaattaaaaagatgcctacctcttttgtttatgtgacacccaacaactggcaacatcagttcaagtggcctttttccctctctggatggtgtcaactaaatcaatcatttaactttttcacttttccaaaagctgaattagaattcattcaatattcatttgttgaatgccttttctgaactacaatctatcggtacacaacagtagcttagtaaagggaaccttatttattattattattattatactttaagttctagggtacatgtgatcaacgtgcaggtttgttacttatgtatacatgtgccatgttggtgtgctgcacccattaactcatcatttacattaggtgtactcctaatgctatccctcccccctcccccaaccccataacaggccccagtgtgtgatgttccccaccctgtgtccaagtgttctcattgttcaattcccacctatgagtgagaacatgcagtgtttggttttctgtccttgcgatagtttgctcagaatgatggtttccagcttcatccatgtccctacaaagggcatgaactcatcctttttaatgactgcatagtattccatggtgtatatgtgccacattttcttaatccagtctatcattgatggacatttgggttggttccaagtctttgctattgtgaatagtgccgcaataaacatacgtgtgcatgtctctttatagcagcatgatttataatcctttgggtatatacccagtaacgggatggctgggtcaaatggtatttctggttctagatccttgaggaatcgccacactgtcttccacaatggttgaactagtttacagtcccaccaacagtgtaaaactgttcctatttctccacatcctctccagcacctgttgtttcccgacttttaatgatcaccattctaactggtgtgagatggtatctcattgtggttttgatttgcatttctctgatggccagtgacgatgagcattttttcatgtgtccgttggctgcataaatgtcttcttttgagaagtatctgttcatatcctttgcccactttttgatgaggttgtttgattttttcttgtaaatttgtttaagttctttgtagattctggatattagccctttgtcagatgggtagattgtaaaaattttctcccattctgtaggttgcctgttcactctcatgatagtttttttgctgtgcggaagctctttagtttaattagatcccatttgtcaattttggcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaaccctttccccatttcttgtgtttgtcaggtttgtcaaataccagatggttgtagatgtgtggtattatttctgaggactctgttctgttccattggtctatgtctctgttttggtaccagtaccatgctgttttggttactgtagccttgtagtatagtttgaagtcaggtagcgtgatgcctccagctttgttcttttggcttaggtttgtcttggcaatgtgggctcttttttggttccataggaactttaaagtagttttttccaattctgtgaagaaagtcattggtagcttgatggggatggcattgaatctataaattaccttgggcagtatggccactttcacgatattgattcttcctattcatgaacacagaatgtccttccatttgtttgtgtcctcttttatttccttgagcagtggtttgtagttctccttgaagaggtccttcacatcccttgtaagttgaattcctacgtattttattctctttgaagcaattgtgaataggagttcactcatgatttggctctctgtttgtctgttattggtgtatgggaatacttgtgatttttgcacattgattttgtatcctgagattttgctgaagttgcttatcagtttaaggagagtttgggctgagacaatggggttttctaaatatacaatcatgtcgtctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgtccattcagtatggtactggctgtgggtttgtcataaatagctgtcattattttgagatacgtcccatcaatacctagtttattaagagtttttagcatgaagggctgttggattttgtcaaaggccttttctgcatctattgagataatcgtgtggtttttgtctttggttctgtttatatgctggattacatttattgatttgcatatattgaaccagccttgtatcccagggataaagctgacttgattgtagtggataagctttttgatgtgctgctggattcggtttgccagtattttattgaggatttttgcatcaatgttcatcagggatattggtctaaaattctctttttttgttgtgtctctgccagcctttggtatcaggatggtgctggcctcataaaatgaattaaggaggattccctctttttctatggattggaatagtttcagaaggaatggtaccagctcctctttgtacctctggtagaattcggctgtgaatctgtctggtcctgtactttttttggttggtaggctattaattattgcctcaatttcagagcctgttattggtctattcagagattcaacttcttcctggtttagtcttgggagggtgtatgtgtccagaaatttatccatttcttctagattttctagtttatttgtgtagaggtgtttatagtattctctgatggtagtttgtatttctgtgggatcggtggtgatatcccctttatcattttttattacgtctgtttgattcttctctcttttcttctttattagtcttgctagcagtctatcaattttgttgatcttttcaaaacagcttctggattcattgattttttgaagggttttttgtgtctctatttccttcagttctgctctgatcttagttatttctcgccttctgctagcttttgaatatgtttgctcttgcttctctagttcttttaattgtgatgttagggtgtcaattttatatctttcctactttctcttgtgggcatttagtgctataagtttccctctacacactgctttaaatgtgtcccagagattctggtatgttgtctttgttctcattggtttcaaagaacatctttatttctgccttcatttcgttatgtaccagtagtcattcaggagcaggttgttcagtttccatgtagttgagcagttttgagtgagtttcttaatcctgagttctagtttgattgcactgtggtctgagagacagtttgttataatttctgttcttttacacttgctgaggagtgctttacttccaactatgtggtcagttttggaataagtgtgatgtggtgctgagaagaatgtttattctgttgattggggtggagagttctgtagatgtctattaggtctgcttggtgcagagctgagttcagttcctgggtatccttgttaactttctgttttgttgatctgtctaatgttgacagtggggtgttaaagtctcccattattattgtgtgggagtctaagtctctttgtaggtcactcaggacttgctttatgaatctgggtgctcctgtattgggtgcacatatatttaggatagttagctcttcttattgaattgatccctttaccattttgtaatggccttctttgtctctttttatctttcttggtttaaagtctgttttatcagagactaggattgcaacccctgctttttttttgttttccatttgcttggtagatcttccttcatccctttattttgagcctatgtgtgtctctgcacgtgagatgggtctcctgaatacagcacactgatgggtcttgactctttatccaatttgccagtctgtgtcttttaattggagcatttagctcatttacacttaaggttaatattgttatgtgtgaatttgatcctgtcattatgatgttagctggttatttttctcgttagttgatgcagtttcttcctagccacgatggtctttacaatttggcatgtttttgcagtggctggtaccagttgttcctttccatgtttagtgcttccttcaggagctcttgtaaggcaggcctggtggtgacaaaatctctcagcatttgcttgtctttaaaggattttgtttctccttcacttacgaagcttagtttggctggatatgaaattctgggttgaaaattcttttctttaagaatgttgaatattggctcccaccctcttctggcttgtagagtttctgccgagagatccgctgttagtctgataggcttccctttgtgggtaacccgacctttctctctggctgcccttaacattttttccttcatttccaactttggtgaatctgacaattatgtgtcttggagttgttcttctcgaggagtatctttgtggcattctctgtatttcctgaatctgaatgttggcctgccttgctagattggggaagttctcctggataatatcctgaagagtgttttccaacttggttccattctcccagtcactttcaggtacaccaatcagatgcagatttagtcttttcacatagtcccatatttcttggaggctttgttcatttcttattactcttttttctctgaacttctcttctcgcttcatttcattcatttgatcttcaatcactgataccctttcttccacttgatcaaatcagctactgaagcttgtgcatgcgtcatgtaattctcgtgccgtggttttcagctccatcaggtcatttaaggtcttctctacgctgtttattctagttagccattcgtctaatcttttttcaaggtttttaacttctttgcgatgggttcgaacatcctcctttagctcggagaagtttgttattaccgatcatccgaggcctacggctgtcaactcatcaaagtccttctctgtccagctttgttccattgctggcgaggagctgcgttcctttggaggagaagaggcactctgagttttagaattttcagcttttctgctctggtttctccgcatctttgtggttttatctgcctttggtctttgatgatggtgacctacaaatggggttttggtgtggatgtcctttctgtttgttagttttccttctaacagtcaggaccctcagctgcaggtctgttggaatttgctggaggtccactccagaccctgtttgcctgagtatcaccagcagaggcttcagaacagcaaatattgcagaacggcaaatgttgctgcctgatcctttctctggaaacttcgtctcagaggggtacctggctgtatgaggtgtcattcggcccctcctgggagttgtctcccagttaggctactcgggggtcagggacccacttgaggaggcagtctgtccgttgtcagatctcatactctgtgctgggagaaccactactctcttcaaagctgtcagacagggatgtttaagtctgcagaagtttctgctgccttttgttcagctatgccctgcccccagaggtggcgtctatagaggcaggcaggcctccttgagctgcaatgggctccacccagttcaagcttcccggctgctttgtttacctactcaagcctcagcaatggtggatgcccctcccccacccttgctgctgccttgcagttcaatcttggactgctgtgctagcagtgagcgaggctccgtgggcgtgggaccctccaagccaggtgtgggatataatctcctagtgtgccatttgctaagaccattggaaaagtgcagtattagagtgggagtgtcctgattttccaggtaccatctgtcacggcttcccttggctaggaaagggaattccccgaccccttgcccttcctgggtgaggcgatgcccagccctgcttctgctcacactccgtgggctgcacccactgtccaataagcccgagtgagatgaacccggtgcctcagttggaaatacagaaatcacctgtcttctgcgtcgctgacgctgggagctgtagactggagctgttcctattcggccatcttggaaccaagatcaagggaacttcatttttcatccacaaaacttttttgctgagagatcaaaatattttgagtatttcatgcagcagatctaggggaaaatggcaaattaaacacagttggccccgttgtgtctgttttctgtcctctctctctctcttttttttttttttgagacagagtctcgctctgtttcccaggctgcagtgcagtggcacggtctcggctcactgcaacctctgcctcccggattcaggtgattctcctgcctcagcctcctgagtgtctgggattacaggtgcttgctaccacacccagctaattttttgtatttttagtagagacagggtttgagaatgttgaccaggttggtcttgaacccctgacctcgtgatctgcctgcctcagtctcccaaagtgctgggattacaggcatgagccactgcacccggcctctcttctctttgatctgtctgtctgtctacctatcatctagtcattctgaagcagaggcaggcaatggaggtgtagttcaaaaatgattttaaaattataattttttacaaccatgtatttctcctgcaaattaagatctgcctgttattatctccaagacagatgccagacttaaacgctcattttgctttaatttgggccaaccattttttttttttttttttttttgctctcattaaaatgtgtatggcatctaggagcatcttttaaataatctggtaaatacccttcaaagtgaagtggtaaaagaatggtgttttaatgggcatgatttaagctaagtgcatatgtatgaaactaattaaagcatttaatgatctgtagaagccttctgaatggtgaaatagccaaacctaaggaatggggagtgggtggaagtgggtactttgccattttttcttttagataactgcaattcgaagacagttgtttatgcttcatattccttggcaaaaatgtttttgagaggaaatatgataatgataaaatgaaacagcactttctgctaatgacctaatacttcaacccaggctcacttcatcagaatcacttacggagtttcagagccacaggtggctgggttccagcccggagatgtctactcagactgtgttgtcattgttgttgttttaatctgcattttaaaaaattccgtaggtgattttaaaatataagaaaaatatttttattaaagaaggggacagtggtttaatcttcttatagaagcttttttggaagtatacattacaggaaggtatacaaattatatgactcagtacattttctcaaagtaaacacacccatgtaactggcacctggaacaagaaataaaacatgatcagggccacataagtttcccatcctgccttcttgtactgctacccaacccccacacaatcacataactactttcttgacttctacaccctagattagtctttgaacttctttatatagatggaagcatgtggtatatacccatttgagtctggctgctgcttcttttttttttttttttttttttttaacgttttgttttgttgtcgttgttgagacagagtcttgctctgtcacccaggctgaattgcagtggcgcaatctcacctcactgcaacctccaccttcctggttcaagcaattctcatgcctcccgagtagctgggattacaggcattcaccagtaaacctggctaatttttgtattcttagtggagatggggtttcgccttgttggccaggctggtctcgaactcctggcctcgggtgatttgcctgcctcggccttccaaagtgctgggattacacacatgagccactgtgcccagtcctgagtctggcttcttttgatcatcattacatttgtaagaatcatccttgtaatttggtcatttttattgctgaataatattccattttactaatataccataattgatccattcgattgtgtatgggcatttgagttgttttcagattggtgatttaaatggtgctgctatgtacattcttgtacatgtcccttttggtaaaatatgtatgcatttatttggctatatattcatttttggttatctattgctacctaataaactacccccacatttagtgacttaaaaacaacagccatgttattgcatgtaattctgtgggtcaggcatttgaacagggcttgctgggaacaacttacctctgttccatgtgttatcagttgagctcactcatctagctggactgggcaggaaagatcaaatggttttaatcacatgtctgggattttggtattaggtattaacttggttacctctcggccaggtgcagtaactcatgcctgtaatctcagcactttgggaggctgaggtggatggatcacttgagatcaggagttcaagaccagcctggccaaccccatctctagtaaaaatacaaaaattagctgggtgtgttggtgcacgcctgtaatcccatctactcaggagactgaggcacaagaatcgcttgaacctgggaggcggaggttgcagtgagccaaaatcgtgctactgcactccagcctgggtgacatagtgagactccatctcagaaaaaaaaaaaaaaatttggttacctctctttttctcacgcagcctttctgtccattaggctattctggacttctttacatgatggctgggtccaagagggcaaaggcagaagctgccaggcctcttaaggcctatgtgctagaactctgggaaatcagttctgccatactctatcggttaaaacaagtcacaaggccagacgtgaattcagagcagttaaagagatatccatctcttcctcagaggagtggcagtattacagtataaagggatgtggacatagggaggcatgattccttggggagccattatcataaaaatgtaccacaagccagggatagaagtttggggttatagcgcttatatctgttcagctttattagatactggcagacatttttacaggatggttgtaacaagctatactctcaccagttcagttgctccatatcctcaccaacacttgcaatagtacattcatttcattttagtcattctggtgaatatctagtggtatcgtatttcaggtttaatttgcatttccctttgagcagtcaagttgctcactttttttcttttcttttttctctttttctttttttttttttttttttttgagacagagtcttactctgttccccaggctggagtgcagtagcgtaatctcggctcactgcaacctctgcctcccgggttcaagccattctcctgcctcagcttcctgagtagctgggactacaggcatgtgccaccacgcctggctaatttttgcatttttagtagaaatgggtttcgccacattggccaggctggtctcaaactcctgacctcaggtgatccgcccacctcggcctcccaaagtgctgggattacaggcatgagccaccgctcccgaccaagttgctcacctttttgtatgtttattggtcatgtggacatctcatgtggtgaagttcctgttcaggtttttttgtccatttttctattgggttatttgtctttttcttatgaatttggaagagttttctaactcttcttattttattttatttttttagatagagtctcactctgtcgcccaggctggagtgcagtggcatgacctcggctccctgcaacctccccgctgcccaggttcaagtgattctcgtgcctcaggctcccgagtagctgggattacaggcatgcaccaccatgcctggctaattttgtatttttagtagatacggggtttcttccatgctggtcaggctggtctcaaactcccgacctcaggtgatccacccgcctcggcctcccaaagtgctgggattacaggcgtgagccattgcgcccggcctaaataggatatttttaggaaccagaaggttatttaacatttccagatatcggggccaccagattaatggtcttaactctggggcatggagtatcttgagacacgttgggtactctgaagataagaggtgaccctggaagcagtcatacttgtccttgtaatcctaccacctcttgatgatcaattataacagttgatctccctgtgctactactttaagagctcaaaaccagtgcataggactccatggggtgtagagactccacagaaacattcccagtccacttttcacacatcagcctcctcccacaggcagaaagccgaagctgccatacatagccataggtttaaacagagactggcggaagcggggagtgggatggagtgtgtggaagtgttgttttcacttttctttctgcttctcagatcagccaaaatgtcctatcggaccaggtattttatattttttgttgctatggtgaatagaacattttccccattatatcttccattggttatcggtagtgtttagtaaagcttttgaattatgtcaatttatcttatattgtgctactattaagtaataataatatttttattgttgatatttgttacatgtttaccatgtgccatgtatttaagtgctttaaatacatcatttcatttagtcttcatgacaaaccagtgagattagtagtattatcatcccctttttgtagatatggaatctgaggcttagaaggcaatctcccaaggttattcatctcattggtggagaagctgtgattcaaaccagtgtgattaatgtctatattttatacatataaaaaatataaaatatatatttattatagtatttatataatatatattccatataattatatatttatatggaatatatattatatattatataattatattatatatattatataattatattatatatattatatattataatataattatatattatattatattccatataattatatagaatatatattatatatatatatatttattttcgagacagggtctcactctgtcacccagactagagcacagtaacatgatcatggctcactgcagcctcgacctcctgggctcagatgatcctcctacctcaggctcccgagtagctgggactagaggcacgcaccaccatgcccagctaatttttttgcattttttgtaggggttttgccatgttgcccaggcttgtctcgaactcctggactcaagcaattctccatgcccagcctctgtattacatttaattctcctatcaattctgggagtttttcaattgattttcttgggtgtaggtatttaatcacattggccacaagtaactttatttttatatctttctatacaataattactgctcttatttcagcttcatgtcttattgcattggccaaagatagtggatcagtgttagaatgaaacagtgaaagtgggcatccttgttttgttgatgatttaatggaaaaaccattattgattatttaaatttataaagcgatgttaaggaagtatcattccattcctagtttctgagtttttaaaaaatcaggaacagatgttaaattttatgaaatgtcattttggcatctattgaatttattatatggacaccaatggttctgatccagattcataactgagaaacaaaaataactataaatgtagttcaattgttgcttttctttttccagcaatatctggagcttgttttcaaagtgacatgtgggtggtagaggcagaaattgttgtataaaaatttatgggctttaaatttttccctgtccagattttgagtctgtactgggtaaaagaaaagattgtgtgtagggggtatttttgaggtattttctttagaacaacttgtaaaggtatcatttgcctataattcttaattagtttagattcatgttgacaaaattgtaaaccaaataggtaaggattaattctgtgttgcacaaatctttatatattgttcattaaattattgttattagttataatagttctagcccacaagaacagtatatacataagaaatgttaaagcctttgattgttttcatacatgacacattagctactggaagagaatttatgttattcttttttatgttgctaaaaaccagcagaaggattatgatttgacgttgactaatacttcatattgagtagttttaactaagaatcggtttagggaactggtcctttttcatatctttgtcactgaacttttaggcaatgatggtcatcagatctatggaagggacggtagaccaagcttctcttttttttaaagaatgaaaacaatattttaattttgttcttaagtaacaagactgagtcttcataactggaagggatggaactgatttgctgtgtcagttagccgatgggaaagggagagatgacagcatgggtggaggcagtgattgggaaaataaaatgatttttgctttattgctcacagagttggggttactaaataaatcggttataagtatataaataatactgtaggtatcgtgtagcatagttacattttaatatgcagtaaaagtgtaatggttaagagtttgagctcaaagccagattctctgggatcaagttccatctctgctacttacatgctgtaccccattttccttgtatataaaatggagataccaacaatatttatctcatagggtggtttcggtcattacatgaatacacatgtgtaaggtgcttagaacagtgcctggcacatcagtaactgggagctcccatccttgtcattatcaccatgatgccttggaaaaggtgtggcctggggttcaactgggcaggggttgctgagttttgaaggatgataaattgtccaaagaagagaaagcaagggtagtccagggagagggaagagtgggaacaataaagacagagtgctgggctgggagaggaaagcatcgccagtgtgggggagatgcaaggtcccggggtgacatcttagatcggaggagtgtctaactatgtttaattgtgttacagagtctgaagagaggatcatgctggagatacaggcaagggaggaagtgactatgaagttgccaggcctctgaggatttggaagggagaaagggtgtggggaacagctccatgggtggttccatatgcctgtctgcatccatagctgcatcctcaacttcatttcctctttccttccagcatctgactttctaaatcaggcatgctttaagctatgctgcctttctttctttctttttgagacagggtcttgctgtgttgcctaggctggagtgcagtggcacaatcacacctcactgcagccttgacctcctgggctcatcctcctgcctcagcctcctgagtagctgggattataggcgcacgccactatgcccagctagtttttttgtattttttgtagagacgaggtttcaccatgttgcccaggctgtttcactgcctttctcatgaacactgcaatcatatcataaattcctcccccatctaaaaaacagaatcccctagtttttaccatgcgttccatattcactttattttttagagtctataacagaaaataacctttataattctgttagatgatatagtgaaagtactgcgggtttttgtgggtttttgtttttgctgttatttgttttttctaagagttgcttggtatttcagtgtgtacagtcaggaaaaggaaagttttcatttgaagcaagatttatatccaagaacgactaccaaattgaaaagggtggcatgggcattgaagacagtgaagtatttaggctttactgcctacgtaatgaatctgagataaagttgtcaagatgctctccctttctagtctctaaatataaattgaaataattaagttattcttaaatctcaaaccaaacccaaatgagaaaaataaccactcccggaccacattaaagacagacattattactcctaaattcagcttcttataaaacatcatcaaccaccaccagaaaacactgtggtacacaagaatttagaaaatatttttttaaattgccaaatagtatgactttagaaaacatttttcacgtttagttcttaactgtaatctctcagcataactggatcatgaaaaaaatgtattctgtctatatcttgaccactctgaatattttaaaagatagaaactgtttgcagagaacttctgaagaatggcctttgtaacaattcggtgttaatgagttgaagagtatgtcattgtcctctgggtcattatccgcaagaatattgtgtattaaacaaccaccatacctcagtggcatgtaatcaatatttctttttgctaacaagtctacagattagctgaacacttctgctgatcttggcaggtttgattaggcagtttttttgggtcttggctggagttcactcatgtgtccagaacaaacactggtggctgctggctgggggctgatcgaggacaaccttggctaggatgactcagctcagctctacatggtcttgggtctttctgaagcctagcctaggctttgtggtagtggcattgttcctaaagagtgcatgaaagcatacaaggcctccagagagacctgagcttggaactggtacatagcacttccatcacattctttaggccagtacaagtcatgagcccagcctggtttgaagggatggggaaacacactcttgacgggagtagctgcaaaagtacattacaaagagcatggatagaaggtgggatagagaattgggatcacttttgcaatccatctaccatgtttcctttcgtctttctctgtctgaattgtcttgatttctgtactggggctgactgtttcatgggcaatctagcaggcagggaccctgggtctcagcacccactaaaatggacaatgcaggcactccgttatgtagaactgtctctccgagactgagaggttctttgggtatttctgcctgtgatttgtcctttaactttatctgctttgttaccaagaaagaatgaaaatcatgtcagaaagtttatttttaagtaaagagaaaaacaaatccgttacagctaaatagaatcctctgaagtgtttaacaggggaaaaattgaatgttgcagttaaattttctgtaggttctgaatagcagcagatgtttgaaccaaatataatgtattgttctgttttcagccctatttgtaaaagtctgagatgtaagagtgggcaaaaaacttagagctagagcttcgatcatccaaataccttgattggctagttttccctgtgcttctccctccccttcccactagccatggacccactgctgtggtaaaacatctgcccaggaagggatggtggtgacccatgtgaatgttctggtctcagggtcagtcattcctcgtggttatatgtgggctgtgttgatatgcagaacatttagcacagtgccttacatgggctaggtattcaagaagatatttattaaatttaagtattgaaatgttgattcccacccccacccccacccccccgttctgtccttccttttccagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacaggtaagtggaagcagatgctgccttgattcttgtacataacagatgcccaataactgttgaaagaatggatgaacataccacagcagagatgcatttctttagaaaacagttcacattaagtgagagctcccctctgttactcatttaatagaagtctcctcaggtgcacagcaagctcctctctgtaggctaacagcatttcatttgccattttctgagatatcattcacataccataaaagtcaccattttacagtgtacgactcagtgactttttcacgcattcacaggattgtgcaaccatcaccaatatctcattccagaacattttcatcactcccaatagaaaggccattcctgttatcattgcctcctccccacccctggcaaccactgttctattttctgtctctatggatttgcctattctagatatttcatgtaaatgaaatcatcaaatatatggccttttgtgtttggcttctttctcttagtgttttaaaggttcgttcatgtcatatcatatatcattacttgatttctttttatggctgataatattccattgtataccacattttgtttatccattcatcagtgaatggacatttggatcatttccaccttttggctattgtgaacagtgctgctatgaatattcattcacagattttcatataaacatgtgttctcagttctcttgggcttatacttaagaatatttcactgggtcatatggtagctctatgctggatcatgtggtaactctatatttaaattttccagtaattactaaactgcttcccacagtagtggcaccattttgcatttctaccagcaatctatcttcccatgtaggttccaatttcttcatgtttttgccaacacttgttattttgtttttttttttatttttattatagccatcctagtgtgtgtgacgtggcatttcattgtggttttgttttgcatttccctaatgactaatgatgttgagcatctttttatgtatttattggccatttgtataccttctttgcagaaatctgtgcagattctttgcccacttaaaatcaggctttttattattgagttataagagttctttctggatataaattccgtatcagatatatgatttgcaaatattttctcccgttctgtaggttgttttttcattttcttgataatgtactttgatgcataaaagcgttacattttgataaagtccagttcatccatgttttttcttggttgcttgtgcttttggtgtcttggttgcttgtgcttttggtgtcatatctaagaatccattgtcaaatctaaggtcatgaagacttgcctttgtgttttcttctaagagttttatagttttagcctttacacttatgtctgtgaatgattttgagttagtttctatatatggtatgaagtcaaaattaattttttgcatatggatatgcattgtcccagcaccatctgttgaagagactgttctttccccattgagtggtctttgcacccttgtcaaaaatcaataggccaggccgggcacagtggctcatgcttgtaatcccaacattttgggaggccgaggcgggtgcatcacctgaggtcaggagttcaagagtagcctggccaacatgatgaaaccctgtctctactaaaaatacaaaaattagccaggcatggtggctcatgcctgtaatcccagctactcaggtggctgaggctgaagaattgcttgaacccaaaaggtggaggttgcagtgagccgagatcgtgccactgcaccctagcctgggcgagaaagcgagactccatctcaaaaaaacaaacaaataaaaatctataggccatagatatctgggtttgttattggactctcagttctattctattggtctatgtgtctgtgccagtaccacactgtcttgattgctgtagctttgtagtaagttttgaaatagggaagtgtgagtccttcaactttgttcttttgcagtgttgaaattgttcttcattattgttttggctatttggggtcccttgcaatgaatttgaagatcaaattttccatttctgcaaaaaagcctattgggattttgatagggattgcgttgaattgctatatcactttgggtaataattgccatcctcacaatacaagtctttcaacccatggtgtctttccatttatttatgtctttaatttctttcagcaatgttttgtagcttttagtggacaagtctttcatcaccttggttaaatttattcttaaacaatttattcttttggttgatattataaaaggaattgttttcttaattccttttttgattgctcattacttgtgtgttgatcttatactctgcagctttgatgaatatacttgttagctctagtagtttgtgtgtgtgtgtgtgtgtatgtgtgcgtgtgtggtgtattcttttgaatattctatataccagatcatggtatctgtgaatatagttttatttccttctttctgatttgggtgccttttgtttctttttcttgctcaattgctctggctagaacttccaccacaatattgaatagcagtgtgaaagtaggcatgtttatcttgttcctcatcgtagggggaaagctttcaatctttcactactgagtttaatgttagttgtaggtttttcataaaagtcttttatcatgttgaggaaatttccttcaattcttagttttctgagtggttttatcaggaaaagttgtcgggttttgtcaaatgcttttttttttttttacatcagttgagatgattgtgcgttttttacccttcgttctattaatgtggtgtgatatattgaataattttcttatgttgaaccaactttgtatttctgggataaatccctcttggccatggtatataatccctttaaaatgctgttgtatttggtttgctggtattatgttgagaatttttgcatctatttcataagggatattggtctgtaattttcttttcttgtagtgtctttgcctggctttggtatcagggtaatactgatctcatagagtgagttaggaattgcttccttttattctgttttttggaagagtttaagaaggattgtgttaattctaatttaaatgtttagtagagttcaccattgaagccatttggccttggacttttctttgttaggaggtttttgatgactgatccaatctcttgttctagatctgttcagattttttatttcttcttgagtctgttttggtaatttgtggagtttctaagaatttgttcatctcatctaagtaatctaatttgttggtgtacaattgttcatagtattctctcataacccttttttatttctttaaggttgatggtaatgtccccactttagtttctgattttagttattttcattttctctttttttcttagtcagtcttgcttaaaggtttgttaattttgttgatcttttcaaagaaccaacttttggttttgttgattctctctattgtttttctattctttatttcatttatctccactctaattcgtattttctttgtcaaaatattaagttagtttattgatttgagatccttcttttttaatgtgtgcatttacagctacaaatttctctctaaacactgcttttgctgtatcccataagttttgatatgttgtgttttcatttttattcttctcaaagtattttctaatttcctttgtgatctttttattacccattggttttttaagagtatgttgtgtaatttctacatatttatgaattttctagttttgcttttgttattgatgtctagtttcattccattgtggtcaaagaagatactttgcatgatttcagtctttttaaattcgatgcggtttattctgtggcctaacatctggtctatcctggagaatgttccatgtgtccttgagaacaatgtatagtctgcttttgttggggaaagtgtttagtagatatctattaggtctagttgtgtgtggtctctgaaatctctgttcctttagcttgtgttaagttagtgttttgacagagacttccttgaacaccaggagcgatttaaaaaaaaaaaaaaaggaagggaaaaaaaccaacaacaaatatttgcagattggctctctgttggagcactccttcaactccttgggccatttacaaatgttagtctttacttcccgcttgtgctgaaccattgttcagtttcctttttcttgattcactgtttggttgctataaactttgagtattttccagagttctgacaaagttgattctgacagggtttgtttgtttgtttgtttttgcttgatttgtcaatgtttttgtggcggaatgggaccttaaagttgcctacatgaccgttttctctgacatcaccccagtaccctcattctcaggttaggaccctaaagggcatacctaggagtaagagtgaactggaagactggcttttcaatgatcagagaacagcttggaatgaatcatgtaattcctgagattgaactgagatcatcttagatagctaaggctcctaaccacctgccaacagcaaatttaagtcttctctggaagacaataggcctgagattgtttgttcagtttttctttcttcctttcttttttaaaggcagggtcacactctgtcacccatgctggagtgtggtggcactatcatagctcactgaagccttgacctcctgggctcaagcaatcctcccccctcagcctctcaagtagctgggactgtaggcacatgccatcatgcccagttaattttttattagcttttggtagagacaagttttcactgtgttgcccaggctggtctcgaactcctggcctcaagtgatcctcccacttcggcttcccaaagtgctgggattataggcatgagccactgcacctggcctcagtttttcatatgcaatttccagaactcaatacaaatataaccaagcacaggaggttataagacacatgaagaaaactgaggcaaacaacaatggaaacagacctgtagggtatttggttagtggcattatcagactctgagtttaaaataaatatgcttaatataagttcaaggagataaatcaatccaaggagccataatagagaagattgataattctgactttataaaaatgaaaagactgttattaagggaagaataaaaggttcaacacagtgtacagagtaaaaaaaaaaggatcatgtatattttgatttttttaattgagaaaaaattcatctaatgtaaaagtgatcatttaaatcattttaaagtgtatgaggccgggtgcagtggctcacgcctgtaatcccagcactttgggaggccgaggcaggcaaatcacttgaggtcaggcgttcaagaccagcctggtcaacatggtgaaaccccgtctctactaaaaatacaaaaatcagctgggcatggtggcacgtgcctgtagtccccgctactcgggaggctgaggcacgataatcacttgaacccaggaggcagaggttacagtgagccgagatcgtgccaccgcactccagcctgggcgacagagtgagactccatcccccccagcccccaaaaaaagagtgtatggttcaacagtttttagtatattaaaaatgttgtgcaaccatcaccactatgtaattccagaacattttcatcacccccaaacaaaaccctttacccattagcagtcactcccagttgctccctcccccagcccctggcaatactaatttaccttctttctctatggatttgtctaatatgaacacttcctgtaagtggaatcgtacaatatatgtggccttttgtgcctggcgtctgttgcttggcatgtttccagagtccatccgtggtagcatggatcagtacttccttcctatttttagctgagtaatgttactttgtatggatatagcacattgtatttaagggattatatgtttatacatgcatttttgtattcatctgtggttatattgatttttgtatgcttgcaaacacatagaatatttctgggaaagatacgatacttttaacagtggctgtttctaggggtagggattaggggaataagatctaggggagacggaaaatgacttttcattattttacccatttctactatttaaaattttatttcaactaaaaaaatgacgtgtttctccattttaatactacttttttttttgagatagagtctcgctctgttgcccaggctggagtgcaatggcgcaatcttggctcactgcaacctccgcctcccgggttcaagtgattctcctgcctcagcctcctgagtagctgggactacaggcgcgccccaccatgcctggctaatttttatatttttaacagagatggggtttcaccatgttagccaggctggtctcgaacttctgacctcaagtgatctgcccacctcggccttccaaagtgctaggattacaggtgtgagccactgtgcccggccctaaaactacttttttaaaaagaaatattctttaaaggtagtattttcctctaacttaaaagaatgtgactattttattcaagtggttatttaacctgaatatatttataaatggagaaactgccatctgagttaatcatcttgagcatttaatattgcagttgtaaatataattctaatgctatggaaagatagccttataggcaaggactagtatgaccaaaatgattttagtcaatccaaagacccagagaaattattttcataataattttctgttgttgcaatatattctcagtgaatatttgttaatttagcttttataaaaaagaaaacttcccctttagacaacagttactctgataagtactaccaatggaccagaaaaactacaatgataagctaaggtaacactgaagccagtgttgggaatcaatagattacatgtggctgggggtggtggctcacacctataatcccaacactttgggaggctgaggcaggaggatcatttgagaccaggagttcgagaccagcctgggcaacctaatgagaccctatctcttccccaccacaaaaaaggaaagagcttgaaaatccagtgtgaatttttcacttacagcacatttcaattcagattagctccatttcacatgctcagtagctccatgtggctagtggctgccatattggacagcataggtccaatatggcaataggtctaaatagttttgacctattaaaatatgttaaatttgtgtggtagtcacatctctgctgtattatattttggagtatgtatttataattttttttcattctccctctcctttttctttttctcttttattattacaattggctttttgtctgcacgtttccctagggcaagggcgtgcctcccttcacttctcttgggctctaaggacctgggatgatgattcattttctcagttacacacgtcgactgagggcttattatatgccagacactgggctagaatgatctatttcagaataattgaaaggttatcctgaaatacagcgacctgaaacgtgcgtgcttgctccacctttacagttttctatacagtcatgtctttcttccttgttcattacatctatttcctctgcttcccgctcacagatacttcatgcccattatgtcttagaggtgctatttgaaaccaagaaagtcctgaagcaaatgccgaatttcactcacatacaaacttctccctccaaagaggtaacaatctgtggtaagtttcagagcagagttgtccaattaatatttaggagcctcttggtcctacatcgtttgcctaacttgaaaactgtgtaaattggactgtgttaagggaaaaatgttaatatagaattatctatcatgataatactgttccccatcttgtctttgttttgcataccagctggcaggaattaattatgtgagaaattaaagagctcatagctttttataaaggcagacagcattttaatatggaaaaaccacccatgggtggaataagcattctttgccctccgtctagctctcattatctttgttccacgttgctttttctaggtgggcctctgcatgccacttgtgctgggaagagaaaagcccgtggcggggtgaagattaaattcttctctgcccttggctgctgttttagatttttccaactggtctgtgcagcttttagaagagtgggaatgtcccagaaatctgtttcttgttcttttaaataacaagatttgagattttgctatcatataggccagcctggcaggatattgcttcaagaaacagtacacattgaaattcctcacagttggtgctcagcatgcttgcaaccgtttgacagtggggtgcgtggaaggaacagcaattcccttaacttctaattaagcctttaggttacaaaacagtgattgttattttccaaatcagtttttagcctgcatttctcttattctggcaggtagaagtgaatttgacaatctaattaaactatttgcatttctagcgtctgatagtggtggcagggacttgatgtagcagtgcctacctcatcacatgccctgactcaggtttttgaagagtctctaatggttcatttccagcctcatcaggcatcacgtctctgactggcagatgattcatctcagcagtgggggtcttttattcaaggcctcacctggccttttcatggaaaatagagacttcgggtcatgaggctcagaaagccatgccaccctgtgaagtctgtgaggccagggctaggtgtgctcttaggatatatagaatagcccaaactgagaatgggatccgctcccctgtgtttcactgggagccactacagactcatccttgctaaaaggatctggaagaagacacacgttaattacagggcagggcagtcctagaatcccacagtgtgagaactgaagggttctctagtctattccttgctcttatgggtgaaattgaagctcagagagaaaagtggcaggatcagaattaaaatcaggtcttctgtatcccaggttagaggcagccccacatctgccatcctgactcgcattaggtacctggtggttcattgtccatcgtgagacaaagattagggcgtgacttaactggacatctccattggttaaagatttccacatcttggcacttatttctagactttttcacgtggcaccattggtagggggaaaagacaaggccagtgggttttcttaacatgggaatattattattttctatttttaacagctcattgaacttcaaaaatttcatgattatttataataaaatttaaaattggggccataacttcaaaaccatcttccgtttaagacggtgttaggaaagggggagagattgtgatgaaaatttgctattattttaattgtgagatgcatttttttacatgtacatctaaatatgccccgtagttttcagcatgcatgaaatataagaggatttttagtctacagttatattataaatgataaccaattctgcactcatgtttttgttggcagtggaaatatctttctgtccttcttcccatggtacgagtttttctttcgctgtccaactagaagttaaaaatattaaactaagtaaagagtcctcccatctttatgtccttagatttagagtgagaccatatgaaagcaatgagatttaagcacacaatgatactaatatgctaataatattatagtagtattttataaataagtgctggtgatatagaatttctattttattatttccagtatatttggagtcttctattgcatgtatttggttaatcttggttgtgggattttaagcaaactgagggaaaagtattcgtaaattaaattgtatagtaattaagttggatacaaagaataaaaatttatgagcagaacttatgaaagatattttacctagaaatagttatccaaatggggcttttggatattcacatagtcactcattattattgctattttttgagacagagtctcgctctgtcacccaggctggagtgcagtggagtgatctcagctcactgcaacctctgcctcccggggctccagcgattctcctgcctcagcctcctgagtagctgggattacaggtgcacgccacgacacctggctaatttttgtatttttagtagagacagggtcttaccatgttggccaggctggccttgaactcctggcctcaagtgatccacctgcctcggcctcccaaagtgctgagattacaggcatgagccaccgtgcctggccttattttttaattaatggcttcagatactcatgatctcccctagttggctttcattttttttctatgtctcatcaaagaatgtcaactacctactcacaaagtttaaatttcagatgctgctactggagtatattaaaaacacggctttaaaaagctatatacttagccaagaaatgtatttactgagtgcctcttatccactgggtcctatggtaggcacttggggattcaatgctgactacaatagatactgttgctgctctcctagggattacagtgtgggtgtacagaataatcgctaagagcctgaggggttttttgtttttcgttttatttttgagacagggtctcactttgtcacccaggctggagtgtggtggcatgatcacagctcactgcagcctcgacttcccagggtcaagcaatcttcccacctcagtcagcctcctgagtagctaggatcacaggtgcgcaccaccaaacctggcaattttttttttttttttttttgagatggagtcttgctctgtcacccaggctggagtgcagtggtgcaatctcagctcactgcaacctccacctcccgggttcaagcgattcttatgcttcagcccccacaagtagctgggattacaggcgtgtgccaccatgcacagctaatttttgtatttttagtagagacggggtttcgccgtgttgaccaggctggtcttgaactcctgggcccaaatgatccatctgccttggcctcccaaagtgctggggtaacaggtgtgagccatcacacccagccaagcttgagttttgaagtgagttaaagttgggtttgaattcttgctctgatacttgatggctgggtatctttgcataacttacttaactactgtgagcctcatttgtaagatgagaatgatgaagataaaacccatctcatagagtggttgtaaggactgaactagataattcatgtaaaacccttagcacagtgcttggcccagagtgatcgaagccctgtgcaaatgactggactgaaaaggtaattgaagcactagatgctgtccccactataggagaggaagagaagagtgctgtggagacaaattgcctgtcaaattaacatcgtcataggataaaaacccaatgccctgagaacacttggagtggatcagcagtatttcacttttaaaaatgggcattgcatcttgttctctactgaatactgatttttcatttgcactgcaggtgatttgcatgggaaactggatgatctttttttgatcttctacaaggtaaatgatgattttgctaaatattaacatttttcttgggggagggcagtcttagggcagataacaatattagttttactagagatatgtactaatacagatataatgttactgtttttaaccaggaggctcaaagatttgtagagccatatcttttttttttttaacacacatctcataaatttttaaaaaattgtactttgggtcttcattctacattattgttgtctgtgtatccattaggatttgtaccggattgtatttattgtctttatcgcatcataaatgtctagatggtacaggatggggagggatgcagtctgttttattttaattttgttcagggatgagcatgtcacataccagtcttctcttccagtgcacactaattatgcatgagtggagttgcttatgataaggaataagttccagcatgctctcttttctcccctgattcgccatccatgggctcagttgttcttccaatgctgtgcctcctcttcatttattgcatttggcttgtgagagccagcacagagggcacaagactgcttggccagcatggattttctctgcatctctttgattggatttttttctgtctctgggccaagagttacagcctgaatgtttgcttcagggatggctgactgcatatggaaaactgatcttgagatccctgccttcacagcggttacccctttacactggtcttctgaatgtctctttttgattaatgcatttattgttcatctactcctgtgacccccacaactagcatgtcaaataattgggcgtagcgtaggtatctcagatgggtggaaagaaaatatattctgattattattgttaccagaaaggggtcccgatccagaccccaagaaaggattcttggatctcgcacaagaaagaattcagggtgagtccatagactaaagtgaaagcaagtttattaagaaagtaaaagaataaaagaatggctactccatagacagagcatccccaagggctgctggttgcccatttttatggttatttcttgatgatatgctaaacaaggggtggactattcatgcctcccctttttagaccacatagggtaacttcctgaggttgccatggcatttgtaagctgtcatgatgctgatgggagtatagccgtgagaatgaccagaggtcactcttgttgccatctcggttttggtgggttttagctggcttctttactgcaactgttttattaggttggtgcaaaagtaattgcggtttctgcgtgctctggttcaaacacctctaacattattgttcctggaccaaactgagggttgggctgctatttctcatggcccaataacgagatacagatgaactgggaaggaagagagtttttatttctgtaagtggctccagggagaaggcctggaaattatcaccagaccaactcaaaattagaaagttttccagagcttatataccttctaagctatatgtctacgtgtaagtgtgcactcatctaaagacgtaagtgattaacttcttttcatctataactaaggtctgagtcctgaagaccttcctctggagcctcagtaaatttacttaatctaaatcggtccaggtgctggggtgattacccttatcttgtctcctgctaaatcatggaggtttgcagagttccttcagacccccaatcaacttgtttgtggaggcctggggagtttcttcacatccccagtaaaacttgtttaatcctaaataggtcctgttaagaattccttcgttatcttgccatgctttaacgcccaggaaaggcctagacaaaactcttggtgggcttttgttacattccagcctttgtatagggcactggctctttgagcttttaatatttaactgaaccactcagtcagtactgagacagttgttatggaggcctgcgttagtgagacctggcctgccacattttgatgaccaatcagttccactctttgaggctgtgagagcttgagtaagccatacaacctccatgaactgcaattttttttttcagctgcaatattatcttgagcttccaccccataagaggttgtattctggataaaataagtatccaaaagcatttttaaaataataaattataatagaaacacaaggttttcacttcatgcattagattagcagcttggaagggaagaggacaggccaaaccaggagtgggtagagccagcacctaggaagaggttccgttgagacttcagcaggcccaagccaggacgtagagtgtgactgtcagagagtgtcaggaggtgtcccaagtagcagattggtgtaggaagtccaggcgaaggtttgctggcagggagccgagggggctggtgaaagagcaattctggacatcagccacagaatctaagctgggtagggaaggaagagaagccaggatgggccagtcaactgggagaagtaggagggtagtaggactggaatgctgaccgactgtgtcagggagcaggctgactgcagtgagggccttaggaggtaggatggtgggaagtgcagggggagcagtcccagggcaagggatgccctggggtggagcctagaacatgggcagcccaagccatcgaaagagagtattggcgatgaggtgggcaaggacctggaaagcaggtgtgttcaacagtggggggcaccacgtggacccagatgaggagcaggggaaggaagtttagtcagaggtcatgggcctgaaaggagggtggtggggtgtttctctgtgagcagccctgggggcaagcagagcctcccctgctcctgggcctgaggtgggtgtcctggggatgggtgggtcctttccttcagaagggctgcaggagtcaggagtgctgctgtgctctggaggaagcccaggcctatggaggagagaagcctttctgaataagttgaaggtggaaggggcttcattgaccatgaaatggagattctactggccccactggagtgccatgggaaaggtggaaggatggacaggggatgggatttatttaatttgggacgtagctccacaccaaatgttcagaagtgcggtccggctattgttgacaattacaatgtgaggaaggaggagggggcagggcatgtggagaacaacaacaaacctggtcattctttatctagagtcttgagaaatatataaaagggcaaatagttgagtaaattaaatcgggaacgtagtcactaaattccaaggcatttagaaaagaaaatttctttatttcgtatgaaagtgcgataagggataggactctggagtagacagatgagaaaagagaattctaacatatttctttaattctgtctgcaaaactatatggaacatataaaactggaaggtgctaatgtaaagattgaacaggaggaggtgggtggtaagaagtactataaaaggaactaaaggtgaaaatatagcattcaaatgcaagcaagatatatttggagagctaaccaatgacagtgctaaggaaatggagattgctagcccagtgatgaaagactagggcactattatatttaggatggatttgggtagagaggtgagagggatgtctggaaaacagaagtgtgcaagagccatggattagaattctggcaggcgtgagtgagaagaaggtaaaatgcatcttggacatggagtgaaccacatacaccagaatctcgaaactgcctggtttaagtggggaaaccgagggaagagccattgatgacagcaagtttccactttaagaaactgaaaagagatctagtgtacaacacgaggactataggtaataaaattgtaccatatatgggattcatgccaaatgagtagattttagctgctattgccacaaaaaaacaaaaattggataactatgtcagatgatggatactttaatttgcttcactatagtaacctttttactatatgtatgtattctgtaacatcatgatatattataccttgaatgtacatggtaaaatttattttttaaaaaagaagaaaatagcaacaatgataaagcaatggggaaaatagctgatcaataatatcattagtattttcaacagcggtacagcagaaaacccggaaactatattattattttaaaggaatttataataagtgaataaatacattactttcatttatctagaaaaaggaaaaaggccgggcacagtggctcatgcctgcaatcctagcacttcaggaggctgaggtggacggatcacttgaggtcaggagttcgagaccagcctggtcaacatgatgaaacccctgtctctaataaaaatacaaaaattagccagatgtggtggtgcgtgcctgtagtcccagctactcaggaggccgaggcaggagaatcgcttgaacccgggaggtggaggttgcaatgagccaagatcgcaccattgcacttcagcctgggggacaagagcaaaactctgtctcaaaaaaaaaaaaaaaaaaagaaaaaagaaaaaagaaaaaaagaagctggaaaggtagtgtacttaatggtgtctcagacgggagaatgacacgtaaagcttgggggtgatggtgcttggtcgcttagcttatagcaaaagaatgtcctaagttaaaagcagggaaatgaaaggctgggacacagagatatctgaggaagccccgaccatctgatgatctctgatttaccaaagtcaggattttgcccttttctgtcttatttatttttgtctgcagtttaactggagaatgatgatagtttgcatggatgtactgtggcctaaaagcatgaatacaggctgttctggaaacagtgtttctatataaatataaatgacagtgataccccacctatcccaatgtcaaacttcagcctactttacttaccttcacttaccactcatatgtcccaaacccagaattaagtaaaaagggtctctgaacgcttgaaattgttgacacaaatccaatgaaccctactcacaggacaggccttaggcctcttactcaaagacccatgaaccagtatcagtaaaaccttctctcacgcaaggttcacatgagtttgcctgtctggctacccaccccacagcagattagggagtgggaggtgaagatggaaaagtcagacataatgacagcaatgaaaattaaaacgttctggctgggcacggtggctcacgcctgtaatcccagcactttgagaggctgaggcgggtggatcacctgaggtcaagagttcgagaccagcccaaccaacatggtggaaccccattctctactaaatacaaaaaaaaattagcttcgcatggtggtgcatgcctgtaatcccagctacctgggaggctgaggcaggagagttacttgaacccgagaggcagaggttgcagtgagccaagattgtgccattgcactgcaccctgggcgacaagagcaaaactctgtctcagaaaaaaaaagaaaagaaaagaaaattaaaagacagaactataaaaatgagataaaaactgaaatactaatactcagcgatctggagctgtggagtgtagggaagagagttcttgccttgtcagaagtgcctgaggggatgtttagactgatgagcctgcaaggccaagagagtttcaagttataaggtgtatactcttaagaagtaaaggggaccaggcgcgtggctcatgcctctaatcccagcactttgggaggccgaggcaggtggatcatgaggtcaggagttcaagagcagcctggccaatatggtgaaaccctgtccctactaaaaatacaaaaattagctgggcgtggtggcacacacccgtagtcccagctactcaggaggctgaggcagaagaattgcttgaacccgggatgcagaggttgcagtgagccgagatcgtgccactgcactccagcctgggcaacagagcgagactccatctgaaaaaaataagaagaagtaaagggagcaaatggcacattttaaaaacttccagccaaaatggttaaagtaatttttaaaggcattttagctttcaaaggaataagcttcagtgatctggaaaatccatttaagcaatgcttatagtatgaatgaggatattgggtcttaggaataggaggatgagagagcatgaagaaagagaaagcttagttaggagaagagcactgggccataaaaatagataaggaagaaaggaagaagcacatctcaaaggaagagagtggtgagggggttggggggtgatggatttctcttggtagcatcacacacgaaggttgcctgctcagattacaggaggtgcataactatgacctaagcaatcacttgattgcttcgggaaatggtagaatttctgtgatggtctttgtttctcactgtaatgctttgtactaatcaatttgtcaacaactgattgaatcccaattatatgtcatacctgactctggttcactgatagaagctacaattgagtcacatcagtgtaaccacaggctcctaatcttttgtttagaagtagttagtggccgtgctttcacttacttttattttattattgtttttaagagcaatagatcttgaattgtggggaatagtttggcaaactacatcctgttggagatttttggagctataagtgaccaaagtttatgttatactatgactaactgattctctccatcactcacaagagtaagtaggaaaacctcaggctttgaattaagacaaaattttaattcatctcaattggtggtttgctagacactttcttcctcatcagttcttttatacagcatagcatgaataggctccaaggctggggctggcccaaagccaactaagggcacagcctgagagactgttctaatgtagggtcactgagaggcctcaccatattactcttttcatccaagtggttggtttggttcaagacttctatcattataactcaccatatgcaaaagtgaatctgtctactaatgcattcattcagtaaacttttatctggtccctgtaatgttcaaggtatcatataaacactaaaggaccatacaaagttgatttaacatatatttatgaaacacctattatgaatgaggcactctactaagggttggcaatacagtatgactaaaacacagttgttggccccaaagacatcacagtttagtggggaaggttggctgataaaaagacaagatagttcagggttggacatgttatgattgggatcagcatggagtcctaaaagaacccactggcagagcacctaaccttatggaagacttcctggaagagaagacatttctgacgatctcttcaaagaattttagtaatttagtaagtgcctaaatcatgaagggaagttttggaggatcatgaaagattttattctcagacactttttgtggtgccctacaataaatgatgggatttgtagcaattattgttcttcattgattgttttgagattttggtttctttaatatttggttgtccttaaaaattgtatcagctagcaccttaatactaagggaaacattttcagctcagaatcgcatctgggtttgaaaaggactcttccccactgggtaccatactcttaacaacagacctttgctaaaagggcatctcaactttacatggcttcaaatataatcttatcatcaagtgaagtaatttacatatcattagttaggtcatatttttagattttattttctgaaaagattaattttaatcagccctgttgcttaattagagtgaccagtttgaaatacttctttcagagcctcagctttagtaaaattacaagacatttttccctcattgaatagaaagctagaaattttagatcaatatcaccaaattagtttgttaaattgatgccatgagtggtgacctcctatcgctgaaaaagagatgcatgtgaacagagagatgctaatgaactcttaaccctgtgggtaccatcctgatgctatccagtggaagccctactgccttgttttccttttttttctctcttccccaccatcctccacccactacacccataattttccagctgtcaaggtagtcaaacattttctttattttctatcactgaaatgcttcacactgccacagtggccaattttattttccttttgaggtgaaggtagtatgttacaatcagaacagacctctgaaatagggtttgcagaagaagaaaattaacgtggagttgaccagagcttattgtttgatgtgccttcaggaaatgtccaaattcactgggataatttccagatgtctgttgtaaaatgcttccataggaaataggcgagactgtgggaaacatctggtttttgtctctgtttaagttaattaattatggtctgctatttttccccctacaggtcatctgagtgcagttcagagttgtagctactctggactttctgtatctgtcaacttaatcaccatgtcatagacggtttgttgcatattagctgcagaatgagccagagggtttcgtttactggaactgggtgaagcatgttttatggcatgaggttttgcttctttgaaggaaacctggagaaatgtcagtagccggaatcctaaatatcctagacactcacaccccagtagactagttcctcatcatcctgtgtgctttttagttcccttattactctaagactaaagtggattcaaacccaaactatataaagtaatacgactaatcctggaacaacagggcagttcttacacatccaaatgagtcttgccctctttgatgcggttgtcttgaggggcttaacactgaaaggagttcagtatacattcaggactccttttagaatcactttcagagatagtgacatactctcttgaatgagctttattatcacaagtcttaatctcttgaagacatgtgagattcttgaagaaaatcttgaagattttctgaaaaggttaaggcttattgagtgtcaagtgtgttgcataaggtggatggattagttgaccattactatttggggcttaaaatgaggtttaactgaagacattcattactctttgctcatagtagaggtgaaataagacatcacagaggtagcaaagaatttacccacaacaaattctggtttaattcgagataagaagttttaatacaagaaaatctgtcatcgcaatagaaagtgtgtttaccattcaaacataataaatataattttagactattggatgctttcctcaaattttgaaattaaggttatactggtttcataaaatgagttggagagattttcatctttttctcttacttataataatttgaatccctgggttgcaaactcaaacttggctatacactgcagtcacccaggtgattctaatgtgcagtcaaggttgggcaccatgggtttaagtcacattaaaactatttgctcatgaaaattaaaatagagttctgctagaaagccacatggggccagtgcactgttcatgttttcctcttcttttgaatcagttttgctaggaaatggatgattttcaaggaaatcataaaattggttcaaagaaagaaccaataaaatttgggtttatataaacccaaattatcctttttatttcttttctatttccttagtttcagctcttctccttatttgatgggttttattgtttttctaatttcctaagatgaatgccatctttcgtgaacatctttaataatgaaggcatttaaggctacacatcttttctgattttagtgttaactaggccttctattgcacttgtaattttgcttttaattttctctttgatataatacttattaagatgataatttttaatttccaagaatcttaattcaaggagccagactttttttctaatcacatttttatgagactgtatcctgtgacatttttcttattttgaatttcttaagagttctttgaagtcaagtacgagactgattctcataaaagttccgtggacatataaaaaattaattacagtgttgagccttgagcaatgctggggttaggggtaccaattccccatacagttgaaaatccacatataattttgactcccccaaaacttaacaactaatagcctactgttgactggaagccttagcaataacataaacagttgatgagcacatattttgtatgttatataattataagctagagaaaaaaatatattattaagaaaatcttaggccaggtgtagtagctcatgcctgtaatcctagcaccttgggaggttgaggtgggtggatcacttgaggccaggagatcgagaccagcctggccaacatggcgaaaccccgtttctactaaaagtacaaaaattagccaggcctggtggcacaggcctgtaatcccagctacactacagaggctgaggcagggattcgcttgagaatctacagataatctacagagaatcgcttgagcctgggaggcagaggttgcagtgagccgagattgcatcactgcactccaatgtaggcgacagggcaagactctctctctcaaatatatatattaaagaagagaaaatatatttactactcaactcattaagtggaagtggatcatcaccaaggtttttatcttcatgttgagtaggctgaggaggaggaagaggcgggattggtcttgctgtctaggggtggcagagggagaagagccacatataagtggacccatgcagttcaaagctgtgttgtttaagggtcagctgtattctcttatttgtaatacacaaagttcttcatatattaaatcaagtttattggttgtatattcaattttcccatattttttctattatatatgttaatcattttttttgttgcgtctctgccagggtttggtatcaggatgatgctggcctcataaaatgagttagggaggattccctctttttctattgattggaatagtttcagaaggaatggtaccagctcctctttgtacctctggtagaatttggctgtgaatgttgctgtgcaacaaattacctcaatacttaatgacttaacactataaacatttagtatctcacagtttctgtgggtcagaaatttgggtcaagcttagctggatggattctggctcaggatctctcatgaggtagcagtcaaactattggccagggctgcagtcatctgaaaagttgattggggctgagggacccatttccaagatggttcattcatgtggctgtagacacagcatttcaattcctcactgactgttggcagaacagccacatgggcttctccacaaggctgcctgattcttcttgtgacagagcagctggctttccccaaagtgagtgatccaagaaagaaagcatgcaggaagctgcagtgtcttttatgacttagtctccaaagttgtacatcatcacttttgcttttttttctcttcatgagaagcaagtcagtaagtcttgcttctgctcaaggggaggcaaattaggcttcaccttgtaaacagagtgccaaagaatttatggacattattttaaagcagtaattcaatctgaataacacactgtgtatttttaaacaatttcttcttgcatttagtagttaaatgtatgaagcaaaaatgtgttcttttattgactataagttcatgagttgtatttttttcataaagtgccttttattatgacataatgttgctttgtgatcctgtttagtactttaatcttaaactctactttgcccggtattaatatttccattcttgctttctttttgttgcatctacctcatattcaaccttctcttaccttctttttaatgtatatttctcatgaacactatatatctgggttttgtattttaacacagcctggtaatcttggtattttaatgagagaatttaatccattcacacttagtataacaacagatatatttgaaattttttcttctactttgctatttcactttgtttcacccttttccttttctttttgctgttttggtaaagttttattttttattgttttatttggaatttttactctgcttttccattcactagtggttaccttcccacttctgacatttctggtaaataatgtatatgtgtgtatttctcaaatagctataactttattcttccactgcagtcctctctctctctctcaataagataactgtttacacactccatgtctcccattcagttaagatttctagagcattttatttttctcttctcacctcccctgtaaatcctagctattgctcataccatagttttagttcctgaccattattaggttttccttcctagcatgtctcttctacttctggaatctttgcttaatacttaaatgcaagtttcatattgtcatattgatttatatataattatatatttcatgattcattgttcacatctgtattctctcctcttgatctttccctgacttgaggacttttattttttatttttatttttttttgagacggagtttcactcttgttgcccaggctggagtgcaatggcatgatcttggcttactgcaacctccacctcccgggttcaagcgattctcctgcctcagcctcctaagtagctgggattacaggcatgcgccaccacacctggctaattttgtatttttagtagaaacagggtttctccatgttggtcaggctggtctcgaactcccaacctcaggtgatccgcccacctcggcctcccaaagtgctgggattataggtgtgggccacggcgcccggccagggacttttaaatgttagtatggttatttagttacagtgttttgttgagtgttttcctcagtggggcatgtggatgctatcttctctgaatgcaggctcctcgaatacagggactttgtattgtttacttctgtgttcctagcacctaaaactgtgcctggtacataacaagcaattgatacatgtttgctgtttttgtgatgttaaatactacacatttgcatgtctgtctttcaccctgagcatttatgtggttggtgatagttgatctctttacacatctgcaagtacttttctatcaccctgagaacttaatgtcttggccactgtagaaatcttggttcaaagtcctttttcctctttaatttgtaaattttattctaccgtctcctacctcccactactatagatgagaagtctgatgctaggctgattcttttccttttgtaacttgttctttctctctggcctcgtctaatctttttaccaggtggtagggattttgtccccatcaattgtgtgtagaagtcgtgtttcaagcttcaaattgaagtcttttttttaaccatagaaaatgttctctcatatttttgtaattattgcctcttcatctgttcctttttcctgattttgaaatgcttattattggcatattaagtctcttggctttgaatgctagtctcttatttattcttcctgattttcatcattttgattttactcaaaatgatgagagtaagagatttttcatctgcttgctctttcaggccaataatgtattttcccaaccattctttcttctagttacctttaacccattgcttttttttttttttttttttttttgagacagagtctcactgtgttgcccaggctggagtgccctggcacaatctcagctcactgcaacctctgcctcccaggttcaagtgattctcctgcctcagcttcaccctcccgagtagctgggattacaggtgcgtgccaccacgcctggctaattttttgtactttcagtagagatggggtttcaccatgttggccaggctggtcttgaactcctgacctcaagtgatccacccacctcagcctcctgaagtgttgggattacaggcatgagccactgtgcccggccaacccattgatattttaagtttgaatagtatattcttaatgccaagaattaataagtttttgttctttcttgtatgttcttcttattactttaaaaacaaactagttctctgtttcctccagcagtcctgttttattggggaccatctgctttagtagatctgattggtctgtctctctctagttgccggatcctcttaggtactagcttatttccattttctattttctgcttaagctaggttaagcctttccatagttggaggcacaacagtttctactcctgcatcgagtgtgaaaaagaagtctctgtgtttctaggtacccctaaatgcaagtgatctgttcttttcgtttcaaggatgtggaagacatcttcctacactttttctagtaggatccaacatttcagctccccctgcctccaaaccaagatcacacacatgctgaggcagagccacccccttaatcaagtgtccaccatcccctcaggcctagttcttccatgttttcaccccagggctccctgccgctgctcctctagcccccttcagacctggacatcccaacagagtctatagccttcaacagtcctcaggttcctctagcttactcaccctagacagctgaaggctggtggaagagtaacagagatcagagatgcagaatccttccccctttctttgtggttggttggttggttggttggttggttggttggtttgttttagacagggtctcactgtgtcacccaggctggaatacagcagtgtgatctcagctccactgagcctcgacctcccaggcctcagacaatcctcccacctcagcctcctgagtagctgggactacaggtgtgcaccatcacacctggctgatttttttgtactttttgtagagaaggggtttcgccatgtttccaaatctgatcttgaactcctgggctcaagcgatccgtccacctcggcttcccaaagtgttaggattactgttgtgagccatcgtgcccagacttctttacgttttgatgaacgatagcctgtatttttgcaactggtttacactaagcccagtgtgaataagcttatatgaattaatacataagaaaatattggggccatgcacagtggctcatgcctgtaatcacaacactttgggaggctgaggtaggcggatcacctgaggttgggagttcaagaccagcctgaccaacatgatgaaaccacatctctacttaaaatacaaaattagccaggcgtggtggcaggtgcctgtaatcccagctactcgggaggctgaagcaggaggatcacttgaacctgggaggcggaggttgcggtgagctgagatcgcgccattgcactccagcctgggcaacaagagcgaaactccatctcaaaaaaagaaaaagaaaatattggaatcttagaattagaaataacatggtcataataaaatgagtctcttaatttgtatgttgctttaccattttaatgcaattttatatacatggtctcatttgagttccaaaatagccgtgtgtggtaagtatggaagatatcatcctcacttgacagatgagaaaactacagctcataaaggttacataacttgcccaaggacacatgggtaatgaatggacctggaccagagaattcaccttcttatcacactatgccattgcttgtttatttgtttgtttgaaattgccttcagaacatgttacattgtataaatgttttctagaatccctaaattatatgctgtaacctgtattaaattttttcaattatttctattatactgatatgagcaatttaaaatgtatatacataataagatactgagtttaataagatttttaaatgtagtcagaaatctaacaaaagaggaatttgaaaatcatttgaaaaagattaatatttctagaatatgtgtattatttcctgaaggtagccattttgtttttcttttcttttcttttttcttttcttttctttttttttcctcttttgagacggagtcttgctgtgtcgcccaggctggagtgcagtggtgcgatctccgctcactgccagctccggctcccggactcactccattctcctgcctcagcctcccgagtagctgggactgcaggcgcctgccatcacgcccggagaatttttttttttgtatatttagtggagacggggtttcaccgtgtgttagccaggatggtcttttctttcttttttttttagacatagtctttctctgttgcccaggctggagtgcagtggtgcaatcctggttcattgcaacctctgcctcccgggttcaagcaattctcctgcctcatcacctgagtagctgggattataggcgcacaccaccacgcctggctaatttttgtatttttagtagagatggggtttcgtcacgttggccaggctagtctcaaactcctgaactcaagtgatctgcccgcctcatcctcccaaggtgctgggattaaaggtatgaaccaccatgcctggcgaaggtaacctttttgaaggaggacatgcatttttatatatgagtagttaaatttgtctctgtgtaatatatttttaaaacatttgaatttgtcttattatgcagtagaagccatgcagtagggaaatagccatctccctatcaaacatgacatcgagaaaatgtaggcatgttacatgtgtttgttttgtcttagagttttatagtatagtactaaatgaattaatagctattttaaagaccaggcctttgttctgatctctgctgcttttcatgctaacactgtgtttaaaagtattttttcatactcaagagtgatattaaaaatacttaaaaactgatatggcccggtcagtgatcactgagaatatacccgggctctgcacacctggtgtagttgctcgctggcagtacatccgagctgctcagtcacatcacatagcactcttcacttgcctgagtactttcatttccattctcccaggtgatctggggagggatgtagtgccatccccattttgcaaattgggggaatcacagccccaaggagctgaccatagggccccttagaataaaggatttctggctcgtagtttggtggtcttccttgggtagaagtttccctcttttcagaagagaaggaagaggtcagaatagccatgtttgataggacaaatatcagctcctttcagaggaaactcatagtaggtggtgggtagaattagcaccgtcccatcctccctggaatcttccattcccaagcagatttgtcactttcagggcctttgcaggagatgcctgccgtggaagagtaaaactggctcaagcgagagagcagatttttcccggtggaagaacctgactcagcctcttttttccatattaacagggatgttatgtacacggcctgactttaaaagtatattcttttaattccttgttttttcccttctcctccttccacagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtaacccaggcctttagattttctcttttaaaagtttcgcactctggaaaatgctgccatatttaattcctaatagagatagaagtgagtgtattggaagagggatgagggggatctcaaggaggacttcaattcttacccctttcaccacccccattattctgctgagtatcagttgccctgaaactcccttcctatcttttcttccagttctgtccgttcttctcccttctattatgttctttctcttgctcccatgcccgaccttcacaggctaaattgtgtgttgggtaggtgtgtgaggccaggtttggaggtgtggcaggttcttcgaacagatttggatgcagtcgttctgttgctactcttggcttgcctcagatgttgtctcagaaactagttccatgtttttcaccgatgcgtgtattgttttatgacatgataattgcttctggcattgttgctcataaacatatttacgaacacagcatttcaactatctaactcaccagaaacttgaggaataaagattggttagatggtttaagaatctttgctggaaggcacagtaggtgacaaatgttcccttttcccttctttttttcttcttcttttaaaaaatctcttgttttatgaaaaacagaaatcagtttgctctaggacagtggaagatatggcatgtctcatgcttttggtcctgggcttttgggtgccttgatcaaagctcagcaactgattagttttgtctttggggcagttttggcgcctggcttgagtacagagtttcaattctaattctcaaggtatggaagcaaatgctaaaactatgaaggaaaaaaatcccaggactattatcagaggcccattatatataatatagcttgatacttttatttaggcatgctgtttatccttattgcctatcgtatttatctagtgtctataatggttaatgaaggagacgtggcccctgccctcatagagcttacatctagcagggaagatgcgtgttgagcaggtttttcaagtgtgatgagtttgtaaagggggaatccaaccttgtctgagggatgatggaaggttcccccatagaaatatggctttagcctgagagctgaagaatgaattaggcaatcaagaaagagccatagagggggatgggaaacagtgttccacagtgaggggacaacttatgcagagctcaggacaagactgtttagatgtgaaagaagttcaggaggacaggagcatagactgagggacagggtggtgcctgatagggctggagacataagaaatgattggatggttcaaaggaatttggacggacttccaagaacaacacaatgtcaccgaataatgtcataaaatttgtgttttaaaatgcagtaggaggagagagttggagaggggcaagagtgaatacacgctcgtcaattaggaagtagttgaaggttaaagggatagataatgggttctcatttagactagggtagtggtgatagagatgcaaagaaatagattcaagaggagtttaggcaatgatgatttaaggctcagtaactggatatgggagagctgaaagaggagggaatcggccgggcatggtagctcgcgcctgtaatcccagcactttgggaggctgaggcgggtggatcatgaggtcaggagattgagaccatcctggctaacacagtgaaaccccgtctctactaaaaaatacaaaaaaattagccgggcatagtggcgggcgcctgtagtcccagctactcgggaggctgaggcaggagaatggcgtgaacccgggaggcagagcttgcagtgagctgagatagcgccactgcactccagcctgggcgacagcgcaagactctgtctcaaaaacaaaaaaaaagggtggggggagggaatcaaggatgacctccagattcccagcttgagtttgggggtacagcggcatcattcacgatattgggaatgtggaaagaggagagaggttgggatgagggggaatgatgaattcagttttgggtaagctgatttgaggtactattgagtaggcagttgagtgtacatacatgtccagagatcagaaatgaagtgtggcctggaacatcatcctgtggtattaacactagataaaaactgaaagcccgggcagggatgagattcccaaaggagaaagtgaggggagaagagagcctaggatgtaatctgaaggaactaccacatttaaggtgaggtagaggagagcttgcaaaagaggctcagaagagccaggaggaaaaccaagagagtttatggtcacagaatccaaggaaagaaaagttttctagaaggatggtagagtcagctgtatttagtgtttcagagagggcgaggaaggtgaggactgcaaggcatctgttggattaaatagtatggacacctttggtgagtacaggatggaattcatctcagaaaacagaacgttacactgtagaagcctgatgtgacatgatttccatggaaagccagagtgagtgtattgcatttcatcttcacagtgtgggatattaagggcatgtactgttatcctaaagcaaggaaaggtaacagaaatattgtcatcattgaatctcccttcactactgctattcaggcattaaggttcctgacactttctattaaaaccctcaataccattatgggacctgtatcagagagagcataacaagccaacttgttacctgctaggtaacaagttgttcagtcttttctttgttcagtcttttcttttttccaatcatttactgtataggatgtctgagaaattctatctaaatgaaaagtcttctctcacacagcttcccccagctaccacagcatgcttctctgcatacttgtagcgtttacaaaacctgtgcctaccacatatttcttaagttgtcttataattgtttcatagaaatctatcttctttccccagctatactataagctccttgagggtagggatgatgtcgttggttgcttttatgctttccaatcatgcctagcaaggactcaggtaagtaacacttccaactgaactctggtttcttgagttcttgtgatagatactgagatgccaagggcttccctttttgcatgactcatggaagtaggcgttatcaacaatcaaatcatttaaatcccatttttttttaggtatggcttcacgaaagaaattttgcataaatataaggtaagacatgcttttttttttttttttagtattcactttgctgtttctatagagaaatttaaaaagagccaagaaagaccagattgatgctttaggaaaggtaataggccaactagtcagaatgcatgccaataaaatacaagcacagcaggaagccctggccacagtagagtcttatattttctttctggattaaaccacactttttcattgtgagttttgtgtaagttttagcatagatacatatttcattgcttcaaaggtaccaaggatttgttttacttaggtgtggtaaaatatgcagacacagaaatgactgtcatgaaggaagagatttttatttacaattctctagaaaatggaggcactgcaagccactctgggagaccgcgtggggaagcaccagagttggtcagaaggcagagggaggctgagcacggtggctcacacctgtaatcccagcactttgggaggctgaggccggtggatcacttgaggtcaggagttcgagaccagcctgaccaacgtggtgaaaccctgtctctactaaaaatataaaaattagctgggcgtggtggcatgctcctgtaatcccagctactcgggaggctgaggcaggagaatacttgaacccaggaggcggaggttgcagtgagccgaggtcgtgccactgcactccagcctgggcaacagagtgagactccatctcaaaaaaaaaaaaaaaaaagaaggcagagggagggtggagggaagcatctgagtgtaatctggtttaggactgaccaatttgagtaatttcagactgctctgggccacagaggttgtccctagttgtctggtaactggccccgggatgaggagtgtgagagctccataaagaaggtagctggggtgtgggctctcggttgcttggtttgcatatgaagggcgagtcattgactatctaggaattagctagccccgggagggacagtctctcctccagagtcagcaaggccccaagatgtcatagtatcaaaaatacagaataaagggccaggcatagtggctcacatctgtaatcctagcactttgggaggccaaggtgggcggatcacctgaggtcaggagttcgagaccagcctggccaacatggagaaaccccgtctctactgaaaatacaaaaattagccagtcgtggtggcacacgcctttagtcccagctacttgggaggctgaggcaggagaatcgcttgaacctgggaggcagaggttgcagtgagccaaggtggcgccactgcactccaatgcgcaacagagcgagactccatctcaaaaaaaaaacaaaaacaaaaacagaataaaaagacatgatgaatacatgctaattggttagtgactccttgctgacttcctttgagtggcctgaaaatcattactttttgtccatacttggggactattcaataaactgaacctgtcagaaaaacaaaacttactcaagctcttacttacagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaaggtaagaagtaatgttggcatgaatcttctctcagggatttagaagggaatacatacctcttcatttattattttgaattgatttgtgttttagtggttgtaactctaaaaagattatagattttattagagtatataaaagtataaattttaagaaaaatctatgactgcatgataaagaactaagtgggtaacttctatatatggaaaaaaattttaaattcatgttgagggtggaaaaatgaggaaatgttggcattttatgtagtttctaaaagtgaaaaatcctgatttttaaaattaaaacctcaattcattcatttatattgtggtaaaatatacataacataaaacttgccactgtaaccatttttaagtgtatagttcagaggtattaagtatattcacattgttgtgcaaccatcaccatcactaccatctatttacagaattttccatcatcccagaccgaaactctggacccattaaacactaactccccattctcccctgtcccagcccctggcaaccaccaaccaccattctaccttctgtctacgaatttcaccactctaggtaccttatataagtggagtcacttatataagtgcagtttatttctgaattgatacgatttcccacataatacacatcaaataacttaggatactttttttggaaatatttttttgaaatgtttaaataatcatgttaaatacaagcagagcaggagctagtatggaacctctgagacaagtggctatgtggtgactgtgaagatctcacgcctagtgaagggttccttggacgggtcttgcagggtcattggagttgtcttcctcctctactcaagccaagaggaagccctcaggctagaggtgtaggggcgccacatgggttgaagaccagtaacagcagtggagccagatgatgctatatggtcctagtgggaaacctgaactgttacccctcaggactgatcatcaacttccaaccaacctggacaggtggggtctagagctggaatttaatctgatagagacagaaatgtgaccccagtggcaccttgacttcttggaccctttatacacatgtgaatgagaatgtcgttgctggtatcctcccatctttttaattaaagtttaataagtctgacctccagaccagatgagatccccttttgtatactgtcaagccctttgtacatatctttcatcacagttaccgaatttaagtaagaaattgtggtactgtttgtttactatcttcctctgtttttctagtccattgataaaaccccagcacctgggatgtagtaagtacttaatagtcactgactatctcttgagggatttaagatcaaagcagggtaaacctaagacaaaactgaatagaaagttttttacagccctctcctgattctgtggtgattttacataccacccttccccacctcaccaactgatgatgatgcttcctggcttacacctgttgtcctattgtaattattaatagcacctccttttactctaaaaaaaaaaaatcccagttgcagccaggcatggtagctcacccctgtaattccagcactttgggaggttgaggtgggcagatcacttgggaccaggagtttgagaccagtctggtcaacatagcaagatgtcatctctacaaaaaagaaaaaattagccaggtgtggtggtgcacacctgtggtcccagctacttgggaggctgaagcatgaggattgctggaacccaggagtttgagattgcagtgagctatgatcgcaccactgcactccagcctgcatgacagagagagaccttgtctcaaacacaacaaaacccagttgcaataaaacttaagcccactctaagtttaaggtacctttctcattatatcagtgagtaatcaagccaataagacattttgatcaagatataatagtcattattaacataatgagtggattagattctaaccaagagcacaagggaacatgatgtctttgtcagtcaaatattggtgaacacagggcatgaatgccacattccatcaccacctgccctatgactacagtgctaatcagtcatggcagcctcttccaattgaccagattgaacacttttgctttcctgaggttagcctgagcagccagctctatcgagggctttttgagatattgagaagatgcctctgggatgtccctcactagctctgtggagatcccaagttgagggccaccttaacatagtaaagactgtgaggctctaagattagacagacagaactaggttaacatcctgcctctgccccttcctgggtgactgggcaacatactgaggttttctaatccttggtttccacacgtataaactgaagataaaaatacctaccatattggatttttgggaggattaaatgtaattacctatatgaagaaaatggtggccaggcgcagtggctcacgcctgtaatcctagcacttttgggaggctgaggtgggcggatcacttgagggtaggaattcaagaccagcctggccaaaaaggtgaaaccctgtccttactaaaatacaaaaaaatagctgggcatggtggtgcacacctgtaatcccagctacttgggaggctgaggcaggaggatcacttgaacccaggaggcagaggctgcagtgagccaagatcaagccactgcactccagcctgggtgacagtgaaacactatctcaaaaaaaaaaaaaaaaaaaagaaaagaaaagaaaatggcatatactactaaacatatagctttctcctccagttctctcttcttttttccttatacttggttctgaggtttgtgtttcagtcaccaatacagaccctggggagagtttgtgggccagccattttctcaggatacctaaagtttcacccccttcagggataactgttctacctgctctttagactggctttaaagatagaaattcaacttgtatattgtttgtgtcttctacccttccttgagtgaggttgaactggtaacacatacttgttgtattaaatatcattgaactgtagtgaaaatgataggttcaaccatttggaactctatcagatgagacataaaagtagattgttccagtccagttttataatccccactttcccatcccataggaccctccaaccctctgtggcaggagggaccatacttcctggtttacacctgcggtcgtaatggtatcattgttaacaggggttgggaagggttgggggaatttgatgacaacctctattctaggttcatttaaggtattttgtaaggtgggcaggttgaggggggtcaatgcagagggattaaagaatgaaggaagattttctaaaactaagattctggtttattatttgtcaaactccccagcaaggcatttgcagaaagatggctactagactccctgggggaaaatggtcgtgtagtgccttagggagagctggggcaaagtatcctgatcccaaatggccttgaaaacttcagagccacacatacttaagagaccatgtggccttgctcaatgagctcatcagaaatgagttgtgtacagctgggcacggtggctcatgcctatagtcccagtacattgggaggccgaagtgagacgatcacttgagaccagaagttcgagaccagcctgggtaacatagcaagaccccatctttacaaaaaaaaaaaaaaagaaagaaagaaaaagggaaaaagaagtgagttgtgtggacccaagtccagagggtcctcccagaatattctgctctgcccctaatgggaacatttgctggcaggagacagggcaggtaggctgtgaactagctagcaatagctgagcttgaatttctacctagctcaatgagacaggacctcagaataagattcaatttcatttttgaaaaataaaggtaagatttcctacacactctagtttgtaaaagaaactaagtgcttggccgggtgcagtggctcacgcctgtaatccgagcactttgggaggccaaggcgggcggatcacgaggtcaggagatcaagaccatcctggctaacacggtgacaccccgtctcttctaaaaaatagaaaaaattagccgggcgtggtggcgggcgcctgtagtcagtgctgaggcaggagaatggcgtgaacccgggaggcggagcttgcagtgagccgagatcgcgccactgcactccagcctgggggacagagcaagactctgtctcaaaaaaaaaaaaaaaaaaaaaaaggaaacttaagtgcctaccacagagaatttgtctatcactgaaccacggccaccagtataacagaagtattgtttaatattgttttgtttaaagacatggtgctacaaagaaacaagtataaaattacagtctctgcttgtgtaagggaacaagagggattctagtaattgatgccctatcagaaagacgttttgttttccaaagaaacgcagcagttttgttgccaagattagagaacatcgtcaatggctggcagagtcaggctgagaaccacaatgcatttaggttggaagggcttctgaagttttcaacctatgtcccctttaagaactttcttggacacagatgtaccttttctcttttcttctggaaagcataacaaaatgcacagcagccactctattaagaggtgtttctgaactcctgaagatcctatggctagataaaggctcaataaggagactcgttgcccctaccttggtatcttccattttctgtgtggatgccacagaatgtgtttaacacctatagagaaactccagtgaaacacagaaactctttctttataggcaatgtctgtaattggaaaatgtaccaacaatgtaacagacccactttacagacatcagtggatgagtgagatataggaggtggacgagatgcaaaaagtgaccgtgtgtttttcattgggttgtggcaccacaacatagaaagaatcccacctgggactgaagtctctgtatgtggcagaataagcagagggttggactaaagcatgaatttgttttatagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtaggtaatcagggtgttcactgcagtggcaacaatgacactagcgtgcatgttgtcccttacaatatatagataaaaagtgactttacctttacgaggagaccacatgattctcttggaattcatcactatatttttaacagctttattgagatataattcacataccatgtaactcacccatttaaagtgtataattcaatggtttttggtatattcacagtgttgtacaactagcaccacaatctaattttagaacgttttcatcatctgaaaaagaaactacatacctattagcatcattccccattcccttctgtagccaccctgtgccacctaacagccttaggcaaccatcaatctactatctgtctttacagatttgcctattctgaacatgttgtagaaatggacacatatgtgatgttttgtgtctggcttctttcactcagcacaatgttctggaggctcatccatgttgtagcatgtatcagtactgaacatctatttgttgctgaataatattccattatatggatatacacattgtatttattcattcataagctgatggacgtttgggttgtttccactttttggctactatgaataatccttctatgagccatcacatacaagtttttctgtgcatgtatgtttttatttctcttaagtgtgtacctaggagtggaactgctgagtcataaactaattctaaaaaagtttaacattttaagaaagtcccaaactgttttcccaagtggctgcaccattttacatttccagtagcaatggatgaacgttccaatttctccacatcctctctaacacttgttattgtctatcattttgattatagccatcccagagggcatgagatggaatctcattgtggttttgatttgcatttccctaatgactaatgatgtcaagcatcttttcatgtgtttattggatatttgtagatcttctttggagaattgtctattcagatcctttgcccatcttaaaaactgagttatttatctttttattattgcattgtaggaggttttttgaatatattctaaatacaaatcctttatcaggtatattatttgcaaataccctctcccattctgtgggttgtcttttcccctttcttgatggtgtcctttgcagtacagcagtttttaattttggtgatgcccagtcaaaatgatatattttttctctttggttgctcgtgtttttggtgttgtatctaagctattgcctaatccaaagtcataaagatctattactttgttttcttctaagagttttatacatttagctcttaaatttaggtgtctgatccattttgagttaatttttgtgtgtggtgggaggtgagattccaaattctttctgttttatgtggatatttagttatcccagcaccaattttttttttcttttttttgagacagagtctcgctctgttacccaggctggagtgcagtgacacgatctcggctcactgcaacctttgcctcctgagtagtagcttggattacaggcatgcattaccacgcctggctaatttttgtatttttagtagagatgagatttcaccatgttgaccaggctggtctcaaactcctgaccttaggtgatctgcccgcctcggcctcccaaactgctgggattacaggtgtgagccactgtgcccggccaccagcaccatttcttaaaaagactatactttccttgttaaattttcttgacacccttatcaaaaaatcagttaaccataataaaagggtttatttctagactcttaattatatttcacaatctctatgtttatccttatgtcagtactgtacaattttgattactgtagctttgtgggaagttttaacattgggaagtgtgagttctccaactttcttcttctttttccagatcgttttggctattctgggccccttgaatttccatatgaattttaggattgatttgtcaatatctaccaaaaagcagctgggatattggtagggttgccttgaatctgtaggtcaatttgggtactatggctgtcttgagatgtctttccatttatttagatctttaatttcaacaatgttttttacctttcagtatacacgtcttgctcttgttttgttaaatttattcctaggtgtttttgatgctattgtaaatagaattgttttcttaattacattttggattgttcattgctagtgtatagaaatacaactgacttttatatactgacattgtgttgtgaactttgataaacgtattagttctaatggtttttagtggatttcttgagattttccacctacaagattatgttatctgtgaataattttacttcttcctttccaatctgtctgccttttcttttccttttttttctttttgcttaattgccttgtctagaacctccagtacactgttgaataaaagtgaagagagtagatgtctttgtcttgttcatgatactggggaaagcattcagtctttcatcaagtatgatattagctgtgtatttgtttgtagtggccttttattacattgaggaagtttctttctatgcttagtttattgagtgtttttattgtgaaagagtgttggattttgtcaaatgctttttctgaatacattgaaatgatgtgttctttccctttattctattaatacagtatattatattgattgatttcagagatgttaaaccaacctgacattcctgggataaatcccacttggtcatgatgtataatccaccttctatgttgctggtttccatttggtaatattttttgaggatttttgcatctatattcataagagctattggtctatggttttcttatgttgtgatatctttgtctggttttggtataagtttggcctcataagaggaattggaaagtattgtctcctcttctgtgttttagaaaagtctgtgaaggattgattttaattcttcaaatgtttgatagaatccatcagtgaagccatcagggcctgggcttttctttgcaggaagttttaaaattactaatttcaatatttttccttgctatagttgtattcaagttttttgtttcttcctgagtagtttgtgtcttggtagttgtgtctttcttggaatttgtttcatttcctgaaacaaatttatttcatgaaattcatttcatctaatatatctaatttgttgacctaaagttgtttgtagtacttctttatttttttttctcctgaaagtttggtagtaatatttccttttttttgttggtcagtctcactaaggtttgtcaatgttattgatctttttgaagaaccaacttttagttttattgatttttctctattgttgtctattctctatttcatttatttctgcactaattgttaacagtggagggtgtccaggttcttggcgtcttgaacaatgaattggacaaaacgcacaaacaaagcaaggaaggaatgaagggttttactgaaatgaaagtacactccacagtgtgggagtggccccgagcatacgggctgaaaggccctgttatagaatttctgggagtttcaatacccccagaggattccattggttacttggggtacaccctatgtaaatgcagagtttgaagtaaagttacaaagtcatttacagcataagcccaatggagaggatatttcctgtcatagctgaagtgtgaactggccttatgttccctgcctccagaccttattttcctgcctcataatctttatcatttccttccttctgcttgttttgggtttagtttgctcttctttttttcagtttccttagaaggtaatatcattgacttgagatcttttttattttttaacaaagatacaaatttccctttaagtactgctttagctccatcccttaagtttgctatgttattaaacaattgctgctgctttaaaaaaaatagttttgctatgttgtgcttttgttttcaatagtattgtctaaatatccttgtgatttctttaacttatctgttatttggtagtgtgttgtttaatttctacatatttatgaattccccatatttctttcgcttattgatttaaaatttaatttgattgtggtcagcgaacacatgctttgcctgatttaaattcctttaaaactttttttctttttttggtaaatccttttaaaatttgttgaggctttttttgtggcctagcatatggtttatcccggagaatgctccatgtgcacttcagaagactatatatttcactcttattgggtggagtgttttatatatgtctctttgaacatatttataatagttgctttgaaatctttgtctgctaagtcgacgtctagtcccttcaaaagcagtttttattgcctgcttcccccctccgctccccccaccccccgcccgtgtatgagtcatacttttttctttgcatgtcctgtaatcttacattgtagtaaccctaggtagttattcccatgcccctctggggcttgttgttatttgcttttttgtttatttgttgagtgacttgtctggactagtttagtgaagtctattccccttcagtgtgcagcctctgatgtcactcttcacagagtgctgccttgggcatgcatacagtttctcccaccaccagggctggtgtggatttaattgggctctctttgactgtctctttccctgatctctcctttaagcttcggacccatctgcctctatttgaagcagtcccagctgttagccttcactaattgctagccgattgctctattgtttttaacaataacaatgccctggcccacagagtgctctacagtctgatccgattaaagttggacccctttgcaggggcagggctttaaccatgtttgaggcttactccaacctccacaaaggctcttttctcatctgtgtctttccccgattcagtctgttaaatttcttctagctggggtactgttactactagtatctcggcactaccatcctcctcgtaaatgcttattcccaacaatctccattgttttcaacagtgcctttaggcatgaacttccttacactctgtgccaaataaggccagtcccttaggaagagtggcagtgctctgttcttgacctgcctcaccccctgggccaaaccactgtgccatcgcactgcagctgggagcagggacagtgacccacttctcctccagtgacagccccattccacaagtggggtagtaggcagggatgatagctcctggtcttcttggcttgcccttcttggcatagcacctcctccttatgattgagcaagcatgggggcagttggggtctagcacctgcaggctgccatgcctaggatagggcttctgcccaatgagcgggagaagtgaccccagtcctctctgctgtgcttgcctggaatccagcttctgtaacgcagagctgaggggaatgagggatgcccatcagcttgctccttctggggcaaaaccatagccctctactgggagctgggggaagaaggagccccgtcttggatgcatccacttgaagtagagcatccttcatgctgatcagtgaagggggttagagtagatcatggctcaaatgccacagactctctctgttggtatcaaaatttagtaagttttcttaaatgtttctccatatgctgtatgccattaggacaatttccagtggctttaactattttaatttttttttaagtgattttccgctgggcgtggtggctcacgcctgtaatcccagcactttgggaggctgaggtgggcggattgcttgagcccaggagttggagaccagccttggcaacttggcgaaaccccatatctataaaaagtacaaaaattagctgggcgtggtggtgcatgcctgtagtaccagctacttgggaggctgaagcaggagcatggcttgaacctgggaggcggaggctgcagtgagctgagatcgtgccactgcactccagcctgggcgacagagtgggaccctgtcttaaagaaaaagatgttcaccagttaaatggttgtttcactggggagagggtctgccaagcccctaacactgccattcctgtcactatgttgtcattttgagaactgtactgagtatgtctataaacatggatgtaaaggcaataagccatgtactcatctttgtgacagcgtgcatatccagagctgcctgtctggagtctctggcagcttctggcatggagtaagatctataaatattcctctcattcattcatccattcaacaagaatgtattgatcactcctgagtactcttgctcatttgtcttggtgaaatttagcgtttttctaaatttccagtcctacattttaactgctttcttgtcagtttttaccctatatggcagggatgagttcttaagaacaacagctatgtgcattatctcattaaatccttaaagcaacctgatgacgtagataatattattcctatttcccgaaagaggacactgaagctcacataagttgaataatttgctaaatgatgggtctggttttgattccaaatttgttggactctacgcttctcatttttgactgctaggtcataccatgtctctcactgtaggaaaagatgttacaggacactgggttttgtttgtttggttggttggtttcctttttttgagatggagtctcactctgtcacccaggctggagtgcagtggcgcaatctcagctcattgcaacctccacctcctgggtttaggcaattctcctgtctcagcctctggagtagctgggattacaggcatgtgccaccacgcccagctaatttttgtgtttttagtagagactgagtttcaccatattggtcaggctggtctcaaactcctgacttcagatgatccacctgccttggcatcccaaagtgctgggattacaggcatgagccactgtgcccggccccagaactctggttttcaacttcttacatgggaatgttatgacctcttagaaaggacttttgaagacttttcttcaggtttcctgttctgaaagaaatgaaataaaattattggatatggactaacgcttaatgataaaagtgttcttcctgtagatagaatcataaccataataagtagctttcgttttcagatataaacacacatacatgcatttgcaatgtcacaagtacacatagacacgtgcccacatgatgttggttacatctgtagctgggaaacataattaaacaattaccaaacagtgttaaatttcttacttcccttcagtaattgttaaagaaacctctttttcttgatttgggacccttataccttgattgctgaaaatgttgactaaaatgtgatttctggtgtaaaatataccctaatcaatgaggagagagagaagtggggagacagactgagggagaaatggaattcatcattggctgtgagtccaaaatatttaaaaatcaagtaagcatgagaggcatctcatagcaagtaggaaaggatgcctccttaaaccttgacatccaaatcccaaagactgaaggttagaacaagctcttctaggattatggtgaataaagaagataatgttaaagaaattggagctgcacacaaagaaaattgtggcctctggaagcctagaagagttagaagagccttaagaagtgggagggaggagactggggctcattattccataacagagcctcccactccccaaacaatagagatacagcatcttgcagaccccacacacatgatcagagctgacattgggtaaaatgggccagaacctcatttctgatgtttaatcattttagttgtgcccctaattttctttcctcagttcctggtacatagtggatacacacacacataagttatgctagagccgaaatttccagataaaaacagagctgacaattactttatttcttaatatctatgagctattttgtataaagatcatatactctttattttgtcttgtagtcatggaaattcataattcttggcagagtgctatagtttaaattttcccttatgttcactgagatgtggggatatatttaatcggagttaagtcactatacagagatgaatatgatactctttaagacagacttacaaagagacagaggccagaaaggtttcaaaaataattttaattatttatagtctgaatgactcccctctctttattcattcatttaacaggtatttattgagcacctactatgtgtcagacactgttctagacttctgggaaatgtcaatgaccaaataaagatccgttaccttgcagagcttacattttagggggaggagttagatgacaaacaatacagtaatgagtaaatgatatgatatcttaagtgatatgttcttttttattattattattatttttagacggagtctcgttctgtcgcccaggctggagtgcagtggcgcaatctcggctcactgcaagctccgcctcccgggctcacaccattctcctgcctcagcctcctaagtagctgggactacaggcacctgccaccacgcccagctaatatttttgtatttttagtagagacggggtttcaccatgttagccaggatgtctcgacctcatgatccgccctgcctcggcctcccaaagtgctgggattacaagcgtgagccactgcgcccagtcttaagtgataagttctatgggaacaataaaaactagagcagagttaaggagaacaggaaaactggacttggggacaaaattgcaattttttttttttgtttgtttgagacagagtctcactcctgtagtccaggtgggaatgcagtagtgcaactacggctcattgcaaacctgaccacctgggctcaagtgattctctcacctcatttttttattttttatagagatgatgtctcactatattgcccagactggtcttgaactcctgggctcaagcgatccttcctcctctgcctcagaaagtgctgggattacaagcatgagccacggcgcctggccaaaattgcaattttaaataacgtagtcagcagcattgaggaggctcccaagagggaaatgacttgattgaggtgtcttggctggtcaggaatgatagagtaggatttgatcctgaggttgacttgaatgtccatgctctttttctgaagggatagatgagagtgacaggcattctcaggaaggacgtgacctactttagtcagcccttattcaatgaggcctgaagggtggacagggagcaggaggaaggcatttaaagaaatctaggtacctggctggaaggtttgggctgagcacggctttttttttgagatggagtcttgctctgtcgcccaggctggagtgcaatggtgcgatctcggctcaatgcagcctctgcctcccagggtgaggcaattctcctgcatcagcctccaaagtagctgggattacaggcatctgccaccacgtccggctaatttttgtagttttagtagaggcagggtttcaccatgttggccatggtagtctcgaactcctgacctcgttcatgatccacccatctcggcctcccaaagtgctggaattacaggggtgagccaccatgtccggcctgagcatagcttttaaaatgacatggtctaggccaggcgtggcggctcacgcctgtgatcccagcactttgggaggccgaggcaggcggatcacaaggtcaggagttccagaccagcctgaccatcgtggtgaaaccccgtctctactaaaaatacaaaaattagccgggcgtggtggcgcatgcctgtaatccctgctactcgggagactgaggcagaattgcttgaacctgggaggcgggggttgcagtgagccgagatcacaccactgcactccagcctgggcgacagagcaagaccccgtctcaaaaaaaaaaaaaaatgacatggtctagctgggcgtggtggcacgtacccgtaatctcagctagtcgggagactgaggcaggagaattgctcgaacccaggaggcggaggttgcagtgagctgagatcacgccattgcactccagcctgggcgacgaaagcaaaactctgtctcaaaaaataaatgaattaatgaattaattaaaaatgacatggtcaaaagctggaagggaggatgtataactaagggaaaatatgaaagaatagtgaatctatagtattaatgttttagaagagaagcatttagatatacctttcagagctattaactctccctcgaagcacacttttggagtctggattacttagagctgcagacatgcgcaaggtccttcttgaaggatttattttagattgaggagatttaaaaggctgacacacaaatagatttttgttgaccaggtcatataaaagctgtaattcagtaaaacgttcccattttttttgtttgaaatttttcaggaaagaatgttgtaaagaattaattagtctttcatgcagtgatcaccccaaggatcctgcatttcagaggataatgtgttgttgagatgaaagagatggtttctactgaggaatttgtttcaccaacaaatgggcttttatgcaatttttttgtgagttctgcaattaatcttacgttaccactacgatctgggtaaacctagtcaagtaaatgatttctagacagaaaaaagaaatgcagaactcagggaatggattctgaaggacaagctcagttcttaaaaactgttaccccttatgacttagaatcaaagaaaaatgagtgtcagatatatcttcctcattcctttgatgatgactaagtcctgaatatgttaagtgatttgcccaaggtgacttaggtaattacttgaagtgctaactccttggccagtgcttattctagttcaacagagtcccatcatatgtgcattgaatttatgtaaatttcaattattgtatatggcaaaaaaggagaaaaatactggaaaattttattttcatatactttatcacatatataaaataatatatccatatttatataatatatataaaacattcacatatccatattattgtatagagttgtatgcatacattcatgtacagtcaaccctccgtatgcacgggttctgcattgtggactcaaccaataacagattgaaaatatttggaaaaaaagaaaacaatataacaatacaatctaatataaattttaaaatatggcataacaactatttacatagcacttacattgtattaggtattataagtaatctggagatgatttatagtacagatactctttgatttatgatgagtttatctggacttaattctatcatgtcaaggagctcattgaatgcttgttgcttttgcaccattgtgaagttgaaaatcgttaagtcagggaccatttgtagacaggaggatgggtgtggattatatgcaaatactacgccattttatacgagggacttgagcatccacagattttagtatcctggatgtaggaggtggtcctggaaccaatccaccttggatactgaggggcaactatatatgttaagggtaacttaagaggtttcccaggggtaattttggctataaatgatttgcatcccatgtagaaattggaagcttaatcccctcctaacaaagcccaactccttgatttccatctttcctccatcattatattacaggtcgaattatgtccctaaacatgacatcatggtgtaagagccagatttgactcagttgaaaatgcaagtgttatttttgtcataaacaccagcaaagtaaaggggttccattatatttattcatagagtagggcggtgctgatgttggaattcagtggggagaaaggagcccccttggctgactcttctttgggtggttttaactgtcacttcaatcatcaaaaactctgcaggtatctgatgtgggcctggtacagggtttctcttttctctagttctgaccaggtacttattccagggtagctctcctgccagttctgctcttttcacctcactgtctttttcctcacttattttctagctcctcttccataccaaacttataaacgggtgtacaatcatgtttagcaattcctggtcctcttctccagacctgatttggagccactagaataactgcataacttcacatgcctgctttttcatgcactcaaaagaaacatgtggaaaatatagactgttagaatcagtctgttagaatctgagatactttacaggtcaactggtccaaatgcctgattctaaagatctcaaaagtgagacccagggaggattttcaaggttatgtagctttaatggcagagagagtttttctcaccgctttaagctgttatagaagtttcaataaagaaacattacaggccgggtgcagtggctcacacctgtaatcccaacaccttgggaggccgaggtgggtcgatcacctgaggtcaggggttcgagatcagcctggccaacacggtaaaaccctgtctctaccaaaaataccaaaaattagccaggtgttgtggcgggcccttgtaatcccagctactcaggaggctgaggcaggagaaccacttgaacccaggaggcggagtttgcagtgagccgagatcatgccactgtactccagcctgggtgacagagcgagactccatcacaaaaaaaaaaaaaagaaaagaaaagaaacattacagatagatgagagccacaaagacggagcctccaatctttatgaaaaatattattttgttttattttgagatggtgtcttgctctgttgccgaggccacagtgcagtggcatgaacatggctcactgcagcctcaacctcctgggctcagggatcttctcacttcagcctcccaagtagctgggaacacattccggcaccaccacacctggctagtttttattttttaagtttttgtagagatggggttttgccatgtttacccaggctgctcttgaattcctggacccaagcattcctcctgactcagcctcccaaagtgctgggattacaggcataagccactgtgcctggcagaaaaatgattttaaaaatttggatctttagtcctggacatcatgtaacctgcatttgcctctcctgcgccccaaaggaaatgttataataatacaacacttgtggatttagaacacattatggaaaccagtcatttactaaatgtattgcggaaactgagaatgtacttaccatcgaggggggaaaagtgaaggagatgctttaggagacaccctcagataaacaggtttccacatttgtgttgggaaacagcaagggcttcctcaggctatgtgctcaacaggacaaaaacctggcccagagccacagcaggagacctactttatgtctttgaacatattaagacacacctaatgtgtgggcattgtggggagctaatttcttccctgaatgtgacaatgaagttcttttaagagaaaagaaccttgtagattcaacaattgtcaaacaattgtgatggaatttttaaagccaaaaaaacaaaaaaaaaatggcaaggcctgattcttggttattgttattgctgtattggttattcatggaggagatgaatatgaaacaatattcttttttctttttcttttttgcggagaccagctcagtaggggagaccctaacccagcagcgctagaggaattaaagacacacacagaaatatagaggtgtgaagtgggaaatcaggggtctcacaaccttcagagctgagagccccaaacacagatttacccacgtatttattaacagcaagccagtcattagcattgtttctatagatattaaattaactaaaagtatcccttatgggaaacgaagggatgggccaaattaaaggaataggttgggcttgttaactgcagcaggagcatgtccctaaggcacagatcgctcatgctgttgtttgtggcttaagaatgcctttcagcggttttccgccctgggcaggccaggtgttccttgccttcattcccgtaaacccacaaccttccagcgtgggcgttatggccatcatgaacatgtcacagtgctgcagagattttgtttatggctagttttggggccagtttatggccagattttaggggggcctgctcccaacaattttgagacagggtctctgtctgtcacccaggctggagtgcagtggagtgatcatggctcactgcagcctcaacctctcaggctcaagtgatcctcccatctcagcctccctagtagctgagactataggcatgcaccaccatgcctggctaatttttgtattttttgcagagttgaggtctcaccatgttgcccaggctgggcttgaactcctggcctcaagcactcctcccacctcagccacccaaagtgctgggatcacaggcatgagccaccacgccaggcctgaaacaattttcaaggaagaatgagaagtggtctttgggataccttgggttaatatttctgacaaataagttggaatctagaaagatatactctcacttgtaagttacagcgaaatctggtttgttgttccaagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtaagctaaaattgttggtgacattcccataaacatccttcccctaagcacagtcttttcttcacagagcatgtctggcctagaagcccatgagaagatgtcttctctagtaccaaacagaaaccagagaaggcgagcttcatctaggttgtttgaaggggcctcactgtcccttatcctaaaagatatttggtttatttccctgatcttccctaatcccagaaacagaaattctttttttttttttgagatggagtctcactctgccacccaggttggagtgcagtggtgtgatctcagctcactgcaacctccgcctcccgggttcaagtgattctcgtgcctcagccacccaagtagctgggattacaggtgtgcgccaccacacccagctaatttttgtatttttagtagagacagggtttcaccatgttagccagactggtctcaaactcctgacctcaggtgatccgcctgcctcggcttcccaaagtgctgggattacagtcgtgagccaccgcgcctggccccagaaacagaaattctgatacatggcactaagtagacacacagaaaggcttggttcttataaggcaactgtcccatacagtggggttgagaatgtccttttcctcacagagcgcataaaaggcagcagtgaatccagtttgctcttgcactttttacatgttccctgtgcagggcccaaaacacaaaacacacttcccttcagctccctgagtaggtgacctccagcaagttgctcactgtagtcagtttagctgcagccactaaaacggagtgtgttgtgttccttcagtggtgtctgatcaaaggctaaaagaggtgaggaccgaggagctggtttcttgtcccaagttgttctgggatgcaccgtttcttttttttttcttttttcttttttttgagacagagtctcgctgtgttgtccaggctggagtgcagtggtgcaatctcggcttactgcaacctccgcctcccgagttcaagtgattctcttgcctcatgctcccgagaagctgggattacaggcgcccgccactacgtccagctaatttttgaacttttagtagagacaaggtttcatgatggccaggctggtctcaaactcctgacctcaggtgatccacctgcctcagcctcccaaagtgctgggattataggcattagccaccgcgcctggcctggaatgcacctttttctatagtgaacagcaataaataaaaatggacaccaagttgtgtggcatttccctctgtgtcagcactttgtttttctgacctttattaattcattttcagctcatactaacattccaagatgagtaaggcaagtattgtttagggtttctttgtagtaagaaaatagatagaaaacatcagtggcttgtctgaagtgacatgctcatcaggacagaacggggcctaaaccaggttccctgtcacccacaaatattgtcctcctggctgggcacggtggctcatgcctgtaatcccagcactttgggaggccaaggcaggtggatcacgaggtcaagagatcgagaccatcctggtcaacatggtaagaccctgtctctactaaaaatacaaaaattagctgggcgtggtggcacacacctgtagtaccagctactcgggaggctgaggcaggagaattcctggaacccaggaggtggaggttgcagtgaggtgagatcgtgccattgcattccatcatggtgagagagcgagactccatcttaaaaaaaaaaaaaaaaaaattgtcctcccatattctaccacagcccaaggctagttccttcacaagacagtggtcgtggtcccttattctagccactgcacctctgcccttaaagcactgactttctggggccctgaaccctctaaatcactcagctccaagcagaagaaaaaaaccgaagtaccagacaaattttgttctgaatgctcaactattacaaggcaagaaaataggggatttatccccttggaaaaagaatttgcaaaatcaaacattaaagaggattctgagatttggcactaaaattgtacccgagaatgcagggccatgcgctgaggacattggctgagtggccaggagttagtgctgctggggacactgggtagtagccttgttttcctccgatgcagtcatagaaatcacatcagactgtgatgatttgcagggtttatgaaccttctttgatttttgctttttaagaattgagctatttctgaccttattgaatgaccttttgagaactaatgttacgtgaacctgaccctctttttctttaaccaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaaggtgtgtatactataccgagagtgctgagcactggtatcacggacccattagaaccagtcccacgtgactaagagcagccacgtgagtgaagagagtcatttatagcttactcattagtatcaacaaaatgtaaatagttccagacaccaagtggtgaatgcacccatatttgaaaccaaaaagagcaattttaaattcatacatctttttagatggataaagcagtcagccctcagaaacgtaactgaatgtaaagaaaagaagatccccacacccactcagtcccccaacctacaaccttctctgacccacaaacagctctatctggtcttgcccctttctcttctctatccagaagtgtatgtgacaaatagttgagtgtctctctccatgtgatggcatttgtagcttatactccttttctccctttaacattatctttctaagtgttttttttggttttttttttgtttgttttttttcatttgttttttgtttttttgagacggagtctcgctctgcagcccaggctggagtgcagtggcgtgatctcagctccctgcaacctctgcctcccaggttcaagctgttctcctgcctcagcctcctgagtagctgagattacaagggcccgccacaacacctggctaacattttatatttttggtagagacggggtttcaccatgttggccaggctggtcttgaactcctgacctcatgtgatctgcctgccttgacctcccaaagtactgggattacaggcatgagccactgcgcccggtctaagattttttacattatagaactaacatgtttgttgttaacaactgaaaaaaagcaaagaagaataaagaaattgttaacaacttctctcctttctcaattatccttttccccagaggtaactaaaactggcagtttagaatggccccttccaccctcttcttgctcttacaaaaatagtcaagcatttattcagtcattgaattaaaaaaaacctttgagtacctgccatgtgtcagatactattctaggcatacataatataagataggctgaagtcccctcatcaaacacatatctcagtgtgaagagaaagacgataaacaatgtacatacttttttttttaaagaaggagtcttgctctgttgcccaggctggagtgcagtggcacgatcttggctcactgcaacctccacctactgggttcaagtgattctcctgtctcagcctcccgagtagctgggactacgggcatgccccaccacgctgggctaatttttgtatttttagtagagacggggtttcaccttgttggccaagctggtattgaactcctgacctcaggtgatttgcccgcctcggcctcccaaagtgctgagattacaggtgtgagctaccacgcccagcctgtacgtacattttttttttttttttgagacggagtcttgctctgttgccaggctggagtgcagtggtgcgatctcagctcactgcaacctctgcctcttgggttcaagcaattctcctgcctcagcctcccaagtagctgggactacaggtgcacgccaccacacccagctaatttttgtttttttagtagagagggggtttcaccatgttggctaggatggtctcgatctcttgaccttgtgatccgcccgcctcagcttcccaaagtgctgggattacagtagtgagccaccacgcccggccgtacgtatattttttaaagaaagaatcacactgcatactgtattctgcaactgaatttttcccctaaaaattttatcatgaacatcaccgcaagttagtaaagatagacctaactcattctttttagtacatacatattattctgtagtatacatgtaccataacagttatggagcaactaaatcttatccaattgatagacatccagattggttccaggattctgcatttaaaaacaatgctataactagcattcctatatataaggaactcatacgactcaacagcaaaaaaaaaaaaaccaagtaatccaatttaaaaaataggcaaaggacctgaatagacattttcccaaagacatacaaatggccaacaggtatacgaaaagatgctcaacgtcactaattatcagggaaatgcaatgcacagccacaatgagatagataccctctctcaccggttagaatggctgttatcaaaaagacaaaacctaagtgttgaccagggagtgtagaaaagggaacgcttgtactctgttgataggaatatggattagtacagccattatagaaaacggtatagaagttcctcaaaacattaaaaatagaagtaccatatgatccagcaatcccactactgggtatatatccaaaggaaatgaaatcagtatcttgaagagatatttgcattcccatgctcagtgtggcattattcacaatagtcaagatatggtaacaaaccaagtgtctatcaagacagaaaaagaaagtgtgactgatatacgtgtgtggatttatatattatatatatatagatatatcacattatatctatctatctatctatctatctatctatctatctatctatctatctagtaattccttgatatttgtagggaattggttccaggagccctctcagataccgaaatccctggatgctcaagtcacttatataaaatagcatggtatttgcataaaacctatgcacatccttccatatactttaagtcatctctaaattacttataataccgaatgcactataaacactatgtcaatagttgttatactgtattgtttagggaataatgacaagaagaagtctgtacatgttaagtacaggcacaaccatctgttttaaaaaaaataaatttggccaagcgcagtggctcacgcttgtagtcccagcactttgggaggccgaggcaggaggatcatttgagcccaggagttcgtgactagctgggcaacatggtgaaaccccatctctacataaaatacaaaaattagctggacgtgatggcgcacacctgtaatcccagctactctggaggctgaggcaggagaatcacttgagcctggaaggtcaaggctgcagtgggccaagactgcaccactgcactccaggttgggcaataaagtgagaccctgtctcaaaaaaaaaaaaaatccactgaagggaaacccatgcatacagagggctgattgtacatgcacaatggaatattattccaacataaaaaagaaatcctgacattatgacaacatggataaacctggagggcattttgctaagtgaaataagtcagacaaatactgtatgacatcacttatatgtggaatctaaaaaagctgaactcatagaaacagagagtagtatggtggttgccaggggctgagaggtggaggatatctggagatacaggtatatcaaatcatcacattgtataccttaaatatgtacaattttatttgccagttataaatatgttatagttttatgtcaataaagctggaaaaaatcctctgtgtgtgtgtgtgtgtgtgtgtgtgtgtgtgtggacatatatccataagttttagtggcttttttaatgtaagattttacaatgtggaatttatggaatttatatgtttaaaattttaatagctacttcagaagggttataacattggacaatctgaaaaacaacataccatatttatttataatttcattataatttttggatctgtacctttgtttagaaaatttctctttctctgtctctgcctctctctgcgcacacacacacacacacacacaaattctcaaatttaacagctacgttgagatgtaatttacataccacaaagtttacccatttacaattcaatgacagtacgtttagagttgtgcaactatcaccattatctaacttttgaacatttttgccatcctaaaaagaaaactcatacccactgagcagtcatttctcagtcacctcctcccatcacagccctaggcaaccactaatctattttctgtctctatggatttgcctattctcggcatttcatataaatgagatcacacaatatgtggtcttttgtggctggcctctttcactcagcacaatgtttttgaggtcattcatgttgtattctatatcagtacttcattccttcttatgggtgaataatattccattgtatggatagaccacattttgtttgtccattcatgagttgatagatatttagggtgtttccactagttggctattataaacaatggtgttatgaacattcatgggcaagtttttgtgtgtacatgtttcatttctcttgagtaaatacttggtaatggaattgctgggttatatggtaactctgtgtttaacattttgagaaacttgcaaacttttttcccaagaagctaaccagtttaccatttccaccatcagtgtgtgaggattccaggttttctacatcattgccaactcttgttatgatctctttttatttatttatttttttgagacagagtttcactcttgttgccccaggctggagtgcagtggcacagtcttggctcactgcaacctccacctcctgggttaaagtgattctcctgcctcagcctcccgagtagctgggactacaggcatgcgccaccatgcccagctaatttgtgtatgtttagtagagatgaggtttctccatgttggccaggctggtctcaaactcctgacctcaggtgatttgcccgcctcggcctcccaaagtgctgggattacaggtgtgagccaccgcgcccagcttgatctctcttttttcttattgttctcttagtggtgtgaggtagaatctcattgtagtgttgcgttgtatttccctaatgattaatgatgttgagcgtctttccatgtgcttattggacatttgtacatcttctttagaaatattatatttcaggtacattttccatttttaattgtcactctttatttttgcattgcaagagttctttattctatatacacatcacttattcagtatatatatatatatatatatatatatattttttttttttttttttttgagacagggtctcactttgttgcccaggcaaaggcgatcatggctcactgcagccttggcctgcggggctcaattgatcctcctgcctcagcctctgaagtagctggggctacaggcacaagccagcacacttggctaatttttgtatttttgatgaaacgggatttcaccatgttgcccaggctgatcttgaactcctgggctcaagagatccacctgcttcagcttcccaaagtgctgggattacaggcgtgagccaccacgactggccacttgttcagtatttgatttgcaaacattctctctcattctgtgggatctcttatccctttctctgtggtattatttgtagtgcaaacatttttcattttgatgaaatccaatttatgtgcttttttggtggtgttgtatctaagaaggcattgcctaactcagagtcataaggattcattcctatgttctcttctaagagttttataggtttagctcctacacttaggtttctgatccattttgagttaatttttgtgtatggtgtgaaggaagggttcagctttattcttttacatgtggatatccagttgtcccagaaccatgactcaaagactgttctttccttcttggcactcttgtcaaaaatcagttgaccataatataagggtttgtttctggcctttaaattgtattctatttgtctatgtctatgtctatcctaatgctaggaccacactgtcctaattattgtaactttacaaacttactacagttttaaaactggtaaatgtgagttgaacgttgcacttctttttaaagattgttttggctattttgggtcccttgcattttcatgtaaatttcagaatcagcttgtcaatttgcaaaaataccagctgagaatttgatagggattatgttgagtctgtagatcaatttgaaggctgttaccatcttaacaatattaagttgtccaatccatgaacatgaaattttgttctatttaaatcttctttaatttcctccaataatattttgaacttttcagtgtacaagtctaggacttattttgctaaatttatttctaaatattttattccttttgctgctatagtaaatggaattgtttttcttttctttccttttctctttttttggagacagggtctcactcagtcacccaggctggagtgcagtgatgtgatcatagctcactgcaccctcaaattcctgggccttacattaaaattagcttgcaccaccacacccggctaattttttcaattttctgtagagacagggtcgcactatgttgcctaggctgggtctcgaactcctgggctcaagtgatcctccagtcttggcttcccaaagtgctgggattacagatgtgagccaccgcacttggcctgttttcttaattatatttttagattcttgatttctagtgtatagaaatacaattgattggccgggcacggtggctcatgcctgtaatcctagcactttgagaggctgaggcgggtggatcacgaggtcaggagatcaagaccagcctggccaatatggtgaaaccctgtctctactaaaaatacaaaaattagctgggtgtgatggcacacgcctgtagtcccagctactcaggaggctgaggcagaagaatggcttgaacccgggaggcggaggttgcagtgagccaacatcacgccactgcactccagcctgggccacggagcaagactccgtctcaaaaaaaaaaaaaaaaaaaacaattgatttttggatattgatcttgtacaatcttgattaacttgttagttttaatctttttctagtagagtcattgagattttttataacctagatcatatctgttaatggagacagttttacttcttttccaatctggatcccttgtatttatttttcttgtataatcatcctggctaaaacctccagtacagtgttgaataaaactggtgagggcagatatacctgtcttatttctgatcttaagggaatgcattcactctttgataattaagtatgatgttagctgtgtatttttatagatgcctctcgtcaagtggaagaagtttctttctatgcctagtttgggtagtgtttttatcatgaaagagtgttgaatttcatcagataaattttttctgcatgcattgagatgatcatgtgatttttgtgattttttaaaatttcaacttttattttcgattcaaggagtacatgtgcagatttgttacatgggtatattgtgtgatgctggggtttgatgtatgagtgatttcatcacccaggtagtgagcataatacccgatacttagttgttcagcccttgccctcctttctgcctccccatctagtagttcccagtgtctatttttcccatctttatgtccatgtgtacccaatggtgagctcccacttaaaagtgagaacatatggcatttggttttctgttcctatgttgattcacttaggataatggcttccagctgcatccatgttgctgcaaaagaaatgattttggtttttttatggttgtatactatttcatggtgtatatgtattgcattttcattatccaatccaccattgatggacacctaggttgattccgtgtttttgctattaggaatagttctatgatgaacatacaactgcatgtgtttttggtacaatgatttattttcctttgggtatatacctagtaatgggattgctgggtccaaatgggagttccatttttagctctttgagaaatctccaaagtgctttctacagtgactgaactagtttgcatttacaccagcggtgtataagcattcccttttctctgcagccttgccaatatttattattttttgacttctgaataatagtcattctgactggtgtgagatggtatctcattgtggttttgatttgcattgctctgaggttcagtgatgttgagcattttttcatgttggttggccgcttataggtcttgttttgagaagtgtttgttcatatcctttgcccgctttttaatggggctatttgttttttgcttgttgaatagtttaagttccttataaattctggatattagacctttgttgcatacatagtttgtgaagatttcctcccaatctttaggttgcctgcttactctgttgatattttcttttgctgtgcagaagttctttagtttaattagttctcatttgtcaatgtttgtttttgttacaattgcttttgaggacttagtcataaattatttgctaaggctgatgtccagaagggtatgtcctaggttttcttctaggatttttacagtttgaggtcttacatttattaataagtctaatccatcttgagttaatttttgcatatggtgataggtagaggtccagtttcattcttctgcgtatgaatagccagttatccccgtgtcatttattgaatagggagtcctttccccattgtttatttgtcctgtgttaatatggtatattacattggttgatttcagctattagacaaagcttgcattcctagaataaatcccacttacccatggtgtataatcctttttatatgtttctggatgccatttgctagtattttgttgaggatattgtatctatattcataagagatactggtctgtagttttcttgtgatctttatctggtttttgtatcaaggtaatactagcttctaagtgggcagtattcccacctcttctttttggaagagtttgtgagtgattggcattaattcttccttaaatgtttcatagaattcaccagtgaagccatctggctctgggcttgtctttgcgaatcatttgattacttagtctttttacttgttacaggcatgttcagttttttaatttcttcctagtcagttttgatcgtttgtgtcattctagcaatttgtccttttcatctatgttatctaatttgttggtctacagttgttcttagtatttctttataatctttcttacttttgtaaggtcagtagtgatgtcccctctcactcttgattttagaaatttgagtcttttttcttttttttcttggacattctaaaagtttgacaatttagtttcaaagaaccaatttttagttttgttgatttttctttattatctttccattctctatttcatttcttactgctctattctttattatttccttttatctgcttatgttgggttcagtttactcttttttccaattttttattttatttatttattttttttttttttgagatggagttttgctcttgttgcccaggctggagtgcaatggcgtgatctcggttcactgcaacctctgcctcccaggttcaagtgattctcctgcctcagcctcccaagtagctgggattacaggcatgagccaccacatccagcctttttccaatcttttaaagtggaagattatgttactgatttgagatcttttttctttttttaatataggcatctatagctataaatttttatctaagcactacttcatatgttttggtatgttgtattttcattttcactcatcttaaaagtattttctgacttctcctgtgatttcttctttgacctattggttaagattttgttgtttaattttctcatatttgtgacttgcccaaatttcttctgttgttaatttttaatttatttattttcccaaattactttattaatttatttctttcaataaatcctaaattttcttcaaagtaaagatactttgatcttaatccttttaaatctattaaggcttatattatggcctagcatcgagtctattgtggagaatgttccacatgtactatagaagaatgtaattctcttgttgttgggtggagtgttttatacatatctgtgaggtctagttggtttgagtgctgttcaagacttctctttccatgttgattttccacctagttgtttcatccattactgaaagtcgactattgaagtctcaatattattgttgaattgtctatgtctcccttcagttctgtccgtttttgcttcatgtagttttgagctctgttgttaggttctcatgtgtttataattgcttcatcttcttgatggactgttttatcattataaaatacccctctttgtctctggtaacaatttttgtcttaaagtccattttgtctgctattggtatgccactctagctctcaggcttgccgtttgcatggaatttcctttttgtctttttccttttaaactctttgtatttttgagactaaagtgtgtctcctattaacaacatatagttagatcttgttttgttgcttttatccagtttcacaatctctgccttttgattatttaatccattctcatatgatgttattattgatatgcctggatttacatctatcattttgccatgtgtgtgtgtgtgtgtgtgtgtgtgtgtgtgtgtgtacatgcacaaaaaatacaaagaggaacaaaacagtaattatatgtatgtgtgtgactgttttgttcctctgttcctcctttatttgaaaatttatttttgtaaatggtctgaggtagaggttgaagtctaggttgttagctaactatcctagcactctttttaaaaattgtcctcttctactgaattgcaatacctctgtattatatatattattcccatacatagtttgatatatttatgaatttttttttttgagacagagtctggctctattgcccaggctggagtgcaatggtgcaatctcagctcactgcaacctccgcctcctgggttcaagcaattctcctgcctcagcctcccaagtagctgggactacaggcacgtgccaccatgcccagctaatttttgtatttttagtagagacggggtttcacaattttggccaggatggtttcgatctcttgactttgtcatccacccgcctcggcctcccaaagtgttgggattacaggtgtgagccaccacacccggcctttgtttatgaaatttctattatgttctactcatgtatcagtcttctcttgtgtcaacatctgttgttttatctcagtgatttaatgataaatttcaatatctggtatagtaagttcctctttattttccttcttttcaaatgattgttcatgtgagttttgacattcaaaagaaaatactatttgtaatccttttaaaacttcatgaaatgcatgtgtgcatgcacacacacatacacatacatatacatatgcatatatttaccatctagtagcgatatgtgagaatctgggcaattcatttaaagtaaaaattcataaatagtaatattgcacattaaaatgaaacacaacaggatgatttatgttacttttacctaattattgttttctttgcagagtggatactatggaaaacagcgccatcaagatattaagagagagagtgatttcacgaaaaagtgaccttactcgtgctttccaacttcaagaccacagaaaatcaggtaacaaatttgcataacatttaccatttcttaacacaccaagttacatacagatcacttttcattttccttgcttccttaggatttcagttctccatttttactaagaaggaagaatagagataaaaataaaatataatccattatttgctcaaaaaaggcatatttctcccttttagcaagctattttcaacttggaaaactaacaacaaccctgaattaaacttttttttttttttttttgagacagagtcttgttctgttgcccaggctggagtgcagtggcgtgacctcagctcactatgacctccacctcctgggtttaagcaattctcctgcctcagcctcctaagtagctaggattataggcatacaccaccacgcccagctaatttttgtatttttagtagagatgggatttcaccatgttgttcaggctggtcttaaactcctgacctcatgatccgtccgccttggccttccaaagtgctgggattacaggcgtgagccacccggccctaaacctctattctgatagtatgctagactagatgttctggagggccttcttattaacaaacagctagattttggaggatgtagaatgttaatgcatttaccagcctcacagtaacgtgaatcttccagctgcatcttcactttccgtgaaagatgatttgaaaccacatgtgagagcatggagcaacaagaaagcacaaaagactagattttcctggggcccaatgctgatattggtatagcaatcaattctgagactaaattataatatagtaggaagatggaaaagctgaatttgagacttccatcatcatgcttggaccctcaaagtggctaaagttgtcctaagtctgtaatgctccctgactcctggcaagcaaatgcaaatttatctttgagggaagcatccctaattttggccactcacgtatccagagattaagatcaactcacatgagatcacaatcaaaaattaccaaacaaacaaggatacaaactaccatgagtgagagtcagcagaaacaacaattatttccccgaggacatcaaatattggaattagcaaataaatatgttcaaaggaaatatggaaccagaaacatgcatttgggaatgatttgaagaaaaaccaaagagatagaaaatatgcttgttaaaaaaagtaaaagcataatgaatgggttaaacggaagattagacgctactcaagaaagaattagtttaggagttataaacaggccaggcgcagtggctcatgcctgtaatcccagcaccttgggagattgaggcgggcagatcacatgaggtcaggagtttgaaaccagcctggccaacatggtgaaaccccacctctactaaaaatacaaaaaaaaacaaaaaattagccagccatggtggcaggcacctgtaatcccagttacttgggaggctgagacaggagaattgcttgaacccaggaggcagaggttgcagtgacccgagaccgcaccattgcactccagcctgggtgacaagagtgaaactctgtctcaaacaaacaaaaaaagagttatgaacaataaaatgagaagttgaacatacacctactcagagtactgggaggagagaatagaatgtaagagaccatatatttgacatggtaatggctaagacatttccagaattgataaaagactcaaattcataaagaggaacagtgattctcaagtagaataaatgaagttaaatccagacctacacacatttgttgtgaaactccagagcaccagtagcaaagaaaaaatctttaaaaagcaggcagagaggaaacacatattgctacaaagagataacgattagactgatagatttctcaacagttgcaaaattagaccatagaatcatatacaccaaacattggaaattaaatttagaaaaacatataccatgaaaacactaacaaaaacaaagctaagacagctttattagtatcaggcaaagtagactctaaggaagtatatattactagaaataaaaaaggacatttcataatgataaaatattaattatgccaattgaatccattctaaatgtgtatgtacttattcatatagcttcaaaactattcaaaacaaaaattgacagaataaaaagtagaagtagaaaaatctaccacgatagagggaggttttaatactcctctctcaggaactaaaagaacaaacagataaaagattagcagactctttttttttttttttgagatggagtcttgctctgtcgcccaggctggagtgcagtagcatgatctcggctcactgcaacctccgcctcccgggttcaagcaattctcctgcctcagcctcccgagtagctgggactacaggcgtgtgccaccacgcccagctaattttttgtatttttagtagaggtggggtttcactgtgttagccagaatggtgttggtctcctgacctcgtgatccacccgccttggcctcccaaagtgctgggattacaagcgtgagccaccgcgcctggccagcaaacttttttcttaaaagactacatagaactctgtacccaaatttcagaatgcatattcttatcaagcacaaatggaccatttacaaaaagtgaccacacactggaacataaagtgaatctcaataggttttgaagaattggaaacattacagaataaagtctctgacatatacaactccgtaacataagatagtaataaaatcaccctttggcttggaaatgagaaatatacttagaaataatccttggctccggccagacgtggtggctcatgcctgtaatcccagcattttgggaggccgaggagggtggatcacgaggtcaggagatggagaccatcctggctaacacagtgaaaccccgtctctactaaaaatacaaaaaattagccaggcgtggtggcgggcgcctgtagtcccagctactcgggaggctgaggcaggagaatggcatgaacccaggaggcgcagcttgcagtgagccgagattgcgccactgcactccagactgggagagagagcgagactctgtctcaaaaaaaaaaaaaaaaaagaaataatccttggctcaaagagaatcacaatggaaattagattgctgaaactgaatgacaatgaaaatacaatgtattagaatttatgggatgcaaattagagaggcattgatgataaccttaaatgtaaaagatatgattaacaaagtaaaaaaaaaaatttgtttttgttttgttttgttttgagatggagtctccctcagtcacccaggctggagtgcagtggcacgatcttggctcattgcaacctccgcctaccaggttaaagcaattcttctgcttcagcctccccaagtagctgggactacaggcatatgccaccacgcccagctaattatttttgtatttttagtggagacaaggtttcatcatgttagccaggctggtctgcaactcttggccttaggtgatccacctgccttggccccccaaagtgctgtgattacaggcatgagccactgtgcccggccaaaaaatggttctttgagggaactgttgaagttgacgaaaccatggcgagagagagagagagagagagagagagagagagagagagagagagaaaacaaataaccagtgcaagtgtagggaggagctgctgtctaaggctgagagagaggacccaaggaaggaaaaacttggaagggaccccctactcccaatcaagagatgagatcaagccctcattggtgaggatgtggctatggtccactggatagggcagaagttcactgaggtgcctcaagttacagttgggtctccggctggtgggccaggactggagaggatggagccacccactgaggtgccagcaagactctctttgggctgtgcaccaccgcgtctcccacacactaatggtgaggaagccatgggctgtggtgtcagtgaaatttactagaaggtgggtgccactacattttccacacatgctaaccgtgcggtgctgtagaaacaagaagcaaggcacaccagaaccagaaagaaaagctttttcttttgctgttctttgcagtgttcttcctgcactgtctactaacagagactaacgttatacgagctgccaaagaggaaatgattacagggtccagctctagtatcacaaaatgtgcaaaaaaaaaaaaaagactagttttggagctaagtaggaataaattgatagctggggtagccagcaattagcttttagataacaaaaatcttaaaagataccattcacaatagataatcaagtactgtgggagaaacctaatgaatgaggtatgagatttctttttttttttttgagacggagtcttgctctgtcgcccaggctggagtgcagtggcacgatcttggttcactgcaagctctgcctcctgggtccatgccattctcctgcctcagcctcccaagtagctgggactacaggcgcccgccaccatgcctggctaattttttgtatttttagtagagacgggggaggtatgagatttctaagatattattaagataaaggggactgaaataaatgggtgggtattactgtgttcaaggactataagggttgaagttgtcaagatacaaattcctcccaaattgagctatagtttcaatgcaatctcagtcaaaatcccaaggtggggatttttcagtagatcttgagaatctgtatctaaaagtcatgtggaattacaaaaggccccaaatagccaagatgttcctgaagaaaaagaacaaggtgggaagactttccctattatatatcaagatctattataaaagtacagtaattagaatggtatgcaattggcacaagaatacccatatagacaatggaagcaagtagagaatcctgaaacagattcatgcatatatagacacttgaaggtcccactgctgagcagtgggcaaaggagtcttttcaataaacgatgctgggccaaatggatatccctataaaaatagaaacagcctatatgtaataaagatatttgtgttttgaaaaattacatatattaggaggaaaagaatattagttgtgaaatgacaggtgaataatacatcttttattctttgtattcttttgtgtttttcaaatcttctataataagcaaacctaggccgcgcatggtggctcacacctgtaatcccagcactttgggaggctgaggtgggcagatgacttgaggtcaggagttcaagaccagcctggccaacatggtgaaactctatctctactaaaagtacaaaaaaattagccgggtatggtggcgtacacctgtaatcccagatacttgggaggctgaggcaggagaatcacttgaacccaggaggcggaggttgcagtgagctcagatggcaccactgcactccagcctgggtgaaaagagccagactccttctcaaaaaaaaaaataaataaataaataagtaagcataccttactttgttaatcaaaaaaaaggaaaaaaaaaatctaacacgtgaagtctgatttcttacaggtgacaggaaggacacgatctgtggaacactgaagatatccttgagttagttctccttcagggctgcagggcctgggaggataaattatgagggagagcagctggccccatgctgccctggctctcccaaggaggttgcattctttaaaatcatattttaacaaatcatttgggctttgttattgttgttgttaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggcaagtgaaacatagccccagctaaaacctagccagggtgaaacataacttagtcctttgaaaagctgggagtggccgggcacagtggctcacgcctgtaatcccagcactttcggaggccaaggcgggcagatcccgaggtcaggagttcgagaccagcctgaccaacatggtgaagccccgtctctaccaaaaatacaaaaatcagccgggtgtggtcgtgcccacctgtaatcccagctactcaagaggctgaggcaggagaattgcttgaacccaggaggcggaggttgcagcgagccaggatcgcaccattgcactccagcctgggtgacagagcgagactccatctcaaaaaaagagaagctgggagtgggataatctaatagatggagtggcagtcttaggaaaagccgaaggggaatctcccaggtacactgtggtctgttcagcaaatttgtgtgttcccaggataagcaaaaagaaaaaagaaaaagcttccacaagcaagtccacatcaaatactggatttttttttgtaagtgctgtctagcagaaggggagatatgacatccatgctttttgtttgttttttgaggtggagtctcgctctgttgcccaggctggagtgcagtggtgcagtctcggctcactgcaacctctgcctgccacgctcaagtgactctcctgtctcagcttcccaagtagctgagattacaggcgcctgccaccatacccagctaatttttatatttttagtggagatggggtttcaccatgttgaccaggctggtcttgaactcttgacctcaagtgatctgcccacctcggcctcccaaagtgctgggattacaggcatgagcccctgtgcctggcctgacatccatgcttttatacaacataccatttctaatacttaatgtattgcttgttaagcctgagtgtacagacttgctgacatgacccagaatatgtctgaaagagttttgaaatgtagaaatcttttcttagaatgtgaatatcagggagatttatcagatccccatacttattagttaacaattcatcagcagttaaatatgacattgagctgaaaaggagctggttggagctaggacttgggtgatcatttgcagtgaagatgagacgttaagagcagagagaagggaagtaaaggtaggttagagactaaagtatccccaggaaggaggcttttgacgtcacttcagaggcagtttaccatggtgactaagatcacaggccttggcttcaggcagccgagatttaaatcccactcaccagctctgtgacccttgggaaagttcctttatctccctgttttcaaatttgtaaaatggacataataatagttctgttcttgttcattcttgttgtagaggaccgaatgaaataatccacataaagttctctgtaaatggtggctgtgttagttactgctgccttattcattttggccctgtcccctgaggatcacagactgaatgaagagggtggggcctccaagggaagtctggccttctcagatttctgtctaaatcacatcatttcaattgttgatgatgttttctgtttgttacatttgctaaaagcgatcagtgtcatgaattcaatatgttctaacacttagaaaatctttattttaggctcattctactctagttgaaactctgtacagatacagatctgacctggaaatcatatttaatgccattgacactgatcactcaggtaaataaatgaacttggatgagtccatttaaaaagtgtatgtgtgtgtgtatgttggggatacaaaatgagtacactttgattgagccctataattaatatggtttgacaccttcattggtaagatggaggccttgcttatgcatactgttaaatgaaaattgtaggagcccattgttttggactaagctccttcaccaggccccaacagactagactaaaagtcaaaatggggtagcagtagtagaaagcaaaggctaatctggttctctgaaatcagaactctgattttatctattttgttcttcatctaacatgatgaaacttgaggggaaaaagaaactcatttaatattattgttatttcagtttggctgcagactctgtattcaagaccatagagtcctacagaagcctaggtagccatcagtcaaactgaaataactttttataaatcaccagcacaaatgaaaagatgatttactatccatttcagtatcttagttactcatggccataaaaatcattcctagaaatctgattctgttttggggagtaagggctatgaaaagtcattttctgcttttttttttttttttttttttttttttgcgacagagttttgctcttgttgcccaggctggagtgcaatggcgggatctcagctcaccacaacctctgcctcccgggttcaagcaattctcctgcctcagcctcctgagtagctgggattacaggcatgcgccaccacaccctgataatttttatttttagtagagatggggttctccatgttggtcaggctggtctcgaactcccgacctcagatgacctgcccacctcagcctcccaaagtgctgggattacaggcgtgagccactgcgcccggccttctgcctttagctttgatgcacaattacttattttcaaatttttaaaaactcatcagataatcccctaatgcagagacctttgaacaccgaaaaaaaaaaaaaatcaatgatcaacacattaaagtaaatgattgcctgtgaaaaaggcagcaccattgtttgtaatcctcttattgactcccaccgtatcttctccctctgctttgatgtcatcctcctctctgccctccttccatgcacctcacctttctattttaggtcttgtaatttctataccacatttagtcccatagtccacaaccccgtccccatttcttcactgtttgctcattctggctttagaataagttcaggatcccttggtagttgaaagtgagatattgtttcttacatttatgatcttactcttccatatccttcagtatcttcatgattaggcagtttagtgagtttctaactggggctatttaatcagtgtgggttccccaacccttgccttaggtgggtcttaaaatgaacactcacaaccttctcctatattcttttaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaata

SEQ ID NO: 3169 - DNA, 137003 bp, human
gaatctacctcttgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggtaagagaagagcacttagtggaccaggtgaatggagtatgatccgggtaggcatgggacaatgatcgaaagttaacctgtggcctctgtctgtttagttgtttagcccaactcttgtggtctttatgttttatgtatgaagtttgttaaaagctttaatatatatgtatagggtgaaactgggtcaccttgatgtgctggtcactgagtcacaggactgtgactttggggaggccacctaacttctctgggcgtggtttcctctcctataaaatgaagatgtctgaggacctttctagacaagtccgaaggatcagagtatcttaccacatttcagcctcacctgttacagagctctgggcagagaacctcatgatggtcttgcaaggtgactccattctctgtctagatcagttttgcccaattcccagtgctttaacatgagagggagttgcatcagtgtgtagtctttgttttacttttgttcttggaatggcagattgtagctcctgtagaaggaaaagaagaagaaataaggaattagcattgctctacattgactcatgctagatgtcaatctgagatacatgtaaaacgtaagcacatacaagataaagaaacagattgtggcaatatttaaaaatatcctagctttctaaattagaagcagttctgataagcctatttggaattcatgcaaaacatccataactctgacagtctgaattgtacatggcaaaggtaaattgcttccaggcagtaattctaggtgcaggtttagatggactatacggtaatcaagtctccattgctttacagatagccctcactccttggcctcttactttccagattgcttctttgttagcctccctgttggctccttcctcttttcattctctttaatgtctctattccccagtgttctgcttttgcctctatagctttactctataagctctccctggctattttatcttctctaatcacttcagctattgtcagcaacctgatgacctatttaatctgactctctggtcctgatttatttcctgagctccaaacccaggcttctcctgcctgtgggatatttcaacagtgaggtctcacaagtactgaaatttagcacactgctgactgaactcacgatttttctccaccataaactcgcttgtcccccttcatgtccgactcttgtaccctttaataccctattgcaatgaatatcatcatctcttagactgtaaattataagaaggcagaaaccatgtctatcttgtccaccccttgtaaccacagcacctagcatagtgcctggcacatggtagacacccagtaaatattgtcaagtgaatgatgaatctatttattcttccaaactaaaaaccctggaatcctcctcgatgtctctgtctccctcactctccatgcccagtctgagacctgtggggtttgttacataaaacccttttacatttggctccttcttccccttcatccccgctgccatgactttaattcagcccttaccatctatctcctggattattgcaggagcctcctcattggtcttcctgttacctgcttttccccattcatcaccatctgatccccagagtgatcttgcagcttgaatctaatcagcttaccctcaggctccccttgacttaaacagagtttgcaatctggcagctttaagcggaatccacgcagtctgtacggcattttgagaaaatgagaatgactgtattttgttgattctaagatgcatttttttttcacattttagcagctctgatattgggatgtgtcttgaaatggacagtgacatagtttgatcagtggtgttctctcttattggtacataaaacagcagtgtaccctgtaatcagtggcttcataaatttgctgaaaaatactcatgctaacatttaaaaataaggagatcgtacataaaactatcttcagcttctcttggaaaattacatcaggcaacactgggctgcgatttctggatagcagccgaagatggagctaccagtaagtagcagctacctcatttagacaaaaactcgctacagtgtctcatggtttccacccaggctgctttagtcatttgtattatctgccccagcccattaagcatttgaaaggacaatccctgactgataagttgaagtccagattctttgttgtgatttataagaacacaggtggcaccaacctacctcccccaggttaatgctcccaacctttgctgtgtactctatgtatcccctaatctcaaatataacagactcccatgttccctggaatgtctttctctatcttttatgccctacgaaacatttcctggtgttcccaggtcgagctcatttctttctggactccagtagtaagtatgtgggcgtatctctgcaaaaaccgcagttacttttgcactaacctaaagtacagttctgtgatttattttttatttttattttttcgagacggagtttttctcttgttgcccaggctggagtgtaatggcgcaaccttggctcaccgcaacctccgcctcccgggttcaagggattctcctgccttagcctcccaagtagctgggattacaggtgcctgccaccacgcctggctaattttttgtgtttttagtagagacacgttttcaccgttttggtcaggctgctcttgaactcctgacctcaggtgatccacccgcttcggcctcccaaagtgctgagatggcaggcgtgagccaccacgcccagccagttctgtgaattttaacacatggatagattagcataaccaccatcatcatcaggatatagaacatgccccccaaaactccctcctgctagccctttgtagtcactcccctccctcacccataaacccctggtaaccactgatcagttccctgtcactatagttttgtctttttgagaatgcgatataactgtctgtatccctttcagcatggcctcttccactcagcataatgcctttgagacccatccaggttgtgtgtatcagcttcatttgtttttattgctaagtagcatttcattgtatggatgtcccacagtttgtgggacactcacggaaggacatttaagctgttttcaatgtttgaccgtatgaacctgcatacacgtttttgcatgaatagaaaattttatttctctaggatagctacccaggagtaggattgctgtcgtatggtaagtgtatgttcaactttataagaaagtaccaaactctttttcagagtgactgtaccactttgcattcctgccagcaaagtgttagagttcgagttgctccacattctagccagcactggatattgtattaaaaaaaaaaattttagctgggcacagtggctcacgcctataatacaaatactttgggaggctgaggcaggcggatacctagagaccagtctgaacaacgtggcaaaacccactccctacaaaaaatacaaaaattagccgggcatggtggcatgtacctgtgatcccaactacttgggaggctgaggtggaaggatagcttgagcccagaaagttgaagttgcagtgagctgtgattgtgtcactgtgctccagcctggtgacagagtgagaccctgtctcaacccccccacccaaatttagccatattcatagacatatagtggtatctcatggttttaattttaatttctgcttccttgaatctggcctggaggaactggagggaacaaaaggtaaactcactgtcagttcagtggtacttcaaactctgatctgtttccttcatctgccgtctgttatttacttttcagagtcctcatgttacttgtttattgctgtgggacagattaccaaaaaatctagtggcttaaaacaacacatgtttatgatcttacagtttctgtggggcagaaacccaggcgtggcttacctgggccctctacgtcagcatctgtcgtgagctgctgcacacaatgtgttgactgggctgctgtcatctgaaggtttgactggggagggatccacttccaagcccgtatggttgttgacaagagtcagttcctcatggtctgtttgactgagggccttagttccttgctggcttttggctagagacttcccccagtcctttgccacttgggcttctcccacatggcagcttacttcattgaaagcacaaaagctgtgaagataatagggtctgctagcaagacagaaaatcacagtcttttataacctagtcatagaagtgacatcccaataccattgccatgctcaattgattagaagcaagtttctgggtccagcctatgctgaagagaagggatgaacacagtggtgtgaattgaccaggaggaagggatcattgggggcagcttagagtctgtctgccacagtcctcaaatagctgtttcatggattctgtccaggttttatagctttgtcccatgagagagaaagagtagagtgggtaaaatgtcccttttccatcttacccagaccagaaccttctgtgaagctttttgatttgatttatgaacattcagggttaatttaaggaatttctttaaactcaagccatcgaggaccaagctagggttagattaagcagtggtccgaattaaaattctgatatctattaatctatttattaaatcacaaccaaggaaagctcaacttttgtatctaagatggagcctttcgaaagctgaatttccccaccttaaaacgtgatggctgttttagcctgtcattgtggctgctcaccaggtgaccccaatagaaacatctggcaagcactgacttttatgaatttcttccatctgatagtgactcataacccacttttaatttcttttaatgacttcctaatgacttgccagatctggcctctcttttctcctagttaatgtgatttttcagtacccagaattcacccttgaaaatatgcttgatcctttctctatttaagtgaaaaattacttggtattcctttcttctcttcacaagggagcaggatctttaaattagagtccttcgattttttttttcttttgagacaaggtcttcctctgttgcctaggctggagtatagtggctctatcatggcttactgcagcctcgatcttgcaggctcaagtgatcctcctgcctcagcctcccaagtagctgtgagaacaggcatgtcccaccacacccagctaattttttttttttttttagtagagaggtcttgctatgttgcccaggctggtctccagctcatcagctcaagcaatcctccttgctcagcctcccaaagtgctgggattacaggtatgagccactgcccccagcctttttgaacttttttcatcatggacccctcacagtaagtttcgtgagaatggaccaagcatatttatttatttacagctaatactgctgaactcatttattgtgtacatgatcaaatatacatggaaatagaaaagttaacaagaataagaaaatagataaaaatatgagttctgatgttttgctttctgctctccagcagatctctgtgcatgtgctgtggggaagctaccccagttttggagactactaggggttaggaagtggtgattgggtgtgattgcttgccagtggccccagcatcaggaggctagctcagagtcagaagagctgggaggccagccctgtctgagcttcccccctttggtgctacggggcttcgaggtatcaggagccacaagcagacaccttaagtacccaccatcaaatagatctgcacatgccgctgttttcttagtctcctctccagtccagctgcttcacctcaattctagcatactcctcagggtatgtcatgatcaataatgggagctgcccattagaactactttgccttggcagaaattggaactgtggccagctccaggaagcttgtgaaataggagaggcttgcctacaaatccctctctcccttgagaggtagccaggcttctccattcccctctgtctttccatagtttgctattgccatggactaactaaatgtcctgggttgggatccctcagaagcagagcctgagataaacatttgagagcaagtttatttggaaggcaggagcaaagaaagtacagcagtggggaagtgagaaaggaagggaaggcaatcaagagagattaagtccagcctgaagaggtggagagggcagccatttttcaatcttaacatccgggcacctttatgtaattgcagcattatcattaggaaagaagttcattttgatttctagttcccctctcccatttcacaccctagttaagtactgtagaatatgcatagctatgagaaccccctcttcccacctcttttcctctggctgatgcctagtcagtcatcaggtctcggcccgtgcatcacttctaggaagccttccgtcatccccctttctgagatagggctctttctctgcgcccctggagtgtctcgtacctgttttattagatattttatcataccatattgctttcatttattcatgtaatagatatttattatgtgcctggcactgttttaagaacctagtatgtatatttcaatatccaatcatgtgtatttttttttctctgccatttgtgtctctgtccctcagtagcacctgctacataggaggtgcttgccacataggaggtttaaaactgttaacatcactctgcccatcattttttcttttttcaggctgggagaacacatccctggtcagctgtaggaaagccagagagcatttgagaagaggctgaagcttgaattttgcaaacacacaaggtgctgactgaggcagtagagtgtaatgattataataagcaggggttctagagccaaagtgcccgggttcaactcccagttccacccctcatttgctgtttgactttaggccacaattcctaatgggtgaagagggatcgtaatagtatatacctcagaggatggtgtgtggattaaataagattaacatatgtaaaatttaaaagtacctagaacatggtcagtgctcaatagatattatcattattgtgatttattcacttacatcagtgttggttcatttaacagttggaggctgaccataagacccctttggtgctcacagtaacatttcagtgttctttctacaatggaaaaatacaatgaagttattcattcaaagcaaattctgagttttcaacaaatcacataaagggcacagccaatccaattcgtggtccaggagctggccattaaaataacaacctaaatcatgagttttttttccctgctttcctttctttctgtggttaaacaaatatttggtgagtacctcttttgcattcagtaatgagtaggtttaaaactgagggtgtggccagtcgcagtggctcacacctgtaatcccagcactttgggaggtcaaggcagatcacctgaggctaggagtttgacactagcatggccaacatggtgaaacctcgtctgtactaaaaatacaaaaattagctgggtgtggtggtgtacacctgtaatcccagctcctcgggaggctgaggcaggagaatcgcttaagcctggcaggcagaggttgcagtgagcccagaatgcaccactacacagcctgggtgacagagtgagactctgtcttaaaaataagaaaacacacacacaactggggatgccaagaggaatgaaacagatcctttccctttaggatttcacatgtaaaagggcaaattacagcacactttgagcagctctataattggacgcacacatggctttgagagccagaagacagagtgactaattcccctttggtgattcaggaaaggcttcacacagaggaggtgacattggaacaactgtatctagacatagccataatttaatggctgaggattgaataggcatttggttgggagagccagctgtatagctacattgtccactattttttttggagcctgagtaattatgctatcatttacaatttgtgtagcagcctcatcaggtcctactcttggcgtccccaccatggaaacctgagtggtcgtattgcctcataatgaggccctctggtgatgttaatatactaataggacagaagcccagagccaccttgccagttatttttcaagtaactccatccgattaaatggcaaactaggtaaccactttactagatctcccgtggctctcaattgcagaaaggaatcgagctaaagagcagcttgggtggggttatgaaatgtttatggctggagtcctgtaaattttagctggcaaagcctaagaccagtaagcttgaaaacacgtatgctgtgtcaccagctaggaagagtttgccagggaaactgctggcagcgcggccgcgatcagtataagactctgtgaacaagaagaccaccactagattgcctcgaacatagcagaactgtggctgctggcatccattactgccatgggcactttgaattttcaagtatgtctttctcctcccctaaactcagcaagattacaggccaactttcctttccctttctgctgatgaagggaggtcattctcccttcacaggtaggttctccaataaggagctactgaacagctggtggagtataaatgtcttatgacccagtggctgctccctcaaacccacacctttctagaaccaaggaaaaatgtttagtttttccacttctcttaattgtaccaggttaatgtaacgttttctaaaaattatcctcagtttacctaaagagtgcttttctgctcttatttactgaaattctcttttctattttgtattgatggcagattatgcacacaatagcgtggtcctgcccatgcggagcctggtccctttggaagcagtcacgtggccgctgactttgcagcccattacttgagtgcatctccaggccaggaacagagcagggctggggcagagagctgtgctcacggccagtgcattgtctcccagattcgtggctctgggcttgccttcccggctgaaaggcaaagcagcctggccctgttctagttatttctttgtgtatatatgtttgtttatttatttaagcaagagctctctctgcagagtggggtgtgtgtgtgtgtgtgtgtgtgtgtgtgtgtgtgtgtgtgtttgtgtggggtgcttcagagagggctgaaattgtacctcttttctttcagccctctgcatttccccagagagaaggtttttttctcgtcttcatttcctttgaaacacctggggtgaggaaaaacctctacattggccaagcagaagaaacaggtaatatgtttgtttattcttaggcatttggggcaagcagaagtctacatcataaacatatatcgtgtggcaatggaacagggaatgtgtactccttggagtatatcttactgctttgcaatttctcggaatgattgttctcaaaaatgctggttgtaaatcagttgccatcagttgaagaagacgtacagatgacttggcaatctgaaggattgtggcctatttcaaatgaacttgatatttggaaaatctccacagtcacttggattgagagccagaaaatgagggaaggggtcctttgagaaacccttctaggtcccctcagggagtattctccaaactccactgcacaccttcatatttagaaatcttcctttagttcccttggcgtcttgtcgtcttagaggtttctagctatctgtaagaatggaaccagaattccttacagtgttcaaaattctctttagtgatttagttcgtatgcgaactgatcagattggatcctgaaaccaaggcatagccttttagtgggcagacatttttgttctttaatgattaaacagagcgagtcttcagttctgccactaatcagctacgccagggagtgtgttatttgagtctcagttttgttcatctgtaacatggtgatgacgatactaccttgaaagtttgctgtgacagtgaactgaaataatagaaatataaagcacccactatgctgggtaaatagtagtcccttaataaatagtagtgattttagctactattatgattactggtatagcattctttccgatcttagacctctcaagggaaaagagcccattgctttgcgactcttaaattataccagaacctgtaggtacccaaagggtttagtctttgggaagccccagacaaagcattctgaagaaagagacttgaacaaacacagtgggttcccacccatgcatggcccctcctaactcatcagctaaaaacagttggtctttgttcaagctagttttttcccaccactcagtcctcagtacaagtcagtaagatatgcattattatcactgttttcttatgaggaaactgaggtacaggggaattaatgactaagagttcaaactcctgttgtctgacttctaaacccaaggctccactgggccagcattaggcagttaggaacaatagttcttgagatgctttacttcaaaagggccccttgctaggctctttgggaaatagtggtcagctctttctgagagattcacaatgtatgttcatatattaaaggctctgagaagtcctgcagtaaagaaacctgtccagctctacatcccctgaacttattatgtaatagtgggacctttattttggccttagtcctagaataataaaccacatagaactattcttccacaaacacactttggaaaacctggcaccaggccacgctgtttcctgattacaatcatgtctgatataccagcagacactttcaaacaccttctggtggtcagtatagtttcctcccttttcttatcctctcatgtggcgagacccaggaagaatcaccagcttggtcttacagacctccccttactcatttaagaccccagacataagtaattgctccactgttctactggaaaggtagtgatggaagggaactctctggcacgggctgccagggactcctctgcctcaccctatgcctctgcattatatttaggccacagacatcaggctataaaacctctgtggcaatgaataccaagcagaatgcaatagggtgagcctgatgaggcatctgttcctcatgctagcacaatctacgggggaagaattacacctgcctgcttcactcccactgtggtggtcgggggtgggggtagagggtgttggtatcagttgaatgactatgggttccaggttttcaggactagagctaaagccaatttcttgctaaagccaacatctctaggaaaagctgaattctagcataggaaactacgaaactgacatctagaatgccagagagggtcgtgtcagggtggctgagccaaggtgtggaagttggatagagatgagcttagaaatcagaccaccttaagaatgaacaagaacaactcggggaggctgggctagtggttggagggtgcttggtggcgaacgttagtttgtccccacggcctgtcttttgtactttccttgtattttcagcattggaagtgaaagattagcatgaaaaaaatggaaaattatcagttccacccagtcacccccaacacacacacagtaaaaaccttttagcggaaggctttccttttgcaaattataagtgagtgccaatgatgagtcattatttcatgtttactctttaaaaccatccttggtatatattagaagggacagcagcaatgggcaagtttcaagctgtttttttgccaagatccacccagcggctcatgttacccactaggacattcttgggcgtttgtgaaccctgtggaagccccccacctctttgagcctgagaacccttttcaggcctcagggaatcacttcttcagagacttcttcaatgcacttaaacgctaacagagggtgggaaatggaagcagcttagattttaccaagtcatggaaaatccccaatcatttttatcagctttacgtcagagatgtcctcaaaggctcacgcactgcttacaaactcacttccctctctcctggaagtctaggtggggcagtacatgggaggggtaagtggcatcttgctttaaccagctcatattttggtgagaatgaaaaagaactgactttttttgtaacctattacctgagagaaaaacagttaaaaataaactgataataattatttaataatgtaaaaattattatagccaattttttctaatggataatcaaaaaattctagaacatcatgtctttccatcatgattttaaaactttctttaaaaattatgtataagtactacccctttctgatttaataaaatgcttttgtataattgaatagcacctacctgtgcacaaaatgatggattaataatgacttttagcaactaaatttttaaagaactctggcctaggaatattgattcctttgttcattcattcattcatttagcattatccaacatctgcaatgtgaaaggcaccatgtaggtgccagagattcaagggctactttggaagttgcccgtggggctaatagtctaacagaaatatactcaagtttgatgctttttagttcttactgaatcttttatatgcagttgtgtttgttgtggattaactgaggggtgactgaaaaccaaatgcctctggagagatattgagacagtgcttttttttttctggaaaaagaaaatcgaaattgaaatatgtcaatcagtccaatcagtgtttatggcctactaaatgctcaattctttttttcccctgttttcttttttaaattaaaaaacatacctttttttttttttttttttaaagtcaggatttcactctgtcacccaggctggagtgcagtggtgtgatcacggctcgctgcatccttgacctcccaggctcaggtgatcctcccacctcagcctcctgaggagctgggactacagatgtgcaccaccatgcctggctaattttttgtattttttggtagagatggggtctccctatgttgcccaggctggtctcgaactcctgggctcaaaggatccatctgcctcagcctcccaaagtgctaggattacgaatgagagccactgtgcccagccccaattcttatgtcttcataaaaaggggtggaaaaaatagcatgaggatggagcgaagcccaagcgagatttggatactgttggaaaatagtgtttcttcaactgagatatggggattccttgcatcaaagttctcggcatggtgcactttaaatgtgtattccaaggcactggacttttgaatctgagtattgttagtaaagcctgggaatctgcatccccccacccccaataagtcttgtgagcactcgagttggagagcactgatctaggcacctggagaatgtcaccaggactagatgaattcctagatgaacagtgccccaatttcaaaaatgagaaaagaatatatgctagaagccacagacttgatatgacctctggaaaaattcagcttgaaatagatggagccaaagcatttctaggaaaatgtgatcatcactatgcagcaccgtgggttttctaaaataccgtctctattacagattgtcaaactttgttgtgtattagaatctggaaaactgaaaaaaatcttgatgcctcatcctccacccagtaccaattatgtcaaattatctgggggtgggacttgggcatcagtattttttaaaccccaagagattctgacttaatgaggtgcaggctgagtactgggagtttgaaaagctccccaggtgacactcatatgcaacgaagtatgacaagcacaggtctatatgacatgggacaagttgcttaacttccttgcactttgtgtaaatactaggtaattttaaaggtctctctcacctttaaacttctatgattttgtattaaaaatgttgccaaattgatttccttcctttcttcctcccctgcccttccttccttttctcctcctccttccctctctcttcttttgctggaataagctggaatgtcaaagtatcaaaatatatacatatcatcattttattaaaatatttagtaaaattctccaggatgtctcacagataaatgagagttatgataggtgagtttaccagctaactgaacaaatgtgctcagcgagtatgaaggtaacggatctgtggtgaacctggaggatggtttggagtgggatgccacagggctcatcctgcccttggatctgatcttgttaatgttctttagccatgatgtagataaggaagacacgaaagaaatgcctatcgaatttggaaataaagccaagcacggtggctgatgcctgtcatcccagcactttgggaggctgaggtgggcacgttgcttgaggccaggagtttgagaccaacttgggcaacatggtgagaccccatgtctacaaaaaagtacaaaaattagctgggcatggtggcgcatgcctgtagttccagctgctcaggaggctgaggtaggagaatcacttgagcccgggaggtggaggctgcagtgagtcatggttgcgccactgcactccagcctgggtgacagagcgagaccttgtctcaaaaaataaataaaaatttggaagtaacccaaagtttaggaaggctaattcattcaatacataaaataatcaggttcacctctggtcagaaaatctgtttactaagcttattgttattttcaaaacatggccatagttcaaatattttgcttattttagttttccctttcttcagtcgagttgaaattttgaagcttttggtgtagtaccaatggaaagatagatatgtcagttgtttgctgactttgtgcctgtcaagaaatgcaaatagggctgggcaagatggctcacacctgtgatcccagcactttgggaggacaaggtcggaggatcacttgagcccaggagtttgagaccagcctcggcaacatagggagaccctgtctctacaaaaaaataaaattagccgggtgtcacggcacatgcttgggaggttaaggctgcagcgagccgtgattgtgccactacactccatcctgggtgacagagtgagaccctgtctgaaaaaaaaaaaaaaaaaaaaggaatgcaaatatattagatcaggttggtttggagcatcacaaaataaaggaaacatcaccctaaaaagtgacgtgacagtatactatggaaaggaattttgttgaaaactcccgtgaagtgattatgggagtcagggagctcatgagaaggactatagaacacaaagttagactccagaggggcctcagcagtgcccagagagcttgtttaaaagggcactcttggccaggcacggtggctcacgcctgtcatcccagcactttgggaggccgaggcaggtggatcacctgaggtcaggagttcgagaccatcctggccaacacagcaaaaccccgtctctactaaaaatacaaaaaattagccaggtgtggtggcgcatgcctgtagtcccagctactagggaggctgaggcgggaggatcacctgagcctgggaggttgaggctgcagtgagctgtgatcacaccactgcactccagcctgggtaatagagcgagactccgtctcaaaaaataaaataaataaaaggacactctcacagattacaattcctaaatttggggggaggtttcaaacctccttttttttttttttttttttttttttttgagatggagtctcgctttgtcgcccaggctagagtacagtggtgcgatctcagctcactgcaacctccgcctcctgggttcaagcgattctgctgcctcagcctcctgagtagctgggattacagacatgtgccaccatgcttggctaatttttgtacttttagtagagacggggtttcaccatgttggccaggctggtctcgaactcctgacctcgtaatccgcccgcctcggcctcccaaagtgctgggattgcaggcgtgagccactgcgaccggctgcctccttttttttaaaacaaatgttcccaacttattccgcgaaatactgtcaaagaactcactttgaatttcagcatagctgttaaatatgttgtttttgtctcatagtcaacttccaatttgtgtttttaaaagcctagataggttgaattactttgagctgaaaaccaaaacagttaattatgtcagctcctccacatcccattccccatatttaaattagaaaatcgtacactctcatatttcgatttttcttttcattttgaatgctctattttatacagagctggatgtgacctagacatggagaaactcatttatgtctagcagagaagcagcctatagctgctctgtagctgctgctgtgttttggaaaataagccaggattagattatgtctgatcactttccacatcacatgatgaacagcgattcagaagaagcgtaaaatgaatcctgctgagcagcccctcagctaccatgtggttaactggcggtttccttccctccctcctgtgtattcctcattagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatgtgagtactgggaatgtgcctgtggttatgaatgaaaaggggaaaatgagctgccctcaccctcttctcctttctcatttactcccacgatgctcaagctgccctgtgtgatttgcacaaggcatcgttagagtagcataggaaactacatttaggaagatgtagctttgaatttatgaagtaccataaagtattgtcttagagatattttgtgtttgatttaatttcattcgataatgtaccaatataaaatctcaatttaaaactcagtggcagggaacaagaaaggcagtgtaatttatatgtgtttcttcaatacttttataaatagctatatccctacttttgtgacatttagtagcatcattgaatttttattggattttataactcaatgatcacattatttctatatctattcaacacagaacttcatgagatttgcatcacgttttaaaaataatctaggagaattgggagaatgctagatcatctgtttccaaaaaaaaggtgtattgtttctaaatagatggcatgcctttctgtacccccatataattagaagcttaaatattcactttgtttattttgtactgaggttctttctcatggctattggcatctagttgaaacaaacttgagcatttaagggatagagtttccaacaagcaaattaaaataaaaacaagtaaataagctgggacaattaatatgagtaatttgctcttaaactccacttctttgatgtctaggttataggtaattcccccaacttctattccacgtcttgcctttggaagtttattcaggcttaaggtggagggtttaggatgcagagtgtgctatactaattagcgtgggatgttttactttgggaatcaaatgttattctcctacccagctgacttgtgctgatgatgtaggaaactcatctctgaaagtaggaagggacataggaggtgtactgactctttcaaatctttaagcatgtcatgaaataaatctttcaaaagctccatctgaactctactgctgtagtagacgtttattagcagagagtaaagagaaattatctttttatatctaggattactcacagttctttaaatttagccaaatttcctaggttaaaaaaaaaaaagccaagtccaacttgtaaaaacaaatcctctctctttttgaaatacttttcaacttttaaaacattgcatgtaagtggaaatattagcttagatttttggattgctttttctttcaaatacctgtgatttattgaggtgaaattcacgtaacataaaattagccattgtcaagtgaacaactcagcagcagttggtatgttcacagtgtcgtgcaaccacaacccctatgtacttctgagacatttccaacactccaaagtaaaaccccttatccattaagcactttctcctctcagcccctggcaaccacaaatctatattcagtctctatggatttatctattctggacatttcatgtaaatggagtcatatattatgtgaccttttgtgtctggctttgtccatgttgtagcatgtatcagtactatattcctttttattgtggaataatatttcattgtatgaatatgccacattgtatttatccattcatcaattgatagacatttggattgtttcagctttgttttttgttttttgttttttttgagacagtcttgctctgtcacccaggctggagtgcagtggggcgatctcggctcgctgcaacctccgcctcccaggttcaagcgattctcctgcctcagcctctggagtagctgggattacaggcacacaccaccacacctagctaatttttgtatttttggtagagacagggtttcaccatgttggccaggctggtctcgaactcctgacctcaggtgatctgcccgcctcggcctcccaaagcgctaggattacaggcgtgagccactgtgcccgacctgtttcagctttttgactgttatgaacaatgctgctgtgaacatatgttttccgttctcttgggtatatacctagaagtggaattgctgggtcatacggtagctttatgtttaacattttgagaaatttccaagctgttttcccaagtgactgcaccattctacattcctaccagcagtgtataaaggtttcaatttctccacattttcagcgatagttgttattgtctgtccttttgattttagtcatcctagtgggtatgaagtggtatcacaccatggttttcatttgtatttcagtagtgactaatgacattgagcatcttttcatgtgtttattggctatttgtatatctgctttggagaaatgtctattcagatcatttacccatttttaattgaattatttatttttatattgttgtaagataaatttatatattctagatacaagtttcctatcaaatatgtgacttgcaaatattttctctcatttgttgaattctcttcatcctttcttaatggtgttctttgaagcacaaaagtttttacttttgatgaagttcactttattttttctttggttgcttgtgattttggtgtcatatctaagaatccattcccgagtccaaaaagatttttgctcacgtcttactttaagagttttgtaacaactcaacaagaaaaaaaagataactccattaaaaagtgggcaaaggtcatgaacagacattttttcaaaagaaggcatacaaatggctaacaaacacacgaaaaaaatgctcaacatcactaatcatcaggtaaatgcaaattgaaaccataatgagataccaccttacataccggtcagaatggctattactaaaaagtcaaaaaataagagatgtaggcaaggatgtagggaaaagggaatgtttatcactgctggtgggaatgtaaattagtacaacctctgtggaaaacattatggagatttctcaaagaactaaaaatagagctaccaaactaccatttcatccagcaatcccaccacggagtctacccaaaggaagtcattatatcaaatagatatctacactcttatgtttaccgcagcactatttacaatagcaaagatatggaatcaccgtaagtgtttttcaatggatgattgggtaaagaaaatgtgtggtgtatgtatatgtaagtgtgtgtgtgtgtatatatgtgtgtgtgtgtatgtgtgtgtatatatacgtatatatgtatgtatgtgtgtgcatatatatatgtatatatatgtgtgtgtgtgtgtatatatatatatatgcatgccatggaatactactcagccataaaaaagaatgaaatcatgtcttttgcagcaacatggatggaacaagaagccattatcctaagtgaaattactcaaaaaacagaaagtcaaataccccatgttctcacttaaaagtgggagctaaataatgtatacatatgggcatccagaatacaataatagacactggagactcagaaagctgggagggtgggaggggggtgaggtatgagaaattacctaatgagtacaatgtatgctacttgggtaatggttacgctaaaagcccagacttcattatacatgtaacaaaattacacttataccccctaaatatatatgtttttaaaggccaaaaaaagttttgtacttttagctcttacttttaggcatttgaaccattttgagttgctgattttcacgtatggtgtgaggtaggagtacaaattcattttttgcatgtggatatccagttgtctcagcactgtttgttgaaaagattgttctttccccattgaatcctcttagcaccattgtcaaaaatcaattgaccataaatgtttatttctgggctctcaattctattccagtgatctgtatgtctttcttatgccagtaccagtgtctggattactatagctttttttttttttttttgagacggagtcttactcttgtagcccaggctggagtgcaatggcacaatctcagctcactgcaacctccgcctcccaggttcaagtgactctcctgcctcagcctccggagtagctgggattacaggcacaaaccaccacatctggctaatttttgtatttttggtagagacggggtttcaccatgttggccaggctggtctgaactcctgaccttgtgatccgcccgccttggcctcccaaagtgctgggattacaggcataagccaccacgccaggcctactatagctttttttaataaagttttgaaattgggaagtatgaattcttcaactttgtttctctttttcaagattattttggctattctgggtcccttacatttccatatgaattttagaatcaatgtgtcagtgtctcaaaagaagccaagtggaatgttgagaggggttgtgttgaatctgtagatcaatttggggagtattgctatattaacaattaaataatctgatccatgaacatgggatgtctttccatctatttagatctttaatttctttcaccagtgtcttgtagtgttcagagtataagttttacacttctttccttaaatttaacctaggttttttattctttttgatgatattatacatggatttttgttaatttcatttttggattgtttattgcaaatgtttaaaaattgatttttgtatattggtcttatatcccaaaactttactgaactcattagctctaataggtttttagtggatattttaggaatttttatttacaaaccaggtcatctgcaaatatagttttacttgtttctttccaatgccttttgtttcattttcttgcctccactacaatgtcaaatagaaatgcaagagtagccatccttgtcttgttcctgatcttaagggagaaacattcagtgtttcaccagtaagtcttatatcagctgtgtctttttcatagatgctctttctcaggttgagaaaacacactcctattcctagtttattgatttttttattattacaaagtggtgtttaattttgtcaaatgctttctctgcatgtattgagatgatcttgtggtttttgtcctttattttatgatatggcatataatgttaattaaatggcacattatgttaattgatgttaagccaacttcgcattcctaggataaatccccttgatcatggtgtataatgctttttatatgctgctgaattcagtttgctggtattttgtagaggaatcttgcaactatattcataagagatactgatctatagttttcttgtgatatctttgtctgatttaactgtcagggtaatattggcctcatagaatgagttggaaagtgttcccttctcctccattttttggaagagttcatgaagaattggtattaattctttaaatatttggtagaattcatcagtgaagctatctgggcatgaggttttctttgtgcgtagtttttttgattacttattctgtctcttgttatatgactatttagattttctattccttcttgagtcatttgtggtagttctaggaatttgcccatttcatctacattatctaatttgttgacatatacttgttcagagtattcccttaaaattcttttttttttttttttttctttactgctccattgctccttatggagcagggcaaacccatatggagtgcgtccagaagagccatttaaaattctttttcttcttttatctcttgttggatatgccaatcaaggtttattatgagttcataataataaatctgctgaaagctgatgcagtgatgtttacttatatttattcatagacaaacattgtgtgcataaaattttctctcattcagatatttggaaaaaatatagaaaagcagttgaaaataatgaatactccctcatcattccactacccagagataatgacaacattctgataatttccttcaatgtattttttgtatattatagatttctgatcatcctaaatgttagttttttgtagcctcactttcagcactaaaatgttatgtaaacatttctcaagttgttataaatgctttgcaaacatcattttagtcattgctaagtattttatttggtgaataggccataatatgcttaattattcttcaaatattggaccttttaatactaatataaataacactttgaagaatttctttgtgcaaagccttttccttattttggattatttctatattcaggtgattagatatgaaattatcgtgtcaagggctataaatattttgaaagctcttgatagaaaatgatagatattatttcctgattactaaccatattccaaagagtgttcaacataatctacatatgttttatctaatccttgtaataaacctgaataaagggttattattcctgtttgtatagtggaagcagctcatgctcagtgtggtacttggtaagtttgtttttcgtttttttgttttttttttttgagatggaatctcactctgtcgcctgggctggagcgcagtggcgtgatctcggctcactgcacccttcacctcccgggttcaagtgattctcctgcctcagcctcctgagtagctgggattacaggcgcccaccactatgcccagctaattttttgtatttttagtagaggcggggcttcaccatgttggccaggctggtcttgaactcctgaccttatggttcgcccgcctcggcctcccaaagtgctgggattataggcgtgagccaccgtgcccagcctacttggtaagtttatgcagcttacagctggcagagttgggatttgaattcaaggagttttgatgacaaagtattttttgctgtcacccattacaccattttatgccacctctgaatgttgctgcttcagaagctagctttaattaaatttacttatatacagtaccttgtatttgcatagtgcttttcaagttggccaggccctgtaacatacgtttgatcctcacagccttttgaagggttgttctcagtttgcagaaaaggaaatgaggctttgaaaggcaaagtgattgcctcaagggaacacagcaagtcacagagccaaggctcgtgcttgattcctgtttccactggtctgactagtgttaagggttttttgtcctgctaggtcgttccacctgaccacagtactctgcctctggagtatcacggcagtttgagaaagcgtaacctacatataaaatcgaggctattccctttcttgtgctctacccagcttccatgtagagaagtagcatcgggccaggcgcggtgactcacgcctgtaatcccaacactttgagaggcgggtgaatcacttgagcccaggagtttgaggttgcagtgagctatgattatgccactgcactccagccaggaccaccactgagtgagaccctgactcttaaaagaagaaaaagaccaggcacagtggctcacacctgtaatcccagcactttgagaggctgaggtgggtggatcacttgaggtcaggagttcaagaccagcctggtcaacatggtgagacactgtctctactaaaaatagaaaaattagctgggcgtgacggcacatgcctgtaatcccagttacttgggaggctgaggcaggagaattgcctgaacctgggaggcagacaggttgcagtgagccaagatcatgccactgcactccagcctgggcaacagagtgagactccatctcaaaaaaaaaagtaacatcaattttatattgtcattgttattttatttcttttgtgatatgtagcaggtaagagaggactaataatagctatcatttattgagtgcctgctactctcattatttcttaccaaaactcttaaagctttgattagtctccctcgttttataaatgaggaaagtgagacttaactgccccaagttacacactcatgggtggcagagcctgaattggaaccagatctggcagattccaaagttcatggcccttctgatatgctaccctgacttggagaattggaatttatccacataacagaaattaaacattgcaatttcattctcctgaatttcacttgacacttaaaattttatgttaatggtatttcaattaataatctattgcctttttgttcccatggagcactttggaaacactgatatattttatttcttcccttgagaccacttagaaatgtatttattcaatttctgtaagtgctaagaggccgacaaagacaatccgtgcttttttggctttgtggtttgatgcgtaagctgtgacaaatagaagtttctctaaaggaaattgttcctttcaaaagtactcattctttattttatatgaaaaaaacttaaaaatactgaatagcaaactaaatatttctttaattcttggtaaaacatctagttaatttagctgtttaaaaatcaaacaatcgccaggcgcggtggctcacgcctgtaatcccagcactttgggaggccgaggcgggtgaatcacgaggtcaggagattgagaccatcctggctaacacggtgcaaccccatctttactaaaaatacaaaaaattagcagggcgtggtggcgggcgcctgtagtcccagctcctcgggaggctgaggaaggtgaatggcgtgaacccaggaggcggagcttgcagtgagccaagatcacaccactgcactacagcctgggcgagagagcgagacaccatctcaaaaaaaaaaaaaaaaaaaaaaatcgaacaatcaagccattcacagctgcttgagagcccccctcccggctctccatccccatctccttactcccaatttgaagtcctttactgtgatgtatatttcagtttgagaccttcatggaaaaataacaaatgaaaatctttcatctttggtgttccctaaagaattttctccaagtttagagggcctcttgccattctccttgctattgtttgtcagagggttctaggttatcatagccatcaagcagtctttactgccaccgtagggtatattgaaaatccctgtgaactcggaccgtcctcattttcctcctcaatgaactgcagacagagaagatgctctttcaagtccattgtccctctaagactatccgtatgctctgtagctgtgggaggggtaggtaggggagggcattgattttccttctgcctctcctgctcattccgctagctattgctcatcagcatcttgacatgctcggtgactttcctctttttttcctttttccttttttttttttttggtttgtatatatatatatatttttttctcaagccattttgttttgcttttgttttcctccccaaatatttttgaaaattgcaaacctacagagaagatgaaagaatagtacataaacacccgtttgaaataatttgaaaataagctgtagacattatggaattaacctctacgtacttcagcatgcatctactaaaagagggatattctcttatataactacaatactagatcaccctgaagaaatttaacattgatagtgtaacattatctaacatgtagtccatattcagaatttcccagttgtccaaaattgccctttgtaactgttctttccttccctttaaaataagtcttctctggccctctcatcccctccagttcctctcgtctctctcctccccttcaagctcgctccttaggggtgcatttgtacccgctgtctcctacctcctctttgatcccagcccagggaagatgatctgacaggttcttgaatgacctcgaagtccaatggagcattttcagtgctgattttgctcacttcctggcagtctttggcactcctgcccactcccttcttactactcattgcccttggcttcaggggcaacacattctcctggtttttcttttaggtctctgcatgaactatttatgtggactctactttctcctggcttttaaatgttggggctcctctgggttccccttggctctctggttttgtcactctaacactctccttggatgctttttctagtccatggctttgacatcagtgtgtcaagactccaaatctttattttcagcccacatcatatgctctaatccctgttttattgggaatcattttaaataagtacttttctttgtaaaaggagaccattttcttcatctgaaatcatgattcctctcactaccaattcttaggtaatagtcaccgtttgatatgataatgtgttggcctggaggtttgtataggattggtactacaaacacatttaatgcctgtatgaaacagacaaaacaaaacaaacccatcccaacaacctttttattctttacaccaattaaatacatcttcatctttttatttgctgtgtgattaatttacctttgctttaaaaatttcaagtattttgagactctgataggggctatttagatatccattttagaatcgtgaacctttagaaggcagaaaggccaggtgtagtagccatgtctgtaatcccagcactttgggaggctgaggcgggaggatcacttgaggctaggagtttgaaaccagcctgggcaacatagcaatacctcgtctctaccaaaggaaaaaaaaaatagctggacatggtggctcgcacctgtagtcccagctacataggaggctgaggcagaggatcacttgagcccaggaggatcacttgagcccaggaggtggaggctgcagtgaaccatgatcgtaccactgcactccagcccgggcaacagagcaagacattgtctcaaaaaagaaaaaacaaaaacacacacacaacacaacacaaaacccaaagagagcagaaccacctctttgtttaaatgatttttactggcttccagctttactaggaaattcacaaagaagccagctttccagttgggtcatgttaattgttaggaaatcttgttacagagagacctattgcaactaagtgcaagaaaggacaatccctcagccccaattgccagttatttcccatattcagaacgcttttcttatatgattatggctttatatttcattagcttttagcagctgcaaaagacaaaaatttaatgcggatcgtatttgaccttggatgaacgaacatggcaatataacacagattagtaattaataacgagggagacataaaacagaatttgcagtcaagatattatttcctgagtgaagattaaaggttattattgaattattgaatagaacacatttcctatgagagactattttaataatttaaaatgataggaattcttttatatagcaaaatttcttttacatacttaagaatacaatagtttttaaaaattaatgtattcataataattcttttggaaaattggcaaaacataatatggtaggaaggttaacagttacttgtaaactattctcttggtctgagtgttttattgagttggcctattattttggtatggtataaatgaagcatcacattttcctgaactagtgatatagccaaggattacaactcatctttttttttttttttttcttttttgacacagggtctcactctgtcacccaggctggagtgcagtggcgccatcaaggctcactgcagcctcaacctcctgggctcaagtgatcctcccacctcaacctcccaagtagctgggactacaggtgtgtgccaccatgcccggttaattgttatagtttttgtagagatggggtttcatcacattgcccaggctggtcgtgaactcctaggctcaagagatctgcccgcctcggcctcccaaagtactaggattacagtcatgagccactgcacccagtccaaggatgacaactcttaaggaacctttcatgagatggctttatgtcatcttcatgttgttccattgccctgttgaatcaaatagggctttaaatgggccatttaaaaatcctaatcctaataaatgtagaagaaatgagttcaaaaatcactgttttgcaaccaccatagaaataattgatttaagcaaaaatcatcaatggatattttggagaacagaatgtatacacagtctcaaagcgtgttcctgcaaactgtttattaattgtaaagaggcaaacacttctacagtagagaagttcacatggacaccaccttacccaagtgatccaagttcgctcagtgataatgagacagatgagcaccacatgccttctgatgtcctaatgcactgagaaagacataccacttatcctgccaaaatacacaacctgaatctcatcacgaggaaaagagcagacagatccagattgagggatgttttacaatcaactggcctgtactgtttgaaaatttcagtgtcattgaagagaaaggcagaggagttgttccagaataaaggagactgaagaaatgacgatggtatatggagagagagagagagagagactagttattaacaattatactatctttactttttcatacatttgaaaatatttcagccgggcgcagtggctcatgcctgtgatcccagcactttgggaagctgaggcgggcagatcacctgagggcaggagttcaagaccagcctggccaacgtgatgaaaccccgtctctactaaaaatacaaaaattagctgggcatggtggcgtgtgcctgtagtctcagctactcgggaagctgaaacaggagaattgcttgaacctgggaggcggaggttgcagtgagccaagatcgcgccactgcactccatcctgggtgacagagtgagactccgtctcaaaaaaaaaacaaaaatttctttcaaaagaaaaaaccctaatcctgtacatcctgagataagtttaccaagtttgtagtggtggcaacctaggcttatgtcctttggtagtaccattttttagccctttcttgtttttgccatctaccaacttcattcattgaagactctccacccactctgagcctcatactgggtatcttcactgtacatgtgaataagccccaaatgctttggtgtctgagttccttgatctcctgagccccagaaaccccctcatctcctcaacttcagctgctcactcccatttactggcccccatggtcacctggaaaagccccacctctggaatcttcatgattatcatcctattctctgattgcttggtcttctttgaaacctctgagccttagatacttcacatgtgtctctatctcccagcctccagttttatatagattttgggaatacaggtgcatttttattacatggatatactgcgtggtggtgaagtctgagccagccctctcttgtcttccctttcttccccatccatcttccctccatcttttgttggctgtcacttgaaccagttaacagatcatacaccttagtcatattttaggcagttaaaaaaactaatgtgtgaaatgtttagtgttcccaaaccaattgctagcaaactttggctacaattccttgatggaaaagccagagatattagtaacttgtatttttctacagggatgattccgattgattgatttattttcaaatagcctttagaatttgtctcctttgtccagaagtttctggtttgagtgttcagttttgcacatcatatcgtgcccttggatggttattttcagcttttctatgtacagtgataggtgggctgcagcaatggcactaaaaacaagtagatggatgagttagagtatttggtaactggaaagaatcttagagatcacacagtccaaagttctcattgtttacatgagaaactgaggacctcggagtttcgttgatttgcctgaggttacttagctggcaactgggtaagtcagggcccaaatggaagtatctcaatgacaaagtcagaacttatttttattaccccatgtggatggggttggtgggtacgagagtaagtacatagaatgttgtagaaatgacctgttattctcgctcttgtctcactggaaggccagaggttcctgagaatgacacaattatgatctcttttgtcccttagggaaagtgatagttgtgtttcaaatgcctgacattgtttggagactggacttcacactttactctcttctttcagaaaagtgtctcccagggacaaggcctctgtgttgtggccttgctctgcagggctgccagagtttgtggctgagcgagcctcataaggtgtctgccttgcttgctgcccaacaagcaggctttgtgtctgtctcatgttcactgggcatgtgctttgagctgtttttccagtgaagtcagaagtctcactgggacagccgcacattctggcagatggcagatatagaaaatctgtaaacaaaaataacagtaatgaagactgtggtcctaggccagagttcagccatatcctcttctcatcatgctttgaacagctgaggttatagatgcttctcctcttcgcttaaagccttttgctattagaggattcattttctttccagttcattcgaattcattttaatcagctgtgtcgcacttgtgcctgggtctcttcttgcctggaggccaggccccttaaaggtacattaaatattcgctaatcctgctgcttcctcaggattcctctgccagaagaatttcaaaagcagagagcctttaaataccttatcattctgaatatgaaatgtcttgtttgaagaactatctgtcaaataaactcctatttaaaaaccaaaaccaaaccaaacataaagactctaccagccagcacaaagagaaatgtaagacacaaagtcttaactaaacagtcatttcatttgttcaacaaatatttattcctgctatgttccagagactattccaggctcaggaaatacagcagctaactcaacagatcaaaatcccagctcttatggagattacattctagtggaaagacacagacaatgacaaagaagtaaatatcacatggtgataagtgctatggagaaaaaataaggaaggagataggcgatgaggggagaggagaccatgtaagaaggggtggtcaggaaaggcctcccgcaaaggtgatgtctgagcaaaagctgcaggctctaactgcatgcacctcagttggccgggctcttcttgctctaggctgttgtgttcggagatggtagcctgtttgtccacagtaatttgtgaattttttttttttttgtgacggagtctcgctctgtcgcccaggctagagtgcagtggtgtgatctcggctcacggcaacctccgtctcccaggttcaagcaattgtcctgcctcagcctcccaagtagctgggattacaggtgcccaccaccatgcccggctaatttttctatttttagtagagacgaggttttgccttgttggccaggctgctctcaaactcctgatctcaggtaatccacctgcttcggcctcccaaagtgctggggttacaggcgtgagccaccatgtgcagtcataatttgtgaaatttctaatgaaatattatgtataattaggaagtctttgggacttaactggaatttgttagcctggagagagacaatttttaaaaaagtatctcccatttatcgagtgcttcctatatgacaggcaatatgctaagcattttatatgaatcaattaatatattactaatacctatgtcaacagattactaatacagtattatgtattattacaacacccctagaaggtgttcattcattcattcaatcattcattcaacaaatatataatacatttccaggccttgccccaggtgctgcggatgcagcaatgaaaaaaatgaagttcctagctaataggggaaaatggacaataaacccatacacatataactgtagacaatgtcagatgctcaagagtgctacagagaacagtagaacaggtaaagagatagggaatgtgagcgggagaaggtgtgggaggagatgctattctatataccatctgattttttttttttttgagacagagtcttgctctgttgcccaggctggagtgcagtggcatgatcttggctcactgcaacctctgcctcccgggttcaagtgattctcatgccttgtgcctcagcctcccaagtagctgggattacaggcatgcaccaccacgcctggctaattttttgtatttttagtagagacagggtttcgccatgttgcccaggctggtctcaaactcctgagctcaggcaatccacttgccttggcctcccaaagtgctaggattaaagacttgagccattgcgcctggccccgtctcattttttatggctgattccaaatgccatgtatatagcaaaatgaggatgagcccaggttctgaaattacagataactggatttgactctgcattgtccctctgacaagtgacatgaccccagacatgttgtttctgagccccagtttccttatctgtaaaatagggacagtcacacttgagaggattgttagggggaggatgaaatcaaatcacgttgaagtagatgatccacataaagcacgaggcacaatgcctggcacaaagcaatcactctgaattcattatttgtcttgctcactaaccccgtacatgactatttaatttcttgcaagataccatgatagtgattgccaccagagaaaagaatctattaaaacaaaacaaaaaaccagcttggcaatagagaaaccacctactggccacagaaagttggccaggtaacttattgaatctatgctgttgcttctgtctagaaacaaaaatagaagacccttgctacacatgctcctcaatagcatgcatttatttattcattcgttcgttcatttattctgcatggaatcaatgtgaccgggaagagaagccctgttatcagatgaagcagcaggaccagaagtagatctaagctgtccaataagtttagaactggatgacgcagatcttcaactctctgggcagggtggggggttatgggggccagcaacccctcgggtagggtctatcatgcctgcattctaccctttgctattttggaggtttcttctccaggggagggtcctcagctggctagtgctgtcctgtggtggatggggcttaggaattaggtgaggttttggaggtctgatattggtatgcccaaccttgctgggctccttccctctcctggagaggtttccttgggaaatgtatgcccaagggacaacagcaggatgtggatcaaagtccactttattagctgctgcacaagtaccccaaatctcaacgtagagctctaatgacggcgtgcgttggagcctgcaggaagttggaggcttgaggtcttagcaggacctatttttcccacccctctgagatgagctcatcgggcagggtctagtcaggaggcagaaaccacagagtgatttgaacagagagaattgaatgtaaagaactatagcaactgcagggaagttaccaccctagagttgagagaacaaagggaaaagggtggaattattccggttgagaaacttgcaaggagggtcccacagaactgaagcccagacctctgagaagtggtgcactcagctggtgctggtatctccggggctgccatgagactggctttgcaagtgctggatgagctgcaaactggatccgacgactgttacctggggtgaagagcagttgctaggttacactgtcaggaacaggaagcagacaggaaggagtgtgtccctagtccctccctccagccttgcagtctgcctttcccacccctattggcagagcctcacagggggcaactgacaaagctgaaatggggtctgcaaagtcccagcctcagcaccactgtgctgactagggaagggtggggttagagttgagacctgatagcttaataagtggcatgtgtgctcgggtacaggcgtatgagcataggcagagatggctgcttcccaagctggggtggggtggggcagttccgtttcctgactttggagtagaagaggaagtagaagacagaggggaccataggtgtttataaacttcctatgccacagtttacacccctcccagtggaacccagtgaacgtattgtgtgctatatacaaaacagcagctcctcccttggagagtggggtggggatggaagctaggcagagatgggagggggcctagcttgcctctttctccgcatcagggaggagaagtggcagtagatgtcaggtgtccagctagtgccagccacttagtaggcattcaagaaatggtgaatggccaggcgcagtggctcacacctgtaatcccagcattttgggaggctgaggcgggtggatcatgaggtcaggagttcaagaccagcctggccaatatggtgaaaccttgtctctacagaaaatacaaaaattagctgggcgtggtggtgggcgcctgtagtcccagctactggggaggctgaggcagagaattgcttgaatccaggaggcggaggttgcagtgagccgagatcgtggctctgcactccagcctgggctacagacgagactctgactcaaataaataaataaataaataaataaataaataaataaataaatggcggccattattattcaaaggaaggaaaggtacacataggttagggaatgaagtaactgactggagtggaaagagccagaggacctgagttcatactaaataagtgacttggagcaagagactcgcctttctgaactcaaaatttccttatgtgtaacatggagatgatgatgcttgtggggaccaaatgtcttgtaatagacccttaacatatgatagttattttgttctattattacagaaatagtaataagctcagttatttcttttttttttttaatcgaaatggagtcttgctctgtctcccaggctggagtgcagtggcggtgatcttggctcactgcaacctccgtctcctaggttcaagtgatcctcccacctcagcctcccaagtagctgggattacaagcgtgtaccaccgtgcccagctaatttttgtatttttagtaaaggtggggtttcaccatgttagccagtctggtctcaaactcctgacctcaagtgttctgcccacctcggcctcccaaagtgttgggattacaggcgtgagccatcgcacttggccaagcttgtttatttgttattgatgttgctaataccaaatagaagagacttcagtgatcatttattctacaacatcattgtgcagatgaagaagcagaggcacagaaaagatcaatagctctatggaggttaagagcttgggctatggagtcagtcagaccagggttcgaatcctcactgtctatttccacttaccagctaagtgagctttagtgagttcctcagtctctgtcagcttcgcagtgttgtgaggactgcaggactaatcaatgcatggtcctttgtaagtgcctaggaagtggcactggaaaggtaccattgtgcttgtgagtatgagaacccctgaggccagagggtgattcatcatgatagcgactgtcccacagaacaggcctttcaggtgaccctagagcctccatcatggtattgtgagaacacttcagatttcagccatgccactgccaattatttgctttgcaaggttgaagatgtgtgtagggaaaatctttttcccctaaccattttttttctccactctcacaccacagcaatcatcaacacagaagacttctgtgaccaaatgtgtggggacttttctgcacacaccaagcagcagataccagctgggtgtcctctaattcagattctgacattatctacccagagatagtgtcagatcccacaggttgagggctcagtccccaagactgcctacccaccccaccccaacaccagttgcaagttaagacctccagaacttctgactgaccagcttcaagttgggggttcccatgaccccctctttgggttccattattttactagagcagctcacaaaactcagggaaacacttccttacatttactggtttgttataaagggtattacaaaggaaacagataaagagatgcatagggcgaggcaagggggaaggggcaggccaccctcccagaacctccactgtttcgctatccggaagctcactgaacccggttctcttgggtttttatgaaggcttcaagacaacagcatttcttcccctagggcatagagccttaagcccataatgagaaagtcaggggaagattagagccttggggcaggtgaaaggaggacaggaggtcagaggctgcccctgaggcctaacatacccgacatcacaacaaaagactgtatcagggccatggatgaaaacctctctctctctctgtctctctctctctctcgctctctctctctctctatatatatatcttgtattagtttgttttcacactgctgataaagacataaccgagactgggtaatttataaagaaaaagaagtttaatggacttatggttccacatggctggggaggcctcacaatcatggtggaagggaaaaggtacgtcttacatggtggcagacaagaaagaatgagcgccaagtgaaaggggaaaccccttataaaactatcagatctcatgagacttattcactaccaccagaacagtatgggggaaaccgcccccatgatcagttacctcccaccaggtccctcccacaacacgtgggaattttgggggctacaattcaagatgagatttgggtggggacacagccaaatcatttgtatattataacaccacaacatgtcactctatttcttcttcctgtggtttttccctataaagctcatgatacgtgatgttgggtctatttcctggggttttctgaaacctgaataatggaaagagtccctggaacccaagagccttggggaagctaataaattaaccttgcgagacgaccaggtcctgggatattctgtgtactgcagcagtactaaaccagaggatgctgagactgggggctggacccctgctttcagaactcacatcgttcctgttatagtcaactcttattttttatgcaccaactgggaaaaacgatagcatgaataaaaggagccagctggtgttgattgctcttcactctaaaactcgaggaggcataagagactgtattttaaatctcattacctcttacctgatttctttcttcaatatgatgaaactacaaggtggctcaaaggctaccttccccagaagagagacagtctgcctagatagtccacaaacaagacaatacttccagttgccatttacttagcatgtgctttttaccaggcattgggctaaactcttccccttgtaacatctcatttcatcctcatagaaactctgtgagggagggggtgtgtttctttatccacctgcattttatcaatcgaatctcaggtgcagaaggtggtgtgaatcatacgtttccatcagctcattgaacattatcatcattggtctgtgcaagaccccttcttatgttaattagtttattcccttctcttcatgtaccccacgctcattcactcccctataaataaccggtccattatgtgttgtgtgcatctttccctttgtatatgttcttatgaaatgtggttttgtatctatatagttctattgattaaagtagtatttcattctgtctctgactttttaataaccattccaatggaagtactatgtttttaagacctactggttaggttgctatgggtttatttaatctattgcttccagttgtgttgtgctactccgtggtgtgcacccaccaaagatacagattctctttcctagtgataggcagccaggcctatttgtatcaaacttcctattgccacaaagaagcaattgcatccccatatgtctccttgatggactgtgtgagaattgcctttggggtacgtagtgaagaatggaattgctacttcatagggtatacatagattcatagatttactatgcttaagccatgccaaaggtaggtgctgttattattcctattttacagatgaggaaactgaggttttgagagttttaataacttacccaaagtaacatagacggtaattagcagagctaggattcaagttcaggcagtcttactccaaaacttctgttcctaatggctgtgccatcattattctctgagtgtttgagacatgaggacattttataaaaaacataaaagtcaatctcattgtttggtgttttaatattcttagaacctaggaatccaggtggactgctttttttttccactgaagcacctacttctcctaacaggtgcatagtaactgtttttctttgactttcatattctgtgggtctgcagcactgagagctgcgttgatcatccagaactggtaccgaggttacaaagctcgactgaaggccagacaacactatgccctcaccatcttccagtccatcgaatatgctgatgaacaaggccaaatgcaggtctgttttgcaagcttttctcttcttttgataaaatgattctctttaccccttgttattgaaagaatgaaagtttgggtccattttaagctgaggaagcttggtgaaaggctttaatagagcatgtcatgacattgtcttggaactagttattgagagagagtgtgctttgggaaaaggatggtgtttttccgttttgaagttcacatttttaagagggctgcccaacatctggttaactaataaaaatagtcttattctattttggggcagatgccttaataggaaataaagttgtcattttataaaagaaaaaaatacttcaaggggttaaaaaatggcagaatttcctagcaacaaacctctgcaagctctagaagaaaatatacatgggtgaggaaggccttttttttttttttcttcgagacgggatttcactcttgtcacccaggctggagtgcaatggcacggtctcagctcgctgcaatctccgcctcctgggttcaagcgattctcctgcctcagcctcccgagtagctaggattataggcacccaccaccacacccagctaattttgaaatttttagtagagacagggtttcaccatgttggccaggctggtctcgaactcctgacctcaggtaatccatctgccttggcctcccaaagttctggaattacaggcgtgagccaccgcacctggccaaggaaggcctttttaaagaatacataaatctagttttaatgcttattaattttaaaaaagtacttttaacaataaacagatcttagaaagatctccaatatagttgctaatgaaaaaatcaacttttaaaacaatatgtagagtttatctcatttatgtgaaagaacatgaaacatacagcaaaagtctggaaaaagatacacaggaaattgtttacagtagttagttctgaggacaggaatggtattggtgggtgtgggttgggatgttaagagggacttctcatttttatttgaaattatttgtagtttttagcaatcatatatctgtgtatcacattataatatttaaagataattaagaacattccaaaaagaactaagttgctagatttatttttggcagctagaaaaatgatatactgtgattcagtcagatgctccctttgtctagattaggaacctcagcataggctgtctttctaagcactgtagaatatagtgataaatatacaggtagagtgaatcccaaattggtatgctttagacacattccagcaccagtacattattttctattgattctttattgagatgtaattcacatgccatacaattcacccatttaaagtgtgcaattcaatggtttttagtatatgtacagggttgtgcaaacatccccacagtcaattttaggacattttcatttcccgcttcctaaactccgtacccattagcagtcatttccccatttccttcccccagtccctggcaacgactaagctattttctatctctatggatttacctattctggccatttcatataaatggaatcatataatatgtggtctttgatgtctggcttcttttttatttatttatttttttgagacagagtctcgctctgtcgctgggctggagtgcagtggcacgatttcagatcactgcaacctccgcctcccaggttcaaccgattctcctgcctcagcctcctgaatagctgggactacaggcatgtgccaccacgcccagctaatttttgcattttcggtctcccagagtgctgggattacaggcgtgagccactgtgcccggcccagcttcttttacttagcataatgctttcaaggttcacccatgttgtagcacatatcaggacttcattcctttttagttaatattactcattccgaagaatattccattgtatggatggaccacattttggtcatctattcctcaggtgatggatcatttgggttgttccaccttttggctattatgaataatgctgctgtgaacatttgtatgcaagtttttgtgtgaacatatgttttcagttctcttgggtatagacctgtgagtggaatgtcatgtagtaactttgtgcttaactttttgaggagctgctaaactgtgttccaaagcagctccatcgttttaccttcccaccagcagtggatgagggctccaatttcttcacatttttgccaatacttgttattatctctttttgattatagctatcgtagtgggtgtgaagtgatgtctgattgtggtttctattgactgttaatggacaaacccatcatcaacagcattaaaatcatacattttgataactgtatggaaagtcttccttctctcaattcccaactcccagatctactcccagattgataaagtgtttacttttcatgagaggcagggcttgaaaaagaaattatttgtgctgtacaaatgcaggtctttgcagatacctggtggccatagagccagtaccctgattgtggctggaaagctggtgaagttccacctttcccttcctttctttccaaaatatatttgatatttaagaatattccttaactcttaatttcaccaccaaaaagaaaagagatcatgaccgggtgcagtggctcacacctgtaatcctagcactttgggaggccgaggcaggtggatcacctgaggtcaggagtttgagacctgcctggccaacatgttgaaaccctgtctctactaaaaatacaaaaacattagctggacatggtggcgagtgcctgtaatcccagctactcgggacactgaggcaggagaatcgcttgatccggggaggcggaggttacagtgagccaaaattgtgccattgcattccagtctgggtgacaagagtgaaactccatcttaaaaaaaagaaaagaagagatcataatgaacaaaatttggtagctgtcttacgttggatttcctagaagcagaggctgagacagggattctggtacaagtgacttattgagggtgtgttttcagggaaagcctgtaagggagtgaggaatgcgagacaggacaggggagaagctaggccaagatgtactttttgaagtctgacctcagcctgatcccatctggagctgtcaagtgtgaaatgcactacagtttgtccctggcagaggcaagggaggtgggggactgggctgttacacccttgcttcagccagtcgttgtctctgggcagccccacaggaggggcgttcatgtgttaccctgtgttgctctggatgcaggcagtcctctggaggcaggcatagaagtgacccttagcacctgcagcagctgagatacaaatgccccacaagagtaagggcactcgggtggaacaccaacagcatttgtcacagtagctgtttggggttcactaattgattaatttttttttattttgtccagttatccaccttcttttccttcatgttggaaaactacacacatatacataaggaagagctaggtaagtaaaaagcttagtcttttcaaatgtgtcattaaatattgaattgtcttcatcaagagcggtaaattctgaagatgggagaacactatgaaattaaaaagatgcctacctcttttgtttatgtgacacccaacaactggcaacatcagttcaagtggcctttttccctctctggatggtgtcaactaaatcaatcatttaactttttcacttttccaaaagctgaattagaattcattcaatattcatttgttgaatgccttttctgaactacaatctatcggtacacaacagtagcttagtaaagggaaccttatttattattattattattatactttaagttctagggtacatgtgatcaacgtgcaggtttgttacttatgtatacatgtgccatgttggtgtgctgcacccattaactcatcatttacattaggtgtactcctaatgctatccctcccccctcccccaaccccataacaggccccagtgtgtgatgttccccaccctgtgtccaagtgttctcattgttcaattcccacctatgagtgagaacatgcagtgtttggttttctgtccttgcgatagtttgctcagaatgatggtttccagcttcatccatgtccctacaaagggcatgaactcatcctttttaatgactgcatagtattccatggtgtatatgtgccacattttcttaatccagtctatcattgatggacatttgggttggttccaagtctttgctattgtgaatagtgccgcaataaacatacgtgtgcatgtctctttatagcagcatgatttataatcctttgggtatatacccagtaacgggatggctgggtcaaatggtatttctggttctagatccttgaggaatcgccacactgtcttccacaatggttgaactagtttacagtcccaccaacagtgtaaaactgttcctatttctccacatcctctccagcacctgttgtttcccgacttttaatgatcaccattctaactggtgtgagatggtatctcattgtggttttgatttgcatttctctgatggccagtgacgatgagcattttttcatgtgtccgttggctgcataaatgtcttcttttgagaagtatctgttcatatcctttgcccactttttgatgaggttgtttgattttttcttgtaaatttgtttaagttctttgtagattctggatattagccctttgtcagatgggtagattgtaaaaattttctcccattctgtaggttgcctgttcactctcatgatagtttttttgctgtgcggaagctctttagtttaattagatcccatttgtcaattttggcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaaccctttccccatttcttgtgtttgtcaggtttgtcaaataccagatggttgtagatgtgtggtattatttctgaggactctgttctgttccattggtctatgtctctgttttggtaccagtaccatgctgttttggttactgtagccttgtagtatagtttgaagtcaggtagcgtgatgcctccagctttgttcttttggcttaggtttgtcttggcaatgtgggctcttttttggttccataggaactttaaagtagttttttccaattctgtgaagaaagtcattggtagcttgatggggatggcattgaatctataaattaccttgggcagtatggccactttcacgatattgattcttcctattcatgaacacagaatgtccttccatttgtttgtgtcctcttttatttccttgagcagtggtttgtagttctccttgaagaggtccttcacatcccttgtaagttgaattcctacgtattttattctctttgaagcaattgtgaataggagttcactcatgatttggctctctgtttgtctgttattggtgtatgggaatacttgtgatttttgcacattgattttgtatcctgagattttgctgaagttgcttatcagtttaaggagagtttgggctgagacaatggggttttctaaatatacaatcatgtcgtctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgtccattcagtatggtactggctgtgggtttgtcataaatagctgtcattattttgagatacgtcccatcaatacctagtttattaagagtttttagcatgaagggctgttggattttgtcaaaggccttttctgcatctattgagataatcgtgtggtttttgtctttggttctgtttatatgctggattacatttattgatttgcatatattgaaccagccttgtatcccagggataaagctgacttgattgtagtggataagctttttgatgtgctgctggattcggtttgccagtattttattgaggatttttgcatcaatgttcatcagggatattggtctaaaattctctttttttgttgtgtctctgccagcctttggtatcaggatggtgctggcctcataaaatgaattaaggaggattccctctttttctatggattggaatagtttcagaaggaatggtaccagctcctctttgtacctctggtagaattcggctgtgaatctgtctggtcctgtactttttttggttggtaggctattaattattgcctcaatttcagagcctgttattggtctattcagagattcaacttcttcctggtttagtcttgggagggtgtatgtgtccagaaatttatccatttcttctagattttctagtttatttgtgtagaggtgtttatagtattctctgatggtagtttgtatttctgtgggatcggtggtgatatcccctttatcattttttattacgtctgtttgattcttctctcttttcttctttattagtcttgctagcagtctatcaattttgttgatcttttcaaaacagcttctggattcattgattttttgaagggttttttgtgtctctatttccttcagttctgctctgatcttagttatttctcgccttctgctagcttttgaatatgtttgctcttgcttctctagttcttttaattgtgatgttagggtgtcaattttatatctttcctactttctcttgtgggcatttagtgctataagtttccctctacacactgctttaaatgtgtcccagagattctggtatgttgtctttgttctcattggtttcaaagaacatctttatttctgccttcatttcgttatgtaccagtagtcattcaggagcaggttgttcagtttccatgtagttgagcagttttgagtgagtttcttaatcctgagttctagtttgattgcactgtggtctgagagacagtttgttataatttctgttcttttacacttgctgaggagtgctttacttccaactatgtggtcagttttggaataagtgtgatgtggtgctgagaagaatgtttattctgttgattggggtggagagttctgtagatgtctattaggtctgcttggtgcagagctgagttcagttcctgggtatccttgttaactttctgttttgttgatctgtctaatgttgacagtggggtgttaaagtctcccattattattgtgtgggagtctaagtctctttgtaggtcactcaggacttgctttatgaatctgggtgctcctgtattgggtgcacatatatttaggatagttagctcttcttattgaattgatccctttaccattttgtaatggccttctttgtctctttttatctttcttggtttaaagtctgttttatcagagactaggattgcaacccctgctttttttttgttttccatttgcttggtagatcttccttcatccctttattttgagcctatgtgtgtctctgcacgtgagatgggtctcctgaatacagcacactgatgggtcttgactctttatccaatttgccagtctgtgtcttttaattggagcatttagctcatttacacttaaggttaatattgttatgtgtgaatttgatcctgtcattatgatgttagctggttatttttctcgttagttgatgcagtttcttcctagccacgatggtctttacaatttggcatgtttttgcagtggctggtaccagttgttcctttccatgtttagtgcttccttcaggagctcttgtaaggcaggcctggtggtgacaaaatctctcagcatttgcttgtctttaaaggattttgtttctccttcacttacgaagcttagtttggctggatatgaaattctgggttgaaaattcttttctttaagaatgttgaatattggctcccaccctcttctggcttgtagagtttctgccgagagatccgctgttagtctgataggcttccctttgtgggtaacccgacctttctctctggctgcccttaacattttttccttcatttccaactttggtgaatctgacaattatgtgtcttggagttgttcttctcgaggagtatctttgtggcattctctgtatttcctgaatctgaatgttggcctgccttgctagattggggaagttctcctggataatatcctgaagagtgttttccaacttggttccattctcccagtcactttcaggtacaccaatcagatgcagatttagtcttttcacatagtcccatatttcttggaggctttgttcatttcttattactcttttttctctgaacttctcttctcgcttcatttcattcatttgatcttcaatcactgataccctttcttccacttgatcaaatcagctactgaagcttgtgcatgcgtcatgtaattctcgtgccgtggttttcagctccatcaggtcatttaaggtcttctctacgctgtttattctagttagccattcgtctaatcttttttcaaggtttttaacttctttgcgatgggttcgaacatcctcctttagctcggagaagtttgttattaccgatcatccgaggcctacggctgtcaactcatcaaagtccttctctgtccagctttgttccattgctggcgaggagctgcgttcctttggaggagaagaggcactctgagttttagaattttcagcttttctgctctggtttctccgcatctttgtggttttatctgcctttggtctttgatgatggtgacctacaaatggggttttggtgtggatgtcctttctgtttgttagttttccttctaacagtcaggaccctcagctgcaggtctgttggaatttgctggaggtccactccagaccctgtttgcctgagtatcaccagcagaggcttcagaacagcaaatattgcagaacggcaaatgttgctgcctgatcctttctctggaaacttcgtctcagaggggtacctggctgtatgaggtgtcattcggcccctcctgggagttgtctcccagttaggctactcgggggtcagggacccacttgaggaggcagtctgtccgttgtcagatctcatactctgtgctgggagaaccactactctcttcaaagctgtcagacagggatgtttaagtctgcagaagtttctgctgccttttgttcagctatgccctgcccccagaggtggcgtctatagaggcaggcaggcctccttgagctgcaatgggctccacccagttcaagcttcccggctgctttgtttacctactcaagcctcagcaatggtggatgcccctcccccacccttgctgctgccttgcagttcaatcttggactgctgtgctagcagtgagcgaggctccgtgggcgtgggaccctccaagccaggtgtgggatataatctcctagtgtgccatttgctaagaccattggaaaagtgcagtattagagtgggagtgtcctgattttccaggtaccatctgtcacggcttcccttggctaggaaagggaattccccgaccccttgcccttcctgggtgaggcgatgcccagccctgcttctgctcacactccgtgggctgcacccactgtccaataagcccgagtgagatgaacccggtgcctcagttggaaatacagaaatcacctgtcttctgcgtcgctgacgctgggagctgtagactggagctgttcctattcggccatcttggaaccaagatcaagggaacttcatttttcatccacaaaacttttttgctgagagatcaaaatattttgagtatttcatgcagcagatctaggggaaaatggcaaattaaacacagttggccccgttgtgtctgttttctgtcctctctctctctcttttttttttttttgagacagagtctcgctctgtttcccaggctgcagtgcagtggcacggtctcggctcactgcaacctctgcctcccggattcaggtgattctcctgcctcagcctcctgagtgtctgggattacaggtgcttgctaccacacccagctaattttttgtatttttagtagagacagggtttgagaatgttgaccaggttggtcttgaacccctgacctcgtgatctgcctgcctcagtctcccaaagtgctgggattacaggcatgagccactgcacccggcctctcttctctttgatctgtctgtctgtctacctatcatctagtcattctgaagcagaggcaggcaatggaggtgtagttcaaaaatgattttaaaattataattttttacaaccatgtatttctcctgcaaattaagatctgcctgttattatctccaagacagatgccagacttaaacgctcattttgctttaatttgggccaaccattttttttttttttttttttttgctctcattaaaatgtgtatggcatctaggagcatcttttaaataatctggtaaatacccttcaaagtgaagtggtaaaagaatggtgttttaatgggcatgatttaagctaagtgcatatgtatgaaactaattaaagcatttaatgatctgtagaagccttctgaatggtgaaatagccaaacctaaggaatggggagtgggtggaagtgggtactttgccattttttcttttagataactgcaattcgaagacagttgtttatgcttcatattccttggcaaaaatgtttttgagaggaaatatgataatgataaaatgaaacagcactttctgctaatgacctaatacttcaacccaggctcacttcatcagaatcacttacggagtttcagagccacaggtggctgggttccagcccggagatgtctactcagactgtgttgtcattgttgttgttttaatctgcattttaaaaaattccgtaggtgattttaaaatataagaaaaatatttttattaaagaaggggacagtggtttaatcttcttatagaagcttttttggaagtatacattacaggaaggtatacaaattatatgactcagtacattttctcaaagtaaacacacccatgtaactggcacctggaacaagaaataaaacatgatcagggccacataagtttcccatcctgccttcttgtactgctacccaacccccacacaatcacataactactttcttgacttctacaccctagattagtctttgaacttctttatatagatggaagcatgtggtatatacccatttgagtctggctgctgcttcttttttttttttttttttttttttaacgttttgttttgttgtcgttgttgagacagagtcttgctctgtcacccaggctgaattgcagtggcgcaatctcacctcactgcaacctccaccttcctggttcaagcaattctcatgcctcccgagtagctgggattacaggcattcaccagtaaacctggctaatttttgtattcttagtggagatggggtttcgccttgttggccaggctggtctcgaactcctggcctcgggtgatttgcctgcctcggccttccaaagtgctgggattacacacatgagccactgtgcccagtcctgagtctggcttcttttgatcatcattacatttgtaagaatcatccttgtaatttggtcatttttattgctgaataatattccattttactaatataccataattgatccattcgattgtgtatgggcatttgagttgttttcagattggtgatttaaatggtgctgctatgtacattcttgtacatgtcccttttggtaaaatatgtatgcatttatttggctatatattcatttttggttatctattgctacctaataaactacccccacatttagtgacttaaaaacaacagccatgttattgcatgtaattctgtgggtcaggcatttgaacagggcttgctgggaacaacttacctctgttccatgtgttatcagttgagctcactcatctagctggactgggcaggaaagatcaaatggttttaatcacatgtctgggattttggtattaggtattaacttggttacctctcggccaggtgcagtaactcatgcctgtaatctcagcactttgggaggctgaggtggatggatcacttgagatcaggagttcaagaccagcctggccaaccccatctctagtaaaaatacaaaaattagctgggtgtgttggtgcacgcctgtaatcccatctactcaggagactgaggcacaagaatcgcttgaacctgggaggcggaggttgcagtgagccaaaatcgtgctactgcactccagcctgggtgacatagtgagactccatctcagaaaaaaaaaaaaaaatttggttacctctctttttctcacgcagcctttctgtccattaggctattctggacttctttacatgatggctgggtccaagagggcaaaggcagaagctgccaggcctcttaaggcctatgtgctagaactctgggaaatcagttctgccatactctatcggttaaaacaagtcacaaggccagacgtgaattcagagcagttaaagagatatccatctcttcctcagaggagtggcagtattacagtataaagggatgtggacatagggaggcatgattccttggggagccattatcataaaaatgtaccacaagccagggatagaagtttggggttatagcgcttatatctgttcagctttattagatactggcagacatttttacaggatggttgtaacaagctatactctcaccagttcagttgctccatatcctcaccaacacttgcaatagtacattcatttcattttagtcattctggtgaatatctagtggtatcgtatttcaggtttaatttgcatttccctttgagcagtcaagttgctcactttttttcttttcttttttctctttttctttttttttttttttttttttgagacagagtcttactctgttccccaggctggagtgcagtagcgtaatctcggctcactgcaacctctgcctcccgggttcaagccattctcctgcctcagcttcctgagtagctgggactacaggcatgtgccaccacgcctggctaatttttgcatttttagtagaaatgggtttcgccacattggccaggctggtctcaaactcctgacctcaggtgatccgcccacctcggcctcccaaagtgctgggattacaggcatgagccaccgctcccgaccaagttgctcacctttttgtatgtttattggtcatgtggacatctcatgtggtgaagttcctgttcaggtttttttgtccatttttctattgggttatttgtctttttcttatgaatttggaagagttttctaactcttcttattttattttatttttttagatagagtctcactctgtcgcccaggctggagtgcagtggcatgacctcggctccctgcaacctccccgctgcccaggttcaagtgattctcgtgcctcaggctcccgagtagctgggattacaggcatgcaccaccatgcctggctaattttgtatttttagtagatacggggtttcttccatgctggtcaggctggtctcaaactcccgacctcaggtgatccacccgcctcggcctcccaaagtgctgggattacaggcgtgagccattgcgcccggcctaaataggatatttttaggaaccagaaggttatttaacatttccagatatcggggccaccagattaatggtcttaactctggggcatggagtatcttgagacacgttgggtactctgaagataagaggtgaccctggaagcagtcatacttgtccttgtaatcctaccacctcttgatgatcaattataacagttgatctccctgtgctactactttaagagctcaaaaccagtgcataggactccatggggtgtagagactccacagaaacattcccagtccacttttcacacatcagcctcctcccacaggcagaaagccgaagctgccatacatagccataggtttaaacagagactggcggaagcggggagtgggatggagtgtgtggaagtgttgttttcacttttctttctgcttctcagatcagccaaaatgtcctatcggaccaggtattttatattttttgttgctatggtgaatagaacattttccccattatatcttccattggttatcggtagtgtttagtaaagcttttgaattatgtcaatttatcttatattgtgctactattaagtaataataatatttttattgttgatatttgttacatgtttaccatgtgccatgtatttaagtgctttaaatacatcatttcatttagtcttcatgacaaaccagtgagattagtagtattatcatcccctttttgtagatatggaatctgaggcttagaaggcaatctcccaaggttattcatctcattggtggagaagctgtgattcaaaccagtgtgattaatgtctatattttatacatataaaaaatataaaatatatatttattatagtatttatataatatatattccatataattatatatttatatggaatatatattatatattatataattatattatatatattatataattatattatatatattatatattataatataattatatattatattatattccatataattatatagaatatatattatatatatatatatttattttcgagacagggtctcactctgtcacccagactagagcacagtaacatgatcatggctcactgcagcctcgacctcctgggctcagatgatcctcctacctcaggctcccgagtagctgggactagaggcacgcaccaccatgcccagctaatttttttgcattttttgtaggggttttgccatgttgcccaggcttgtctcgaactcctggactcaagcaattctccatgcccagcctctgtattacatttaattctcctatcaattctgggagtttttcaattgattttcttgggtgtaggtatttaatcacattggccacaagtaactttatttttatatctttctatacaataattactgctcttatttcagcttcatgtcttattgcattggccaaagatagtggatcagtgttagaatgaaacagtgaaagtgggcatccttgttttgttgatgatttaatggaaaaaccattattgattatttaaatttataaagcgatgttaaggaagtatcattccattcctagtttctgagtttttaaaaaatcaggaacagatgttaaattttatgaaatgtcattttggcatctattgaatttattatatggacaccaatggttctgatccagattcataactgagaaacaaaaataactataaatgtagttcaattgttgcttttctttttccagcaatatctggagcttgttttcaaagtgacatgtgggtggtagaggcagaaattgttgtataaaaatttatgggctttaaatttttccctgtccagattttgagtctgtactgggtaaaagaaaagattgtgtgtagggggtatttttgaggtattttctttagaacaacttgtaaaggtatcatttgcctataattcttaattagtttagattcatgttgacaaaattgtaaaccaaataggtaaggattaattctgtgttgcacaaatctttatatattgttcattaaattattgttattagttataatagttctagcccacaagaacagtatatacataagaaatgttaaagcctttgattgttttcatacatgacacattagctactggaagagaatttatgttattcttttttatgttgctaaaaaccagcagaaggattatgatttgacgttgactaatacttcatattgagtagttttaactaagaatcggtttagggaactggtcctttttcatatctttgtcactgaacttttaggcaatgatggtcatcagatctatggaagggacggtagaccaagcttctcttttttttaaagaatgaaaacaatattttaattttgttcttaagtaacaagactgagtcttcataactggaagggatggaactgatttgctgtgtcagttagccgatgggaaagggagagatgacagcatgggtggaggcagtgattgggaaaataaaatgatttttgctttattgctcacagagttggggttactaaataaatcggttataagtatataaataatactgtaggtatcgtgtagcatagttacattttaatatgcagtaaaagtgtaatggttaagagtttgagctcaaagccagattctctgggatcaagttccatctctgctacttacatgctgtaccccattttccttgtatataaaatggagataccaacaatatttatctcatagggtggtttcggtcattacatgaatacacatgtgtaaggtgcttagaacagtgcctggcacatcagtaactgggagctcccatccttgtcattatcaccatgatgccttggaaaaggtgtggcctggggttcaactgggcaggggttgctgagttttgaaggatgataaattgtccaaagaagagaaagcaagggtagtccagggagagggaagagtgggaacaataaagacagagtgctgggctgggagaggaaagcatcgccagtgtgggggagatgcaaggtcccggggtgacatcttagatcggaggagtgtctaactatgtttaattgtgttacagagtctgaagagaggatcatgctggagatacaggcaagggaggaagtgactatgaagttgccaggcctctgaggatttggaagggagaaagggtgtggggaacagctccatgggtggttccatatgcctgtctgcatccatagctgcatcctcaacttcatttcctctttccttccagcatctgactttctaaatcaggcatgctttaagctatgctgcctttctttctttctttttgagacagggtcttgctgtgttgcctaggctggagtgcagtggcacaatcacacctcactgcagccttgacctcctgggctcatcctcctgcctcagcctcctgagtagctgggattataggcgcacgccactatgcccagctagtttttttgtattttttgtagagacgaggtttcaccatgttgcccaggctgtttcactgcctttctcatgaacactgcaatcatatcataaattcctcccccatctaaaaaacagaatcccctagtttttaccatgcgttccatattcactttattttttagagtctataacagaaaataacctttataattctgttagatgatatagtgaaagtactgcgggtttttgtgggtttttgtttttgctgttatttgttttttctaagagttgcttggtatttcagtgtgtacagtcaggaaaaggaaagttttcatttgaagcaagatttatatccaagaacgactaccaaattgaaaagggtggcatgggcattgaagacagtgaagtatttaggctttactgcctacgtaatgaatctgagataaagttgtcaagatgctctccctttctagtctctaaatataaattgaaataattaagttattcttaaatctcaaaccaaacccaaatgagaaaaataaccactcccggaccacattaaagacagacattattactcctaaattcagcttcttataaaacatcatcaaccaccaccagaaaacactgtggtacacaagaatttagaaaatatttttttaaattgccaaatagtatgactttagaaaacatttttcacgtttagttcttaactgtaatctctcagcataactggatcatgaaaaaaatgtattctgtctatatcttgaccactctgaatattttaaaagatagaaactgtttgcagagaacttctgaagaatggcctttgtaacaattcggtgttaatgagttgaagagtatgtcattgtcctctgggtcattatccgcaagaatattgtgtattaaacaaccaccatacctcagtggcatgtaatcaatatttctttttgctaacaagtctacagattagctgaacacttctgctgatcttggcaggtttgattaggcagtttttttgggtcttggctggagttcactcatgtgtccagaacaaacactggtggctgctggctgggggctgatcgaggacaaccttggctaggatgactcagctcagctctacatggtcttgggtctttctgaagcctagcctaggctttgtggtagtggcattgttcctaaagagtgcatgaaagcatacaaggcctccagagagacctgagcttggaactggtacatagcacttccatcacattctttaggccagtacaagtcatgagcccagcctggtttgaagggatggggaaacacactcttgacgggagtagctgcaaaagtacattacaaagagcatggatagaaggtgggatagagaattgggatcacttttgcaatccatctaccatgtttcctttcgtctttctctgtctgaattgtcttgatttctgtactggggctgactgtttcatgggcaatctagcaggcagggaccctgggtctcagcacccactaaaatggacaatgcaggcactccgttatgtagaactgtctctccgagactgagaggttctttgggtatttctgcctgtgatttgtcctttaactttatctgctttgttaccaagaaagaatgaaaatcatgtcagaaagtttatttttaagtaaagagaaaaacaaatccgttacagctaaatagaatcctctgaagtgtttaacaggggaaaaattgaatgttgcagttaaattttctgtaggttctgaatagcagcagatgtttgaaccaaatataatgtattgttctgttttcagccctatttgtaaaagtctgagatgtaagagtgggcaaaaaacttagagctagagcttcgatcatccaaataccttgattggctagttttccctgtgcttctccctccccttcccactagccatggacccactgctgtggtaaaacatctgcccaggaagggatggtggtgacccatgtgaatgttctggtctcagggtcagtcattcctcgtggttatatgtgggctgtgttgatatgcagaacatttagcacagtgccttacatgggctaggtattcaagaagatatttattaaatttaagtattgaaatgttgattcccacccccacccccacccccccgttctgtccttccttttccagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacaggtaagtggaagcagatgctgccttgattcttgtacataacagatgcccaataactgttgaaagaatggatgaacataccacagcagagatgcatttctttagaaaacagttcacattaagtgagagctcccctctgttactcatttaatagaagtctcctcaggtgcacagcaagctcctctctgtaggctaacagcatttcatttgccattttctgagatatcattcacataccataaaagtcaccattttacagtgtacgactcagtgactttttcacgcattcacaggattgtgcaaccatcaccaatatctcattccagaacattttcatcactcccaatagaaaggccattcctgttatcattgcctcctccccacccctggcaaccactgttctattttctgtctctatggatttgcctattctagatatttcatgtaaatgaaatcatcaaatatatggccttttgtgtttggcttctttctcttagtgttttaaaggttcgttcatgtcatatcatatatcattacttgatttctttttatggctgataatattccattgtataccacattttgtttatccattcatcagtgaatggacatttggatcatttccaccttttggctattgtgaacagtgctgctatgaatattcattcacagattttcatataaacatgtgttctcagttctcttgggcttatacttaagaatatttcactgggtcatatggtagctctatgctggatcatgtggtaactctatatttaaattttccagtaattactaaactgcttcccacagtagtggcaccattttgcatttctaccagcaatctatcttcccatgtaggttccaatttcttcatgtttttgccaacacttgttattttgtttttttttttatttttattatagccatcctagtgtgtgtgacgtggcatttcattgtggttttgttttgcatttccctaatgactaatgatgttgagcatctttttatgtatttattggccatttgtataccttctttgcagaaatctgtgcagattctttgcccacttaaaatcaggctttttattattgagttataagagttctttctggatataaattccgtatcagatatatgatttgcaaatattttctcccgttctgtaggttgttttttcattttcttgataatgtactttgatgcataaaagcgttacattttgataaagtccagttcatccatgttttttcttggttgcttgtgcttttggtgtcttggttgcttgtgcttttggtgtcatatctaagaatccattgtcaaatctaaggtcatgaagacttgcctttgtgttttcttctaagagttttatagttttagcctttacacttatgtctgtgaatgattttgagttagtttctatatatggtatgaagtcaaaattaattttttgcatatggatatgcattgtcccagcaccatctgttgaagagactgttctttccccattgagtggtctttgcacccttgtcaaaaatcaataggccaggccgggcacagtggctcatgcttgtaatcccaacattttgggaggccgaggcgggtgcatcacctgaggtcaggagttcaagagtagcctggccaacatgatgaaaccctgtctctactaaaaatacaaaaattagccaggcatggtggctcatgcctgtaatcccagctactcaggtggctgaggctgaagaattgcttgaacccaaaaggtggaggttgcagtgagccgagatcgtgccactgcaccctagcctgggcgagaaagcgagactccatctcaaaaaaacaaacaaataaaaatctataggccatagatatctgggtttgttattggactctcagttctattctattggtctatgtgtctgtgccagtaccacactgtcttgattgctgtagctttgtagtaagttttgaaatagggaagtgtgagtccttcaactttgttcttttgcagtgttgaaattgttcttcattattgttttggctatttggggtcccttgcaatgaatttgaagatcaaattttccatttctgcaaaaaagcctattgggattttgatagggattgcgttgaattgctatatcactttgggtaataattgccatcctcacaatacaagtctttcaacccatggtgtctttccatttatttatgtctttaatttctttcagcaatgttttgtagcttttagtggacaagtctttcatcaccttggttaaatttattcttaaacaatttattcttttggttgatattataaaaggaattgttttcttaattccttttttgattgctcattacttgtgtgttgatcttatactctgcagctttgatgaatatacttgttagctctagtagtttgtgtgtgtgtgtgtgtgtatgtgtgcgtgtgtggtgtattcttttgaatattctatataccagatcatggtatctgtgaatatagttttatttccttctttctgatttgggtgccttttgtttctttttcttgctcaattgctctggctagaacttccaccacaatattgaatagcagtgtgaaagtaggcatgtttatcttgttcctcatcgtagggggaaagctttcaatctttcactactgagtttaatgttagttgtaggtttttcataaaagtcttttatcatgttgaggaaatttccttcaattcttagttttctgagtggttttatcaggaaaagttgtcgggttttgtcaaatgcttttttttttttttacatcagttgagatgattgtgcgttttttacccttcgttctattaatgtggtgtgatatattgaataattttcttatgttgaaccaactttgtatttctgggataaatccctcttggccatggtatataatccctttaaaatgctgttgtatttggtttgctggtattatgttgagaatttttgcatctatttcataagggatattggtctgtaattttcttttcttgtagtgtctttgcctggctttggtatcagggtaatactgatctcatagagtgagttaggaattgcttccttttattctgttttttggaagagtttaagaaggattgtgttaattctaatttaaatgtttagtagagttcaccattgaagccatttggccttggacttttctttgttaggaggtttttgatgactgatccaatctcttgttctagatctgttcagattttttatttcttcttgagtctgttttggtaatttgtggagtttctaagaatttgttcatctcatctaagtaatctaatttgttggtgtacaattgttcatagtattctctcataacccttttttatttctttaaggttgatggtaatgtccccactttagtttctgattttagttattttcattttctctttttttcttagtcagtcttgcttaaaggtttgttaattttgttgatcttttcaaagaaccaacttttggttttgttgattctctctattgtttttctattctttatttcatttatctccactctaattcgtattttctttgtcaaaatattaagttagtttattgatttgagatccttcttttttaatgtgtgcatttacagctacaaatttctctctaaacactgcttttgctgtatcccataagttttgatatgttgtgttttcatttttattcttctcaaagtattttctaatttcctttgtgatctttttattacccattggttttttaagagtatgttgtgtaatttctacatatttatgaattttctagttttgcttttgttattgatgtctagtttcattccattgtggtcaaagaagatactttgcatgatttcagtctttttaaattcgatgcggtttattctgtggcctaacatctggtctatcctggagaatgttccatgtgtccttgagaacaatgtatagtctgcttttgttggggaaagtgtttagtagatatctattaggtctagttgtgtgtggtctctgaaatctctgttcctttagcttgtgttaagttagtgttttgacagagacttccttgaacaccaggagcgatttaaaaaaaaaaaaaaaggaagggaaaaaaaccaacaacaaatatttgcagattggctctctgttggagcactccttcaactccttgggccatttacaaatgttagtctttacttcccgcttgtgctgaaccattgttcagtttcctttttcttgattcactgtttggttgctataaactttgagtattttccagagttctgacaaagttgattctgacagggtttgtttgtttgtttgtttttgcttgatttgtcaatgtttttgtggcggaatgggaccttaaagttgcctacatgaccgttttctctgacatcaccccagtaccctcattctcaggttaggaccctaaagggcatacctaggagtaagagtgaactggaagactggcttttcaatgatcagagaacagcttggaatgaatcatgtaattcctgagattgaactgagatcatcttagatagctaaggctcctaaccacctgccaacagcaaatttaagtcttctctggaagacaataggcctgagattgtttgttcagtttttctttcttcctttcttttttaaaggcagggtcacactctgtcacccatgctggagtgtggtggcactatcatagctcactgaagccttgacctcctgggctcaagcaatcctcccccctcagcctctcaagtagctgggactgtaggcacatgccatcatgcccagttaattttttattagcttttggtagagacaagttttcactgtgttgcccaggctggtctcgaactcctggcctcaagtgatcctcccacttcggcttcccaaagtgctgggattataggcatgagccactgcacctggcctcagtttttcatatgcaatttccagaactcaatacaaatataaccaagcacaggaggttataagacacatgaagaaaactgaggcaaacaacaatggaaacagacctgtagggtatttggttagtggcattatcagactctgagtttaaaataaatatgcttaatataagttcaaggagataaatcaatccaaggagccataatagagaagattgataattctgactttataaaaatgaaaagactgttattaagggaagaataaaaggttcaacacagtgtacagagtaaaaaaaaaaggatcatgtatattttgatttttttaattgagaaaaaattcatctaatgtaaaagtgatcatttaaatcattttaaagtgtatgaggccgggtgcagtggctcacgcctgtaatcccagcactttgggaggccgaggcaggcaaatcacttgaggtcaggcgttcaagaccagcctggtcaacatggtgaaaccccgtctctactaaaaatacaaaaatcagctgggcatggtggcacgtgcctgtagtccccgctactcgggaggctgaggcacgataatcacttgaacccaggaggcagaggttacagtgagccgagatcgtgccaccgcactccagcctgggcgacagagtgagactccatcccccccagcccccaaaaaaagagtgtatggttcaacagtttttagtatattaaaaatgttgtgcaaccatcaccactatgtaattccagaacattttcatcacccccaaacaaaaccctttacccattagcagtcactcccagttgctccctcccccagcccctggcaatactaatttaccttctttctctatggatttgtctaatatgaacacttcctgtaagtggaatcgtacaatatatgtggccttttgtgcctggcgtctgttgcttggcatgtttccagagtccatccgtggtagcatggatcagtacttccttcctatttttagctgagtaatgttactttgtatggatatagcacattgtatttaagggattatatgtttatacatgcatttttgtattcatctgtggttatattgatttttgtatgcttgcaaacacatagaatatttctgggaaagatacgatacttttaacagtggctgtttctaggggtagggattaggggaataagatctaggggagacggaaaatgacttttcattattttacccatttctactatttaaaattttatttcaactaaaaaaatgacgtgtttctccattttaatactacttttttttttgagatagagtctcgctctgttgcccaggctggagtgcaatggcgcaatcttggctcactgcaacctccgcctcccgggttcaagtgattctcctgcctcagcctcctgagtagctgggactacaggcgcgccccaccatgcctggctaatttttatatttttaacagagatggggtttcaccatgttagccaggctggtctcgaacttctgacctcaagtgatctgcccacctcggccttccaaagtgctaggattacaggtgtgagccactgtgcccggccctaaaactacttttttaaaaagaaatattctttaaaggtagtattttcctctaacttaaaagaatgtgactattttattcaagtggttatttaacctgaatatatttataaatggagaaactgccatctgagttaatcatcttgagcatttaatattgcagttgtaaatataattctaatgctatggaaagatagccttataggcaaggactagtatgaccaaaatgattttagtcaatccaaagacccagagaaattattttcataataattttctgttgttgcaatatattctcagtgaatatttgttaatttagcttttataaaaaagaaaacttcccctttagacaacagttactctgataagtactaccaatggaccagaaaaactacaatgataagctaaggtaacactgaagccagtgttgggaatcaatagattacatgtggctgggggtggtggctcacacctataatcccaacactttgggaggctgaggcaggaggatcatttgagaccaggagttcgagaccagcctgggcaacctaatgagaccctatctcttccccaccacaaaaaaggaaagagcttgaaaatccagtgtgaatttttcacttacagcacatttcaattcagattagctccatttcacatgctcagtagctccatgtggctagtggctgccatattggacagcataggtccaatatggcaataggtctaaatagttttgacctattaaaatatgttaaatttgtgtggtagtcacatctctgctgtattatattttggagtatgtatttataattttttttcattctccctctcctttttctttttctcttttattattacaattggctttttgtctgcacgtttccctagggcaagggcgtgcctcccttcacttctcttgggctctaaggacctgggatgatgattcattttctcagttacacacgtcgactgagggcttattatatgccagacactgggctagaatgatctatttcagaataattgaaaggttatcctgaaatacagcgacctgaaacgtgcgtgcttgctccacctttacagttttctatacagtcatgtctttcttccttgttcattacatctatttcctctgcttcccgctcacagatacttcatgcccattatgtcttagaggtgctatttgaaaccaagaaagtcctgaagcaaatgccgaatttcactcacatacaaacttctccctccaaagaggtaacaatctgtggtaagtttcagagcagagttgtccaattaatatttaggagcctcttggtcctacatcgtttgcctaacttgaaaactgtgtaaattggactgtgttaagggaaaaatgttaatatagaattatctatcatgataatactgttccccatcttgtctttgttttgcataccagctggcaggaattaattatgtgagaaattaaagagctcatagctttttataaaggcagacagcattttaatatggaaaaaccacccatgggtggaataagcattctttgccctccgtctagctctcattatctttgttccacgttgctttttctaggtgggcctctgcatgccacttgtgctgggaagagaaaagcccgtggcggggtgaagattaaattcttctctgcccttggctgctgttttagatttttccaactggtctgtgcagcttttagaagagtgggaatgtcccagaaatctgtttcttgttcttttaaataacaagatttgagattttgctatcatataggccagcctggcaggatattgcttcaagaaacagtacacattgaaattcctcacagttggtgctcagcatgcttgcaaccgtttgacagtggggtgcgtggaaggaacagcaattcccttaacttctaattaagcctttaggttacaaaacagtgattgttattttccaaatcagtttttagcctgcatttctcttattctggcaggtagaagtgaatttgacaatctaattaaactatttgcatttctagcgtctgatagtggtggcagggacttgatgtagcagtgcctacctcatcacatgccctgactcaggtttttgaagagtctctaatggttcatttccagcctcatcaggcatcacgtctctgactggcagatgattcatctcagcagtgggggtcttttattcaaggcctcacctggccttttcatggaaaatagagacttcgggtcatgaggctcagaaagccatgccaccctgtgaagtctgtgaggccagggctaggtgtgctcttaggatatatagaatagcccaaactgagaatgggatccgctcccctgtgtttcactgggagccactacagactcatccttgctaaaaggatctggaagaagacacacgttaattacagggcagggcagtcctagaatcccacagtgtgagaactgaagggttctctagtctattccttgctcttatgggtgaaattgaagctcagagagaaaagtggcaggatcagaattaaaatcaggtcttctgtatcccaggttagaggcagccccacatctgccatcctgactcgcattaggtacctggtggttcattgtccatcgtgagacaaagattagggcgtgacttaactggacatctccattggttaaagatttccacatcttggcacttatttctagactttttcacgtggcaccattggtagggggaaaagacaaggccagtgggttttcttaacatgggaatattattattttctatttttaacagctcattgaacttcaaaaatttcatgattatttataataaaatttaaaattggggccataacttcaaaaccatcttccgtttaagacggtgttaggaaagggggagagattgtgatgaaaatttgctattattttaattgtgagatgcatttttttacatgtacatctaaatatgccccgtagttttcagcatgcatgaaatataagaggatttttagtctacagttatattataaatgataaccaattctgcactcatgtttttgttggcagtggaaatatctttctgtccttcttcccatggtacgagtttttctttcgctgtccaactagaagttaaaaatattaaactaagtaaagagtcctcccatctttatgtccttagatttagagtgagaccatatgaaagcaatgagatttaagcacacaatgatactaatatgctaataatattatagtagtattttataaataagtgctggtgatatagaatttctattttattatttccagtatatttggagtcttctattgcatgtatttggttaatcttggttgtgggattttaagcaaactgagggaaaagtattcgtaaattaaattgtatagtaattaagttggatacaaagaataaaaatttatgagcagaacttatgaaagatattttacctagaaatagttatccaaatggggcttttggatattcacatagtcactcattattattgctattttttgagacagagtctcgctctgtcacccaggctggagtgcagtggagtgatctcagctcactgcaacctctgcctcccggggctccagcgattctcctgcctcagcctcctgagtagctgggattacaggtgcacgccacgacacctggctaatttttgtatttttagtagagacagggtcttaccatgttggccaggctggccttgaactcctggcctcaagtgatccacctgcctcggcctcccaaagtgctgagattacaggcatgagccaccgtgcctggccttattttttaattaatggcttcagatactcatgatctcccctagttggctttcattttttttctatgtctcatcaaagaatgtcaactacctactcacaaagtttaaatttcagatgctgctactggagtatattaaaaacacggctttaaaaagctatatacttagccaagaaatgtatttactgagtgcctcttatccactgggtcctatggtaggcacttggggattcaatgctgactacaatagatactgttgctgctctcctagggattacagtgtgggtgtacagaataatcgctaagagcctgaggggttttttgtttttcgttttatttttgagacagggtctcactttgtcacccaggctggagtgtggtggcatgatcacagctcactgcagcctcgacttcccagggtcaagcaatcttcccacctcagtcagcctcctgagtagctaggatcacaggtgcgcaccaccaaacctggcaattttttttttttttttttttgagatggagtcttgctctgtcacccaggctggagtgcagtggtgcaatctcagctcactgcaacctccacctcccgggttcaagcgattcttatgcttcagcccccacaagtagctgggattacaggcgtgtgccaccatgcacagctaatttttgtatttttagtagagacggggtttcgccgtgttgaccaggctggtcttgaactcctgggcccaaatgatccatctgccttggcctcccaaagtgctggggtaacaggtgtgagccatcacacccagccaagcttgagttttgaagtgagttaaagttgggtttgaattcttgctctgatacttgatggctgggtatctttgcataacttacttaactactgtgagcctcatttgtaagatgagaatgatgaagataaaacccatctcatagagtggttgtaaggactgaactagataattcatgtaaaacccttagcacagtgcttggcccagagtgatcgaagccctgtgcaaatgactggactgaaaaggtaattgaagcactagatgctgtccccactataggagaggaagagaagagtgctgtggagacaaattgcctgtcaaattaacatcgtcataggataaaaacccaatgccctgagaacacttggagtggatcagcagtatttcacttttaaaaatgggcattgcatcttgttctctactgaatactgatttttcatttgcactgcaggtgatttgcatgggaaactggatgatctttttttgatcttctacaaggtaaatgatgattttgctaaatattaacatttttcttgggggagggcagtcttagggcagataacaatattagttttactagagatatgtactaatacagatataatgttactgtttttaaccaggaggctcaaagatttgtagagccatatcttttttttttttaacacacatctcataaatttttaaaaaattgtactttgggtcttcattctacattattgttgtctgtgtatccattaggatttgtaccggattgtatttattgtctttatcgcatcataaatgtctagatggtacaggatggggagggatgcagtctgttttattttaattttgttcagggatgagcatgtcacataccagtcttctcttccagtgcacactaattatgcatgagtggagttgcttatgataaggaataagttccagcatgctctcttttctcccctgattcgccatccatgggctcagttgttcttccaatgctgtgcctcctcttcatttattgcatttggcttgtgagagccagcacagagggcacaagactgcttggccagcatggattttctctgcatctctttgattggatttttttctgtctctgggccaagagttacagcctgaatgtttgcttcagggatggctgactgcatatggaaaactgatcttgagatccctgccttcacagcggttacccctttacactggtcttctgaatgtctctttttgattaatgcatttattgttcatctactcctgtgacccccacaactagcatgtcaaataattgggcgtagcgtaggtatctcagatgggtggaaagaaaatatattctgattattattgttaccagaaaggggtcccgatccagaccccaagaaaggattcttggatctcgcacaagaaagaattcagggtgagtccatagactaaagtgaaagcaagtttattaagaaagtaaaagaataaaagaatggctactccatagacagagcatccccaagggctgctggttgcccatttttatggttatttcttgatgatatgctaaacaaggggtggactattcatgcctcccctttttagaccacatagggtaacttcctgaggttgccatggcatttgtaagctgtcatgatgctgatgggagtatagccgtgagaatgaccagaggtcactcttgttgccatctcggttttggtgggttttagctggcttctttactgcaactgttttattaggttggtgcaaaagtaattgcggtttctgcgtgctctggttcaaacacctctaacattattgttcctggaccaaactgagggttgggctgctatttctcatggcccaataacgagatacagatgaactgggaaggaagagagtttttatttctgtaagtggctccagggagaaggcctggaaattatcaccagaccaactcaaaattagaaagttttccagagcttatataccttctaagctatatgtctacgtgtaagtgtgcactcatctaaagacgtaagtgattaacttcttttcatctataactaaggtctgagtcctgaagaccttcctctggagcctcagtaaatttacttaatctaaatcggtccaggtgctggggtgattacccttatcttgtctcctgctaaatcatggaggtttgcagagttccttcagacccccaatcaacttgtttgtggaggcctggggagtttcttcacatccccagtaaaacttgtttaatcctaaataggtcctgttaagaattccttcgttatcttgccatgctttaacgcccaggaaaggcctagacaaaactcttggtgggcttttgttacattccagcctttgtatagggcactggctctttgagcttttaatatttaactgaaccactcagtcagtactgagacagttgttatggaggcctgcgttagtgagacctggcctgccacattttgatgaccaatcagttccactctttgaggctgtgagagcttgagtaagccatacaacctccatgaactgcaattttttttttcagctgcaatattatcttgagcttccaccccataagaggttgtattctggataaaataagtatccaaaagcatttttaaaataataaattataatagaaacacaaggttttcacttcatgcattagattagcagcttggaagggaagaggacaggccaaaccaggagtgggtagagccagcacctaggaagaggttccgttgagacttcagcaggcccaagccaggacgtagagtgtgactgtcagagagtgtcaggaggtgtcccaagtagcagattggtgtaggaagtccaggcgaaggtttgctggcagggagccgagggggctggtgaaagagcaattctggacatcagccacagaatctaagctgggtagggaaggaagagaagccaggatgggccagtcaactgggagaagtaggagggtagtaggactggaatgctgaccgactgtgtcagggagcaggctgactgcagtgagggccttaggaggtaggatggtgggaagtgcagggggagcagtcccagggcaagggatgccctggggtggagcctagaacatgggcagcccaagccatcgaaagagagtattggcgatgaggtgggcaaggacctggaaagcaggtgtgttcaacagtggggggcaccacgtggacccagatgaggagcaggggaaggaagtttagtcagaggtcatgggcctgaaaggagggtggtggggtgtttctctgtgagcagccctgggggcaagcagagcctcccctgctcctgggcctgaggtgggtgtcctggggatgggtgggtcctttccttcagaagggctgcaggagtcaggagtgctgctgtgctctggaggaagcccaggcctatggaggagagaagcctttctgaataagttgaaggtggaaggggcttcattgaccatgaaatggagattctactggccccactggagtgccatgggaaaggtggaaggatggacaggggatgggatttatttaatttgggacgtagctccacaccaaatgttcagaagtgcggtccggctattgttgacaattacaatgtgaggaaggaggagggggcagggcatgtggagaacaacaacaaacctggtcattctttatctagagtcttgagaaatatataaaagggcaaatagttgagtaaattaaatcgggaacgtagtcactaaattccaaggcatttagaaaagaaaatttctttatttcgtatgaaagtgcgataagggataggactctggagtagacagatgagaaaagagaattctaacatatttctttaattctgtctgcaaaactatatggaacatataaaactggaaggtgctaatgtaaagattgaacaggaggaggtgggtggtaagaagtactataaaaggaactaaaggtgaaaatatagcattcaaatgcaagcaagatatatttggagagctaaccaatgacagtgctaaggaaatggagattgctagcccagtgatgaaagactagggcactattatatttaggatggatttgggtagagaggtgagagggatgtctggaaaacagaagtgtgcaagagccatggattagaattctggcaggcgtgagtgagaagaaggtaaaatgcatcttggacatggagtgaaccacatacaccagaatctcgaaactgcctggtttaagtggggaaaccgagggaagagccattgatgacagcaagtttccactttaagaaactgaaaagagatctagtgtacaacacgaggactataggtaataaaattgtaccatatatgggattcatgccaaatgagtagattttagctgctattgccacaaaaaaacaaaaattggataactatgtcagatgatggatactttaatttgcttcactatagtaacctttttactatatgtatgtattctgtaacatcatgatatattataccttgaatgtacatggtaaaatttattttttaaaaaagaagaaaatagcaacaatgataaagcaatggggaaaatagctgatcaataatatcattagtattttcaacagcggtacagcagaaaacccggaaactatattattattttaaaggaatttataataagtgaataaatacattactttcatttatctagaaaaaggaaaaaggccgggcacagtggctcatgcctgcaatcctagcacttcaggaggctgaggtggacggatcacttgaggtcaggagttcgagaccagcctggtcaacatgatgaaacccctgtctctaataaaaatacaaaaattagccagatgtggtggtgcgtgcctgtagtcccagctactcaggaggccgaggcaggagaatcgcttgaacccgggaggtggaggttgcaatgagccaagatcgcaccattgcacttcagcctgggggacaagagcaaaactctgtctcaaaaaaaaaaaaaaaaaaagaaaaaagaaaaaagaaaaaaagaagctggaaaggtagtgtacttaatggtgtctcagacgggagaatgacacgtaaagcttgggggtgatggtgcttggtcgcttagcttatagcaaaagaatgtcctaagttaaaagcagggaaatgaaaggctgggacacagagatatctgaggaagccccgaccatctgatgatctctgatttaccaaagtcaggattttgcccttttctgtcttatttatttttgtctgcagtttaactggagaatgatgatagtttgcatggatgtactgtggcctaaaagcatgaatacaggctgttctggaaacagtgtttctatataaatataaatgacagtgataccccacctatcccaatgtcaaacttcagcctactttacttaccttcacttaccactcatatgtcccaaacccagaattaagtaaaaagggtctctgaacgcttgaaattgttgacacaaatccaatgaaccctactcacaggacaggccttaggcctcttactcaaagacccatgaaccagtatcagtaaaaccttctctcacgcaaggttcacatgagtttgcctgtctggctacccaccccacagcagattagggagtgggaggtgaagatggaaaagtcagacataatgacagcaatgaaaattaaaacgttctggctgggcacggtggctcacgcctgtaatcccagcactttgagaggctgaggcgggtggatcacctgaggtcaagagttcgagaccagcccaaccaacatggtggaaccccattctctactaaatacaaaaaaaaattagcttcgcatggtggtgcatgcctgtaatcccagctacctgggaggctgaggcaggagagttacttgaacccgagaggcagaggttgcagtgagccaagattgtgccattgcactgcaccctgggcgacaagagcaaaactctgtctcagaaaaaaaaagaaaagaaaagaaaattaaaagacagaactataaaaatgagataaaaactgaaatactaatactcagcgatctggagctgtggagtgtagggaagagagttcttgccttgtcagaagtgcctgaggggatgtttagactgatgagcctgcaaggccaagagagtttcaagttataaggtgtatactcttaagaagtaaaggggaccaggcgcgtggctcatgcctctaatcccagcactttgggaggccgaggcaggtggatcatgaggtcaggagttcaagagcagcctggccaatatggtgaaaccctgtccctactaaaaatacaaaaattagctgggcgtggtggcacacacccgtagtcccagctactcaggaggctgaggcagaagaattgcttgaacccgggatgcagaggttgcagtgagccgagatcgtgccactgcactccagcctgggcaacagagcgagactccatctgaaaaaaataagaagaagtaaagggagcaaatggcacattttaaaaacttccagccaaaatggttaaagtaatttttaaaggcattttagctttcaaaggaataagcttcagtgatctggaaaatccatttaagcaatgcttatagtatgaatgaggatattgggtcttaggaataggaggatgagagagcatgaagaaagagaaagcttagttaggagaagagcactgggccataaaaatagataaggaagaaaggaagaagcacatctcaaaggaagagagtggtgagggggttggggggtgatggatttctcttggtagcatcacacacgaaggttgcctgctcagattacaggaggtgcataactatgacctaagcaatcacttgattgcttcgggaaatggtagaatttctgtgatggtctttgtttctcactgtaatgctttgtactaatcaatttgtcaacaactgattgaatcccaattatatgtcatacctgactctggttcactgatagaagctacaattgagtcacatcagtgtaaccacaggctcctaatcttttgtttagaagtagttagtggccgtgctttcacttacttttattttattattgtttttaagagcaatagatcttgaattgtggggaatagtttggcaaactacatcctgttggagatttttggagctataagtgaccaaagtttatgttatactatgactaactgattctctccatcactcacaagagtaagtaggaaaacctcaggctttgaattaagacaaaattttaattcatctcaattggtggtttgctagacactttcttcctcatcagttcttttatacagcatagcatgaataggctccaaggctggggctggcccaaagccaactaagggcacagcctgagagactgttctaatgtagggtcactgagaggcctcaccatattactcttttcatccaagtggttggtttggttcaagacttctatcattataactcaccatatgcaaaagtgaatctgtctactaatgcattcattcagtaaacttttatctggtccctgtaatgttcaaggtatcatataaacactaaaggaccatacaaagttgatttaacatatatttatgaaacacctattatgaatgaggcactctactaagggttggcaatacagtatgactaaaacacagttgttggccccaaagacatcacagtttagtggggaaggttggctgataaaaagacaagatagttcagggttggacatgttatgattgggatcagcatggagtcctaaaagaacccactggcagagcacctaaccttatggaagacttcctggaagagaagacatttctgacgatctcttcaaagaattttagtaatttagtaagtgcctaaatcatgaagggaagttttggaggatcatgaaagattttattctcagacactttttgtggtgccctacaataaatgatgggatttgtagcaattattgttcttcattgattgttttgagattttggtttctttaatatttggttgtccttaaaaattgtatcagctagcaccttaatactaagggaaacattttcagctcagaatcgcatctgggtttgaaaaggactcttccccactgggtaccatactcttaacaacagacctttgctaaaagggcatctcaactttacatggcttcaaatataatcttatcatcaagtgaagtaatttacatatcattagttaggtcatatttttagattttattttctgaaaagattaattttaatcagccctgttgcttaattagagtgaccagtttgaaatacttctttcagagcctcagctttagtaaaattacaagacatttttccctcattgaatagaaagctagaaattttagatcaatatcaccaaattagtttgttaaattgatgccatgagtggtgacctcctatcgctgaaaaagagatgcatgtgaacagagagatgctaatgaactcttaaccctgtgggtaccatcctgatgctatccagtggaagccctactgccttgttttccttttttttctctcttccccaccatcctccacccactacacccataattttccagctgtcaaggtagtcaaacattttctttattttctatcactgaaatgcttcacactgccacagtggccaattttattttccttttgaggtgaaggtagtatgttacaatcagaacagacctctgaaatagggtttgcagaagaagaaaattaacgtggagttgaccagagcttattgtttgatgtgccttcaggaaatgtccaaattcactgggataatttccagatgtctgttgtaaaatgcttccataggaaataggcgagactgtgggaaacatctggtttttgtctctgtttaagttaattaattatggtctgctatttttccccctacaggtcatctgagtgcagttcagagttgtagctactctggactttctgtatctgtcaacttaatcaccatgtcatagacggtttgttgcatattagctgcagaatgagccagagggtttcgtttactggaactgggtgaagcatgttttatggcatgaggttttgcttctttgaaggaaacctggagaaatgtcagtagccggaatcctaaatatcctagacactcacaccccagtagactagttcctcatcatcctgtgtgctttttagttcccttattactctaagactaaagtggattcaaacccaaactatataaagtaatacgactaatcctggaacaacagggcagttcttacacatccaaatgagtcttgccctctttgatgcggttgtcttgaggggcttaacactgaaaggagttcagtatacattcaggactccttttagaatcactttcagagatagtgacatactctcttgaatgagctttattatcacaagtcttaatctcttgaagacatgtgagattcttgaagaaaatcttgaagattttctgaaaaggttaaggcttattgagtgtcaagtgtgttgcataaggtggatggattagttgaccattactatttggggcttaaaatgaggtttaactgaagacattcattactctttgctcatagtagaggtgaaataagacatcacagaggtagcaaagaatttacccacaacaaattctggtttaattcgagataagaagttttaatacaagaaaatctgtcatcgcaatagaaagtgtgtttaccattcaaacataataaatataattttagactattggatgctttcctcaaattttgaaattaaggttatactggtttcataaaatgagttggagagattttcatctttttctcttacttataataatttgaatccctgggttgcaaactcaaacttggctatacactgcagtcacccaggtgattctaatgtgcagtcaaggttgggcaccatgggtttaagtcacattaaaactatttgctcatgaaaattaaaatagagttctgctagaaagccacatggggccagtgcactgttcatgttttcctcttcttttgaatcagttttgctaggaaatggatgattttcaaggaaatcataaaattggttcaaagaaagaaccaataaaatttgggtttatataaacccaaattatcctttttatttcttttctatttccttagtttcagctcttctccttatttgatgggttttattgtttttctaatttcctaagatgaatgccatctttcgtgaacatctttaataatgaaggcatttaaggctacacatcttttctgattttagtgttaactaggccttctattgcacttgtaattttgcttttaattttctctttgatataatacttattaagatgataatttttaatttccaagaatcttaattcaaggagccagactttttttctaatcacatttttatgagactgtatcctgtgacatttttcttattttgaatttcttaagagttctttgaagtcaagtacgagactgattctcataaaagttccgtggacatataaaaaattaattacagtgttgagccttgagcaatgctggggttaggggtaccaattccccatacagttgaaaatccacatataattttgactcccccaaaacttaacaactaatagcctactgttgactggaagccttagcaataacataaacagttgatgagcacatattttgtatgttatataattataagctagagaaaaaaatatattattaagaaaatcttaggccaggtgtagtagctcatgcctgtaatcctagcaccttgggaggttgaggtgggtggatcacttgaggccaggagatcgagaccagcctggccaacatggcgaaaccccgtttctactaaaagtacaaaaattagccaggcctggtggcacaggcctgtaatcccagctacactacagaggctgaggcagggattcgcttgagaatctacagataatctacagagaatcgcttgagcctgggaggcagaggttgcagtgagccgagattgcatcactgcactccaatgtaggcgacagggcaagactctctctctcaaatatatatattaaagaagagaaaatatatttactactcaactcattaagtggaagtggatcatcaccaaggtttttatcttcatgttgagtaggctgaggaggaggaagaggcgggattggtcttgctgtctaggggtggcagagggagaagagccacatataagtggacccatgcagttcaaagctgtgttgtttaagggtcagctgtattctcttatttgtaatacacaaagttcttcatatattaaatcaagtttattggttgtatattcaattttcccatattttttctattatatatgttaatcattttttttgttgcgtctctgccagggtttggtatcaggatgatgctggcctcataaaatgagttagggaggattccctctttttctattgattggaatagtttcagaaggaatggtaccagctcctctttgtacctctggtagaatttggctgtgaatgttgctgtgcaacaaattacctcaatacttaatgacttaacactataaacatttagtatctcacagtttctgtgggtcagaaatttgggtcaagcttagctggatggattctggctcaggatctctcatgaggtagcagtcaaactattggccagggctgcagtcatctgaaaagttgattggggctgagggacccatttccaagatggttcattcatgtggctgtagacacagcatttcaattcctcactgactgttggcagaacagccacatgggcttctccacaaggctgcctgattcttcttgtgacagagcagctggctttccccaaagtgagtgatccaagaaagaaagcatgcaggaagctgcagtgtcttttatgacttagtctccaaagttgtacatcatcacttttgcttttttttctcttcatgagaagcaagtcagtaagtcttgcttctgctcaaggggaggcaaattaggcttcaccttgtaaacagagtgccaaagaatttatggacattattttaaagcagtaattcaatctgaataacacactgtgtatttttaaacaatttcttcttgcatttagtagttaaatgtatgaagcaaaaatgtgttcttttattgactataagttcatgagttgtatttttttcataaagtgccttttattatgacataatgttgctttgtgatcctgtttagtactttaatcttaaactctactttgcccggtattaatatttccattcttgctttctttttgttgcatctacctcatattcaaccttctcttaccttctttttaatgtatatttctcatgaacactatatatctgggttttgtattttaacacagcctggtaatcttggtattttaatgagagaatttaatccattcacacttagtataacaacagatatatttgaaattttttcttctactttgctatttcactttgtttcacccttttccttttctttttgctgttttggtaaagttttattttttattgttttatttggaatttttactctgcttttccattcactagtggttaccttcccacttctgacatttctggtaaataatgtatatgtgtgtatttctcaaatagctataactttattcttccactgcagtcctctctctctctctcaataagataactgtttacacactccatgtctcccattcagttaagatttctagagcattttatttttctcttctcacctcccctgtaaatcctagctattgctcataccatagttttagttcctgaccattattaggttttccttcctagcatgtctcttctacttctggaatctttgcttaatacttaaatgcaagtttcatattgtcatattgatttatatataattatatatttcatgattcattgttcacatctgtattctctcctcttgatctttccctgacttgaggacttttattttttatttttatttttttttgagacggagtttcactcttgttgcccaggctggagtgcaatggcatgatcttggcttactgcaacctccacctcccgggttcaagcgattctcctgcctcagcctcctaagtagctgggattacaggcatgcgccaccacacctggctaattttgtatttttagtagaaacagggtttctccatgttggtcaggctggtctcgaactcccaacctcaggtgatccgcccacctcggcctcccaaagtgctgggattataggtgtgggccacggcgcccggccagggacttttaaatgttagtatggttatttagttacagtgttttgttgagtgttttcctcagtggggcatgtggatgctatcttctctgaatgcaggctcctcgaatacagggactttgtattgtttacttctgtgttcctagcacctaaaactgtgcctggtacataacaagcaattgatacatgtttgctgtttttgtgatgttaaatactacacatttgcatgtctgtctttcaccctgagcatttatgtggttggtgatagttgatctctttacacatctgcaagtacttttctatcaccctgagaacttaatgtcttggccactgtagaaatcttggttcaaagtcctttttcctctttaatttgtaaattttattctaccgtctcctacctcccactactatagatgagaagtctgatgctaggctgattcttttccttttgtaacttgttctttctctctggcctcgtctaatctttttaccaggtggtagggattttgtccccatcaattgtgtgtagaagtcgtgtttcaagcttcaaattgaagtcttttttttaaccatagaaaatgttctctcatatttttgtaattattgcctcttcatctgttcctttttcctgattttgaaatgcttattattggcatattaagtctcttggctttgaatgctagtctcttatttattcttcctgattttcatcattttgattttactcaaaatgatgagagtaagagatttttcatctgcttgctctttcaggccaataatgtattttcccaaccattctttcttctagttacctttaacccattgcttttttttttttttttttttttttgagacagagtctcactgtgttgcccaggctggagtgccctggcacaatctcagctcactgcaacctctgcctcccaggttcaagtgattctcctgcctcagcttcaccctcccgagtagctgggattacaggtgcgtgccaccacgcctggctaattttttgtactttcagtagagatggggtttcaccatgttggccaggctggtcttgaactcctgacctcaagtgatccacccacctcagcctcctgaagtgttgggattacaggcatgagccactgtgcccggccaacccattgatattttaagtttgaatagtatattcttaatgccaagaattaataagtttttgttctttcttgtatgttcttcttattactttaaaaacaaactagttctctgtttcctccagcagtcctgttttattggggaccatctgctttagtagatctgattggtctgtctctctctagttgccggatcctcttaggtactagcttatttccattttctattttctgcttaagctaggttaagcctttccatagttggaggcacaacagtttctactcctgcatcgagtgtgaaaaagaagtctctgtgtttctaggtacccctaaatgcaagtgatctgttcttttcgtttcaaggatgtggaagacatcttcctacactttttctagtaggatccaacatttcagctccccctgcctccaaaccaagatcacacacatgctgaggcagagccacccccttaatcaagtgtccaccatcccctcaggcctagttcttccatgttttcaccccagggctccctgccgctgctcctctagcccccttcagacctggacatcccaacagagtctatagccttcaacagtcctcaggttcctctagcttactcaccctagacagctgaaggctggtggaagagtaacagagatcagagatgcagaatccttccccctttctttgtggttggttggttggttggttggttggttggttggtttgttttagacagggtctcactgtgtcacccaggctggaatacagcagtgtgatctcagctccactgagcctcgacctcccaggcctcagacaatcctcccacctcagcctcctgagtagctgggactacaggtgtgcaccatcacacctggctgatttttttgtactttttgtagagaaggggtttcgccatgtttccaaatctgatcttgaactcctgggctcaagcgatccgtccacctcggcttcccaaagtgttaggattactgttgtgagccatcgtgcccagacttctttacgttttgatgaacgatagcctgtatttttgcaactggtttacactaagcccagtgtgaataagcttatatgaattaatacataagaaaatattggggccatgcacagtggctcatgcctgtaatcacaacactttgggaggctgaggtaggcggatcacctgaggttgggagttcaagaccagcctgaccaacatgatgaaaccacatctctacttaaaatacaaaattagccaggcgtggtggcaggtgcctgtaatcccagctactcgggaggctgaagcaggaggatcacttgaacctgggaggcggaggttgcggtgagctgagatcgcgccattgcactccagcctgggcaacaagagcgaaactccatctcaaaaaaagaaaaagaaaatattggaatcttagaattagaaataacatggtcataataaaatgagtctcttaatttgtatgttgctttaccattttaatgcaattttatatacatggtctcatttgagttccaaaatagccgtgtgtggtaagtatggaagatatcatcctcacttgacagatgagaaaactacagctcataaaggttacataacttgcccaaggacacatgggtaatgaatggacctggaccagagaattcaccttcttatcacactatgccattgcttgtttatttgtttgtttgaaattgccttcagaacatgttacattgtataaatgttttctagaatccctaaattatatgctgtaacctgtattaaattttttcaattatttctattatactgatatgagcaatttaaaatgtatatacataataagatactgagtttaataagatttttaaatgtagtcagaaatctaacaaaagaggaatttgaaaatcatttgaaaaagattaatatttctagaatatgtgtattatttcctgaaggtagccattttgtttttcttttcttttcttttttcttttcttttctttttttttcctcttttgagacggagtcttgctgtgtcgcccaggctggagtgcagtggtgcgatctccgctcactgccagctccggctcccggactcactccattctcctgcctcagcctcccgagtagctgggactgcaggcgcctgccatcacgcccggagaatttttttttttgtatatttagtggagacggggtttcaccgtgtgttagccaggatggtcttttctttcttttttttttagacatagtctttctctgttgcccaggctggagtgcagtggtgcaatcctggttcattgcaacctctgcctcccgggttcaagcaattctcctgcctcatcacctgagtagctgggattataggcgcacaccaccacgcctggctaatttttgtatttttagtagagatggggtttcgtcacgttggccaggctagtctcaaactcctgaactcaagtgatctgcccgcctcatcctcccaaggtgctgggattaaaggtatgaaccaccatgcctggcgaaggtaacctttttgaaggaggacatgcatttttatatatgagtagttaaatttgtctctgtgtaatatatttttaaaacatttgaatttgtcttattatgcagtagaagccatgcagtagggaaatagccatctccctatcaaacatgacatcgagaaaatgtaggcatgttacatgtgtttgttttgtcttagagttttatagtatagtactaaatgaattaatagctattttaaagaccaggcctttgttctgatctctgctgcttttcatgctaacactgtgtttaaaagtattttttcatactcaagagtgatattaaaaatacttaaaaactgatatggcccggtcagtgatcactgagaatatacccgggctctgcacacctggtgtagttgctcgctggcagtacatccgagctgctcagtcacatcacatagcactcttcacttgcctgagtactttcatttccattctcccaggtgatctggggagggatgtagtgccatccccattttgcaaattgggggaatcacagccccaaggagctgaccatagggccccttagaataaaggatttctggctcgtagtttggtggtcttccttgggtagaagtttccctcttttcagaagagaaggaagaggtcagaatagccatgtttgataggacaaatatcagctcctttcagaggaaactcatagtaggtggtgggtagaattagcaccgtcccatcctccctggaatcttccattcccaagcagatttgtcactttcagggcctttgcaggagatgcctgccgtggaagagtaaaactggctcaagcgagagagcagatttttcccggtggaagaacctgactcagcctcttttttccatattaacagggatgttatgtacacggcctgactttaaaagtatattcttttaattccttgttttttcccttctcctccttccacagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtaacccaggcctttagattttctcttttaaaagtttcgcactctggaaaatgctgccatatttaattcctaatagagatagaagtgagtgtattggaagagggatgagggggatctcaaggaggacttcaattcttacccctttcaccacccccattattctgctgagtatcagttgccctgaaactcccttcctatcttttcttccagttctgtccgttcttctcccttctattatgttctttctcttgctcccatgcccgaccttcacaggctaaattgtgtgttgggtaggtgtgtgaggccaggtttggaggtgtggcaggttcttcgaacagatttggatgcagtcgttctgttgctactcttggcttgcctcagatgttgtctcagaaactagttccatgtttttcaccgatgcgtgtattgttttatgacatgataattgcttctggcattgttgctcataaacatatttacgaacacagcatttcaactatctaactcaccagaaacttgaggaataaagattggttagatggtttaagaatctttgctggaaggcacagtaggtgacaaatgttcccttttcccttctttttttcttcttcttttaaaaaatctcttgttttatgaaaaacagaaatcagtttgctctaggacagtggaagatatggcatgtctcatgcttttggtcctgggcttttgggtgccttgatcaaagctcagcaactgattagttttgtctttggggcagttttggcgcctggcttgagtacagagtttcaattctaattctcaaggtatggaagcaaatgctaaaactatgaaggaaaaaaatcccaggactattatcagaggcccattatatataatatagcttgatacttttatttaggcatgctgtttatccttattgcctatcgtatttatctagtgtctataatggttaatgaaggagacgtggcccctgccctcatagagcttacatctagcagggaagatgcgtgttgagcaggtttttcaagtgtgatgagtttgtaaagggggaatccaaccttgtctgagggatgatggaaggttcccccatagaaatatggctttagcctgagagctgaagaatgaattaggcaatcaagaaagagccatagagggggatgggaaacagtgttccacagtgaggggacaacttatgcagagctcaggacaagactgtttagatgtgaaagaagttcaggaggacaggagcatagactgagggacagggtggtgcctgatagggctggagacataagaaatgattggatggttcaaaggaatttggacggacttccaagaacaacacaatgtcaccgaataatgtcataaaatttgtgttttaaaatgcagtaggaggagagagttggagaggggcaagagtgaatacacgctcgtcaattaggaagtagttgaaggttaaagggatagataatgggttctcatttagactagggtagtggtgatagagatgcaaagaaatagattcaagaggagtttaggcaatgatgatttaaggctcagtaactggatatgggagagctgaaagaggagggaatcggccgggcatggtagctcgcgcctgtaatcccagcactttgggaggctgaggcgggtggatcatgaggtcaggagattgagaccatcctggctaacacagtgaaaccccgtctctactaaaaaatacaaaaaaattagccgggcatagtggcgggcgcctgtagtcccagctactcgggaggctgaggcaggagaatggcgtgaacccgggaggcagagcttgcagtgagctgagatagcgccactgcactccagcctgggcgacagcgcaagactctgtctcaaaaacaaaaaaaaagggtggggggagggaatcaaggatgacctccagattcccagcttgagtttgggggtacagcggcatcattcacgatattgggaatgtggaaagaggagagaggttgggatgagggggaatgatgaattcagttttgggtaagctgatttgaggtactattgagtaggcagttgagtgtacatacatgtccagagatcagaaatgaagtgtggcctggaacatcatcctgtggtattaacactagataaaaactgaaagcccgggcagggatgagattcccaaaggagaaagtgaggggagaagagagcctaggatgtaatctgaaggaactaccacatttaaggtgaggtagaggagagcttgcaaaagaggctcagaagagccaggaggaaaaccaagagagtttatggtcacagaatccaaggaaagaaaagttttctagaaggatggtagagtcagctgtatttagtgtttcagagagggcgaggaaggtgaggactgcaaggcatctgttggattaaatagtatggacacctttggtgagtacaggatggaattcatctcagaaaacagaacgttacactgtagaagcctgatgtgacatgatttccatggaaagccagagtgagtgtattgcatttcatcttcacagtgtgggatattaagggcatgtactgttatcctaaagcaaggaaaggtaacagaaatattgtcatcattgaatctcccttcactactgctattcaggcattaaggttcctgacactttctattaaaaccctcaataccattatgggacctgtatcagagagagcataacaagccaacttgttacctgctaggtaacaagttgttcagtcttttctttgttcagtcttttcttttttccaatcatttactgtataggatgtctgagaaattctatctaaatgaaaagtcttctctcacacagcttcccccagctaccacagcatgcttctctgcatacttgtagcgtttacaaaacctgtgcctaccacatatttcttaagttgtcttataattgtttcatagaaatctatcttctttccccagctatactataagctccttgagggtagggatgatgtcgttggttgcttttatgctttccaatcatgcctagcaaggactcaggtaagtaacacttccaactgaactctggtttcttgagttcttgtgatagatactgagatgccaagggcttccctttttgcatgactcatggaagtaggcgttatcaacaatcaaatcatttaaatcccatttttttttaggtatggcttcacgaaagaaattttgcataaatataaggtaagacatgcttttttttttttttttagtattcactttgctgtttctatagagaaatttaaaaagagccaagaaagaccagattgatgctttaggaaaggtaataggccaactagtcagaatgcatgccaataaaatacaagcacagcaggaagccctggccacagtagagtcttatattttctttctggattaaaccacactttttcattgtgagttttgtgtaagttttagcatagatacatatttcattgcttcaaaggtaccaaggatttgttttacttaggtgtggtaaaatatgcagacacagaaatgactgtcatgaaggaagagatttttatttacaattctctagaaaatggaggcactgcaagccactctgggagaccgcgtggggaagcaccagagttggtcagaaggcagagggaggctgagcacggtggctcacacctgtaatcccagcactttgggaggctgaggccggtggatcacttgaggtcaggagttcgagaccagcctgaccaacgtggtgaaaccctgtctctactaaaaatataaaaattagctgggcgtggtggcatgctcctgtaatcccagctactcgggaggctgaggcaggagaatacttgaacccaggaggcggaggttgcagtgagccgaggtcgtgccactgcactccagcctgggcaacagagtgagactccatctcaaaaaaaaaaaaaaaaaagaaggcagagggagggtggagggaagcatctgagtgtaatctggtttaggactgaccaatttgagtaatttcagactgctctgggccacagaggttgtccctagttgtctggtaactggccccgggatgaggagtgtgagagctccataaagaaggtagctggggtgtgggctctcggttgcttggtttgcatatgaagggcgagtcattgactatctaggaattagctagccccgggagggacagtctctcctccagagtcagcaaggccccaagatgtcatagtatcaaaaatacagaataaagggccaggcatagtggctcacatctgtaatcctagcactttgggaggccaaggtgggcggatcacctgaggtcaggagttcgagaccagcctggccaacatggagaaaccccgtctctactgaaaatacaaaaattagccagtcgtggtggcacacgcctttagtcccagctacttgggaggctgaggcaggagaatcgcttgaacctgggaggcagaggttgcagtgagccaaggtggcgccactgcactccaatgcgcaacagagcgagactccatctcaaaaaaaaaacaaaaacaaaaacagaataaaaagacatgatgaatacatgctaattggttagtgactccttgctgacttcctttgagtggcctgaaaatcattactttttgtccatacttggggactattcaataaactgaacctgtcagaaaaacaaaacttactcaagctcttacttacagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaaggtaagaagtaatgttggcatgaatcttctctcagggatttagaagggaatacatacctcttcatttattattttgaattgatttgtgttttagtggttgtaactctaaaaagattatagattttattagagtatataaaagtataaattttaagaaaaatctatgactgcatgataaagaactaagtgggtaacttctatatatggaaaaaaattttaaattcatgttgagggtggaaaaatgaggaaatgttggcattttatgtagtttctaaaagtgaaaaatcctgatttttaaaattaaaacctcaattcattcatttatattgtggtaaaatatacataacataaaacttgccactgtaaccatttttaagtgtatagttcagaggtattaagtatattcacattgttgtgcaaccatcaccatcactaccatctatttacagaattttccatcatcccagaccgaaactctggacccattaaacactaactccccattctcccctgtcccagcccctggcaaccaccaaccaccattctaccttctgtctacgaatttcaccactctaggtaccttatataagtggagtcacttatataagtgcagtttatttctgaattgatacgatttcccacataatacacatcaaataacttaggatactttttttggaaatatttttttgaaatgtttaaataatcatgttaaatacaagcagagcaggagctagtatggaacctctgagacaagtggctatgtggtgactgtgaagatctcacgcctagtgaagggttccttggacgggtcttgcagggtcattggagttgtcttcctcctctactcaagccaagaggaagccctcaggctagaggtgtaggggcgccacatgggttgaagaccagtaacagcagtggagccagatgatgctatatggtcctagtgggaaacctgaactgttacccctcaggactgatcatcaacttccaaccaacctggacaggtggggtctagagctggaatttaatctgatagagacagaaatgtgaccccagtggcaccttgacttcttggaccctttatacacatgtgaatgagaatgtcgttgctggtatcctcccatctttttaattaaagtttaataagtctgacctccagaccagatgagatccccttttgtatactgtcaagccctttgtacatatctttcatcacagttaccgaatttaagtaagaaattgtggtactgtttgtttactatcttcctctgtttttctagtccattgataaaaccccagcacctgggatgtagtaagtacttaatagtcactgactatctcttgagggatttaagatcaaagcagggtaaacctaagacaaaactgaatagaaagttttttacagccctctcctgattctgtggtgattttacataccacccttccccacctcaccaactgatgatgatgcttcctggcttacacctgttgtcctattgtaattattaatagcacctccttttactctaaaaaaaaaaaatcccagttgcagccaggcatggtagctcacccctgtaattccagcactttgggaggttgaggtgggcagatcacttgggaccaggagtttgagaccagtctggtcaacatagcaagatgtcatctctacaaaaaagaaaaaattagccaggtgtggtggtgcacacctgtggtcccagctacttgggaggctgaagcatgaggattgctggaacccaggagtttgagattgcagtgagctatgatcgcaccactgcactccagcctgcatgacagagagagaccttgtctcaaacacaacaaaacccagttgcaataaaacttaagcccactctaagtttaaggtacctttctcattatatcagtgagtaatcaagccaataagacattttgatcaagatataatagtcattattaacataatgagtggattagattctaaccaagagcacaagggaacatgatgtctttgtcagtcaaatattggtgaacacagggcatgaatgccacattccatcaccacctgccctatgactacagtgctaatcagtcatggcagcctcttccaattgaccagattgaacacttttgctttcctgaggttagcctgagcagccagctctatcgagggctttttgagatattgagaagatgcctctgggatgtccctcactagctctgtggagatcccaagttgagggccaccttaacatagtaaagactgtgaggctctaagattagacagacagaactaggttaacatcctgcctctgccccttcctgggtgactgggcaacatactgaggttttctaatccttggtttccacacgtataaactgaagataaaaatacctaccatattggatttttgggaggattaaatgtaattacctatatgaagaaaatggtggccaggcgcagtggctcacgcctgtaatcctagcacttttgggaggctgaggtgggcggatcacttgagggtaggaattcaagaccagcctggccaaaaaggtgaaaccctgtccttactaaaatacaaaaaaatagctgggcatggtggtgcacacctgtaatcccagctacttgggaggctgaggcaggaggatcacttgaacccaggaggcagaggctgcagtgagccaagatcaagccactgcactccagcctgggtgacagtgaaacactatctcaaaaaaaaaaaaaaaaaaaagaaaagaaaagaaaatggcatatactactaaacatatagctttctcctccagttctctcttcttttttccttatacttggttctgaggtttgtgtttcagtcaccaatacagaccctggggagagtttgtgggccagccattttctcaggatacctaaagtttcacccccttcagggataactgttctacctgctctttagactggctttaaagatagaaattcaacttgtatattgtttgtgtcttctacccttccttgagtgaggttgaactggtaacacatacttgttgtattaaatatcattgaactgtagtgaaaatgataggttcaaccatttggaactctatcagatgagacataaaagtagattgttccagtccagttttataatccccactttcccatcccataggaccctccaaccctctgtggcaggagggaccatacttcctggtttacacctgcggtcgtaatggtatcattgttaacaggggttgggaagggttgggggaatttgatgacaacctctattctaggttcatttaaggtattttgtaaggtgggcaggttgaggggggtcaatgcagagggattaaagaatgaaggaagattttctaaaactaagattctggtttattatttgtcaaactccccagcaaggcatttgcagaaagatggctactagactccctgggggaaaatggtcgtgtagtgccttagggagagctggggcaaagtatcctgatcccaaatggccttgaaaacttcagagccacacatacttaagagaccatgtggccttgctcaatgagctcatcagaaatgagttgtgtacagctgggcacggtggctcatgcctatagtcccagtacattgggaggccgaagtgagacgatcacttgagaccagaagttcgagaccagcctgggtaacatagcaagaccccatctttacaaaaaaaaaaaaaaagaaagaaagaaaaagggaaaaagaagtgagttgtgtggacccaagtccagagggtcctcccagaatattctgctctgcccctaatgggaacatttgctggcaggagacagggcaggtaggctgtgaactagctagcaatagctgagcttgaatttctacctagctcaatgagacaggacctcagaataagattcaatttcatttttgaaaaataaaggtaagatttcctacacactctagtttgtaaaagaaactaagtgcttggccgggtgcagtggctcacgcctgtaatccgagcactttgggaggccaaggcgggcggatcacgaggtcaggagatcaagaccatcctggctaacacggtgacaccccgtctcttctaaaaaatagaaaaaattagccgggcgtggtggcgggcgcctgtagtcagtgctgaggcaggagaatggcgtgaacccgggaggcggagcttgcagtgagccgagatcgcgccactgcactccagcctgggggacagagcaagactctgtctcaaaaaaaaaaaaaaaaaaaaaaaggaaacttaagtgcctaccacagagaatttgtctatcactgaaccacggccaccagtataacagaagtattgtttaatattgttttgtttaaagacatggtgctacaaagaaacaagtataaaattacagtctctgcttgtgtaagggaacaagagggattctagtaattgatgccctatcagaaagacgttttgttttccaaagaaacgcagcagttttgttgccaagattagagaacatcgtcaatggctggcagagtcaggctgagaaccacaatgcatttaggttggaagggcttctgaagttttcaacctatgtcccctttaagaactttcttggacacagatgtaccttttctcttttcttctggaaagcataacaaaatgcacagcagccactctattaagaggtgtttctgaactcctgaagatcctatggctagataaaggctcaataaggagactcgttgcccctaccttggtatcttccattttctgtgtggatgccacagaatgtgtttaacacctatagagaaactccagtgaaacacagaaactctttctttataggcaatgtctgtaattggaaaatgtaccaacaatgtaacagacccactttacagacatcagtggatgagtgagatataggaggtggacgagatgcaaaaagtgaccgtgtgtttttcattgggttgtggcaccacaacatagaaagaatcccacctgggactgaagtctctgtatgtggcagaataagcagagggttggactaaagcatgaatttgttttatagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtaggtaatcagggtgttcactgcagtggcaacaatgacactagcgtgcatgttgtcccttacaatatatagataaaaagtgactttacctttacgaggagaccacatgattctcttggaattcatcactatatttttaacagctttattgagatataattcacataccatgtaactcacccatttaaagtgtataattcaatggtttttggtatattcacagtgttgtacaactagcaccacaatctaattttagaacgttttcatcatctgaaaaagaaactacatacctattagcatcattccccattcccttctgtagccaccctgtgccacctaacagccttaggcaaccatcaatctactatctgtctttacagatttgcctattctgaacatgttgtagaaatggacacatatgtgatgttttgtgtctggcttctttcactcagcacaatgttctggaggctcatccatgttgtagcatgtatcagtactgaacatctatttgttgctgaataatattccattatatggatatacacattgtatttattcattcataagctgatggacgtttgggttgtttccactttttggctactatgaataatccttctatgagccatcacatacaagtttttctgtgcatgtatgtttttatttctcttaagtgtgtacctaggagtggaactgctgagtcataaactaattctaaaaaagtttaacattttaagaaagtcccaaactgttttcccaagtggctgcaccattttacatttccagtagcaatggatgaacgttccaatttctccacatcctctctaacacttgttattgtctatcattttgattatagccatcccagagggcatgagatggaatctcattgtggttttgatttgcatttccctaatgactaatgatgtcaagcatcttttcatgtgtttattggatatttgtagatcttctttggagaattgtctattcagatcctttgcccatcttaaaaactgagttatttatctttttattattgcattgtaggaggttttttgaatatattctaaatacaaatcctttatcaggtatattatttgcaaataccctctcccattctgtgggttgtcttttcccctttcttgatggtgtcctttgcagtacagcagtttttaattttggtgatgcccagtcaaaatgatatattttttctctttggttgctcgtgtttttggtgttgtatctaagctattgcctaatccaaagtcataaagatctattactttgttttcttctaagagttttatacatttagctcttaaatttaggtgtctgatccattttgagttaatttttgtgtgtggtgggaggtgagattccaaattctttctgttttatgtggatatttagttatcccagcaccaattttttttttcttttttttgagacagagtctcgctctgttacccaggctggagtgcagtgacacgatctcggctcactgcaacctttgcctcctgagtagtagcttggattacaggcatgcattaccacgcctggctaatttttgtatttttagtagagatgagatttcaccatgttgaccaggctggtctcaaactcctgaccttaggtgatctgcccgcctcggcctcccaaactgctgggattacaggtgtgagccactgtgcccggccaccagcaccatttcttaaaaagactatactttccttgttaaattttcttgacacccttatcaaaaaatcagttaaccataataaaagggtttatttctagactcttaattatatttcacaatctctatgtttatccttatgtcagtactgtacaattttgattactgtagctttgtgggaagttttaacattgggaagtgtgagttctccaactttcttcttctttttccagatcgttttggctattctgggccccttgaatttccatatgaattttaggattgatttgtcaatatctaccaaaaagcagctgggatattggtagggttgccttgaatctgtaggtcaatttgggtactatggctgtcttgagatgtctttccatttatttagatctttaatttcaacaatgttttttacctttcagtatacacgtcttgctcttgttttgttaaatttattcctaggtgtttttgatgctattgtaaatagaattgttttcttaattacattttggattgttcattgctagtgtatagaaatacaactgacttttatatactgacattgtgttgtgaactttgataaacgtattagttctaatggtttttagtggatttcttgagattttccacctacaagattatgttatctgtgaataattttacttcttcctttccaatctgtctgccttttcttttccttttttttctttttgcttaattgccttgtctagaacctccagtacactgttgaataaaagtgaagagagtagatgtctttgtcttgttcatgatactggggaaagcattcagtctttcatcaagtatgatattagctgtgtatttgtttgtagtggccttttattacattgaggaagtttctttctatgcttagtttattgagtgtttttattgtgaaagagtgttggattttgtcaaatgctttttctgaatacattgaaatgatgtgttctttccctttattctattaatacagtatattatattgattgatttcagagatgttaaaccaacctgacattcctgggataaatcccacttggtcatgatgtataatccaccttctatgttgctggtttccatttggtaatattttttgaggatttttgcatctatattcataagagctattggtctatggttttcttatgttgtgatatctttgtctggttttggtataagtttggcctcataagaggaattggaaagtattgtctcctcttctgtgttttagaaaagtctgtgaaggattgattttaattcttcaaatgtttgatagaatccatcagtgaagccatcagggcctgggcttttctttgcaggaagttttaaaattactaatttcaatatttttccttgctatagttgtattcaagttttttgtttcttcctgagtagtttgtgtcttggtagttgtgtctttcttggaatttgtttcatttcctgaaacaaatttatttcatgaaattcatttcatctaatatatctaatttgttgacctaaagttgtttgtagtacttctttatttttttttctcctgaaagtttggtagtaatatttccttttttttgttggtcagtctcactaaggtttgtcaatgttattgatctttttgaagaaccaacttttagttttattgatttttctctattgttgtctattctctatttcatttatttctgcactaattgttaacagtggagggtgtccaggttcttggcgtcttgaacaatgaattggacaaaacgcacaaacaaagcaaggaaggaatgaagggttttactgaaatgaaagtacactccacagtgtgggagtggccccgagcatacgggctgaaaggccctgttatagaatttctgggagtttcaatacccccagaggattccattggttacttggggtacaccctatgtaaatgcagagtttgaagtaaagttacaaagtcatttacagcataagcccaatggagaggatatttcctgtcatagctgaagtgtgaactggccttatgttccctgcctccagaccttattttcctgcctcataatctttatcatttccttccttctgcttgttttgggtttagtttgctcttctttttttcagtttccttagaaggtaatatcattgacttgagatcttttttattttttaacaaagatacaaatttccctttaagtactgctttagctccatcccttaagtttgctatgttattaaacaattgctgctgctttaaaaaaaatagttttgctatgttgtgcttttgttttcaatagtattgtctaaatatccttgtgatttctttaacttatctgttatttggtagtgtgttgtttaatttctacatatttatgaattccccatatttctttcgcttattgatttaaaatttaatttgattgtggtcagcgaacacatgctttgcctgatttaaattcctttaaaactttttttctttttttggtaaatccttttaaaatttgttgaggctttttttgtggcctagcatatggtttatcccggagaatgctccatgtgcacttcagaagactatatatttcactcttattgggtggagtgttttatatatgtctctttgaacatatttataatagttgctttgaaatctttgtctgctaagtcgacgtctagtcccttcaaaagcagtttttattgcctgcttcccccctccgctccccccaccccccgcccgtgtatgagtcatacttttttctttgcatgtcctgtaatcttacattgtagtaaccctaggtagttattcccatgcccctctggggcttgttgttatttgcttttttgtttatttgttgagtgacttgtctggactagtttagtgaagtctattccccttcagtgtgcagcctctgatgtcactcttcacagagtgctgccttgggcatgcatacagtttctcccaccaccagggctggtgtggatttaattgggctctctttgactgtctctttccctgatctctcctttaagcttcggacccatctgcctctatttgaagcagtcccagctgttagccttcactaattgctagccgattgctctattgtttttaacaataacaatgccctggcccacagagtgctctacagtctgatccgattaaagttggacccctttgcaggggcagggctttaaccatgtttgaggcttactccaacctccacaaaggctcttttctcatctgtgtctttccccgattcagtctgttaaatttcttctagctggggtactgttactactagtatctcggcactaccatcctcctcgtaaatgcttattcccaacaatctccattgttttcaacagtgcctttaggcatgaacttccttacactctgtgccaaataaggccagtcccttaggaagagtggcagtgctctgttcttgacctgcctcaccccctgggccaaaccactgtgccatcgcactgcagctgggagcagggacagtgacccacttctcctccagtgacagccccattccacaagtggggtagtaggcagggatgatagctcctggtcttcttggcttgcccttcttggcatagcacctcctccttatgattgagcaagcatgggggcagttggggtctagcacctgcaggctgccatgcctaggatagggcttctgcccaatgagcgggagaagtgaccccagtcctctctgctgtgcttgcctggaatccagcttctgtaacgcagagctgaggggaatgagggatgcccatcagcttgctccttctggggcaaaaccatagccctctactgggagctgggggaagaaggagccccgtcttggatgcatccacttgaagtagagcatccttcatgctgatcagtgaagggggttagagtagatcatggctcaaatgccacagactctctctgttggtatcaaaatttagtaagttttcttaaatgtttctccatatgctgtatgccattaggacaatttccagtggctttaactattttaatttttttttaagtgattttccgctgggcgtggtggctcacgcctgtaatcccagcactttgggaggctgaggtgggcggattgcttgagcccaggagttggagaccagccttggcaacttggcgaaaccccatatctataaaaagtacaaaaattagctgggcgtggtggtgcatgcctgtagtaccagctacttgggaggctgaagcaggagcatggcttgaacctgggaggcggaggctgcagtgagctgagatcgtgccactgcactccagcctgggcgacagagtgggaccctgtcttaaagaaaaagatgttcaccagttaaatggttgtttcactggggagagggtctgccaagcccctaacactgccattcctgtcactatgttgtcattttgagaactgtactgagtatgtctataaacatggatgtaaaggcaataagccatgtactcatctttgtgacagcgtgcatatccagagctgcctgtctggagtctctggcagcttctggcatggagtaagatctataaatattcctctcattcattcatccattcaacaagaatgtattgatcactcctgagtactcttgctcatttgtcttggtgaaatttagcgtttttctaaatttccagtcctacattttaactgctttcttgtcagtttttaccctatatggcagggatgagttcttaagaacaacagctatgtgcattatctcattaaatccttaaagcaacctgatgacgtagataatattattcctatttcccgaaagaggacactgaagctcacataagttgaataatttgctaaatgatgggtctggttttgattccaaatttgttggactctacgcttctcatttttgactgctaggtcataccatgtctctcactgtaggaaaagatgttacaggacactgggttttgtttgtttggttggttggtttcctttttttgagatggagtctcactctgtcacccaggctggagtgcagtggcgcaatctcagctcattgcaacctccacctcctgggtttaggcaattctcctgtctcagcctctggagtagctgggattacaggcatgtgccaccacgcccagctaatttttgtgtttttagtagagactgagtttcaccatattggtcaggctggtctcaaactcctgacttcagatgatccacctgccttggcatcccaaagtgctgggattacaggcatgagccactgtgcccggccccagaactctggttttcaacttcttacatgggaatgttatgacctcttagaaaggacttttgaagacttttcttcaggtttcctgttctgaaagaaatgaaataaaattattggatatggactaacgcttaatgataaaagtgttcttcctgtagatagaatcataaccataataagtagctttcgttttcagatataaacacacatacatgcatttgcaatgtcacaagtacacatagacacgtgcccacatgatgttggttacatctgtagctgggaaacataattaaacaattaccaaacagtgttaaatttcttacttcccttcagtaattgttaaagaaacctctttttcttgatttgggacccttataccttgattgctgaaaatgttgactaaaatgtgatttctggtgtaaaatataccctaatcaatgaggagagagagaagtggggagacagactgagggagaaatggaattcatcattggctgtgagtccaaaatatttaaaaatcaagtaagcatgagaggcatctcatagcaagtaggaaaggatgcctccttaaaccttgacatccaaatcccaaagactgaaggttagaacaagctcttctaggattatggtgaataaagaagataatgttaaagaaattggagctgcacacaaagaaaattgtggcctctggaagcctagaagagttagaagagccttaagaagtgggagggaggagactggggctcattattccataacagagcctcccactccccaaacaatagagatacagcatcttgcagaccccacacacatgatcagagctgacattgggtaaaatgggccagaacctcatttctgatgtttaatcattttagttgtgcccctaattttctttcctcagttcctggtacatagtggatacacacacacataagttatgctagagccgaaatttccagataaaaacagagctgacaattactttatttcttaatatctatgagctattttgtataaagatcatatactctttattttgtcttgtagtcatggaaattcataattcttggcagagtgctatagtttaaattttcccttatgttcactgagatgtggggatatatttaatcggagttaagtcactatacagagatgaatatgatactctttaagacagacttacaaagagacagaggccagaaaggtttcaaaaataattttaattatttatagtctgaatgactcccctctctttattcattcatttaacaggtatttattgagcacctactatgtgtcagacactgttctagacttctgggaaatgtcaatgaccaaataaagatccgttaccttgcagagcttacattttagggggaggagttagatgacaaacaatacagtaatgagtaaatgatatgatatcttaagtgatatgttcttttttattattattattatttttagacggagtctcgttctgtcgcccaggctggagtgcagtggcgcaatctcggctcactgcaagctccgcctcccgggctcacaccattctcctgcctcagcctcctaagtagctgggactacaggcacctgccaccacgcccagctaatatttttgtatttttagtagagacggggtttcaccatgttagccaggatgtctcgacctcatgatccgccctgcctcggcctcccaaagtgctgggattacaagcgtgagccactgcgcccagtcttaagtgataagttctatgggaacaataaaaactagagcagagttaaggagaacaggaaaactggacttggggacaaaattgcaattttttttttttgtttgtttgagacagagtctcactcctgtagtccaggtgggaatgcagtagtgcaactacggctcattgcaaacctgaccacctgggctcaagtgattctctcacctcatttttttattttttatagagatgatgtctcactatattgcccagactggtcttgaactcctgggctcaagcgatccttcctcctctgcctcagaaagtgctgggattacaagcatgagccacggcgcctggccaaaattgcaattttaaataacgtagtcagcagcattgaggaggctcccaagagggaaatgacttgattgaggtgtcttggctggtcaggaatgatagagtaggatttgatcctgaggttgacttgaatgtccatgctctttttctgaagggatagatgagagtgacaggcattctcaggaaggacgtgacctactttagtcagcccttattcaatgaggcctgaagggtggacagggagcaggaggaaggcatttaaagaaatctaggtacctggctggaaggtttgggctgagcacggctttttttttgagatggagtcttgctctgtcgcccaggctggagtgcaatggtgcgatctcggctcaatgcagcctctgcctcccagggtgaggcaattctcctgcatcagcctccaaagtagctgggattacaggcatctgccaccacgtccggctaatttttgtagttttagtagaggcagggtttcaccatgttggccatggtagtctcgaactcctgacctcgttcatgatccacccatctcggcctcccaaagtgctggaattacaggggtgagccaccatgtccggcctgagcatagcttttaaaatgacatggtctaggccaggcgtggcggctcacgcctgtgatcccagcactttgggaggccgaggcaggcggatcacaaggtcaggagttccagaccagcctgaccatcgtggtgaaaccccgtctctactaaaaatacaaaaattagccgggcgtggtggcgcatgcctgtaatccctgctactcgggagactgaggcagaattgcttgaacctgggaggcgggggttgcagtgagccgagatcacaccactgcactccagcctgggcgacagagcaagaccccgtctcaaaaaaaaaaaaaaatgacatggtctagctgggcgtggtggcacgtacccgtaatctcagctagtcgggagactgaggcaggagaattgctcgaacccaggaggcggaggttgcagtgagctgagatcacgccattgcactccagcctgggcgacgaaagcaaaactctgtctcaaaaaataaatgaattaatgaattaattaaaaatgacatggtcaaaagctggaagggaggatgtataactaagggaaaatatgaaagaatagtgaatctatagtattaatgttttagaagagaagcatttagatatacctttcagagctattaactctccctcgaagcacacttttggagtctggattacttagagctgcagacatgcgcaaggtccttcttgaaggatttattttagattgaggagatttaaaaggctgacacacaaatagatttttgttgaccaggtcatataaaagctgtaattcagtaaaacgttcccattttttttgtttgaaatttttcaggaaagaatgttgtaaagaattaattagtctttcatgcagtgatcaccccaaggatcctgcatttcagaggataatgtgttgttgagatgaaagagatggtttctactgaggaatttgtttcaccaacaaatgggcttttatgcaatttttttgtgagttctgcaattaatcttacgttaccactacgatctgggtaaacctagtcaagtaaatgatttctagacagaaaaaagaaatgcagaactcagggaatggattctgaaggacaagctcagttcttaaaaactgttaccccttatgacttagaatcaaagaaaaatgagtgtcagatatatcttcctcattcctttgatgatgactaagtcctgaatatgttaagtgatttgcccaaggtgacttaggtaattacttgaagtgctaactccttggccagtgcttattctagttcaacagagtcccatcatatgtgcattgaatttatgtaaatttcaattattgtatatggcaaaaaaggagaaaaatactggaaaattttattttcatatactttatcacatatataaaataatatatccatatttatataatatatataaaacattcacatatccatattattgtatagagttgtatgcatacattcatgtacagtcaaccctccgtatgcacgggttctgcattgtggactcaaccaataacagattgaaaatatttggaaaaaaagaaaacaatataacaatacaatctaatataaattttaaaatatggcataacaactatttacatagcacttacattgtattaggtattataagtaatctggagatgatttatagtacagatactctttgatttatgatgagtttatctggacttaattctatcatgtcaaggagctcattgaatgcttgttgcttttgcaccattgtgaagttgaaaatcgttaagtcagggaccatttgtagacaggaggatgggtgtggattatatgcaaatactacgccattttatacgagggacttgagcatccacagattttagtatcctggatgtaggaggtggtcctggaaccaatccaccttggatactgaggggcaactatatatgttaagggtaacttaagaggtttcccaggggtaattttggctataaatgatttgcatcccatgtagaaattggaagcttaatcccctcctaacaaagcccaactccttgatttccatctttcctccatcattatattacaggtcgaattatgtccctaaacatgacatcatggtgtaagagccagatttgactcagttgaaaatgcaagtgttatttttgtcataaacaccagcaaagtaaaggggttccattatatttattcatagagtagggcggtgctgatgttggaattcagtggggagaaaggagcccccttggctgactcttctttgggtggttttaactgtcacttcaatcatcaaaaactctgcaggtatctgatgtgggcctggtacagggtttctcttttctctagttctgaccaggtacttattccagggtagctctcctgccagttctgctcttttcacctcactgtctttttcctcacttattttctagctcctcttccataccaaacttataaacgggtgtacaatcatgtttagcaattcctggtcctcttctccagacctgatttggagccactagaataactgcataacttcacatgcctgctttttcatgcactcaaaagaaacatgtggaaaatatagactgttagaatcagtctgttagaatctgagatactttacaggtcaactggtccaaatgcctgattctaaagatctcaaaagtgagacccagggaggattttcaaggttatgtagctttaatggcagagagagtttttctcaccgctttaagctgttatagaagtttcaataaagaaacattacaggccgggtgcagtggctcacacctgtaatcccaacaccttgggaggccgaggtgggtcgatcacctgaggtcaggggttcgagatcagcctggccaacacggtaaaaccctgtctctaccaaaaataccaaaaattagccaggtgttgtggcgggcccttgtaatcccagctactcaggaggctgaggcaggagaaccacttgaacccaggaggcggagtttgcagtgagccgagatcatgccactgtactccagcctgggtgacagagcgagactccatcacaaaaaaaaaaaaaagaaaagaaaagaaacattacagatagatgagagccacaaagacggagcctccaatctttatgaaaaatattattttgttttattttgagatggtgtcttgctctgttgccgaggccacagtgcagtggcatgaacatggctcactgcagcctcaacctcctgggctcagggatcttctcacttcagcctcccaagtagctgggaacacattccggcaccaccacacctggctagtttttattttttaagtttttgtagagatggggttttgccatgtttacccaggctgctcttgaattcctggacccaagcattcctcctgactcagcctcccaaagtgctgggattacaggcataagccactgtgcctggcagaaaaatgattttaaaaatttggatctttagtcctggacatcatgtaacctgcatttgcctctcctgcgccccaaaggaaatgttataataatacaacacttgtggatttagaacacattatggaaaccagtcatttactaaatgtattgcggaaactgagaatgtacttaccatcgaggggggaaaagtgaaggagatgctttaggagacaccctcagataaacaggtttccacatttgtgttgggaaacagcaagggcttcctcaggctatgtgctcaacaggacaaaaacctggcccagagccacagcaggagacctactttatgtctttgaacatattaagacacacctaatgtgtgggcattgtggggagctaatttcttccctgaatgtgacaatgaagttcttttaagagaaaagaaccttgtagattcaacaattgtcaaacaattgtgatggaatttttaaagccaaaaaaacaaaaaaaaaatggcaaggcctgattcttggttattgttattgctgtattggttattcatggaggagatgaatatgaaacaatattcttttttctttttcttttttgcggagaccagctcagtaggggagaccctaacccagcagcgctagaggaattaaagacacacacagaaatatagaggtgtgaagtgggaaatcaggggtctcacaaccttcagagctgagagccccaaacacagatttacccacgtatttattaacagcaagccagtcattagcattgtttctatagatattaaattaactaaaagtatcccttatgggaaacgaagggatgggccaaattaaaggaataggttgggcttgttaactgcagcaggagcatgtccctaaggcacagatcgctcatgctgttgtttgtggcttaagaatgcctttcagcggttttccgccctgggcaggccaggtgttccttgccttcattcccgtaaacccacaaccttccagcgtgggcgttatggccatcatgaacatgtcacagtgctgcagagattttgtttatggctagttttggggccagtttatggccagattttaggggggcctgctcccaacaattttgagacagggtctctgtctgtcacccaggctggagtgcagtggagtgatcatggctcactgcagcctcaacctctcaggctcaagtgatcctcccatctcagcctccctagtagctgagactataggcatgcaccaccatgcctggctaatttttgtattttttgcagagttgaggtctcaccatgttgcccaggctgggcttgaactcctggcctcaagcactcctcccacctcagccacccaaagtgctgggatcacaggcatgagccaccacgccaggcctgaaacaattttcaaggaagaatgagaagtggtctttgggataccttgggttaatatttctgacaaataagttggaatctagaaagatatactctcacttgtaagttacagcgaaatctggtttgttgttccaagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtaagctaaaattgttggtgacattcccataaacatccttcccctaagcacagtcttttcttcacagagcatgtctggcctagaagcccatgagaagatgtcttctctagtaccaaacagaaaccagagaaggcgagcttcatctaggttgtttgaaggggcctcactgtcccttatcctaaaagatatttggtttatttccctgatcttccctaatcccagaaacagaaattctttttttttttttgagatggagtctcactctgccacccaggttggagtgcagtggtgtgatctcagctcactgcaacctccgcctcccgggttcaagtgattctcgtgcctcagccacccaagtagctgggattacaggtgtgcgccaccacacccagctaatttttgtatttttagtagagacagggtttcaccatgttagccagactggtctcaaactcctgacctcaggtgatccgcctgcctcggcttcccaaagtgctgggattacagtcgtgagccaccgcgcctggccccagaaacagaaattctgatacatggcactaagtagacacacagaaaggcttggttcttataaggcaactgtcccatacagtggggttgagaatgtccttttcctcacagagcgcataaaaggcagcagtgaatccagtttgctcttgcactttttacatgttccctgtgcagggcccaaaacacaaaacacacttcccttcagctccctgagtaggtgacctccagcaagttgctcactgtagtcagtttagctgcagccactaaaacggagtgtgttgtgttccttcagtggtgtctgatcaaaggctaaaagaggtgaggaccgaggagctggtttcttgtcccaagttgttctgggatgcaccgtttcttttttttttcttttttcttttttttgagacagagtctcgctgtgttgtccaggctggagtgcagtggtgcaatctcggcttactgcaacctccgcctcccgagttcaagtgattctcttgcctcatgctcccgagaagctgggattacaggcgcccgccactacgtccagctaatttttgaacttttagtagagacaaggtttcatgatggccaggctggtctcaaactcctgacctcaggtgatccacctgcctcagcctcccaaagtgctgggattataggcattagccaccgcgcctggcctggaatgcacctttttctatagtgaacagcaataaataaaaatggacaccaagttgtgtggcatttccctctgtgtcagcactttgtttttctgacctttattaattcattttcagctcatactaacattccaagatgagtaaggcaagtattgtttagggtttctttgtagtaagaaaatagatagaaaacatcagtggcttgtctgaagtgacatgctcatcaggacagaacggggcctaaaccaggttccctgtcacccacaaatattgtcctcctggctgggcacggtggctcatgcctgtaatcccagcactttgggaggccaaggcaggtggatcacgaggtcaagagatcgagaccatcctggtcaacatggtaagaccctgtctctactaaaaatacaaaaattagctgggcgtggtggcacacacctgtagtaccagctactcgggaggctgaggcaggagaattcctggaacccaggaggtggaggttgcagtgaggtgagatcgtgccattgcattccatcatggtgagagagcgagactccatcttaaaaaaaaaaaaaaaaaaattgtcctcccatattctaccacagcccaaggctagttccttcacaagacagtggtcgtggtcccttattctagccactgcacctctgcccttaaagcactgactttctggggccctgaaccctctaaatcactcagctccaagcagaagaaaaaaaccgaagtaccagacaaattttgttctgaatgctcaactattacaaggcaagaaaataggggatttatccccttggaaaaagaatttgcaaaatcaaacattaaagaggattctgagatttggcactaaaattgtacccgagaatgcagggccatgcgctgaggacattggctgagtggccaggagttagtgctgctggggacactgggtagtagccttgttttcctccgatgcagtcatagaaatcacatcagactgtgatgatttgcagggtttatgaaccttctttgatttttgctttttaagaattgagctatttctgaccttattgaatgaccttttgagaactaatgttacgtgaacctgaccctctttttctttaaccaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaaggtgtgtatactataccgagagtgctgagcactggtatcacggacccattagaaccagtcccacgtgactaagagcagccacgtgagtgaagagagtcatttatagcttactcattagtatcaacaaaatgtaaatagttccagacaccaagtggtgaatgcacccatatttgaaaccaaaaagagcaattttaaattcatacatctttttagatggataaagcagtcagccctcagaaacgtaactgaatgtaaagaaaagaagatccccacacccactcagtcccccaacctacaaccttctctgacccacaaacagctctatctggtcttgcccctttctcttctctatccagaagtgtatgtgacaaatagttgagtgtctctctccatgtgatggcatttgtagcttatactccttttctccctttaacattatctttctaagtgttttttttggttttttttttgtttgttttttttcatttgttttttgtttttttgagacggagtctcgctctgcagcccaggctggagtgcagtggcgtgatctcagctccctgcaacctctgcctcccaggttcaagctgttctcctgcctcagcctcctgagtagctgagattacaagggcccgccacaacacctggctaacattttatatttttggtagagacggggtttcaccatgttggccaggctggtcttgaactcctgacctcatgtgatctgcctgccttgacctcccaaagtactgggattacaggcatgagccactgcgcccggtctaagattttttacattatagaactaacatgtttgttgttaacaactgaaaaaaagcaaagaagaataaagaaattgttaacaacttctctcctttctcaattatccttttccccagaggtaactaaaactggcagtttagaatggccccttccaccctcttcttgctcttacaaaaatagtcaagcatttattcagtcattgaattaaaaaaaacctttgagtacctgccatgtgtcagatactattctaggcatacataatataagataggctgaagtcccctcatcaaacacatatctcagtgtgaagagaaagacgataaacaatgtacatacttttttttttaaagaaggagtcttgctctgttgcccaggctggagtgcagtggcacgatcttggctcactgcaacctccacctactgggttcaagtgattctcctgtctcagcctcccgagtagctgggactacgggcatgccccaccacgctgggctaatttttgtatttttagtagagacggggtttcaccttgttggccaagctggtattgaactcctgacctcaggtgatttgcccgcctcggcctcccaaagtgctgagattacaggtgtgagctaccacgcccagcctgtacgtacattttttttttttttttgagacggagtcttgctctgttgccaggctggagtgcagtggtgcgatctcagctcactgcaacctctgcctcttgggttcaagcaattctcctgcctcagcctcccaagtagctgggactacaggtgcacgccaccacacccagctaatttttgtttttttagtagagagggggtttcaccatgttggctaggatggtctcgatctcttgaccttgtgatccgcccgcctcagcttcccaaagtgctgggattacagtagtgagccaccacgcccggccgtacgtatattttttaaagaaagaatcacactgcatactgtattctgcaactgaatttttcccctaaaaattttatcatgaacatcaccgcaagttagtaaagatagacctaactcattctttttagtacatacatattattctgtagtatacatgtaccataacagttatggagcaactaaatcttatccaattgatagacatccagattggttccaggattctgcatttaaaaacaatgctataactagcattcctatatataaggaactcatacgactcaacagcaaaaaaaaaaaaaccaagtaatccaatttaaaaaataggcaaaggacctgaatagacattttcccaaagacatacaaatggccaacaggtatacgaaaagatgctcaacgtcactaattatcagggaaatgcaatgcacagccacaatgagatagataccctctctcaccggttagaatggctgttatcaaaaagacaaaacctaagtgttgaccagggagtgtagaaaagggaacgcttgtactctgttgataggaatatggattagtacagccattatagaaaacggtatagaagttcctcaaaacattaaaaatagaagtaccatatgatccagcaatcccactactgggtatatatccaaaggaaatgaaatcagtatcttgaagagatatttgcattcccatgctcagtgtggcattattcacaatagtcaagatatggtaacaaaccaagtgtctatcaagacagaaaaagaaagtgtgactgatatacgtgtgtggatttatatattatatatatatagatatatcacattatatctatctatctatctatctatctatctatctatctatctatctatctagtaattccttgatatttgtagggaattggttccaggagccctctcagataccgaaatccctggatgctcaagtcacttatataaaatagcatggtatttgcataaaacctatgcacatccttccatatactttaagtcatctctaaattacttataataccgaatgcactataaacactatgtcaatagttgttatactgtattgtttagggaataatgacaagaagaagtctgtacatgttaagtacaggcacaaccatctgttttaaaaaaaataaatttggccaagcgcagtggctcacgcttgtagtcccagcactttgggaggccgaggcaggaggatcatttgagcccaggagttcgtgactagctgggcaacatggtgaaaccccatctctacataaaatacaaaaattagctggacgtgatggcgcacacctgtaatcccagctactctggaggctgaggcaggagaatcacttgagcctggaaggtcaaggctgcagtgggccaagactgcaccactgcactccaggttgggcaataaagtgagaccctgtctcaaaaaaaaaaaaaatccactgaagggaaacccatgcatacagagggctgattgtacatgcacaatggaatattattccaacataaaaaagaaatcctgacattatgacaacatggataaacctggagggcattttgctaagtgaaataagtcagacaaatactgtatgacatcacttatatgtggaatctaaaaaagctgaactcatagaaacagagagtagtatggtggttgccaggggctgagaggtggaggatatctggagatacaggtatatcaaatcatcacattgtataccttaaatatgtacaattttatttgccagttataaatatgttatagttttatgtcaataaagctggaaaaaatcctctgtgtgtgtgtgtgtgtgtgtgtgtgtgtgtgtggacatatatccataagttttagtggcttttttaatgtaagattttacaatgtggaatttatggaatttatatgtttaaaattttaatagctacttcagaagggttataacattggacaatctgaaaaacaacataccatatttatttataatttcattataatttttggatctgtacctttgtttagaaaatttctctttctctgtctctgcctctctctgcgcacacacacacacacacacacaaattctcaaatttaacagctacgttgagatgtaatttacataccacaaagtttacccatttacaattcaatgacagtacgtttagagttgtgcaactatcaccattatctaacttttgaacatttttgccatcctaaaaagaaaactcatacccactgagcagtcatttctcagtcacctcctcccatcacagccctaggcaaccactaatctattttctgtctctatggatttgcctattctcggcatttcatataaatgagatcacacaatatgtggtcttttgtggctggcctctttcactcagcacaatgtttttgaggtcattcatgttgtattctatatcagtacttcattccttcttatgggtgaataatattccattgtatggatagaccacattttgtttgtccattcatgagttgatagatatttagggtgtttccactagttggctattataaacaatggtgttatgaacattcatgggcaagtttttgtgtgtacatgtttcatttctcttgagtaaatacttggtaatggaattgctgggttatatggtaactctgtgtttaacattttgagaaacttgcaaacttttttcccaagaagctaaccagtttaccatttccaccatcagtgtgtgaggattccaggttttctacatcattgccaactcttgttatgatctctttttatttatttatttttttgagacagagtttcactcttgttgccccaggctggagtgcagtggcacagtcttggctcactgcaacctccacctcctgggttaaagtgattctcctgcctcagcctcccgagtagctgggactacaggcatgcgccaccatgcccagctaatttgtgtatgtttagtagagatgaggtttctccatgttggccaggctggtctcaaactcctgacctcaggtgatttgcccgcctcggcctcccaaagtgctgggattacaggtgtgagccaccgcgcccagcttgatctctcttttttcttattgttctcttagtggtgtgaggtagaatctcattgtagtgttgcgttgtatttccctaatgattaatgatgttgagcgtctttccatgtgcttattggacatttgtacatcttctttagaaatattatatttcaggtacattttccatttttaattgtcactctttatttttgcattgcaagagttctttattctatatacacatcacttattcagtatatatatatatatatatatatatatattttttttttttttttttttgagacagggtctcactttgttgcccaggcaaaggcgatcatggctcactgcagccttggcctgcggggctcaattgatcctcctgcctcagcctctgaagtagctggggctacaggcacaagccagcacacttggctaatttttgtatttttgatgaaacgggatttcaccatgttgcccaggctgatcttgaactcctgggctcaagagatccacctgcttcagcttcccaaagtgctgggattacaggcgtgagccaccacgactggccacttgttcagtatttgatttgcaaacattctctctcattctgtgggatctcttatccctttctctgtggtattatttgtagtgcaaacatttttcattttgatgaaatccaatttatgtgcttttttggtggtgttgtatctaagaaggcattgcctaactcagagtcataaggattcattcctatgttctcttctaagagttttataggtttagctcctacacttaggtttctgatccattttgagttaatttttgtgtatggtgtgaaggaagggttcagctttattcttttacatgtggatatccagttgtcccagaaccatgactcaaagactgttctttccttcttggcactcttgtcaaaaatcagttgaccataatataagggtttgtttctggcctttaaattgtattctatttgtctatgtctatgtctatcctaatgctaggaccacactgtcctaattattgtaactttacaaacttactacagttttaaaactggtaaatgtgagttgaacgttgcacttctttttaaagattgttttggctattttgggtcccttgcattttcatgtaaatttcagaatcagcttgtcaatttgcaaaaataccagctgagaatttgatagggattatgttgagtctgtagatcaatttgaaggctgttaccatcttaacaatattaagttgtccaatccatgaacatgaaattttgttctatttaaatcttctttaatttcctccaataatattttgaacttttcagtgtacaagtctaggacttattttgctaaatttatttctaaatattttattccttttgctgctatagtaaatggaattgtttttcttttctttccttttctctttttttggagacagggtctcactcagtcacccaggctggagtgcagtgatgtgatcatagctcactgcaccctcaaattcctgggccttacattaaaattagcttgcaccaccacacccggctaattttttcaattttctgtagagacagggtcgcactatgttgcctaggctgggtctcgaactcctgggctcaagtgatcctccagtcttggcttcccaaagtgctgggattacagatgtgagccaccgcacttggcctgttttcttaattatatttttagattcttgatttctagtgtatagaaatacaattgattggccgggcacggtggctcatgcctgtaatcctagcactttgagaggctgaggcgggtggatcacgaggtcaggagatcaagaccagcctggccaatatggtgaaaccctgtctctactaaaaatacaaaaattagctgggtgtgatggcacacgcctgtagtcccagctactcaggaggctgaggcagaagaatggcttgaacccgggaggcggaggttgcagtgagccaacatcacgccactgcactccagcctgggccacggagcaagactccgtctcaaaaaaaaaaaaaaaaaaaacaattgatttttggatattgatcttgtacaatcttgattaacttgttagttttaatctttttctagtagagtcattgagattttttataacctagatcatatctgttaatggagacagttttacttcttttccaatctggatcccttgtatttatttttcttgtataatcatcctggctaaaacctccagtacagtgttgaataaaactggtgagggcagatatacctgtcttatttctgatcttaagggaatgcattcactctttgataattaagtatgatgttagctgtgtatttttatagatgcctctcgtcaagtggaagaagtttctttctatgcctagtttgggtagtgtttttatcatgaaagagtgttgaatttcatcagataaattttttctgcatgcattgagatgatcatgtgatttttgtgattttttaaaatttcaacttttattttcgattcaaggagtacatgtgcagatttgttacatgggtatattgtgtgatgctggggtttgatgtatgagtgatttcatcacccaggtagtgagcataatacccgatacttagttgttcagcccttgccctcctttctgcctccccatctagtagttcccagtgtctatttttcccatctttatgtccatgtgtacccaatggtgagctcccacttaaaagtgagaacatatggcatttggttttctgttcctatgttgattcacttaggataatggcttccagctgcatccatgttgctgcaaaagaaatgattttggtttttttatggttgtatactatttcatggtgtatatgtattgcattttcattatccaatccaccattgatggacacctaggttgattccgtgtttttgctattaggaatagttctatgatgaacatacaactgcatgtgtttttggtacaatgatttattttcctttgggtatatacctagtaatgggattgctgggtccaaatgggagttccatttttagctctttgagaaatctccaaagtgctttctacagtgactgaactagtttgcatttacaccagcggtgtataagcattcccttttctctgcagccttgccaatatttattattttttgacttctgaataatagtcattctgactggtgtgagatggtatctcattgtggttttgatttgcattgctctgaggttcagtgatgttgagcattttttcatgttggttggccgcttataggtcttgttttgagaagtgtttgttcatatcctttgcccgctttttaatggggctatttgttttttgcttgttgaatagtttaagttccttataaattctggatattagacctttgttgcatacatagtttgtgaagatttcctcccaatctttaggttgcctgcttactctgttgatattttcttttgctgtgcagaagttctttagtttaattagttctcatttgtcaatgtttgtttttgttacaattgcttttgaggacttagtcataaattatttgctaaggctgatgtccagaagggtatgtcctaggttttcttctaggatttttacagtttgaggtcttacatttattaataagtctaatccatcttgagttaatttttgcatatggtgataggtagaggtccagtttcattcttctgcgtatgaatagccagttatccccgtgtcatttattgaatagggagtcctttccccattgtttatttgtcctgtgttaatatggtatattacattggttgatttcagctattagacaaagcttgcattcctagaataaatcccacttacccatggtgtataatcctttttatatgtttctggatgccatttgctagtattttgttgaggatattgtatctatattcataagagatactggtctgtagttttcttgtgatctttatctggtttttgtatcaaggtaatactagcttctaagtgggcagtattcccacctcttctttttggaagagtttgtgagtgattggcattaattcttccttaaatgtttcatagaattcaccagtgaagccatctggctctgggcttgtctttgcgaatcatttgattacttagtctttttacttgttacaggcatgttcagttttttaatttcttcctagtcagttttgatcgtttgtgtcattctagcaatttgtccttttcatctatgttatctaatttgttggtctacagttgttcttagtatttctttataatctttcttacttttgtaaggtcagtagtgatgtcccctctcactcttgattttagaaatttgagtcttttttcttttttttcttggacattctaaaagtttgacaatttagtttcaaagaaccaatttttagttttgttgatttttctttattatctttccattctctatttcatttcttactgctctattctttattatttccttttatctgcttatgttgggttcagtttactcttttttccaattttttattttatttatttattttttttttttttgagatggagttttgctcttgttgcccaggctggagtgcaatggcgtgatctcggttcactgcaacctctgcctcccaggttcaagtgattctcctgcctcagcctcccaagtagctgggattacaggcatgagccaccacatccagcctttttccaatcttttaaagtggaagattatgttactgatttgagatcttttttctttttttaatataggcatctatagctataaatttttatctaagcactacttcatatgttttggtatgttgtattttcattttcactcatcttaaaagtattttctgacttctcctgtgatttcttctttgacctattggttaagattttgttgtttaattttctcatatttgtgacttgcccaaatttcttctgttgttaatttttaatttatttattttcccaaattactttattaatttatttctttcaataaatcctaaattttcttcaaagtaaagatactttgatcttaatccttttaaatctattaaggcttatattatggcctagcatcgagtctattgtggagaatgttccacatgtactatagaagaatgtaattctcttgttgttgggtggagtgttttatacatatctgtgaggtctagttggtttgagtgctgttcaagacttctctttccatgttgattttccacctagttgtttcatccattactgaaagtcgactattgaagtctcaatattattgttgaattgtctatgtctcccttcagttctgtccgtttttgcttcatgtagttttgagctctgttgttaggttctcatgtgtttataattgcttcatcttcttgatggactgttttatcattataaaatacccctctttgtctctggtaacaatttttgtcttaaagtccattttgtctgctattggtatgccactctagctctcaggcttgccgtttgcatggaatttcctttttgtctttttccttttaaactctttgtatttttgagactaaagtgtgtctcctattaacaacatatagttagatcttgttttgttgcttttatccagtttcacaatctctgccttttgattatttaatccattctcatatgatgttattattgatatgcctggatttacatctatcattttgccatgtgtgtgtgtgtgtgtgtgtgtgtgtgtgtgtgtgtacatgcacaaaaaatacaaagaggaacaaaacagtaattatatgtatgtgtgtgactgttttgttcctctgttcctcctttatttgaaaatttatttttgtaaatggtctgaggtagaggttgaagtctaggttgttagctaactatcctagcactctttttaaaaattgtcctcttctactgaattgcaatacctctgtattatatatattattcccatacatagtttgatatatttatgaatttttttttttgagacagagtctggctctattgcccaggctggagtgcaatggtgcaatctcagctcactgcaacctccgcctcctgggttcaagcaattctcctgcctcagcctcccaagtagctgggactacaggcacgtgccaccatgcccagctaatttttgtatttttagtagagacggggtttcacaattttggccaggatggtttcgatctcttgactttgtcatccacccgcctcggcctcccaaagtgttgggattacaggtgtgagccaccacacccggcctttgtttatgaaatttctattatgttctactcatgtatcagtcttctcttgtgtcaacatctgttgttttatctcagtgatttaatgataaatttcaatatctggtatagtaagttcctctttattttccttcttttcaaatgattgttcatgtgagttttgacattcaaaagaaaatactatttgtaatccttttaaaacttcatgaaatgcatgtgtgcatgcacacacacatacacatacatatacatatgcatatatttaccatctagtagcgatatgtgagaatctgggcaattcatttaaagtaaaaattcataaatagtaatattgcacattaaaatgaaacacaacaggatgatttatgttacttttacctaattattgttttctttgcagagtggatactatggaaaacagcgccatcaagatattaagagagagagtgatttcacgaaaaagtgaccttactcgtgctttccaacttcaagaccacagaaaatcaggtaacaaatttgcataacatttaccatttcttaacacaccaagttacatacagatcacttttcattttccttgcttccttaggatttcagttctccatttttactaagaaggaagaatagagataaaaataaaatataatccattatttgctcaaaaaaggcatatttctcccttttagcaagctattttcaacttggaaaactaacaacaaccctgaattaaacttttttttttttttttttgagacagagtcttgttctgttgcccaggctggagtgcagtggcgtgacctcagctcactatgacctccacctcctgggtttaagcaattctcctgcctcagcctcctaagtagctaggattataggcatacaccaccacgcccagctaatttttgtatttttagtagagatgggatttcaccatgttgttcaggctggtcttaaactcctgacctcatgatccgtccgccttggccttccaaagtgctgggattacaggcgtgagccacccggccctaaacctctattctgatagtatgctagactagatgttctggagggccttcttattaacaaacagctagattttggaggatgtagaatgttaatgcatttaccagcctcacagtaacgtgaatcttccagctgcatcttcactttccgtgaaagatgatttgaaaccacatgtgagagcatggagcaacaagaaagcacaaaagactagattttcctggggcccaatgctgatattggtatagcaatcaattctgagactaaattataatatagtaggaagatggaaaagctgaatttgagacttccatcatcatgcttggaccctcaaagtggctaaagttgtcctaagtctgtaatgctccctgactcctggcaagcaaatgcaaatttatctttgagggaagcatccctaattttggccactcacgtatccagagattaagatcaactcacatgagatcacaatcaaaaattaccaaacaaacaaggatacaaactaccatgagtgagagtcagcagaaacaacaattatttccccgaggacatcaaatattggaattagcaaataaatatgttcaaaggaaatatggaaccagaaacatgcatttgggaatgatttgaagaaaaaccaaagagatagaaaatatgcttgttaaaaaaagtaaaagcataatgaatgggttaaacggaagattagacgctactcaagaaagaattagtttaggagttataaacaggccaggcgcagtggctcatgcctgtaatcccagcaccttgggagattgaggcgggcagatcacatgaggtcaggagtttgaaaccagcctggccaacatggtgaaaccccacctctactaaaaatacaaaaaaaaacaaaaaattagccagccatggtggcaggcacctgtaatcccagttacttgggaggctgagacaggagaattgcttgaacccaggaggcagaggttgcagtgacccgagaccgcaccattgcactccagcctgggtgacaagagtgaaactctgtctcaaacaaacaaaaaaagagttatgaacaataaaatgagaagttgaacatacacctactcagagtactgggaggagagaatagaatgtaagagaccatatatttgacatggtaatggctaagacatttccagaattgataaaagactcaaattcataaagaggaacagtgattctcaagtagaataaatgaagttaaatccagacctacacacatttgttgtgaaactccagagcaccagtagcaaagaaaaaatctttaaaaagcaggcagagaggaaacacatattgctacaaagagataacgattagactgatagatttctcaacagttgcaaaattagaccatagaatcatatacaccaaacattggaaattaaatttagaaaaacatataccatgaaaacactaacaaaaacaaagctaagacagctttattagtatcaggcaaagtagactctaaggaagtatatattactagaaataaaaaaggacatttcataatgataaaatattaattatgccaattgaatccattctaaatgtgtatgtacttattcatatagcttcaaaactattcaaaacaaaaattgacagaataaaaagtagaagtagaaaaatctaccacgatagagggaggttttaatactcctctctcaggaactaaaagaacaaacagataaaagattagcagactctttttttttttttttgagatggagtcttgctctgtcgcccaggctggagtgcagtagcatgatctcggctcactgcaacctccgcctcccgggttcaagcaattctcctgcctcagcctcccgagtagctgggactacaggcgtgtgccaccacgcccagctaattttttgtatttttagtagaggtggggtttcactgtgttagccagaatggtgttggtctcctgacctcgtgatccacccgccttggcctcccaaagtgctgggattacaagcgtgagccaccgcgcctggccagcaaacttttttcttaaaagactacatagaactctgtacccaaatttcagaatgcatattcttatcaagcacaaatggaccatttacaaaaagtgaccacacactggaacataaagtgaatctcaataggttttgaagaattggaaacattacagaataaagtctctgacatatacaactccgtaacataagatagtaataaaatcaccctttggcttggaaatgagaaatatacttagaaataatccttggctccggccagacgtggtggctcatgcctgtaatcccagcattttgggaggccgaggagggtggatcacgaggtcaggagatggagaccatcctggctaacacagtgaaaccccgtctctactaaaaatacaaaaaattagccaggcgtggtggcgggcgcctgtagtcccagctactcgggaggctgaggcaggagaatggcatgaacccaggaggcgcagcttgcagtgagccgagattgcgccactgcactccagactgggagagagagcgagactctgtctcaaaaaaaaaaaaaaaaaagaaataatccttggctcaaagagaatcacaatggaaattagattgctgaaactgaatgacaatgaaaatacaatgtattagaatttatgggatgcaaattagagaggcattgatgataaccttaaatgtaaaagatatgattaacaaagtaaaaaaaaaaatttgtttttgttttgttttgttttgagatggagtctccctcagtcacccaggctggagtgcagtggcacgatcttggctcattgcaacctccgcctaccaggttaaagcaattcttctgcttcagcctccccaagtagctgggactacaggcatatgccaccacgcccagctaattatttttgtatttttagtggagacaaggtttcatcatgttagccaggctggtctgcaactcttggccttaggtgatccacctgccttggccccccaaagtgctgtgattacaggcatgagccactgtgcccggccaaaaaatggttctttgagggaactgttgaagttgacgaaaccatggcgagagagagagagagagagagagagagagagagagagagagagagaaaacaaataaccagtgcaagtgtagggaggagctgctgtctaaggctgagagagaggacccaaggaaggaaaaacttggaagggaccccctactcccaatcaagagatgagatcaagccctcattggtgaggatgtggctatggtccactggatagggcagaagttcactgaggtgcctcaagttacagttgggtctccggctggtgggccaggactggagaggatggagccacccactgaggtgccagcaagactctctttgggctgtgcaccaccgcgtctcccacacactaatggtgaggaagccatgggctgtggtgtcagtgaaatttactagaaggtgggtgccactacattttccacacatgctaaccgtgcggtgctgtagaaacaagaagcaaggcacaccagaaccagaaagaaaagctttttcttttgctgttctttgcagtgttcttcctgcactgtctactaacagagactaacgttatacgagctgccaaagaggaaatgattacagggtccagctctagtatcacaaaatgtgcaaaaaaaaaaaaaagactagttttggagctaagtaggaataaattgatagctggggtagccagcaattagcttttagataacaaaaatcttaaaagataccattcacaatagataatcaagtactgtgggagaaacctaatgaatgaggtatgagatttctttttttttttttgagacggagtcttgctctgtcgcccaggctggagtgcagtggcacgatcttggttcactgcaagctctgcctcctgggtccatgccattctcctgcctcagcctcccaagtagctgggactacaggcgcccgccaccatgcctggctaattttttgtatttttagtagagacgggggaggtatgagatttctaagatattattaagataaaggggactgaaataaatgggtgggtattactgtgttcaaggactataagggttgaagttgtcaagatacaaattcctcccaaattgagctatagtttcaatgcaatctcagtcaaaatcccaaggtggggatttttcagtagatcttgagaatctgtatctaaaagtcatgtggaattacaaaaggccccaaatagccaagatgttcctgaagaaaaagaacaaggtgggaagactttccctattatatatcaagatctattataaaagtacagtaattagaatggtatgcaattggcacaagaatacccatatagacaatggaagcaagtagagaatcctgaaacagattcatgcatatatagacacttgaaggtcccactgctgagcagtgggcaaaggagtcttttcaataaacgatgctgggccaaatggatatccctataaaaatagaaacagcctatatgtaataaagatatttgtgttttgaaaaattacatatattaggaggaaaagaatattagttgtgaaatgacaggtgaataatacatcttttattctttgtattcttttgtgtttttcaaatcttctataataagcaaacctaggccgcgcatggtggctcacacctgtaatcccagcactttgggaggctgaggtgggcagatgacttgaggtcaggagttcaagaccagcctggccaacatggtgaaactctatctctactaaaagtacaaaaaaattagccgggtatggtggcgtacacctgtaatcccagatacttgggaggctgaggcaggagaatcacttgaacccaggaggcggaggttgcagtgagctcagatggcaccactgcactccagcctgggtgaaaagagccagactccttctcaaaaaaaaaaataaataaataaataagtaagcataccttactttgttaatcaaaaaaaaggaaaaaaaaaatctaacacgtgaagtctgatttcttacaggtgacaggaaggacacgatctgtggaacactgaagatatccttgagttagttctccttcagggctgcagggcctgggaggataaattatgagggagagcagctggccccatgctgccctggctctcccaaggaggttgcattctttaaaatcatattttaacaaatcatttgggctttgttattgttgttgttaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggcaagtgaaacatagccccagctaaaacctagccagggtgaaacataacttagtcctttgaaaagctgggagtggccgggcacagtggctcacgcctgtaatcccagcactttcggaggccaaggcgggcagatcccgaggtcaggagttcgagaccagcctgaccaacatggtgaagccccgtctctaccaaaaatacaaaaatcagccgggtgtggtcgtgcccacctgtaatcccagctactcaagaggctgaggcaggagaattgcttgaacccaggaggcggaggttgcagcgagccaggatcgcaccattgcactccagcctgggtgacagagcgagactccatctcaaaaaaagagaagctgggagtgggataatctaatagatggagtggcagtcttaggaaaagccgaaggggaatctcccaggtacactgtggtctgttcagcaaatttgtgtgttcccaggataagcaaaaagaaaaaagaaaaagcttccacaagcaagtccacatcaaatactggatttttttttgtaagtgctgtctagcagaaggggagatatgacatccatgctttttgtttgttttttgaggtggagtctcgctctgttgcccaggctggagtgcagtggtgcagtctcggctcactgcaacctctgcctgccacgctcaagtgactctcctgtctcagcttcccaagtagctgagattacaggcgcctgccaccatacccagctaatttttatatttttagtggagatggggtttcaccatgttgaccaggctggtcttgaactcttgacctcaagtgatctgcccacctcggcctcccaaagtgctgggattacaggcatgagcccctgtgcctggcctgacatccatgcttttatacaacataccatttctaatacttaatgtattgcttgttaagcctgagtgtacagacttgctgacatgacccagaatatgtctgaaagagttttgaaatgtagaaatcttttcttagaatgtgaatatcagggagatttatcagatccccatacttattagttaacaattcatcagcagttaaatatgacattgagctgaaaaggagctggttggagctaggacttgggtgatcatttgcagtgaagatgagacgttaagagcagagagaagggaagtaaaggtaggttagagactaaagtatccccaggaaggaggcttttgacgtcacttcagaggcagtttaccatggtgactaagatcacaggccttggcttcaggcagccgagatttaaatcccactcaccagctctgtgacccttgggaaagttcctttatctccctgttttcaaatttgtaaaatggacataataatagttctgttcttgttcattcttgttgtagaggaccgaatgaaataatccacataaagttctctgtaaatggtggctgtgttagttactgctgccttattcattttggccctgtcccctgaggatcacagactgaatgaagagggtggggcctccaagggaagtctggccttctcagatttctgtctaaatcacatcatttcaattgttgatgatgttttctgtttgttacatttgctaaaagcgatcagtgtcatgaattcaatatgttctaacacttagaaaatctttattttaggctcattctactctagttgaaactctgtacagatacagatctgacctggaaatcatatttaatgccattgacactgatcactcaggtaaataaatgaacttggatgagtccatttaaaaagtgtatgtgtgtgtgtatgttggggatacaaaatgagtacactttgattgagccctataattaatatggtttgacaccttcattggtaagatggaggccttgcttatgcatactgttaaatgaaaattgtaggagcccattgttttggactaagctccttcaccaggccccaacagactagactaaaagtcaaaatggggtagcagtagtagaaagcaaaggctaatctggttctctgaaatcagaactctgattttatctattttgttcttcatctaacatgatgaaacttgaggggaaaaagaaactcatttaatattattgttatttcagtttggctgcagactctgtattcaagaccatagagtcctacagaagcctaggtagccatcagtcaaactgaaataactttttataaatcaccagcacaaatgaaaagatgatttactatccatttcagtatcttagttactcatggccataaaaatcattcctagaaatctgattctgttttggggagtaagggctatgaaaagtcattttctgcttttttttttttttttttttttttttttgcgacagagttttgctcttgttgcccaggctggagtgcaatggcgggatctcagctcaccacaacctctgcctcccgggttcaagcaattctcctgcctcagcctcctgagtagctgggattacaggcatgcgccaccacaccctgataatttttatttttagtagagatggggttctccatgttggtcaggctggtctcgaactcccgacctcagatgacctgcccacctcagcctcccaaagtgctgggattacaggcgtgagccactgcgcccggccttctgcctttagctttgatgcacaattacttattttcaaatttttaaaaactcatcagataatcccctaatgcagagacctttgaacaccgaaaaaaaaaaaaaatcaatgatcaacacattaaagtaaatgattgcctgtgaaaaaggcagcaccattgtttgtaatcctcttattgactcccaccgtatcttctccctctgctttgatgtcatcctcctctctgccctccttccatgcacctcacctttctattttaggtcttgtaatttctataccacatttagtcccatagtccacaaccccgtccccatttcttcactgtttgctcattctggctttagaataagttcaggatcccttggtagttgaaagtgagatattgtttcttacatttatgatcttactcttccatatccttcagtatcttcatgattaggcagtttagtgagtttctaactggggctatttaatcagtgtgggttccccaacccttgccttaggtgggtcttaaaatgaacactcacaaccttctcctatattcttttaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaa
